United States Patent 7,833,706 (GENETIC POLYMORPHISMS ASSOCIATED WITH RHEUMATOID ARTHRITIS, METHODS OF DETECTION AND USES THEREOF) - sequence listing, part 13

SEQ ID NO: 33779 - DNA, 201 bp, Homo sapiens
tgctggtccttctctctaacatggctaactctaccccactttaagactcagctttatcagcccttgctatgagaagcctttgttgatcaccccaggaggakaaaggtgtccccttttgtgctctccatcaagagcatcacagaactaatgcatcatcttaatactattaatgtgtctgatgtgtcggagaggccccaaagg

SEQ ID NO: 33780 - DNA, 201 bp, Homo sapiens
tgcctggactaactatctcacatctccctgtcacacccaactcccaattctctccaccatgctggtccttctctctaacatggctaactctaccccacttyaagactcagctttatcagcccttgctatgagaagcctttgttgatcaccccaggaggagaaaggtgtccccttttgtgctctccatcaagagcatcacag

SEQ ID NO: 33781 - DNA, 201 bp, Homo sapiens
aaatataaaaaagaaaagccatctatatgcagatgtctgggcagtataaaaggtctgagagatgtgcttaatactatgattattaaagaagttaatgtctrtgagagcacccagcacatagtaggcactaaataaatgtttgctggatttgaatctaaagcatgcttgatcagacctacatagaggcaattccttgaaaag

SEQ ID NO: 33782 - DNA, 201 bp, Homo sapiens
gtccccggagtgtgatgttccccttcctgtgtccatgtgttctcattgttcagttcccacctatgagtgagaacatgtggtgtttggttttttgtccttgyaatagtttgctgagaatgatggtttccagtttcatccatgtccctacaaaggacatgaactcttcattttttatggctgcatagtattccatggtgtata

SEQ ID NO: 33783 - DNA, 201 bp, Homo sapiens
tgtgtctttatagcagcatgatttataatcctttgggtatatacccagtaatgggatggctgggtcaaatggtatttctagttctagatccctgaggaatygccacactgacttccacaatggttgaactagtttacagtcccaccaacagtgtaaaagtgttcctatttctccacatcctctctagcacctgttttttcc

SEQ ID NO: 33784 - DNA, 201 bp, Homo sapiens
ctaaaaacaatttaaaaacttagctggtcatggtggtgcacacctgtagtcctggctgcttgggaggctgaagtgggaagatcccttgagcccaggagttytaaggtggcagtgagctatgatcacaacactgcactctagcctggggaacagaccaagacattgtctcttaaaaaaaaaaaaaagtaggtaaagattgaa

SEQ ID NO: 33785 - DNA, 201 bp, Homo sapiens
ttttttcccagtggaggagctggatgttgttcctaaaagaaaagggcagagggaccctgggcaggcaaaattttcagctgcctgccaccttagcccctgtscccacactcacttctgaaccacatgtgatcagtcttctcttcccaccacataactgaaacttcaaggtcatgggtgagctctatgttgttaagtcttatt

SEQ ID NO: 33786 - DNA, 201 bp, Homo sapiens
aggagctggatgttgttcctaaaagaaaagggcagagggaccctgggcaggcaaaattttcagctgcctgccaccttagcccctgtccccacactcacttytgaaccacatgtgatcagtcttctcttcccaccacataactgaaacttcaaggtcatgggtgagctctatgttgttaagtcttatttataggagcgatca

SEQ ID NO: 33787 - DNA, 201 bp, Homo sapiens
ttgaggccagactggccaaaatgttgaaaccccatctctactaaaaatacaaaaattacctgggcatggtggtgtgtgcctgtaatcctggctactcgggrggttgaggcaggagaatcgcttgaacccgggaggcagtggttgcagtgagctgagattgcactactgcactccacctgggcaataagagtgagactccat

SEQ ID NO: 33788 - DNA, 201 bp, Homo sapiens
actctgtaagtcttcagtgcacaaaatttatatgaacctaataataaacactgaataataaatttgtgaagtaaataaaaatattgggaggacaagttgarggggatgccaatggataatgcctaaaactgataaatagaaagcaagatagcctaaacatcatatttagaaaagtgtggcaagtaccaaaaagaaataact

SEQ ID NO: 33789 - DNA, 201 bp, Homo sapiens
tttgggccgagttagcaatatgtaagtagaaaactaagtaattgaggaatatagttaacttcagaggaaaaaacctcagaaaattagacaagaaaacatartatactctgtaagtcttcagtgcacaaaatttatatgaacctaataataaacactgaataataaatttgtgaagtaaataaaaatattgggaggacaagt

SEQ ID NO: 33790 - DNA, 201 bp, Homo sapiens
cctagatgcaaccatactttaaaaaatatattttccatcgtggttggttgagtctacagtgtgtaaccacagacgcagagggccaattgtacttactcttkggaggaaaaatcggagggaagcaggccgaagtggtgacccgtaggaattgttgttttctgtactattaggcgctttaaactatgtaactgtatgtcttta

SEQ ID NO: 33791 - DNA, 201 bp, Homo sapiens
acggtttggctactctaggtaccttgtatcagtggaatcatatagtatttgtccttctgtactaacttatttcacttaggggagttttttttaaaaaggcrtaagtctataaacacaagcataacagaaaacgaggcaacaacagcgtggtttttggcattaggatacaggggtgtgtgtggctaaaataaggaggcctag

SEQ ID NO: 33792 - DNA, 201 bp, Homo sapiens
aggaaatctgtgcttagagtgctgtggcagaagtagaaattgctgtcagccaactgattttctgattcttctgtctataaaagctgtgcccattgttaacwtaggtgataagttgaatttttagtttttttaggttttttgtttgtttgtttgtttttgaggtggagtctcactccgttgcccacgctggagtgcagtggt

SEQ ID NO: 33793 - DNA, 201 bp, Homo sapiens
ctatttcttttctttctctcactcttttatttatttctttctttcttttagacagggtctcgctatgtcacccaggctggagcacagtgtgatcatggctyactgcagcctcaacctcccaggcccaagcaatcctcctaccttagcctcctgtgtagctgggactataggcgtgcagcaccacacttggctaaattttta

SEQ ID NO: 33794 - DNA, 201 bp, Homo sapiens
cctcttttctacctggtgaatgcatccttcaaggcccagttaattcatcatctactttgtcgagtttttctcaccacctgtatcagttgagaattgcattyagctatgatcacaacagaggcttaagcccataacaagcaatctggagccaggcattccagaagtggtgtactctttccatcgtgccctctgggacccagg

SEQ ID NO: 33795 - DNA, 201 bp, Homo sapiens
agcactcatgtttcagcaagaaaaaaaagcccagtagccaaattttaaaagtgggcaaaggacacaatcagttcattgaaatggaaataaaaatagctttraaacatattgaaaaatattcagaacttctcatagtaagagaaatgtgaattaaagttgcaacaagatgccatcttctgtctatcagattgacaaagatta

SEQ ID NO: 33796 - DNA, 201 bp, Homo sapiens
ccttgcaaaactagcagtcaaataaaacagaactctaaaattgaatttaaagtacagttttgtctggctagccatatgtagaaagctgaaactggatcccytccttacaccttatacaaaaattaattcaagatggattaaagacttaaatgttagacctaaaaccataaaaaccctagaagaaaacctaggcaatatctc

SEQ ID NO: 33797 - DNA, 201 bp, Homo sapiens
aagggtttccaaggccactagctggcagaaggataaggtggaaatgtaaatgacatgcccctctcttcatgaaaacaatgtcagttgttcctctcagtccycaccataacagtttctgaaattctttctcacctccttcacttatttatcctttctgctccctgctagactgctaggggtggggacaggagtgatgtctga

SEQ ID NO: 33798 - DNA, 201 bp, Homo sapiens
aagaatcagctggtgatacacatggagtgtttgctccaagaacatttctcatggtgtggaaaatggcagtggtggcctcctggctttcaggctgaaatacrtttagctgatctttgtcggcaaaggtgtccaacaatagcaactgcttatgacaactaattttaggaaacgtgtgtagttaatttgaaatatcgccctggg

SEQ ID NO: 33799 - DNA, 201 bp, Homo sapiens
aggctgagacaggagaatctcttgaacccaggaggcagatgttgcagtgagccaagattgtgccactgcactccagcctgagcgacagagtgagactccakctcaagaaaaaaaagaaaaagaaaaagaaaaaaaaaagtcactgtaagagatgaattagaagaatgtgtcttgaatgcgggcacaatttatttttgttgt

SEQ ID NO: 33800 - DNA, 201 bp, Homo sapiens
acttctgccccagctctaccttggttgataccccaaatgccccttttcctctggcctacctagcctgctttctccccttcttccttggttaactttgcacrtgaccattttgattctctaaagagaatcattcaattaggaaatggaaatctgaggcaatgagagagaggagacatgcatcactatttatttttagaaact

SEQ ID NO: 33801 - DNA, 201 bp, Homo sapiens
actccatgctgtaccatagagagaggagcctgacctttggctttgggatctatgcgaccccagtcagaacatggcacttttgatgtcttcatgacctttgrcgtgctactcttcctctttgcatttctgtttttttcgtctgtaactgggaataatacccatccggcaagtttcgaattagaaattagaggccaggtgtgg

SEQ ID NO: 33802 - DNA, 201 bp, Homo sapiens
gattgaaatacaatttgtgtggcttttaggcaagtgagcatttagcaagtaagaatttcccagattgggtttagagttgtatttgcttatgttccaaactyttttttttttttttttttggtaagataattttgaatatcagtagaacttggggcagatagaatgacagaacatggaatgtgtaatccttttgggatttgt

SEQ ID NO: 33803 - DNA, 201 bp, Homo sapiens
gcttgtccccatcagtaagctttggtgtcacaccagccggatgactttctggtggagggccagcttcctgcacttccgtgacaacagcctgacagccccayggaggcatggctgtagacattaagacatttctgtagacatttgttctagttgttgtccttttttgtctgttatttattatttatttatttatcattattt

SEQ ID NO: 33804 - DNA, 201 bp, Homo sapiens
ggtgacagcgttgaatggcttgtccccatcagtaagctttggtgtcacaccagccggatgactttctggtggagggccagcttcctgcacttccgtgacarcagcctgacagccccacggaggcatggctgtagacattaagacatttctgtagacatttgttctagttgttgtccttttttgtctgttatttattattta

SEQ ID NO: 33805 - DNA, 201 bp, Homo sapiens
tactttcttgggagtttgatgtttcctcttgcttccacagctgtcagaaagggcttgttctgagggtgacctgcaggttgcaaggctgtggaaacatagcrgtgacagcgttgaatggcttgtccccatcagtaagctttggtgtcacaccagccggatgactttctggtggagggccagcttcctgcacttccgtgacaa

SEQ ID NO: 33806 - DNA, 201 bp, Homo sapiens
cattactagttggcctcactttaaaaaatgttgtttcttggatagcatttttctttcacaagttggtttgctttcacatgtcaaaaaacaaaaccagggcygggcgcggtagctcacacctgtaatcccagcactttgggaggcgaaggtgggtggatcatctggggtcaggggtttgacaccagcctggccaacatggtg

SEQ ID NO: 33807 - DNA, 201 bp, Homo sapiens
cagcagcatcactgccttgctccgtgatcttcccatgtttgagtcacctcatccttgatatggaaggggcagtacctgttctctcagtagcataagataavaggtagggaagtgcttgggaaaatgcaataaaagacactgctggaagccttcagcagtaggttgggttacagaggtcttggccttgcaaaatgaagtgag

SEQ ID NO: 33808 - DNA, 201 bp, Homo sapiens
tttgtatttttagtagagacaaaatttcaccacgttggccaggctggtcttaaactcctgacctcaagtgatccacccacgttagcctcccaaactgctgrgattacaggcgtgagccaccacgcttggctcaaatttcctcttctgtaagaacaccagtcatattagactcatccactctaaagacttcattttaattta

SEQ ID NO: 33809 - DNA, 201 bp, Homo sapiens
atgtgaaaactgtgtgcttctcaatatcccaccttttctcctttaaatttggaatcctcaaaatcatctctggagaaaggcatacatctgtctcccaggcrtgttcttaactttggcaaataaatctaaaatgattgagatttgtcttgtcattttcttccattgacagaggctagaagaccaagatccaggtgtttgcag

SEQ ID NO: 33810 - DNA, 201 bp, Homo sapiens
ccaggatacatgtgcaggacctacaggtttgttacataggtaaacgtgtgccatggtgctttgctgcacctatcaacccatcacctacatattaagccctrcatgcattagctagttatcctgatgctctccctccccaccccctccaagaggccccagtgtgtgttgttcccttccctgtgtccatgtatactcattgtt

SEQ ID NO: 33811 - DNA, 201 bp, Homo sapiens
tctactgaccttgtgatccacccgcctcagcctcccaaagtgctgggattacagcaggagtttttactctaaatattaagttaagcttacaagttaagctrcttgtaagctgtctgaaggtctatttccctgactttgcagttccttaattttgaaggcaatctctgcctgtatgtcttcttccttagagacctttgtccc

SEQ ID NO: 33812 - DNA, 201 bp, Homo sapiens
gacacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccat

SEQ ID NO: 33813 - DNA, 201 bp, Homo sapiens
acacatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccatt

SEQ ID NO: 33814 - DNA, 201 bp, Homo sapiens
cacatataaatatatgtgtatatatattatataactggcatatacattattgggatatatattagtaggatgtatatatatatatgtgtgtatacatatatgtgtgtgtgtgtgtgtgtgtgtgtgtgtgtatatatgtaaaatgtatacacacttctatttgacctgtaccagttcattattaccacaataatgctaact

SEQ ID NO: 33815 - DNA, 201 bp, Homo sapiens
acatataaatatatgtgtatatatattatataactggcatatacattattgggatatatattagtaggatgtatatatatatatgtgtgtatacatatatgtgtgtgtgtgtgtgtgtgtgtgtgtgtgtatatatgtaaaatgtatacacacttctatttgacctgtaccagttcattattaccacaataatgctaacta

SEQ ID NO: 33816 - DNA, 201 bp, Homo sapiens
actgcacaccctaaatatctgctaaagtactctgtactttgagatttaaatcaaatctgctcaggccaggtgtggtggctcatgcctgtaatcacacctcwaataaataaataaataaataaataaaacctgctcagagcccacctggttggtagtatcatccagtctacacagggaacctctagtccagagctcctctac

SEQ ID NO: 33817 - DNA, 201 bp, Homo sapiens
attttacttgcacttttttaattatgaagagtttgagtatctcttcacaagttcaagggtcatttttacttatttatctgtaaactacgttttttttggtkttttttttttttttttttttttggagacagtctctcactctgtcaccctgctggagtgcagtggcacgatcatggctaactgtagccttgacctcctggg

SEQ ID NO: 33818 - DNA, 201 bp, Homo sapiens
aaagctggtggaggacttgcttaggtcatgttaattagtttttctcagctctcaccaggtgtcattcatggaggttgcataaaagaaactcatacccaggkatgagctttttcttaaatattacctttctgaattttgaaatttagtgtagcattgagacatttaaacacatttttgaagcacaaaacttatttatcctag

SEQ ID NO: 33819 - DNA, 201 bp, Homo sapiens
ttggtggcgttttctgtggttctgagatccaacccccaacttcgtcccttttgacctagtttatcacccatgtccttgggttgaaaatagtagtgtaatcstaagagaaggggcctgaaaggaagggaagagaaatcagatgtcagctggtgaggatgagaaatactgcaacaagggagcagcattgacccttgagagcta

SEQ ID NO: 33820 - DNA, 201 bp, Homo sapiens
ggagaccgtggaaagaggggagaggggagaggggagagggaatcacagaattttcaaactggtttagcatgctggctctgcagccagactgcctgagctcraatgtcagttgacttttctgtaaaatgggataataatagtaccagtttcatagatttgcaggagatgtgagattacatgaattcacttataaaaagtgcg

SEQ ID NO: 33821 - DNA, 201 bp, Homo sapiens
accacgcccagctaatttttgtattttttagtagagacaggttttcaccatgttggccaggctggtcctgaactcctgacctcaggtgatccacctgcctyggtctcccaaagtgctgggattacaggcgtgagccaccccgcctggctgccttttgtttttctagtacgctgatgagaccaaaaagaagatataataaaa

SEQ ID NO: 33822 - DNA, 201 bp, Homo sapiens
tctccctctctccagtctgtttttgctctgttcccaaacaatgctttgatgtgcaaggcactcctaatggaagataagtcatcaattagcccgatggaagrttaagctgaaaacagacttttcagggaagggattatcactgagctgttaatcactgattgacattatctattggggatatattcttatgggagacttact

SEQ ID NO: 33823 - DNA, 201 bp, Homo sapiens
ttttatatatatatacgcactttatcctgtctaatgtagtgctcctattttctttttcatattctttctgttagagccaaattcactactctgactttgcrtaatataaatacagatatccttactcattaagaggctgtgttgttttagaaattagtaagtggctacatctgcataattttgcattggtgagagttggct

SEQ ID NO: 33824 - DNA, 201 bp, Homo sapiens
tgcaagctccctcagctagttaattttgcgtttaagtctatgtgattttcattctaatgtcttttggaattaaatgtaatgttgtaagaaaagaagcgtcygaccaataaagcaaggcagtctaggctgttttatatatatatacgcactttatcctgtctaatgtagtgctcctattttctttttcatattctttctgtt

SEQ ID NO: 33825 - DNA, 201 bp, Homo sapiens
gatcacatcgaaagcctctgaacctctgaaaggcattaaaagttgtcccactgcacctatgagccatccagagaaacgttaaataagttggtccagaaacmcttttgaagtcctccatcctttcaatacttttcttacttctttgcttctgagcgggaggtgcagcatttaaaatcaaagacattaataataaggtctcat

SEQ ID NO: 33826 - DNA, 201 bp, Homo sapiens
actttttgccagaaaagagcatgcagagtgaacttgtgacataatacattccttgaagctcccacgttatagtttcctggtaacatagagttgtttatatkattgctacttaaaacttggttgctttgtagatcctacttgggaattgaattaacttcagtgaacttgatagaagctgcatctttctgtaaagttttgggc

SEQ ID NO: 33827 - DNA, 201 bp, Homo sapiens
aatgggccaagcttaggaattccaagaaggcagactcaagatagagggctgccaaagctcacagatgtggaatgaaaccagtttcaaaacctgattcttcrctcagttggaatgtgttttaaaacctggactcacttgagatgtttgcacctggtaagaatgtttcaaaccttgaattctactttgtgtaattatctgtga

SEQ ID NO: 33828 - DNA, 201 bp, Homo sapiens
cttcctcatggaaacctcccctgacctccctgagtagcccaaactctcctattgtaggcactctcagagcgcttctcatagatgcaattttacgtttgttygtaattctgttttgttttttcacaacaataaattttgagagggcagctctatgcctagtctccaccctgtgtccccgatgcccagcacagtgcctgaagc

SEQ ID NO: 33829 - DNA, 201 bp, Homo sapiens
ccacgtcattccccagcccaatcccttatgctttctttcaatgacacttaaaatttaagacccaaacctacatgatctggccccatctgccttttcagacwcttcttcctcctcgagccccttaccccatcctagccaccgaagccagtgatgccacatcccagcctctttctgcctctgcaggacagttttgtgtgtgct

SEQ ID NO: 33830 - DNA, 201 bp, Homo sapiens
acaacaacaacagcaacaacaacaaaaaccaaccagtgattaattgtaatcttttaggcccattttaaatgcgtcctcctccatgaaatatttcttggttyctctggacggatgttgtttctcttgcctctgaattcccagagaactttgtacctctcttagggaaattatcaatctctgtcttttattatagttagttat

SEQ ID NO: 33831 - DNA, 201 bp, Homo sapiens
aaatgtcagttgacttttctgtaaaatgggataataatagtaccagtttcatagatttgcaggagatgtgagattacatgaattcacttataaaaagtgcrtgatacttaaagccatgttacctttaaacttccaatccattcattcatttattcaacaaaaactacatactgtgatggttgcacaagcctgtgaaaatac

SEQ ID NO: 33832 - DNA, 201 bp, Homo sapiens
gtctgccccatacagaagttcaagctgtgcattgcacaactccaaggagtgtctatcacatagcaagttatataaatggtgccccagagtttgatagtccrcaatatgtacagttgtgtgcattgatcatgaagagagaatccatgttcacttcccaattcagccctcaagaaaaccaacacgaggtcttcgacagcttac

SEQ ID NO: 33833 - DNA, 201 bp, Homo sapiens
cccaaagtccttgcttggacctctcctcctctccactcctcccctcccctcccctccccattgggcactgccagggcccagtacaagtgaaacagatgctyaactcctagacttgtggaggcttaggtagaccagcaagtcactattaggacagaaaaacaagaccacgtcattccccagcccaatcccttatgctttctt

SEQ ID NO: 33834 - DNA, 201 bp, Homo sapiens
ttaacagtgaacaggtgcaaaaccaagatttgaaaccagtttttgatcttggtttgatcttgatgccacatcccagcctctttctacctctgtaggacggytttgtgtctcctctgcattttcagcctccattgctaatctgacaccatctaaagcaggaatatccttattaatggaatagtgcttaatgggattaggctt

SEQ ID NO: 33835 - DNA, 201 bp, Homo sapiens
cttcagccttttctctcctgttagggatcaaaacttgccaaaacagaaattttaaaaagacacgcaggatgtggggctgctcctgggaggtttgctgtgtktgtttggggtcctgcaccctccactccactcctgagtgtccaagggtggatgtccagaaatttagccacctactcccatcagtgtagccagaacctttgc

SEQ ID NO: 33836 - DNA, 201 bp, Homo sapiens
tttccctgaaccagtgaaattgctatcaggaaaaaatgactcaagtttccaggcagctatgaatgaggtgtttttctgggcggtctgagcaactatctttyggaaggatacataagaaggtacaagctgccagcccatccatttccctaagatgaacttgaagcacgttttctttcagcagcccagacagcacaggctttt

SEQ ID NO: 33837 - DNA, 201 bp, Homo sapiens
cttccttctactgacatctggtacttaggataagggaaaaggctttccctgaaccagtgaaattgctatcaggaaaaaatgactcaagtttccaggcagcyatgaatgaggtgtttttctgggcggtctgagcaactatcttttggaaggatacataagaaggtacaagctgccagcccatccatttccctaagatgaact

SEQ ID NO: 33838 - DNA, 201 bp, Homo sapiens
ttggcatttaaaaatgttcacttcttattgcaagacagggacagtctttaaagatttttctgctcaccaccactaccaaaaactaataacaaattttgtcytcatggggaagaaaatcttactcattcttgagatttcacagccatgtctaaagatctaggctatataagaagagaggaatgccttagaaatgtaatgctg

SEQ ID NO: 33839 - DNA, 201 bp, Homo sapiens
catgatacccttttctatgtatggagggtgaggtgtttctccttggtttaccctgaccaatttattattactgttccaaaaaggaaactgcatgattaatrtcagaatcaggtccaaaggcctctggctctggtgatggctaatgtgatttggatctagattctgtttaataacctgccaaaggcacctagctctttctct

SEQ ID NO: 33840 - DNA, 201 bp, Homo sapiens
ttgttcaatcaagtcactgaatcatcagccctgtgatatctacaagcgcatgcatgtgtctgagtgaagtgagctgggcagttccatgatacccttttctrtgtatggagggtgaggtgtttctccttggtttaccctgaccaatttattattactgttccaaaaaggaaactgcatgattaatgtcagaatcaggtccaa

SEQ ID NO: 33841 - DNA, 201 bp, Homo sapiens
ggccaggccgcttcttgtcctcttttggggctgggactggtatgatgttgaagtagcccatctctaagtcttcccctcctccctgccagcttaattgtgcmacattgttcaatcaagtcactgaatcatcagccctgtgatatctacaagcgcatgcatgtgtctgagtgaagtgagctgggcagttccatgatacccttt

SEQ ID NO: 33842 - DNA, 201 bp, Homo sapiens
aatttttagaattaactgaaagagtggcaagttgagcattcaatttgcaagtcatgctatgtttggaattaggagggataaccccttttccttcccaaagrgactgacaagcataccaagagggggtgggatttctggaactctgtgaagttaacaagaagggacttggaaagttagaagaaggagggggagctgcattcc

SEQ ID NO: 33843 - DNA, 201 bp, Homo sapiens
gacaccgcagccttgctttgcacaatcttgctagctttgtgagtttcactggggattggaggggaggcccgccttcaacttgagctgcttgtgttttggtkggtggtaatgccttagaaacagaaaggagccagctccccttcagccactcaggcttctgcctgggtttccttttaaccctggaatttcatgtggaccctc

SEQ ID NO: 33844 - DNA, 201 bp, Homo sapiens
tctgaagaatattctagaactttaaaattaatattaacaaagcattgacgttgttttagtaaagaagcaattcagaataaagttggtatgattgctttactttttttttttttttttttgagacggagtttcgctcttgttgcccaggctggagtgcaatggcacgatctcggctcactgcaacctctgcctcccacgttc

SEQ ID NO: 33845 - DNA, 201 bp, Homo sapiens
cgaggctgtgactttataatttttagaattaactgaaagagtggcaagttgagcattcaatttgcaagtcatgctatgtttggaattaggagggataaccmcttttccttcccaaagggactgacaagcataccaagagggggtgggatttctggaactctgtgaagttaacaagaagggacttggaaagttagaagaagg

SEQ ID NO: 33846 - DNA, 201 bp, Homo sapiens
cttaagtgctttgatccctgtaatataataaaatggcctacacttaaccatcattctggtaccactctctgtgtcagaggttgttgctcttttatttgccrgttttctttctaaaagcagtcatgagcagacaagcttagaaagggtattttcttcgtgttgtttcagggaaaatagagaaagtcaaacctcctccatccc

SEQ ID NO: 33847 - DNA, 201 bp, Homo sapiens
tagaaggatataggtgtcaacatccagaaggatacaggtgtcaacagataagattatgctcataattagaaaatagaattcattgagcatctgcaatatgycaggagctttgtatacattatctcatttgtttgtcacaataatcttatgaaatgaatactattgtatttcccattttacagacagcatagcttaaactca

SEQ ID NO: 33848 - DNA, 201 bp, Homo sapiens
ttacaggtaagaggcaatgaccaggttagcaaccagtcaagaacattcatgagcaaatgctggtctagtctgaagggccatcttgggtacacttgggcacwactggtgctgggctgaacatgccactcaggagtttttactggaacacaggcatgtagaaacacatctagaaggatataggtgtcaacatccagaaggata

SEQ ID NO: 33849 - DNA, 201 bp, Homo sapiens
gttcttaccagattcttgaaaggattctgtgaactcttctcccctaaagcttagaatcactgttctggatggtaccaaaaaccacacagtagaacactttrtacttttgtctcccacctctgataataaatgcagaatttggcatagtcaaaatgttacaaaaggtttgtacagcatcaaaagaccttggattgcaaattt

SEQ ID NO: 33850 - DNA, 201 bp, Homo sapiens
agcactttgggaggctgaggcaggaggattgcttgaactcaggagtttgagaccagcctgggcaacttggccagacatcatctctacttaaagaaaaaaamccgccgggtgcggtggcttacgcctgtaatcccagcactttgggaggctgaggcgggcagatcacgaggtcaggagtttgagactatcctggccaatatg

SEQ ID NO: 33851 - DNA, 201 bp, Homo sapiens
agaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccagg

SEQ ID NO: 33852 - DNA, 201 bp, Homo sapiens
gaatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggt

SEQ ID NO: 33853 - DNA, 201 bp, Homo sapiens
cattgaaaccacagcagccacagataagctatatatatatatatagagagagagagagaactatagagagagggcaaactatgtatatagaataaagtgtrtatatatagtgtaagatacatatatatatatgtcgttttgtgtgtgtgtgtgtgtgtgtgtgtgtgtgtgtgtgtatgtagttctacttccaagaatttc

SEQ ID NO: 33854 - DNA, 201 bp, Homo sapiens
cctgagtctgagtaatttataaagaatagagatttggttcttacatttctggaggctgtctcatcccatagaagaaggtcagagggcaaaagagcatacarcctgtgagagacaagagagagccagtcttactttgataatgaatccattcctgggttgaccattcgtgaggtcagagccctcatgaccttatcgcctctt

SEQ ID NO: 33855 - DNA, 201 bp, Homo sapiens
ccccaagtgctgggattacagacacgagccactgtaccctgccaataatccacatctctatgaaataaaaaccatggactccacttcagcttttcatcacmcctttagcactgagtttccccattcctattctccagggttaaccactgtctttgtctaatttctgctgctgaaagagtatacctgagtctgagtaattta

SEQ ID NO: 33856 - DNA, 201 bp, Homo sapiens
gagcctgggaggcagaggttgcagtgagccgagatggagccactgcactccagcctggtgacagagcaagaactctgtctcaaaaaaaaaaaaaaaaaaargaaaaaaagaaagaaagaaagaaaaagaaaaaaagagacatgtaacgggaatttgttcccatcttggtgacagtttcagagtgccccgcataggccgtgc

SEQ ID NO: 33857 - DNA, 201 bp, Homo sapiens
attttgccagcccaatgcatacaagagagtgcagtttgtgtgtgtgtgtgtgtgtcaatgtaaagacaaatatttctttaaataataatgtatttgtattwttttttgcagtggaattggaaattttctcacagtcctatccagatgtgcaaagaagtggtagtttatttctataagtgacctaatcatccactgtgtaca

SEQ ID NO: 33858 - DNA, 201 bp, Homo sapiens
tctcatttaaagatttagaaagataaagtaaaagggtggggatcagattctgcccttcctctattctttcctacaatttgagtctcatgttggctcttttsttcatttgtttttaattgactcatgatagttgtacctatttgtggggtataatgtgagatagtgcagctttcatttgcctttctcttattatgagtatgt

SEQ ID NO: 33859 - DNA, 201 bp, Homo sapiens
aatcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtg

SEQ ID NO: 33860 - DNA, 201 bp, Homo sapiens
cctgggcctggtggagggcgcttgtaatcccagctacttgggaggctgaggcaggagaattgcttgaacgtgggaggcagaggttgcagtgagccgcgatygtgccactgaactccagcctggcaacaagagcaaaactcggtctcaaaaaaaaaaaaaaaaaaaaaaaaattattgtcctagaaaacactaataacgttg

SEQ ID NO: 33861 - DNA, 201 bp, Homo sapiens
gttggtatagttttcccttctcttcttttggggtgtgaatctttttgttcttgatgtatggagtcatttatgcattatagaacccagatttttggaacccyattcccagcctcttacacttagatgtgatgtatcctcatttcttcattgcacatttcttcatttcatagaatggtagaatgttttgtaagtgtacatgta

SEQ ID NO: 33862 - DNA, 201 bp, Homo sapiens
atcgcttgaccccaggaggaggcggctgcagtgagctgagattgtgccactgcactccagcctgggtgacagagtgagattctgtctcaaaataaataaataaataaataaataaataaataaataaataaataaataaaataaaaaataaaaaaacaaaaaaaataaaaaaataaaaaaacaaacaaactagccaggtgt

SEQ ID NO: 33863 - DNA, 201 bp, Homo sapiens
tggggtgtgaatctttttgttcttgatgtatggagtcatttatgcattatagaacccagatttttggaaccctattcccagcctcttacacttagatgtgmtgtatcctcatttcttcattgcacatttcttcatttcatagaatggtagaatgttttgtaagtgtacatgtaaaaattaatcaattccagaatcaccaca

SEQ ID NO: 33864 - DNA, 201 bp, Homo sapiens
ggaaaattccatccaaaataatattattgctttcctaaaaccaacctgaatgtttgaaggcagatgaataggtcaggaattataacagtatctattacttygtggattgttgtaatgtctgaaacaaggatagaatttttttttcaattttactttaagtttcgggatacatgtgcagaatgtgcaggtttgttacacagg

SEQ ID NO: 33865 - DNA, 201 bp, Homo sapiens
tgtgcgtgtgcgcgtgcacgcgcaccttgtaggtaggtgaggagattactagattgactctcctgtacatttaagttaaatggaacaaaaaaaaatgactrttgcttagaataatggataagccggcctcctattttttgttctctacttgactgatcagtccttgggaaattcttcaatgggattttcctatgacatatt

SEQ ID NO: 33866 - DNA, 201 bp, Homo sapiens
tatttttaaaactactcaaaattttaaaatactaaaagaaaaaatgggactcaaatttaatgagcccgtgtgtgcgtgtgtgtgtgcgtgtgtgtgtgtgygcatgtgtgtgcgtgtgcgtgtgcgcgtgcacgcgcaccttgtaggtaggtgaggagattactagattgactctcctgtacatttaagttaaatggaaca

SEQ ID NO: 33867 - DNA, 201 bp, Homo sapiens
gagattcttcataaatgagagaaggtagtagtcggtttcgtttgcattaagagaaggagcacatttctttgcacaaagtaaaataccctcccacgactccscactgctccccgtatccctgctggcttatgcttatcatgcatcccagtggtgaatggagaaattccatgctttccttctcctgcagaggttccttcctgg

SEQ ID NO: 33868 - DNA, 201 bp, Homo sapiens
tcccagctttagcacttatggctggagcccttgggcaagtcacttaaaactctctgaaccttggtttcctgatatgtaaactacagctatcaagagtactracctcctacgcttgttttgaggaataaatgtaattatgcataaaaatcgcatggtctaatgcccagcatatcataaatgctcaacaaaggttatgagcac

SEQ ID NO: 33869 - DNA, 201 bp, Homo sapiens
gggaatatttttattgggacttgaaaagagaaaaagagcttaaactgaagcatgaaagatttccattagagttttgagagtgtcagactctcaaacaatartatcagggatgcagtggaaaagtttctaagcatgtactgagtacccaccattgagggtgctacaaggcaacattccctcccattcccaatcctgcctggc

SEQ ID NO: 33870 - DNA, 201 bp, Homo sapiens
cttgaatccatggactggacccgaaacattggtctatctcagtgagggaggaagggtgctactagaatctgatgggtagagaccagggatgcagctaaacrctctataacacacaggacacccccttccaccaacaaagaattatcctgcacaaaatatcaatggtgccaatgttgaaaaaccctggtctaattgtctaga

SEQ ID NO: 33871 - DNA, 201 bp, Homo sapiens
cattacagatgagcagaatttattcattttgggggaaaaaatgaacagactgtatttggaaacttagatcatatccaaagcacttgatgattcctgtttgraatcatttttccttcaaagaatagttcagatcagtgttaaatgcagggcagagatggactcaagagtgggaggcattgcttttgaatggaatcacaatgt

SEQ ID NO: 33872 - DNA, 201 bp, Homo sapiens
aatgtcacatgcacggaagcatagtctagcttccaaaaaccattgaaaggagtttcaatcttttcttttaaattcatatatatgtatatatatatatatakagagagagagagagagagagagagcagagagagtttatttgggccaagcctggggactgcaacccaggagcatagattcaagttgccctaaatatacact

SEQ ID NO: 33873 - DNA, 201 bp, Homo sapiens
gctcaagcagtcctcccacctcggcctcccaagcagttccacaattacattcccaaagtgctgggataacaggcatgagccgccatgtgctggcctaaagwtaacacttaaaatgctagcaattgtgcagcagatcaattgttcatccttcacactgattaagtagctttgaacatggaaattctctaagcctgactgccc

SEQ ID NO: 33874 - DNA, 201 bp, Homo sapiens
tctgaggcaggctcagtgatttgtgaagaggttaaaattgcaaattctggctctgccacatctgtgctatatgaccttaggcagttccttaatttttcatstcttaagtggagacaatgctagtacttcttcacagaattgtgatgagttaaatactagtaagaagagttcagcacatgtaagtgctcagtaatgttacct

SEQ ID NO: 33875 - DNA, 201 bp, Homo sapiens
tcactgcctggttgtgcatcatagagttcacagcattgtgaaatcacccttaaggcaaagctgacagcatctttatttattgtgcatggatttcatgttarcctcatcatccttttgctgcatgttgataaggcagaaatagtgagtcatttaaatagcggattacaaagactctgatgtagtaaatctaccctctaggtt

SEQ ID NO: 33876 - DNA, 201 bp, Homo sapiens
cccagagccttgcagtgccagtgctgttagccactgtccccgactccatttgtgagaatgctgctgactggcatttatgagagtgcttagtacctgccagrcactgtgcctggggatttacatggattatctacttttaccctcaaaacaccgatatgagttaggcactattaatttcattttctgattgagagagctgat

SEQ ID NO: 33877 - DNA, 201 bp, Homo sapiens
tgattgtccttttaatgtttgttatctgaggccttattccttaggatgacagtccaagtacttaaaaaaaaagtatcccttttgcctctttcaaatgcatwttttttattcttaaattttttattgatacataatgtttgtacatatgtatgggatttatgtgatattttgttacatgcataaaatatgtaatgattaagt

SEQ ID NO: 33878 - DNA, 201 bp, Homo sapiens
atcaagtcatttttctgcttgaaataatgcagtggcttctcatcttattcaggaaaataggtaatccaaagtgcttatcaaggtttgcaaggaccttaggwtctggctcactgccagtcttctctcacccctcctttctcagctctgaagtcctcctggctgctccaaacatgattgctcagtgtccccacacctgctgtt

SEQ ID NO: 33879 - DNA, 201 bp, Homo sapiens
tagttttgatcctgggagcaagaattagtcaagaatggacctgatctaagaccactgtagttttttggacaggctatgagccagtggactggcacagatgratacaaataacacatagctaatactaattgagaatctaaaaggtgtattctgtggcctttataagcatgaacttatccaatgagttccatgaactcatga

SEQ ID NO: 33880 - DNA, 201 bp, Homo sapiens
ttctggaagagcagagtcagaattcaattccaggtttgtcatatttcagagcccacagtttattgctttctgtgtaatgagtaaatatttcttttagaatmaaaaaatattttaattaaaatgtaatgacaggaaaatagttttgatcctgggagcaagaattagtcaagaatggacctgatctaagaccactgtagtttt

SEQ ID NO: 33881 - DNA, 201 bp, Homo sapiens
tattttccatctgctcacagattgtgaggtttattattgtttctgttattgttttttgagacagggtctcaccttgttgcccaggctggagtgcagtggcrccatcttggctcactgcaacctccacctcccaggttcaagtatttcttgtgccttagcctctagcctccctggtagctgggattacaggtgtgcgccacc

SEQ ID NO: 33882 - DNA, 201 bp, Homo sapiens
aaaaggatgttgcttctctacacgtaaaacttgttggaagacagattatcctcctagaagagcagatgttctctattacaaaagaggaaaagcatttagaytcttccggtggtgaatagaggccacaggttacagctttctttggcctttgcttttaaaaaaacattctgctgaaggccttttgttgccagtggtgtccag

SEQ ID NO: 33883 - DNA, 201 bp, Homo sapiens
tgtggacgtaggtcttcctttgtcttgggattgtacctaggagtagaattgctgggtcatatggtaaatctgggtttaactttttaaaaagctgtcagackcttttccaaagcatctacaccactttacacctcaccaacaatgaatgaggcttccaagttttctacatcctagccaacacttactactgtccatcttttg

SEQ ID NO: 33884 - DNA, 201 bp, Homo sapiens
ggtcatttttctgtttcattttttacttgttagaggctctaaattgtagttctttttttaaataacacaactttattaaggataaaatttgcatgccatayggttcccccaggtaggtatatgattcaataatgtttcataaatttactaaccatcacacaatccagttttagaacacacacagttttaaataatttccat

SEQ ID NO: 33885 - DNA, 201 bp, Homo sapiens
tgagactccatctcaaaacaaaaaacaaaaaaaccctctcttcttcataaattacccagtctcaggtaactctttacagcagtgtgaaaatggactaatamacctgtgaatgtgacttatttggaaaaaaagtctttgcagatacaattaacaatcttggctgggcacgttggctcatgcctgtaatccaagcactgggag

SEQ ID NO: 33886 - DNA, 201 bp, Homo sapiens
tacaaacagtaagctcatcacctgatattattacatctgccacttagaagctgtgtgactggaagcactctgtgcctcagttacctcatctgtaaaattcrgataataatagtgctactctcataggctgatatgaggtttacattagttaatatatgtaaagcactttgaatgaattcagtaatatagtcagcaccatgt

SEQ ID NO: 33887 - DNA, 201 bp, Homo sapiens
tataaaaacaacttaagttcaagactatcctctccagtcttctattcatacttttatttaatttaaaaagactgttggaaactttcaagtttttacttgcrttagtttgtttctgccttatcagaacccataaaaatagtagtttttactgacattagtttgtttctgccttataagaacccataaaaatactagtttttt

SEQ ID NO: 33888 - DNA, 201 bp, Homo sapiens
cttagcaaataaacgtttcctctgtgggctgggggtgttacaatgtttttaaatagtgggattatcaagtttagggttttattggctcagagggcaagtgygaaatcttgagtctgtctggtgctggggtttgaaacctgatgcccatgtgtcacttgctttattaagtcaccaccttggaagggctgcttcctccttatt

SEQ ID NO: 33889 - DNA, 201 bp, Homo sapiens; identical to SEQ ID NO: 8807

SEQ ID NO: 33890 - DNA, 201 bp, Homo sapiens
ggttttattggctcagagggcaagtgtgaaatcttgagtctgtctggtgctggggtttgaaacctgatgcccatgtgtcacttgctttattaagtcaccaycttggaagggctgcttcctccttattaatgaaaagcctgctccatttgttttggcttgcaccaacctaacagtgtctttaaatcagcgacagactgtttt

SEQ ID NO: 33891 - DNA, 201 bp, Homo sapiens
tacagggtaaaactctggcaagatgctgtggtgacttatctgagcctaaaacaaaggagaaccatcccagaatcctagaaatctcccttcccccaaatcartgaagggaagtttcataatgatggacagagtcccagatggaaattgactacctgttctacagaaaggtcttcaattctaacagagaactctctgatcgca

SEQ ID NO: 33892 - DNA, 201 bp, Homo sapiens
agaactctctgatcgcaggaaaagctatctcaatttcaatgacttgtccactgacagaaaatagtgtaagaagggctcactctgggggagtgagaagtaargcattagaggaggaaagatgataactgagtgggaagaaagaaaatcatgaaggaccaacaggaggcacctgggtcgcagcccagggagcattaatgatcc

SEQ ID NO: 33893 - DNA, 201 bp, Homo sapiens; identical to SEQ ID NO: 8732

SEQ ID NO: 33894 - DNA, 201 bp, Homo sapiens
cacacacaactgacaaaagatccaagtttttctgtttccttctcttctgcttatctctgtttctcccatctcatcctctgactgctacactcttttctgcrtgtatttaagctaattagatatgtagatcagaatgtggggctgttggtcttcagaccccatgaaggggaaatcactggagtgactgagaaacatcaagga

SEQ ID NO: 33895 - DNA, 201 bp, Homo sapiens; identical to SEQ ID NO: 8734

SEQ ID NO: 33896 - DNA, 201 bp, Homo sapiens
ctctgtttctcccatctcatcctctgactgctacactcttttctgcatgtatttaagctaattagatatgtagatcagaatgtggggctgttggtcttcaraccccatgaaggggaaatcactggagtgactgagaaacatcaaggagtgaatgagagccccaggtggtgctggcattttcatttactggcttgatcatct

SEQ ID NO: 33897 - DNA, 201 bp, Homo sapiens
gaacaatagggtatctagttgctgcaaagaatagacttataaataaactaatatcagatggagaaagttttggcatgggtgtagaatggcctcctggtatwacttcccctcccatcctcttctggtgtggtgcctgttcccggctagggggtgttctgtaagtgtgtcactgccatgtactaaccctggtcttttccctct

SEQ ID NO: 33898 - DNA, 201 bp, Homo sapiens
aggggaaggaatcttgttaattcaaagtacagaaactgaaagcaacgttttgaattaacaaagtacggcttatctgatatttttattagtgaacaataggktatctagttgctgcaaagaatagacttataaataaactaatatcagatggagaaagttttggcatgggtgtagaatggcctcctggtattacttcccctc

SEQ ID NO: 33899 - DNA, 201 bp, Homo sapiens
gggatgctgaccagagtccaaatcacagcctcctggatgttcagccccatctttacttttagcgcaggatctgccctcagtggggttttccagtgtgctckctctctctttctcatcccatgacttcattactgagaggtcatccaaccactctgtctcatcttagaacaagagaagacctcgtcggttttcctgggctac

SEQ ID NO: 33900 - DNA, 201 bp, Homo sapiens; identical to SEQ ID NO: 8724

SEQ ID NO: 33901 - DNA, 201 bp, Homo sapiens; identical to SEQ ID NO: 8725

SEQ ID NO: 33902 - DNA, 201 bp, Homo sapiens; identical to SEQ ID NO: 8728

SEQ ID NO: 33903 - DNA, 201 bp, Homo sapiens
ctttgtagcaacatggatgcagaaggaggccattatcctgcaagaattaatgcagaaacagaaaatcaaatactgcatgttctcccttataggtgggaacyactacacatgggcataaagatggaaacagtagagactggggactctaaaagaaggggcaatagagaaaggagaaagggttgtaaaactacctattggata

SEQ ID NO: 33904 - DNA, 201 bp, Homo sapiens
tggatatctacccaaaggaaaataaatcgtcttatcaaaaagacactcacactcatgttttctgtagcactattcacagtaggaaaatcatgaaattaacstaagtgttcatcagcggtagactggataaagaaaatgtggcatatatacaccatggaatactacatagtcatataaataatgaaatcatgtcctttgtag

SEQ ID NO: 33905 - DNA, 201 bp, Homo sapiens
ccttcccccatcttttcctccctctctttcttcttctccttcctcttcttttttcttccttctccttccccttctcttcttcttcttcttcctcttctttyttttttttttttttttttttaaagaaacaaccctttacaagtgtaaaaccactcttagctcctctggccatacagaaacaggctcaggctgtctttggcc

SEQ ID NO: 33906 - DNA, 201 bp, Homo sapiens
agtgggaagatcccttgagcccaggagttctaaggtggcagtgagctatgatcacaacactgcactctagcctggggaacagaccaagacattgtctcttaaaaaaaaaaaaaagtaggtaaagattgaaacaggctggcacacggttagaactcagtactaaaatataaaggagataacatattgcccactaacattttg

SEQ ID NO: 33907 - DNA, 201 bp, Homo sapiens
tgaagccaggatctgtcccatccaggaaaggagaattggcaggagttggggacatcttgccatgggtgaatactcctctgagaagggagaagggaggaggmagcttacagacagaaccatgagggagggacaacatggagcccaaagccctgctcctgagttgctgggtctggatctcggggtcagggttgtttgtgagat

SEQ ID NO: 33908 - DNA, 201 bp, Homo sapiens
caggaaaggagaattggcaggagttggggacatcttgccatgggtgaatactcctctgagaagggagaagggaggaggaagcttacagacagaaccatgarggagggacaacatggagcccaaagccctgctcctgagttgctgggtctggatctcggggtcagggttgtttgtgagattggagaggcagcagaagtagcc

SEQ ID NO: 33909 - DNA, 201 bp, Homo sapiens
cgtgttgtcctggacttttcaagaagccgataactcctaggtagaaccaggaacccaactctactcgtctgtcctacgtagggtctacaaggcagtgtaayacaccacgccctgcaccctaactgatcatagtcagccgtggtgaccacaggatggttcatccttcttgctggttcccagcatccttcttgctggttcgca

SEQ ID NO: 33910 - DNA, 201 bp, Homo sapiens
taggtagaaccaggaacccaactctactcgtctgtcctacgtagggtctacaaggcagtgtaacacaccacgccctgcaccctaactgatcatagtcagcygtggtgaccacaggatggttcatccttcttgctggttcccagcatccttcttgctggttcgcatgtgctcttttggcacttatcactcccacattctgga

SEQ ID NO: 33911 - DNA, 201 bp, Homo sapiens
agtgggtaagcaaatgccacacaaaagaaggcacatagtgcacacttgtaccatcatctaacgtctgcatggttctattgcagggctatactttcttatcrgtagatacatggaaatggaaatgcacctgcttttaaatatatacttaatgcacaagtgtcaatgatatagttttcacctgaagaaaatctagagccatca

SEQ ID NO: 33912 - DNA, 201 bp, Homo sapiens
cagggagctatctcctggaggaggctgagacataagccctgggaatcacatgttctttcagatggaaaattccctgtctgtaagtagtttttttttttttktttcttttttaaactgctaaaacattgagtatgcagacacacatgtgaccagtccatgagatctcacatgggctccagcctccatcttatttgaatgcag

SEQ ID NO: 33913 - DNA, 201 bp, Homo sapiens
acacttgtaccatcatctaacgtctgcatggttctattgcagggctatactttcttatcggtagatacatggaaatggaaatgcacctgcttttaaatatrtacttaatgcacaagtgtcaatgatatagttttcacctgaagaaaatctagagccatcaaagtacagggcgagacatactatatgagcctgaacgattgt

SEQ ID NO: 33914 - DNA, 201 bp, Homo sapiens
gagctatctcctggaggaggctgagacataagccctgggaatcacatgttctttcagatggaaaattccctgtctgtaagtagtttttttttttttgtttyttttttaaactgctaaaacattgagtatgcagacacacatgtgaccagtccatgagatctcacatgggctccagcctccatcttatttgaatgcagaaag

SEQ ID NO: 33915 - DNA, 201 bp, Homo sapiens
tagttggatatgcatttttgagagagtactccactgtagtatatgaagtaatttgaattgggagggatggggagtgggcagtaagaccactcagaggtggytatcttgatactgatccaagaatgaaatagggatagactgacatgagagagtggctgtggagatggtgaagaaggcatggatttgatagttatgtggttg

SEQ ID NO: 33916 - DNA, 201 bp, Homo sapiens
cagaatcctcttgtttaaaagatggaaaatgagaagtactgactaatgggaggaatgttaagaataccgatagctcaacccttaaaaaaaaaaaagcctayataaaagggtggataaaatgaagtcattcacttaagttggtccatggcatttttcatgaagcaatgattgggttgagtgatcaagattaccatttccaga

SEQ ID NO: 33917 - DNA, 201 bp, Homo sapiens
gtatatgaagtaatttgaattgggagggatggggagtgggcagtaagaccactcagaggtggctatcttgatactgatccaagaatgaaatagggatagamtgacatgagagagtggctgtggagatggtgaagaaggcatggatttgatagttatgtggttgaattgctggaacttggtactgattgagtaaagggtgag

SEQ ID NO: 33918 - DNA, 201 bp, Homo sapiens
taaatagcatagtttgggttttaaatgcctgtgtttgtaatgggttcaaagattttaaaatactaaaatttagaaagttgaaagaagtgctggaagaggaraaaagattttccctctgctccttggccaaccatcaggcagtcatttcatgtgccttcctgtttcacctagggttcttggtcccaagcaacagaaatagat

SEQ ID NO: 33919 - DNA, 201 bp, Homo sapiens
gatcagggattctgtgtcagctattggaagtttgaagtaattgattagtatcttgatgagcttcaacaatttcagtaagtttgggtagcaaattgcacccytttttttttttttgaaatggagtctttctctgttgcttgggctggaatgcagtggcgcgatctcggctcactgcaagctccgcttccccggttcacatca

SEQ ID NO: 33920 - DNA, 201 bp, Homo sapiens
attctgatgcagatttctgattaggaaccatgttttagtctttctcatctttcacagtttctttacaaacgatttctatttttctgaagccccaaccctaygccatcagtcttaatcaatgactctttgttcaattgggaaaaccagtccatctgatgcaaattcacttaacctctctcctgagagttgaactcaaacttt

SEQ ID NO: 33921 - DNA, 201 bp, Homo sapiens
caaggctaactggctaatgtgatgctcatctgaatgtcctcttgactaattagagactttgactaatattcaccttcctttttgactgtatctttggcctmatttccctgttgtctaatttgctttgacccccaaacatccaagtcttgcctgacctaaaaaccctttccactagaccctgcttcccatgggctatgttcc

SEQ ID NO: 33922 - DNA, 201 bp, Homo sapiens
ctctctactcactgaggtcttagggaggcaaccgtacataagattttctgaaatttgggatctggtctacagccgtaccaccctgaatatgcccgacctcrtctgaaacttgggatctggattaggaaactgcttgaaaaccagaatctaagatgtgatttccaatgggcctgtcgtagggtcttcagtgaatatctacac

SEQ ID NO: 33923 - DNA, 201 bp, Homo sapiens
tccgggaggccggtctcagacaccacagagccctcatccccagaagggaaggaagagagcctagctacagagccagccccaggtacccaaaagaaaaagcrctgtcaatgctgtgttgtcatgtgaccacttctttcttctcctttcttctgggcagcctgtactctccaccactcacgtagacctcactgtaccactaac

SEQ ID NO: 33924 - DNA, 201 bp, Homo sapiens; identical to SEQ ID NO: 8784

SEQ ID NO: 33925 - DNA, 201 bp, Homo sapiens
aaagatgggattgtacccccacatgtagagtaacgctctgccttgtttttgttcctacagggtttctccagtacggatggaggtaagtgctctctgcccckactgtagatgaatgttttaatcctggtcagcttagggggtttcattaacaggggcttaaggaagaggtactgtgttgatttgtaaaggcatcagaagaag

SEQ ID NO: 33926 - DNA, 201 bp, Homo sapiens
agccatcctcctacctcagcctcccaaatagctgagattataggcatgagccactgtacccaggtatattgtattttcttaaagcaagtcatggtataccygaaagaaaccaaatataaggcactgtagatgaatcccagtgctgttggcagaagggacagggaggccacatgtgaaccaggggtcactggccctgcccca

SEQ ID NO: 33927 - DNA, 201 bp, Homo sapiens
aaataatgagatgatataggaatctctgctctagtggtgggtctgaggtttgctctagtggtgggtctgaggttttctctactgagggcaaaattggagctttttttaaaaaaaaaaaaaaatttaatttttttttgagacagggtctccttctgttgcccaggctggagtgtagtggtaccatcacagctcactgcagcc

SEQ ID NO: 33928 - DNA, 201 bp, Homo sapiens
gagccatacagtgtctatgggttgaaaaacgaaattcagaaagcaaatagttggtcaccttagagcccagagggatgctcagaattccctaacctcacagyggtgactactgaaagtttcattctgttttatgacttgacttgcagcgaggaaggtagcacagctgtaaaccagctgtattttatttacgcttggaaacag

SEQ ID NO: 33929 - DNA, 201 bp, Homo sapiens
ttgcagtgtgctatgcaaatgggaatatttttattgggacttgaaaagagaaaaagagcttaaactgaagcatgaaagatttccattagagttttgagagygtcagactctcaaacaataatatcagggatgcagtggaaaagtttctaagcatgtactgagtacccaccattgagggtgctacaaggcaacattccctcc

SEQ ID NO: 33930 - DNA, 201 bp, Homo sapiens
ttcattagttgatccttctttaagctttgagtaattcaggaattggtcttcattgggacaatggaccgcaattttcagaaccataatcctagttttttagtttttttttttaaatttttatttatttatttatttattttttgagacagagttttgctcttgttgcccaggctggagtgcagtggcgcaatctcagctcac

SEQ ID NO: 33931 - DNA, 201 bp, Homo sapiens
tccaaggctctgagaccctctttctcaaacgcctcaaatctgaaatgtcttggagacttcaccactgaagtgagagagatgtttgctggcaatattgaaaygccatggtttgcctattaggtaatctttgaacgtggtgctctgaactcagaaaggttgtttttttcttctttctctttccccctgtgcatgtgtattttg

SEQ ID NO: 33932 - DNA, 201 bp, Homo sapiens
tcaggaattggtcttcattgggacaatggaccgcaattttcagaaccataatcctagttttttagtttttttttttaaatttttatttatttatttatttmttttttgagacagagttttgctcttgttgcccaggctggagtgcagtggcgcaatctcagctcacagcaacctccacctcctgggtttaagccattctcc

SEQ ID NO: 33933 - DNA, 201 bp, Homo sapiens
attctcttgagcatataagaatacacacaaatactcacttgtgcctcttcagttattgaagaattgagtttgtcctgtgtatctggggagctgttgattaytctcatgaatgtgcacctaatacagtctgccctccctattcatgggttccatatccacgccttcagtcaatcttggattgtaactattggaaaaaataat

SEQ ID NO: 33934 - DNA, 201 bp, Homo sapiens
tgatgcagcagttacaagtagtaaaatagatcagtatgtactgacatgaagaaaatagacttacacataccttatgtaaaggaggtgaggaaaaggaacawtggtcttttctgtattattagaatttgaatatcaaaattggattcatatattacttatataattaaaaaattaagttagtcagacttagaactctttgaa

SEQ ID NO: 33935 - DNA, 201 bp, Homo sapiens
gctggtgatgttagctgcttccttggcgtctgagttctggcttgtgagcagatcttatgcccaatacatcagaaactccatgtctccttcagttgtagtcrttgggagaatccatgggttgactggagcctaaggaaagcaccaaaaagtcactagaggcactggagtggatatgaccttttcctttgaacagcagtttgc

SEQ ID NO: 33936 - DNA, 201 bp, Homo sapiens
tggcgtctgagttctggcttgtgagcagatcttatgcccaatacatcagaaactccatgtctccttcagttgtagtcgttgggagaatccatgggttgacwggagcctaaggaaagcaccaaaaagtcactagaggcactggagtggatatgaccttttcctttgaacagcagtttgcacaacatataccggtggctttgt

SEQ ID NO: 33937 - DNA, 201 bp, Homo sapiens
aacccacagcaaggccacttgatgtctcagtctgtagagtaggtgcttaataattgtctttgacgagttaatgggtgcagcacaccaacatggcgcatgtrtacatatgtaacaaacctgcacattgtacacatgtaccctagaactgaaattataatgaaacaacaacaacaacaacaacaaaataataataataattgt

SEQ ID NO: 33938 - DNA, 201 bp, Homo sapiens
caaccaaaaagccaagctaactctgttttgatccatccactcttcttaccatttcccatgtcattttaaaagcctcctaatattgagactccattttgatrtatcaggatagaatgagaagaacccaccttcaaatcctggctagggcacttactaggcaggtgatcttgggaaacgtccctctatttctctatacctctt

SEQ ID NO: 33939 - DNA, 201 bp, Homo sapiens
acatggcccttcacttcttttgtaaacggacataattgatccaacacagcatgattgctttctagtgcagcaattttcagaatactgccttctcaaagatrtggttctcctgattgattatgaaatgagataaaaatataagtccttggtttaataagtgatgaacaagcccataaaatactaggtttttacttttgctag

SEQ ID NO: 33940 - DNA, 201 bp, Homo sapiens
cgtgtgtttgtttgtgtgtgtgtgtgtgtgtgtgtgtgtgtgtgtatgtgtgtgtgagagagagagccaattaagagacagagggagttgggtggggggamttatggccacatcggtaaatggttttatgctatgctttggtctagtgcctactcttctgaattctgcaaaccctgactctctcatcactttcctggagtt

SEQ ID NO: 33941 - DNA, 201 bp, Homo sapiens
atcactttcctggagttctcaggggaccctgaggagatcacaagcctgcccccagaacctagcactcctgaagtctctctggagatgtgagggaagaagasaataggtcctcacatcttcacttacttgggcttctctctcagaggcagagaatcgactgggattccagtctgcagggccttgggcagtctttagtctggg

SEQ ID NO: 33942 - DNA, 201 bp, Homo sapiens
gagaaattgaccagtctccttcactaggaatgtgggtcaagacacagggaagccttgtttccagtgaaggggtggggagttccagaagtattttcatcccrtcttcagacctgtacctgaggcataagacagagagaatagcagaacagtgattactcttttgaccaataccgtagaagctctcagaaaaaaaggctggac

SEQ ID NO: 33943 - DNA, 201 bp, Homo sapiens
aaggtttagttaggatggaggtgaagcacctggcaggtagctgtcattggatggtgttgagcagagcccttagcttttgtctgtattgctgtcttgtcctrtggggggtcagaagcaacatctctgaagtggaatgtgtattaatgactttttttttttttagacagagtctcactctgtcacccaggctggagtgctgcc

SEQ ID NO: 33944 - DNA, 201 bp, Homo sapiens
gatatcatgaagataaataaagatatagctattaaaatgtttgaaatttcagggaaaattgcaatgtaatgaggatgatgatgaggattagctaattagagttattgtttattgagtatctactaagtaccagactctgttctaggcatttaatacactttgtgtttaattttcaaaacaacatttaaagataggtattat

SEQ ID NO: 33945 - DNA, 201 bp, Homo sapiens
gttgcgtttccccagcacagtcaaattctgggctggggcatgggagaaagatgggttaagtctttaaagatgggaaaagatgggattgtacccccacatgkagagtaacgctctgccttgtttttgttcctacagggtttctccagtacggatggaggtaagtgctctctgccccgactgtagatgaatgttttaatcctg

SEQ ID NO: 33946 - DNA, 201 bp, Homo sapiens
ggtgaatcagggtgatggcttttcagttgacattggaagaatgaggaggaaggaggaagaagtggcagccgggtaggacagcaggtcttctctgtcccccsagttcttctgatgtcctgcacagaaacctgaggggtagagtagcaaaggagaaatccaagctcaggctgggaaagaagctcatggcaccaaggttagggc

SEQ ID NO: 33947 - DNA, 201 bp, Homo sapiens
tcaccatagactctaattagtctgaggactctaattagttctgctaaaaagtctcactgctattcggtgacaaagctcctataatgtggcatgcatgtagrcagttgtagtttccaaaaaagaaagaagtaggtggagcataggatgctcaaagtagacaatgatcaaagacttttgagagtcatcagtctaggaaagtta

SEQ ID NO: 33948 - DNA, 201 bp, Homo sapiens
tgtatgtttggttaaattatacttggttgtttgcataggctgtctctccctgagacgctcacctcacttctctatgggtcagcgaaacacataccctgtgkaatcacctcccctataaaaccccatggcaacctcttccaacaattcatcctttgcattccatccaagtatgtcttgttatatccatagcatttagtgcat

SEQ ID NO: 33949 - DNA, 201 bp, Homo sapiens
ctctccctgagacgctcacctcacttctctatgggtcagcgaaacacataccctgtggaatcacctcccctataaaaccccatggcaacctcttccaacarttcatcctttgcattccatccaagtatgtcttgttatatccatagcatttagtgcatttattatttcctctcctgctttcctctactagattttgagagc

SEQ ID NO: 33950 - DNA, 201 bp, Homo sapiens
tgcttgtggtgaatgtaattcagggtgtcttaggactatcctgctcattatgaatagaggataaaaacagatttctaagttctccatctgccataaaattmtgggaagaaaaaatatgaagtattcctttctgcacacacagaagtcttccattttgcaattttctatctagtctgctgtcctttctctctcttctttatc

SEQ ID NO: 33951 - DNA, 201 bp, Homo sapiens
taggtaattgctctctaactcaaccaaaacaaatctaaaccacatcaagtcagcaccttaatttgggaaattcctcttattagaaaagaatctttaagaasctatactcaaggtatgcaaatctgaaatgcaaacctgatatgaagcccaagcctaactcatgtcagtcaggatgtttgagttgatcctgatttattatta

SEQ ID NO: 33952 - DNA, 201 bp, Homo sapiens
gtcgatccttcatttttatgaaaagatgcaatgcaaaataaccttgatttagaatttaatgaggctgacatttaacctgagttcagttaggaagacaaacraaaaacacagacaaagttgagagaaggaaaataattacctacttgaatagtgtgggcaattctccatccatatgccccaggagaatatgaggtgggagat

SEQ ID NO: 33953 - DNA, 201 bp, Homo sapiens
gtctgtgtttgagtgctaatgtcgacaactttgaggccaataaataccaaatggggctctaggatttgggcaactgtgatagtgtgtgtgtcctgcatgtsacatgagaaagagagaggccgggatttaagaaaggtgcctcttggctgggtggcatgaactcagtcagctggctttccccaggcacctgattggccttaa

SEQ ID NO: 33954 - DNA, 201 bp, Homo sapiens
gatactttatgaacattttaagggattctcatgagtaattttgattatagacgatttttactttatgcattgactaggaaccaaatgcaactttcttagaragacacaaaattcattgtccaaatagaccatagggtcagcaggctttgtaaacatgttttgtatgtgcctaggggttgagagcaggggcgggagaggttc

SEQ ID NO: 33955 - DNA, 201 bp, Homo sapiens
gggttggagggaagggctcccagttccggagagggtccatgtgccagccaccctgctgaatgccttatgttaggggggtgagatctcagatgtgcacaggwaccaggttgacttggctgagcttttgggactgtggtagccaagagagggcagactcctgaggggacagagagtgctcaactccaactgatgggcactgtg

SEQ ID NO: 33956 - DNA, 201 bp, Homo sapiens
agagagacacaaaattcattgtccaaatagaccatagggtcagcaggctttgtaaacatgttttgtatgtgcctaggggttgagagcaggggcgggagagrttctggtccgttcatcaaaccaggggctggtgttaatgtttgatcaacaaaacacatgtaggcctaggctctgatctaggtccaactgccaacatagcct

SEQ ID NO: 33957 - DNA, 201 bp, Homo sapiens
tcatatcctcctgtttttgcattggggcatagttcatttcaaaaaggactttcctggtgattgaatgaatgtgcatcttatctgaatctggaatcacgttygcctaatttgaagcatggagaaaattctggaccttcttatcttcaaagagagcaataagcatttgttggtttaaacaagacatcatctgatgataccaag

SEQ ID NO: 33958 - DNA, 201 bp, Homo sapiens
ctaggggttgagagcaggggcgggagaggttctggtccgttcatcaaaccaggggctggtgttaatgtttgatcaacaaaacacatgtaggcctaggctcygatctaggtccaactgccaacatagccttttcatgcctgcctttcctacttcaggtagagagaggagaaaaaacctattgaggaaaaaagaaagaataat

SEQ ID NO: 33959 - DNA, 201 bp, Homo sapiens
gctgcttgggaggatgaggcaggagaatggcatgaacccgggaggcagagcttgcagtgagccgagatagcgccactgcactccagcctgggcaacagagsgagactccgtctcaaaaacaacaacaacaacaacaacaacaacaacaaaaaaaaaaaaacactacctggtagtgtttacagccttgagtgcccagaccaa

SEQ ID NO: 33960 - DNA, 201 bp, Homo sapiens
gaactttaagcacacttagtgaaagactaaaggtcagagagcacaccagccacattccctgagtccaagcagggagccagagaggagtggtttctggccarccttccctgttcagttacctcatggaacccttgggaccagggccttgatttacaaatagagtggccaccaggtaaaagttgcccatggccagtggtagca

SEQ ID NO: 33961 - DNA, 201 bp, Homo sapiens
tatgacaaagagaaagaaaaatatcttgcagatctcagctgatatcatctagctgcatggcgtgggcaattttcggagcctaattttcttcatctttaaakgggaaagtttccagagagtcactagatccctgctagacgtgactattttatgatttcataaatgtttggaggactagagggtctaagacagcaattgact

SEQ ID NO: 33962 - DNA, 201 bp, Homo sapiens
taagcacacttagtgaaagactaaaggtcagagagcacaccagccacattccctgagtccaagcagggagccagagaggagtggtttctggccagccttcmctgttcagttacctcatggaacccttgggaccagggccttgatttacaaatagagtggccaccaggtaaaagttgcccatggccagtggtagcaggatcg

SEQ ID NO: 33963 - DNA, 201 bp, Homo sapiens
gtccccaaataaatggaagaaatggtgcaaaatgcaagctacaaagtaggtgtttgatcatacacattcatattttattatttaatttgattcaatcttarggtcagagctaacagaaataaatatatttattattattattgatcaataattattagaaccataaagaagtgtcctcacactcagagtctagtgtgctag

SEQ ID NO: 33964 - DNA, 201 bp, Homo sapiens
tggtctgcctggaaatttccaaagggactttggtgccttaataaatattttcaaattgctcaaggttttggaagatagcagagccataattgtgaaatcgrgttaaagaatgattgctgcagtacttgcgtcggccctgtggccatgctgaagtggacagggttgtggacactcacaattgctcactgcagatggacagcc

SEQ ID NO: 33965 - DNA, 201 bp, Homo sapiens
gatgaattttgggaggacacaattcagcccatatcagatgtgctctcccttagggggttctaagacaactggggcatcagccttaaacatgaggcgatagragcggctcttgtatttctgtctttagtcccttggtctgcccgttagtccttctagaaggagtccacttgacagatcatgatgcccttcagaagtacccag

SEQ ID NO: 33966 - DNA, 201 bp, Homo sapiens
gttgtcaacctgttttcatcactggatgtttagaagccttggataatatcaaaggtatctatgttggagaccatgggcttcaatttctggctgtcttttgrcatttagaacctaaacagctctgggctggtagacatcactgacatgactttattgttcccatgagtgaacatctgcatgagatcaaaagtagtgatttca

SEQ ID NO: 33967 - DNA, 201 bp, Homo sapiens
aagcagcagcaaatgctatcagcctggaccatgagattgcatgtgccctgcagtgatcttccaccttgactgacattaaaactacctggtagtggccgggygtggtggctcacacctgtaatcccagcactttaggaggccgaggcgggcggatcacgaggtcaggagatcaagaccatcctggctaacacggtgaaaccc

SEQ ID NO: 33968 - DNA, 201 bp, Homo sapiens
tttcccattcccaagcaacattccaaagttctcacttcctggttaaccttcccaatttccaactctgttttctgccctacttcgtttgcttccttaatgtrttaggctgttcctgcattgttataaagaaatacctgagacagggtaatttatgaagaaaagagctttaattggctgatgattctgcaggctgtatagaag

SEQ ID NO: 33969 - DNA, 201 bp, Homo sapiens
tcagtctcccaaagcgctgggattacaagtgtgtgccaccgcatctggccaaggctaattacatttaagatgataattgtatttcccaaattaaaaaaaawatttccaagtcactgaatattaaaaacacgagctgtgggcctattctcttcaggccagggttcttaggtcaacctcagacaacctgaaagtgagataaat

SEQ ID NO: 33970 - DNA, 201 bp, Homo sapiens
ttcccttttagaatatcatcttttcctgtccctccttgggtctcacaacatttcccttgtgccaaatactgcccctacccttcaatctaaacactccccaratttcatccccggtaggaaagcccactttgaatatgagtgaaatagggactccattccccttacttactgtaaccaacttatatttataaacatttatta

SEQ ID NO: 33971 - DNA, 201 bp, Homo sapiens
attaaaaaaaatatttccaagtcactgaatattaaaaacacgagctgtgggcctattctcttcaggccagggttcttaggtcaacctcagacaacctgaamgtgagataaattctgcagttagtgtgaattattcagactatcagaatctgccaaatcaaattccatttcttcaagaacttatttccagtcagagtacaaa

SEQ ID NO: 33972 - DNA, 201 bp, Homo sapiens
ctccattccccttacttactgtaaccaacttatatttataaacatttattaaaagagggaattaaattcacttcttttatgttttaatttaaccaacaaaygtttgttgagattagcactggtcaacaaaacagtcatgattctctttgtctgatgagagatagatgttaaatcagtaaatatgtgtgtatactgattgaa

SEQ ID NO: 33973 - DNA, 201 bp, Homo sapiens
ctgtaccatgtcagtgttcttgtgtggtacatgaaacatcaggcaatggcaggtacttgctgccctcctgggtgggttgggtatgagatccatgtgtttgyaggaatgcactttaacacctgcagttattaatttgatgccacacctatagattttgcctcacacttctctggaatggtcttcaaaacagtatgggatcca

SEQ ID NO: 33974 - DNA, 201 bp, Homo sapiens
gagaaagtgtctgttgcccaaccagaggcctcatgctgtccaaatatagagattataagctgttcaggtgtgtttcagaactagtatagaaagggaagctkctttggcctcctttagatttgtgactagttttgtagtacattgaaccttatgaaattgccattttgtagatccataatattgactattgacagttccata

SEQ ID NO: 33975 - DNA, 201 bp, Homo sapiens
taacttgatgtacatcatcactgtcagtggtcgtggtctgtgctcttgctctgtctacttgtcactttctcagagagccctagtaagccacaaggtgcaawtgttcagaagacagtgaaaatcacttacaaagacaaagcttaaaatatctcattgacttttaaaagtgatcaagtgattgttttacagttcatcaaattt

SEQ ID NO: 33976 - DNA, 201 bp, Homo sapiens
tgttggttgtttctatgaacaaacaagttgaatgtgtataaaattatagaatcatgtttttagcccctcataattctccaagatgtcattccattgtgttytggcattgacccttgctctgggaaggtctgaggctagactatttcttctttgtagatggcttgcctactcccatccctcccactcctgcaattttttttt

SEQ ID NO: 33977 - DNA, 201 bp, Homo sapiens
ggggtggaggagggccaagttccaacctcagttgtctttacttcctcccacacagagagctatgttatgaaagtggtgtggaggccgggcgctggaggccrggtgcggtggctcatgcttgtaatcccagcactttgggaggctgaggcaggtggatcatgaggtcggaagatagagaccatcctggccaacatggtgaaa

SEQ ID NO: 33978 - DNA, 201 bp, Homo sapiens
aggcaggagaatggcatgaacccgggaggcagagcttgcagtgagccgagatagcgccactgcactccagcctgggcaacagagcgagactccgtctcaamaacaacaacaacaacaacaacaacaacaacaaaaaaaaaaaaacactacctggtagtgtttacagccttgagtgcccagaccaataagatcaaaatctct

SEQ ID NO: 33979 - DNA, 201 bp, Homo sapiens
gccatgttgcccaggctggtctcaaactcctgggctcaaggagtcctcccatgttggccttccaaaatgctgggattataggtataagctactgcacctgrcccaaaaacaactctttcagaaaaatgtgtggcttcttgagatacaaaccctagcaaagtatcttttttaaaattattattatactttaagttctagggt

SEQ ID NO: 33980 - DNA, 201 bp, Homo sapiens
tagcagagccataattgtgaaatcgggttaaagaatgattgctgcagtacttgcgtcggccctgtggccatgctgaagtggacagggttgtggacactcamaattgctcactgcagatggacagcctttgcttttctggtcatacatatgcttgatcctgaaattctctagatgggctacttctgagcagctgcttggaga

SEQ ID NO: 33981 - DNA, 201 bp, Homo sapiens
aaagacccccttgagcctcaaaggatgttcgaagcatgattcagttggggagttattggtcaacatggtgggacaattcttcactgtgtgggactgccctmaacagtacagggtacttagcatgtctgccctcccaatgctgagtaccagtggtgctccacagtcactgtgacaatcaagaaaagtaatgattgccacatg

SEQ ID NO: 33982 - DNA, 201 bp, Homo sapiens
agagcttgcagtgagccgagatagcgccactgcactccagcctgggcaacagagcgagactccgtctcaaaaacaacaacaacaacaacaacaacaacaamaaaaaaaaaaaaacactacctggtagtgtttacagccttgagtgcccagaccaataagatcaaaatctctgaaggtgaggcctgggcttggtgctttttg

SEQ ID NO: 33983 - DNA, 201 bp, Homo sapiens
atatgcttgatcctgaaattctctagatgggctacttctgagcagctgcttggagaatgggaagccaaccctatagtgtaaggtttcttaactgaagtacyattaacactttgggatagataattttctgctgtctgtggggccgatcttttgcattataggatgttagtggcatccttggtctctatccattaaatgcta

SEQ ID NO: 33984 - DNA, 201 bp, Homo sapiens
tggcacttcccaatcatcatgtattgggatgtgaagttgtgtggagtctgaggctgacccctggtagtgtgaggaccttgggggattgccttggaaaatasagggtccagcccaaggctctggctttcagggtcgggggttgagatgaatttgtcacagctccacctgagctcaccacactgggaagtcaaacagaggcaa

SEQ ID NO: 33985 - DNA, 201 bp, Homo sapiens
gcttgcagtgagccgagatagcgccactgcactccagcctgggcaacagagcgagactccgtctcaaaaacaacaacaacaacaacaacaacaacaacaamaaaaaaaaaacactacctggtagtgtttacagccttgagtgcccagaccaataagatcaaaatctctgaaggtgaggcctgggcttggtgctttttgatg

SEQ ID NO: 33986 - DNA, 201 bp, Homo sapiens
ggtttcttaactgaagtaccattaacactttgggatagataattttctgctgtctgtggggccgatcttttgcattataggatgttagtggcatccttggyctctatccattaaatgctagtagcacaccccactcttcattgtgacaatcaagaaggtctccagacattgccaaatatcctttggggaaaaaaataaccc

SEQ ID NO: 33987 - DNA, 201 bp, Homo sapiens
gtagtgtgaggaccttgggggattgccttggaaaatagagggtccagcccaaggctctggctttcagggtcgggggttgagatgaatttgtcacagctccrcctgagctcaccacactgggaagtcaaacagaggcaacagcttctgtttgctaagtgttaccacatgctaggcactgtgttgagtatggtgaaggacctc

SEQ ID NO: 33988 - DNA, 201 bp, Homo sapiens
gtgaacatctgcatgagatcaaaagtagtgatttcagtgtcaccaatattgaaaaatacagaaattgaaattgtaggtaaacccctggatggttatagttmaggacagaaagacaaggagtgaaagaaactccgtgaaacaggaaatgccaagaaaagcctatagcttccctgacttgagacaaaggctgttgactagaat

SEQ ID NO: 33989 - DNA, 201 bp, Homo sapiens
tcagctcctatgtgaactctaactgatagaaagtgtccatctatagtgccgccgtgggaagatctttgaagctgcattttaggtgttggagaaaggacatyaagacagattagagctgtcttccatgggcaagagatgagggagttggcatacacgtgtaaggaaccttcttacctaacatttctgcggagattcactata

SEQ ID NO: 33990 - DNA, 201 bp, Homo sapiens
gaacagctccagtctacagctcccagcgtgagcaacacagaagatgggtgatttctgcatttccaactgaggtactgggttcatctcattggggcttgtcrgacagtgggtgcaggacagggggtgcagcacattgagcattagccaaagcagggcgaggcatcgcctcacccaggaagcgcaaggggtcagggaattccc

SEQ ID NO: 33991 - DNA, 201 bp, Homo sapiens
ggatggttatagttaaggacagaaagacaaggagtgaaagaaactccgtgaaacaggaaatgccaagaaaagcctatagcttccctgacttgagacaaagrctgttgactagaatctcttgattcttagtccagtgattattttctagcaatagggacttgctcaagcacaggaaattagttccaatatggtgggggcaca

SEQ ID NO: 33992 - DNA, 201 bp, Homo sapiens
tatagtcagcaaaatattagaaaactgtgatagataatgtgctttgattgattgatgtacagtcagcaaaatattagaaaactgtgatagataacatgggmtttgattgatgtacagtcagcaaaatattagaaaagttaaagataacatgcttttttattaagtaaaatctagtggcagttctaatacttactctaattg

SEQ ID NO: 33993 - DNA, 201 bp, Homo sapiens
gttccaatatggtgggggcacatggccaatttcaatagcctgttggaatagcctggagatgccctgttgcatactggcatgtttgattccttattgaaaamagataaaatatatacaattgcaaaattcatataattctgcaaaagtaatataatgtaaaggaaaaagaggaaaaaaagttctgctaccatgttaaaaaaa

SEQ ID NO: 33994 - DNA, 201 bp, Homo sapiens
caatatagtgagattccatctctactaaaaatcaaacagttcggtggctcacgcctgtaatcccagcactttgggaggccaatgagggcggatcacctgargtcgggagttcgagaccagaccgaccaacgtggagaaaccccatctctactaaaaatacaaaatttgccgggcgtggtggcgcatgcttgtaatcccagc

SEQ ID NO: 33995 - DNA, 201 bp, Homo sapiens
gttatataaaaagtctgtgattcctactcctaataaagtcatggtatattagtccaatctcacactgctataaataacttcccctgagactgggtaatttrtaaagggaagaggtttaattgattcacagttctgcatgtctggggaggcctcaggaaacttacaatcatggtggaaggggaagcaggcacatcttacgtg

SEQ ID NO: 33996 - DNA, 201 bp, Homo sapiens
atttctagggaatttctggccgttcaaaaatgtcatctgaacccaaagcttttatttctaagctgagctgaatccatcaccgagtaaagagcaggagggaraactcatttgttcaaatgcctgcaggtattggcctgagggaatatggggagaatagctattcccaaggataccctttttctttcttagtggttggccatt

SEQ ID NO: 33997 - DNA, 201 bp, Homo sapiens
atgggaacacactcactatcatgagaacagcatgggagaaactgcccccatgatccaatcacctcccaccaggttctgcccctgacacatggggattatgrggattacaattcaagatgagatgtgggtggggacacagagccaaaccatatcatataggtactaatgatctacctggggcttgtgcttacattcataact

SEQ ID NO: 33998 - DNA, 201 bp, Homo sapiens
tgccctctgtggggccaggtattttgtttttgtttttgtttttgtttttgtttttgttttagatgagtcttgctgtgttgcccaggctggaatgcaatggkgcgatttcggctcactgcaacctccgcctcctgtgtttaagcgattctgttggcttggcctcccaagtagctgagacaacaggtgcgcaccacaacatcc

SEQ ID NO: 33999 - DNA, 201 bp, Homo sapiens
aacagtgaaagtgagaaatctcagagtctcattggtctgacagctatgtaaggaactgaggggatgtaccattgcaaatcgtcaaaatggaaataccccaratgcaatgcaggactctggatgcgattctggaacaaagaaagaacacttgtgggggaaaaaaaatagtgcaacccagagtctttatttaacagtattgta

SEQ ID NO: 34000 - DNA, 201 bp, Homo sapiens
cacactctatttggcctgattggtcctttcatgtattcatttgtttattcaaaaaacatttattgagcacctactatgtattgctaggtctgtgctaggtrctgtagtgcatatctcttggtggaggtggcagaagagtccagaaaattttagtgcggtaacttatatggcgagaaacacataggataatgggacactgga

SEQ ID NO: 34001 - DNA, 201 bp, Homo sapiens
agaacagcatgggagaaactgcccccatgatccaatcacctcccaccaggttctgcccctgacacatggggattatgaggattacaattcaagatgagatstgggtggggacacagagccaaaccatatcatataggtactaatgatctacctggggcttgtgcttacattcataactgaaggcggtgctaaatgttagct

SEQ ID NO: 34002 - DNA, 201 bp, Homo sapiens
ctatactggtgattttgactcaggtctgggatgggtcctgagagtctgcatttctaaggagctcccatgtgaggccaatgctactttgggtaggaaggagmtaaatgatgacttgacatgggaaaagagaaagagggattgaagaaaacatttcaggtagagggaatggtgtgtcaaaaagcctagaggtgtaggagcatg

SEQ ID NO: 34003 - DNA, 201 bp, Homo sapiens
tctgtcttatccccaaacgccctgaattctcacttctttcttttgtaactgggcccctgctctgatggtttcctcctttcctttgcctgatgctacctctkttaccttcttggggttcttccccagcaaatttttctaggttctttcttctgcattcactttccatctctctcagctgggttgtgtcctttggccgctatc

SEQ ID NO: 34004 - DNA, 201 bp, Homo sapiens
ttagccccatggggctagagcactgctactgaaaaaaaaccaccctaactatatttgcagctttacggtgtgtaaaacttcagtttaaaaacaaaagggaraaaaggtctctgccttcaaagattataagctattcattcaaaaagaccaaacattgtaagaaataactggataattaatccataaagggcaagagaagta

SEQ ID NO: 34005 - DNA, 201 bp, Homo sapiens
ccaattactccccgaaggcctcaactccaaataccattacattagggattagggtttccacatacgaatgttggggaacacaacattcaggccatagcacsatcctaataaatggcaccactatccaaccagttgcacagactccaaacctagtcatcattgctgcctctagttcctcttgccctatagcctgtgtataag

SEQ ID NO: 34006 - DNA, 201 bp, Homo sapiens
atggaaacagttgctttgccaacttcaccttttttatcaggggctcttcttggattcttggactgtgtttgagatcagttcactcttgatatctcccctcsgcatggaaagcatccacaaatttccagctagagcatgaacttgcaatttggtttgcctagatcctggaagtctacagagttagaatctttcctggttctg

SEQ ID NO: 34007 - DNA, 201 bp, Homo sapiens
ccttagtatccctttacactgcttaacttttccataatgccctcatgactatgtaacattaaatatttatttatttatttattatatgtgaggagagcctygctagaatgtaaacctgatgaagacttcaaaacccctggaacagtgcttttgcacagagtaatcatcatcaatacatacttggtgaaaaactgtaaaaat

SEQ ID NO: 34008 - DNA, 201 bp, Homo sapiens
aggggcagaatcacctaaatcaatgggtatatatagttataacacttttgattcacatcaccaaatggttcaccagaagacttgcaccatttatatacatrcagataccaacagtatgtaagtctgttcctcaaaccttcactaatgctgagtgtgattgcttttgaaatcctgcccactttgatagtcaaaataacagcg

SEQ ID NO: 34009 - DNA, 201 bp, Homo sapiens
agcttcaatgtgttcatccacaaaatacggattagccctatttcacagagttgccatgaggatttattgagataatgtatgtaaatgtctacacattgtargtattcaattaataattgttaccatcatcatccatatcatctatatttcctgtcaaggaaactggcataccagctaagccagcaagcacatgcaaatagt

SEQ ID NO: 34010 - DNA, 201 bp, Homo sapiens
agcctcagcaatggcggatgcccctcccccagccaggctgctgtctcacagatcatctcagactgctgcgctagcagtgagcaaggctccatgggtgtggraggtgcacagccaggtacgggagagaatcaccttgtctgccggttgctaagaccttgggaacagcacagtatttgggcgggagtgtcctgtttttccagg

SEQ ID NO: 34011 - DNA, 201 bp, Homo sapiens
tattctgtcaggcttctttatctatgttcgtgaacaaatattgttgtaattttttttcttataatgcctctatcaaattttggttcagagttatgttggcmtcataaaactagctggaatggggtgtcttcctcttttattttctgaaagagtttaggttgaagtgctattgtttcttccttaaatgtttgatagaaatca

SEQ ID NO: 34012 - DNA, 201 bp, Homo sapiens
tcggctcactgcaacctccacctcccgggttcaagcgattctcctgcctcaacctcccgagtagctgggactacaggcatgtgccaccacgcccagctgatttttttttttgtatttttagtagagatgggatttcactgtgttagtcaggatggtcttgatctcctgaccttatgatctgcctgcctcggcctctcaaag

SEQ ID NO: 34013 - DNA, 201 bp, Homo sapiens
gagatcgtgccactgcactccagcctgggtaacagagtgggactctgtctcaaaaaaaaaaaaaaaagaatttttgccataccaagaatggggttgacttsgtcctgcattttaagacagaggtttcttctgcctcaagcccctaacttcagcctgaaatcatcaacatccatcacagtagcggaacaacctagaaggaat

SEQ ID NO: 34014 - DNA, 201 bp, Homo sapiens
atttattataagtcagagatataatgtcatttaatactcacaataagcttagaggtatacattattccaactcaacgatgcaattcaaatgttgttgaggrtttatgtgtggtaagccagggcaggcattgcactaagcacaatgtcacagtggggttgtagagatgaaaaggattcctgcctgcagataacatacaatcc

SEQ ID NO: 34015 - DNA, 201 bp, Homo sapiens
catgtagtaatttgatccaactttattctcttggaccagtcaagaccaattaaggagccaccatccatgccatgcctctgtttatcctaatgagaagtgcrtggattgataatgaaggctggcagcttaatgtagctcaaaacataatttgtaaactctaatgaccagaatgttagccataagaatggtataaatggaact

SEQ ID NO: 34016 - DNA, 201 bp, Homo sapiens
atgattgtgaggcctccgcagccatatggaactgtgattcaattaaatgtctttcctttataaattacccagtctcaggtacgtctttattagcagtgtgwgaacaaactaatacagtaaattggtactggtagagtgaggtgctactgtaaagatacctgaaaatgtggaagcaactttggaactggtgaacagggagag

SEQ ID NO: 34017 - DNA, 201 bp, Homo sapiens
gagtctttatttaacagtattgtatcaatgttaatttcttagttttgacaaatgcatcctggttatgtaagatgttaggattatgggaagctgggtaatgratagatggagagtttctgcactatgtctgtactgtttttgtaaatgtacaatgattccaaaataaaaggtgtatttaagaaacagaaatgccaagtgtat

SEQ ID NO: 34018 - DNA, 201 bp, Homo sapiens
tctcatggctgccacccacataattctaaaggtctcccaatgggagaacagccaccctggtaagtgtccagcatcatacaaggagtctctgcccattgtgrctcttgcttgagcccccacacttagccctcaccaagctgtgtgatttaggattcaggtgttagaacggagaaggcaccaggcctactgcaccatatcaat

SEQ ID NO: 34019 - DNA, 201 bp, Homo sapiens
ttgtgcacactatcttgttttgtatttccaaccacgacagctatgttcagttgtgccccatcccctcccctgttctgtggcctgcggtgctgagaactgcragcagccaatgggactgctgcttactgtgaggtccatgcagtgtccacccccgcttcctgccctgagactgcctccaggcctggcacgtcttcctaagac

SEQ ID NO: 34020 - DNA, 201 bp, Homo sapiens
tgaaattgaggggacttgactaagttgggagctggcaaaccccttgccaccaccacagcctttgcagataaagtctttgccttgctttcccatcccctaayggcaaaatgaattgctaagatgagaaaaaggaattttgcaccatctgcaccaattctgaggttttgcaagtgatcaccaatgtggagagtatggttcagg

SEQ ID NO: 34021 - DNA, 201 bp, Homo sapiens
tcatctgtaaaatggaacaataccttcttttttcttttctttttttttttttttttagatggagtctggctctgtcacccaggctggagtgcaatggtgcsatctcagctcactgcaacctccgcctgctgggttcaagcgattctcctgcctcagcctcctgagtagatgggattacaggcgcccaccatgcccagctaa

SEQ ID NO: 34022 - DNA, 201 bp, Homo sapiens
cagtaacacctgtttgtggtagaccaacaatggcgccctaaaagatatatccgcatcaaatccctgggacctatgtgtgtgaccttatttggaagaggggtttttttttgcagatgcaattaggaatcttgagatgcagagaacatcctgtgctatccaggtgggccttaaatgcaatgacaactgtcttcataagagacg

SEQ ID NO: 34023 - DNA, 201 bp, Homo sapiens
acagctatgttcagttgtgccccatcccctcccctgttctgtggcctgcggtgctgagaactgcgagcagccaatgggactgctgcttactgtgaggtccrtgcagtgtccacccccgcttcctgccctgagactgcctccaggcctggcacgtcttcctaagacaggcctatcaacccagtggatccttctgccccttcc

SEQ ID NO: 34024 - DNA, 201 bp, Homo sapiens
ggctggtctcaaactcctgacctcaggtgatccacccgcctcggccacccaaagtgctgggattacaggcgtgagccactgctcctggccaaaaacaatamcttctttaaagccttgtagagatcccaacgtgagatgggtgtgatatatatttttaagagaacacaataaatagcactccattacttgcctgagttctga

SEQ ID NO: 34025 - DNA, 201 bp, Homo sapiens
cagatgcaattaggaatcttgagatgcagagaacatcctgtgctatccaggtgggccttaaatgcaatgacaactgtcttcataagagacgtatagggagmtctgacagatagaaggggagaaggcaatgcgatcaccactaggtagaggttagagggatgcacccctaagtcagggaatgccagcagctgccagaagctt

SEQ ID NO: 34026 - DNA, 201 bp, Homo sapiens
catgaacttgcaatttggtttgcctagatcctggaagtctacagagttagaatctttcctggttctgaactcagaagcagcagtgagcagtgggactgctrggacctttaccagcaatcacccaccacatgcaccagcttcaagcagctctgcagaagccgtccgtcaccctccccgttgcacaccttggctgtgaaccgc

SEQ ID NO: 34027 - DNA, 201 bp, Homo sapiens
ctcctggcctcaagtaatcctcctgctttggcctcccaaagtgctggaaatataggcataagccactacacctggcctcaagaagtaatttttaaataatrtttttcataagaagttgagccatgttactgaaatgatgacatgctgaatggtgcattgcagcattgcatagtgaaattgaggggacttgactaagttggg

SEQ ID NO: 34028 - DNA, 201 bp, Homo sapiens
gtatagggagatctgacagatagaaggggagaaggcaatgcgatcaccactaggtagaggttagagggatgcacccctaagtcagggaatgccagcagctrccagaagcttaaagaggcaaaggatgaattgtcccctagagcctccaaagggagtgtggcactgcttatgccttggctttggacttctggcctccagaac

SEQ ID NO: 34029 - DNA, 201 bp, Homo sapiens
tcctggaagtctacagagttagaatctttcctggttctgaactcagaagcagcagtgagcagtgggactgctgggacctttaccagcaatcacccaccacrtgcaccagcttcaagcagctctgcagaagccgtccgtcaccctccccgttgcacaccttggctgtgaaccgccagggcaggggcatgtgtgggaagcagg

SEQ ID NO: 34030 - DNA, 201 bp, Homo sapiens
tatggctcttcttcagccctgggagcaggggagtgcagacttttgttcaacccctttcacagatgtgcacactgaagtcccagtgtgtccagtgacttgcycaaggtcatcagcactgtctggtggagctgggactcgaacccagtcctcctgctctcagctgtgggaaatggagacagcagttgccctggaagatgtttc

SEQ ID NO: 34031 - DNA, 201 bp, Homo sapiens
ccatcaggtcccaaaatgttcagagttgggttagtatctgtggctttcaccaggtaaacacatcagtgttcttcctaatttggactgttgtggcttccctrgttcttttttcccctagattgttataaaggttctgtattagttttccagggctgttataataaagtgccacaaattgggtggcttaaacaacaacaattt

SEQ ID NO: 34032 - DNA, 201 bp, Homo sapiens
ttatctttgtgcccactcagccatcaccacttccaacacacacccacacctgtggagagaatgcagcctcctagagctcatgtcatggcaggactgagggmagtagtcagttcttggtgctctctaatagggctctgaattgcagcctgggccgtgcccattcatttatgtattgtctatagctgcttctgtgttacaaga

SEQ ID NO: 34033 - DNA, 201 bp, Homo sapiens
tttgccagctcctgcactagaggataaagattaacaggattgactccacatagaggagaggagaggaaggggcaaggatggaagcaaggagggagaagggktagagagaaagaaagagggaggggggtcactcagagacttcacaaagtatgttatttcctaaaaactgtaatgcccagtatctagtgattacctgtggca

SEQ ID NO: 34034 - DNA, 201 bp, Homo sapiens
cagcttctccctatgtctcttcacatcatcttctttctacatatgtctgccggtgtgtccaaatttccccttttcataaggacaccaatcatgttggaatrgggcctaccctaatgacataagttgatgacttctgaaaggaccctgactcagaaatatcctgaggtactgggggttaggacttcaatatatctttctggg

SEQ ID NO: 34035 - DNA, 201 bp, Homo sapiens
tagaggagaggagaggaaggggcaaggatggaagcaaggagggagaagggttagagagaaagaaagagggaggggggtcactcagagacttcacaaagtaygttatttcctaaaaactgtaatgcccagtatctagtgattacctgtggcactgtcagccttctgcctgggaacaggaatcttgcaaagatcaaatgcagg

SEQ ID NO: 34036 - DNA, 201 bp, Homo sapiens
ggagttcaaaatgtcaacagagctgcccccagtcctgtctgtgtttttgcttaggacccagtgttgtgtcactactccccattgataataaacaaaacatkcctcatatgttcacagttatttagagtttacagaattctctccttctatcaatttgtttgtgcctgaaggagcaggaaaggtattattttctgcatttta

SEQ ID NO: 34037 - DNA, 201 bp, Homo sapiens
catgtatatcttactttgtaaaataatcccctctatgaacatgtaagactactgttcacaatttggacattttcctttcaaacacatttttcatgaatatrttataggaaagttaaaaccatctctattctaaaaggaaaatctaccattttgctcagagagaaagttactgagtttgtctatgtgattttaagtagtatt

SEQ ID NO: 34038 - DNA, 201 bp, Homo sapiens
agtatgttatttcctaaaaactgtaatgcccagtatctagtgattacctgtggcactgtcagccttctgcctgggaacaggaatcttgcaaagatcaaatrcagggcccagagccccaggactctgcattggcattcgtcagtaagttttgaaggaggcagacatctcaaaaccatcctaagcataaggcacccagctggt

SEQ ID NO: 34039 - DNA, 201 bp, Homo sapiens
tttgttcaagatcatccaggctgtggccggagcccacatcatccatgtctctatgtcagctgtctttccactgctccaagccacctgccctgctgccctcygtttcccctccaggtcactgttgtgcggaccatgcaacccgagtctcaaagactcacggatccccttgctgtgctctaggacccagtcctagcacctcct

SEQ ID NO: 34040 - DNA, 201 bp, Homo sapiens
tgctgccctccgtttcccctccaggtcactgttgtgcggaccatgcaacccgagtctcaaagactcacggatccccttgctgtgctctaggacccagtccyagcacctcctaacctccccaagagggcaaaaagcagcctaggtctggtgagggtggccaaggccagaggattctgttagtatgcagatcaaaggaggagc

SEQ ID NO: 34041 - DNA, 201 bp, Homo sapiens
ctccccaagagggcaaaaagcagcctaggtctggtgagggtggccaaggccagaggattctgttagtatgcagatcaaaggaggagcatgggcaaagtgasaaggtttgtgatggagcagaacagtgtcaggaagtgatgtgaagctcagcgtggctcgtggatgttgagaagtgaggttgatgggcagggggtgctggac

SEQ ID NO: 34042 - DNA, 201 bp, Homo sapiens
tccccaagagggcaaaaagcagcctaggtctggtgagggtggccaaggccagaggattctgttagtatgcagatcaaaggaggagcatgggcaaagtgacraggtttgtgatggagcagaacagtgtcaggaagtgatgtgaagctcagcgtggctcgtggatgttgagaagtgaggttgatgggcagggggtgctggacc

SEQ ID NO: 34043 - DNA, 201 bp, Homo sapiens
ttggtggagagtggtgtgatggctgatttatttgtcttgtttgtttgttgtttcatttttccattttactagtgtgatttcagaatcacaaggaggcaagraggaaaattgattttagatagcagcttcagaatgaaaaatgagtggaaattccacttttcggtctagaccagggaccagcaaacaatagcccgtgggcca

SEQ ID NO: 34044 - DNA, 201 bp, Homo sapiens
tgagtggaaattccacttttcggtctagaccagggaccagcaaacaatagcccgtgggccaaattcagcctgcagcctcttttcataaggcctatgagcastgcctggtttttatatttttacaaatttgaaaaaattcaaaaaaggatcttttatgactcatgagatttgtatgaaattcaaatgtcagcatccataaat

SEQ ID NO: 34045 - DNA, 201 bp, Homo sapiens
atagcccgtgggccaaattcagcctgcagcctcttttcataaggcctatgagcagtgcctggtttttatatttttacaaatttgaaaaaattcaaaaaagkatcttttatgactcatgagatttgtatgaaattcaaatgtcagcatccataaataaacttttaccagagcataaccatgcccattcatgtatgtgttgtc

SEQ ID NO: 34046 - DNA, 201 bp, Homo sapiens
caaattcagcctgcagcctcttttcataaggcctatgagcagtgcctggtttttatatttttacaaatttgaaaaaattcaaaaaaggatcttttatgacwcatgagatttgtatgaaattcaaatgtcagcatccataaataaacttttaccagagcataaccatgcccattcatgtatgtgttgtctatggctaagttt

SEQ ID NO: 34047 - DNA, 201 bp, Homo sapiens
aagggcgcgctttggactgaggatttgaatgtggaagattggcttaaaaaaagatgcttgctgctgggctttggggaaggactaaacagaggcttggggtsgggggacgactccaggaatattatgaccgaatgctcaggcatacgttggcttcatagcctggagaaccaagagaagggtgacctgaacggtggctgccat

SEQ ID NO: 34048 - DNA, 201 bp, Homo sapiens
gagcggatccccagccgtccctgggcgttctcccgggttctagcaaagccccccggggtgcccatcagtttccttgggtgactacagcgtgtgttttttcyttcctctttcccctgcctgtgtgcccttctccaggatggcagaggcggaattgcacaaggaaaggctgcaagccatagcagtaagtccactttcatttta

SEQ ID NO: 34049 - DNA, 201 bp, Homo sapiens
tactggctgtgagatgaatgcataaccagaacctcccattcccctttttccagcgtctctcctatctcccagcagtgctttatcactttctcctctcaagytgataaagagaaaggaagaaagaaacagagaagtcggtttatgttcataattaacatccatgaactctgcataattttttcccctctctttacaggtcct

SEQ ID NO: 34050 - DNA, 201 bp, Homo sapiens
ggctgtgagatgaatgcataaccagaacctcccattcccctttttccagcgtctctcctatctcccagcagtgctttatcactttctcctctcaagttgayaaagagaaaggaagaaagaaacagagaagtcggtttatgttcataattaacatccatgaactctgcataattttttcccctctctttacaggtcctcgag

SEQ ID NO: 34051 - DNA, 201 bp, Homo sapiens
cacttacattagatttaacttactttttaattctggtcccgtaaggtggaagattagataattgattttaaacttatcttctctaatattgatattctacrctataaattctctctagtcgttagtttagctgcctctcataattgtaacacactgtgttatcattttcattcagttttaaatattttccaaattcctttg

SEQ ID NO: 34052 - DNA, 201 bp, Homo sapiens
acaaagaaaggctaacatcattgatgtcatcaagagcactcatgtttcagcaagaaaaaaaagcccagtagccaaattttaaaagtgggcaaaggacacartcagttcattgaaatggaaataaaaatagctttaaaacatattgaaaaatattcagaacttctcatagtaagagaaatgtgaattaaagttgcaacaaga

SEQ ID NO: 34053 - DNA, 201 bp, Homo sapiens
catgagaccagggtatataacagcccccagtggccttacccttcacctgcatgtgtgctacattttttttttttttttttttttgagacggagtttcgctyttgtcacccagcctggagtgcaatggcgtgatctcagcttgcagcaacctccgcctctcgggttcaagcgattcttgtgcctcagcctcctgagtagctg

SEQ ID NO: 34054 - DNA, 201 bp, Homo sapiens
ccacgcctggctaatattttgtatttttagtagagacagagtttcggcatattggccaggctggtcttgaacccctgacctcaagtgatctgccagcctcrgtctctcaaagtattgggattataggcgtgagccaccacacccagccgggttgctaatctttgaggcaggcaacacacatccaaaatgctttaccctacc

SEQ ID NO: 34055 - DNA, 201 bp, Homo sapiens
ctcatcgtggcagctattttattttctctcacaaaactcccttttgctaacataccctcttacaattttttgacatatttcaatttccccatggtagcacrtagtgcctcatatgcctgcatttaatctgcccccatgttttcaattctatagctctgcccatcacccaggaggactagtacctttaacacattagccttc

SEQ ID NO: 34056 - DNA, 201 bp, Homo sapiens
ttgtcctatgttgctcaggctagtcttgaactcctgggctcaagcaatcctcctgccccggtcttgctgggattataggtgtgagccaccatgcccagtcttttttttttttttttaatttataaagaaatacatggtgtggtggttcatgactgcaatctcagtgctttgaggacagaggtggtaggaagtcttgatgag

SEQ ID NO: 34057 - DNA, 201 bp, Homo sapiens
gcttccggtgaggcctcaggaagctttcagtcatggagaaaggtgaagcagaaggctggcaagttgtatggtgggagcaggagcaagagcaaggggtggcgggggtgtcacagactttaaacaaccagatctcaggggaactcactcactattgcgagtgaacaccaaggccccatccccaggattcacccccaggaccaa

SEQ ID NO: 34058 - DNA, 201 bp, Homo sapiens
gaagtagcgtctacctgtcatcttagctttatctttctctgtatttactcaaaatagaatctttaaatctacaggggtttgttgttgtttatttctacagwtgtatttgtaaccttttattgattaaacaattgtaagaaatggagtattcaatacaatttccttttatagtcactggaaactctgcgtgctttaatagag

SEQ ID NO: 34059 - DNA, 201 bp, Homo sapiens
gatattttctcccattctgtaggttgtctgtttactctgttggtagtttccttttgctgtgcaaaagccctttggtttaattaggtcccagttgccagacsgacagctttgaattctggtcttaacacttcataactgggggatctaggggcaagttacctaacctctctcagcctcagtgtcctcatctgtaatggaggg

SEQ ID NO: 34060 - DNA, 201 bp, Homo sapiens
ttgatgaggtagttcatttaaagcactcagaactgcgcgtggcacctgtaaacactcccacccccagtaccttttcacaagtactattaggatgatgctgtttagcagcaattatcagcacctctcatctcaagttatattgctagtgacaaaacctttggcatttcagtgtatagctttccaatcttttccataactgta

SEQ ID NO: 34061 - DNA, 201 bp, Homo sapiens
ggctgtaaatatattccttggagcttgggagccccatggctatgttccaggccagagagtccaaagaaaatcaaagactgccacctaacagcttttttggycatcctgaaagtccccaccttctcccaggtagctccagagatagacaactcccagccaggctctgacagctgaatcgaatggcccagtggtggcacattc

SEQ ID NO: 34062 - DNA, 201 bp, Homo sapiens
tgttccaggccagagagtccaaagaaaatcaaagactgccacctaacagcttttttggccatcctgaaagtccccaccttctcccaggtagctccagagawagacaactcccagccaggctctgacagctgaatcgaatggcccagtggtggcacattccccagagggcttcaggttcaggatgcagccaagtttcctgct

SEQ ID NO: 34063 - DNA, 201 bp, Homo sapiens
tcatgccagaagaagtgactccactagtttgttgtgtgactcagattgatgattggatactaggtgatgaaaaatataatttttaacttctctggtagaartcatgctggtggcatgctggaatcctaaaaccttaaagcaaataaaatccactgagagccaagatgtggtaaggaaggagaaatcttctaattctttcca

SEQ ID NO: 34064 - DNA, 201 bp, Homo sapiens; identical to SEQ ID NO: 8736

SEQ ID NO: 34065 - DNA, 201 bp, Homo sapiens; identical to SEQ ID NO: 8723

SEQ ID NO: 34066 - DNA, 201 bp, Homo sapiens; identical to SEQ ID NO: 8726

SEQ ID NO: 34067 - DNA, 201 bp, Homo sapiens
ctggataataccctgaagagtgttttacaacttggttccattctccccatcactttctggtacaccaatcaaatgtagtttggtcttttcacatagtcccrtatttcttggaagctttgtttgttcctttttgctcttttttctctaactttatcacttcatttcattaatttgatcttcagtcactgataccctttcttc

SEQ ID NO: 34068 - DNA, 201 bp, Homo sapiens; identical to SEQ ID NO: 8727

SEQ ID NO: 34069 - DNA, 201 bp, Homo sapiens
tcttttctttaagaatgttgaatattggtccccactctcttctggcttgtagagtttctgctaagagatctgctgttagtctgatgggcttccctttgtgkgtaactcaacctttctctctggctgcccttaacactttttccttcatttcaaccttggtgaatctgacaattatgtgtgttggggttgctcttcttgagg

SEQ ID NO: 34070 - DNA, 201 bp, Homo sapiens
agaagctagtgactgaaagcagcaggtgccatgtagaatccagtctggttgtggtggtggcagctgatgccttcagttttcagaagcagcaattgcagggytcccggtggaggcaaccagtgcccagcatctgccgggtcagcagagcaggctcctgtactgcgttcagtggtggggctgttgtgtttcctccagaccagc

SEQ ID NO: 34071 - DNA, 201 bp, Homo sapiens
caaataatcacgaggaccttcccctccctggagaaatagattgaaacctcttcccctccctggagaaatagatccaagcctctccactgccatcttgtcaracatatttacattgctcaactgacttgggaagaaaacaaatttccagtatgagactctctggtgggccaagctgtttctcaaggagcattgagaaataat

SEQ ID NO: 34072 - DNA, 201 bp, Homo sapiens
tgagacttgtgatgatatggatttttttaaaataaatcagctactatatcatactagagcagaaggaatttaatatttccttctgtcccttggttgaattrccagagatttgtctattttattggtctgttcaaagtcccagcacagagtaggcactgagtacctactgcaacatgaattccttggagactgtcatattta

SEQ ID NO: 34073 - DNA, 201 bp, Homo sapiens
tggttgaattgccagagatttgtctattttattggtctgttcaaagtcccagcacagagtaggcactgagtacctactgcaacatgaattccttggagacygtcatatttacaaaggtttgcctgacagagttggccctgtcagaatcaaattgctaataccacgtcttcaatacataaactgcctttgaattacttattc

SEQ ID NO: 34074 - DNA, 201 bp, Homo sapiens
gaggcaggagactcgcttgaacccgggaggtggaggttgcggtgagccgagatcgcgccattgcactccagcctgggcaacaggaatgaaactcggtctcaaaaaaaaaaaaaaaaaaaaaaaaatcgaacaattagctggatgcttgtagtctcagctactcaggaggctaaagaggatcacctgagcccaggactttgg

SEQ ID NO: 34075 - DNA, 201 bp, Homo sapiens
cttagcccatgacagggaatcacagattccaaatgagtgccctcagaatgactggtttccttgaaagcagctgtttcataaacatgactttgcgggggcakctcaggccttccatgcagtggagtctgctggtcttggggctgctctgttaagcaaaggatgggaaccaaaggtactgacattttaatattagccacacag

SEQ ID NO: 34076 - DNA, 201 bp, Homo sapiens
gcccccaattaaagcataagtaagatactcaaaatctcattcctattcctattccactagcagttactgagcactgattaaatgccctgaactgtgccaattttttttttttttttgtaagacagagtcttactctgtcacccaggctggagtgcagtggcacgatctcggctcactgcaacctccgcctcccgggttcaa

SEQ ID NO: 34077 - DNA, 201 bp, Homo sapiens
acagcactccctcctcattttttaaataagatgaacaaaggcagcaagccctttgaccctcatcattatacaaattgtagtgtacctctgacatggagaarctggagagaagacagggcaggttagagagtatgctctgtgctttgtggttagagacaaagggatgataagtgtgagaggccattggtataaacttttggc

SEQ ID NO: 34078 - DNA, 201 bp, Homo sapiens
tcacaagcagcaagcagctcaagggactggttacagaattgtctggggtttaaataccctttagagatttcccattggttacttggtgtatgccctatgtaatgaagtagtggctcatgattagtctgattggttgcaggaggggaccaatcagaggctgaagttacaaagctacaccctatgcaaacatctgattgtgga

SEQ ID NO: 34079 - DNA, 201 bp, Homo sapiens
ataagtgtgagaggccattggtataaacttttggcagcaacaggaagtagaagagtttttaaaatcttgtgcatcaaaaataagacattgcactgaaaacrtaagtcttatgttcctattggttcatatgcactctagttcatgcttttgtatattattggctgagaactgaagcaaaatataaatgcttactcataaaga

SEQ ID NO: 34080 - DNA, 201 bp, Homo sapiens
ctcagccaagcacatggtgctggcaggacacttggagctgtccctataccagcagcaatcttttgtcttgcttatttaattaccttatcctaaagtacgtstttactagaaatttgctgtcctcagtgagaagcagtacctttcccttgttccctgctgaaccaccagggtcactaccagcagatcagagccacttccctg

SEQ ID NO: 34081 - DNA, 201 bp, Homo sapiens
cacgcctgtaatctcagcactttgggaggctgaggagggtggatcgcttgaggtcaggagtttgagactagcctggtaaacatggtgaaaccccatctctrctgaaaatacaaaaattagccaggcttggtagcatatgcctgtaaccccagctacttgggaggctgaggcaggagaatcgcttgaacccgggaggcagag

SEQ ID NO: 34082 - DNA, 201 bp, Homo sapiens
aagaagggaagtacagtgttgattcttcatgggagactgatggaattataatagacttctgttcttaaggtagaaaattatcatttttttaacctgaaaakatagagtaatagtctatgataaggacaaattaccccaatatgtttttaaaacattgcaattattaacaaagtggtagtttctttcatttaaaaccccctt

SEQ ID NO: 34083 - DNA, 201 bp, Homo sapiens
aggaagagatccgagcagctcaggaaagggaagaggagctgaagaggcagagacaagtcttgcagagtacgcagagccccaggacaaagaatgccccatcrctgccctccagaacatgctacaaaactgctccaggtaagtgaggtgcctcacatgagagacagatgccacagcagtctgttgttgttgattccagctcat

SEQ ID NO: 34084 - DNA, 201 bp, Homo sapiens
cacgacagctatgttcagttgtgccccatcccctcccctgttctgtggcctgcggtgctgagaactgcgagcagccaatgggactgctgcttactgtgagrtccatgcagtgtccacccccgcttcctgccctgagactgcctccaggcctggcacgtcttcctaagacaggcctatcaacccagtggatccttctgcccc

SEQ ID NO: 34085 - DNA, 201 bp, Homo sapiens
tatcaagctagtacataaaattgtttgaaaactgaatcagatgtttatgtaattcataaaaacatataatttccctctaatatttcatttttcctaattayaaaaataatgcatgcttattatagaaatgtagacataaaaaactatgaaaagaagaaaagaaaactcaatccaaatcttaccactcagaaatgacgtgcc

SEQ ID NO: 34086 - DNA, 201 bp, Homo sapiens
cccaactgctgcctcatctgcagtagttcctttcagatgaaaagttaaaatgggagagaaatattttgcatttgctcttttcattagactattcgatttcyatgtaaatgtcttctacagggattgaaagaaatgaatatattggttcaccagacattgctgaaggttccaacacagccttgacctatttttgtttgaaat

SEQ ID NO: 34087 - DNA, 201 bp, Homo sapiens
aaatattatttctatggcaaataagcagcccttccttataatgctgaaatcatagaagttagttgttttcccctcattttttgacaatcattctttttgcrgtagtaacgaaatcaagcagttttcatttggctttttggtagttgaagttaatttgtcaatttcctgctagtcttctattacgtacacatttttctggtt

SEQ ID NO: 34088 - DNA, 201 bp, Homo sapiens
agctacaccctatgcaaacatctgattgtggaaagcaaccaatcagaggctgcagtgaagttacaaagttatacttctatgcaaatgaagatttggcccamggccaacctgattggttgtgggaagggagcaatcagacataatttcaatttttcatctgccacacaagaaaagggtgggggatttgcaaagggagtagtt

SEQ ID NO: 34089 - DNA, 201 bp, Homo sapiens
cagatgaaaagttaaaatgggagagaaatattttgcatttgctcttttcattagactattcgatttctatgtaaatgtcttctacagggattgaaagaaaygaatatattggttcaccagacattgctgaaggttccaacacagccttgacctatttttgtttgaaattgagaaatgctcacaaatgtaagaggcctcctt

SEQ ID NO: 34090 - DNA, 201 bp, Homo sapiens
tttctatggcaaataagcagcccttccttataatgctgaaatcatagaagttagttgttttcccctcattttttgacaatcattctttttgcggtagtaaygaaatcaagcagttttcatttggctttttggtagttgaagttaatttgtcaatttcctgctagtcttctattacgtacacatttttctggttagctgaca

SEQ ID NO: 34091 - DNA, 201 bp, Homo sapiens
aatttttttggcaaagattttatatatttgtagttatgctctctataaattttgcatcaagcttttttcatttcacattttcataaataatttctcatgcygttataaactcttcataaacataattttaattggctacgtaattgttttttaggagtacatttggctgcaagtgcctgaaaacctgggaagaaacagctt

SEQ ID NO: 34092 - DNA, 201 bp, Homo sapiens
accattctgcctacctgtacagaaagtgctggatttttccaccacaaggggcttatcaatgtggtgtcataaagcgggtcttactttctcatcagagcccrtatcagaccacttcccttcttggtctttagaggaaaccaaagtgaagcactcctagcaaagaatttgatgttatgaccatcaaagcaaaagtatagctct

SEQ ID NO: 34093 - DNA, 201 bp, Homo sapiens
ctataaaggaccctaaatggaaactctgctgtgttgtgcatttgacttggcactaataggccagatatattaactgttgggtgaaattaatgataatattkcatctaaattctatgggatgtttcttaaggttttgggtgttaaattaccccttctaaaatccagtattgaggctcgaactaatcaatgtcttctttttct

SEQ ID NO: 34094 - DNA, 201 bp, Homo sapiens
ctatgaagtcatgtgtgataaataaacatgcatctgagtttatgtaattcagccaagaaatattttttgaacattttctatgttatagatatatttgtggrtgctgagaatgttcatggtaaatacaagacagtctctgccctcacggagcttgcattctggtgggagactagggaagaataatttatgaataaactattg

SEQ ID NO: 34095 - DNA, 201 bp, Homo sapiens
ttaacaacaatatattttagattttaacatagctggaagagaggactaaaaatgttcccaacacaaagaaatgataaatacacgagatggtggatgtcctraacaccctggttattatacatcctatgcatgtaacaaaatattacaggtacccaacaaatgtgtacaaatatcatatgtcaataaaacaattaaaagtaa

SEQ ID NO: 34096 - DNA, 201 bp, Homo sapiens
tatgaagtcatgtgtgataaataaacatgcatctgagtttatgtaattcagccaagaaatattttttgaacattttctatgttatagatatatttgtggaygctgagaatgttcatggtaaatacaagacagtctctgccctcacggagcttgcattctggtgggagactagggaagaataatttatgaataaactattga

SEQ ID NO: 34097 - DNA, 201 bp, Homo sapiens
tcagtttttagacagactatttttcttttttttcccctcagatgtataaatagcattgaatctgcagtagtgttagaaaggtaattataacccaaccatgyctgagatgacattgtgatttcttaatagaaaaagcttgttgggtccccacttgcaagttgatttttcataatttaattctcaaaatgtcaccttatttct

SEQ ID NO: 34098 - DNA, 201 bp, Homo sapiens
ggagagtggtaggtgatgtgaccaaagaggtggtggctggggctggattatgaaggcatctatataccgtggtaaggatgttggcctttacttgacatgasatcagaatccagtggaagatttggagcacaagaattgcacaatctgacctattttttaaaaagattactctggctgatgtggtgagctgagttagtaagg

SEQ ID NO: 34099 - DNA, 201 bp, Homo sapiens
ttctcgcagtttttcagtactttacctctttctctgattcttcatttcaaaagcctaggaatcctctggcaaaaagtcacttaaaaggtttggggcaaggraacaagattccctttagctcacatggaaggaagtcaaagctgaattatcttcatctagcaatagaaagaataaagattgcaacgtttacaatttaatata

SEQ ID NO: 34100 - DNA, 201 bp, Homo sapiens
ggcagctctctgggaccttttttttttttttgtctgaaagaattccaatattatgagcatgtaatataaacaaaggtagtgctttaatctattgggaaaakgatgaatgatttaatcactagcaatgacatggagggagaaaatcaatatgaaccaatggagcctcttttataaaggcactaattcaccccctgatatggt

SEQ ID NO: 34101 - DNA, 201 bp, Homo sapiens
ttatatattcacaaatatatggtttggaattataacttatctttaaaagggaagcagagcataaaagttcaaaaaatttaaagcctgatgttgcgatagaraagaaaatctcattttctgaagagaaattcaagccagctgcagaaatttgcataagtaacaagaaagccaaatgttaatcaccaaaacaatggggaaaat

SEQ ID NO: 34102 - DNA, 201 bp, Homo sapiens
tcgagtgcacaaatagagaggctgttcttgtgcaggagtgatagcagagcccacagaatgagtgcaggtgtgcgggagcctgtggtggcttggtctgtggrtgaaccttctgactgcttccgttttctcagtgaaatgggaagcaaggtcatcagctggcagggaggaagggggaagaggtgttggaaatttgaggagaga

SEQ ID NO: 34103 - DNA, 201 bp, Homo sapiens
aatgtaaaatacaattttcttcctgttcatgcctggaaatctttggagtattgcttggctggccaacctccaagttcatgatcggggagaaggctgacacrtgactctgagcagccaaactagacaattcatggctagggtcagaactcctggcttcagtggttttgtgaatggaggtgttaccaagttcctgcggcacat

SEQ ID NO: 34104 - DNA, 201 bp, Homo sapiens
gctggagtgcagtggcatgatctcagcccactgcaacctctgccccccaggttctagtgattcttctgtctcagcctcccaagtagctgggattacaggcrcatgccatcacacctggttaattttgtatttttagttgacatggggtttctctatgttggtcaggctagtcgcgaactcctgacctcaggtgatacgcct

SEQ ID NO: 34105 - DNA, 201 bp, Homo sapiens
cacatgccatcacacctggttaattttgtatttttagttgacatggggtttctctatgttggtcaggctagtcgcgaactcctgacctcaggtgatacgcytgccttggcctcccaaagtgttgggattacaggcgcgagccactgtgcccagcccagtgttggttatttttaaagactcatcagttcataataaaatgcc

SEQ ID NO: 34106 - DNA, 201 bp, Homo sapiens
ggggtttctctatgttggtcaggctagtcgcgaactcctgacctcaggtgatacgcctgccttggcctcccaaagtgttgggattacaggcgcgagccacygtgcccagcccagtgttggttatttttaaagactcatcagttcataataaaatgcccttaatgccgcatacaaatgagagtctatggaattgtgcatcct

SEQ ID NO: 34107 - DNA, 201 bp, Homo sapiens
gtcaagtgatttgcccaagaccatagagactataaatgagggagcctgagagaaactcctgggctgtctgctttcaaagaccgagctctttccaggccacygttctctttgaaagaaatgtttcctttggaataattcatttagtgagatgccagttaccatcattgctgtctctcttactctaaatatattgtgatggac

SEQ ID NO: 34108 - DNA, 201 bp, Homo sapiens
gaaaggcttgtgtggacagaatgagggtgagttatttgccttgaatactgaaaaaggaaagctcagaggttccaaaggtggcagtggttgtctagtactayctgcagagagacccccagctttgggaggtcctgaatttctgtatgctggtgaggtggggtcagtggtaaggtgaggagggtcctcaggccacagtgaggc

SEQ ID NO: 34109 - DNA, 201 bp, Homo sapiens
gtttccaaaaccgttccagttctgctctaataatgggggacggggaaaaagagggtgcctccttcctcagtttgccatcttctttttccagcttccaaaarcatactcgaggaaagccattggaaacctgtcaagctgttccctagtactgaaagacagtttgtgacaaaacaggcttttctgcgcccttgggctttctgt

SEQ ID NO: 34110 - DNA, 201 bp, Homo sapiens
gctacaccctatgcaaacatctgattgtggaaagcaaccaatcagaggctgcagtgaagttacaaagttatacttctatgcaaatgaagatttggcccaargccaacctgattggttgtgggaagggagcaatcagacataatttcaatttttcatctgccacacaagaaaagggtgggggatttgcaaagggagtagttc

SEQ ID NO: 34111 - DNA, 201 bp, Homo sapiens
caccctatgcaaacatctgattgtggaaagcaaccaatcagaggctgcagtgaagttacaaagttatacttctatgcaaatgaagatttggcccaaggccwacctgattggttgtgggaagggagcaatcagacataatttcaatttttcatctgccacacaagaaaagggtgggggatttgcaaagggagtagttctggt

SEQ ID NO: 34112 - DNA, 201 bp, Homo sapiens
ccctatgcaaacatctgattgtggaaagcaaccaatcagaggctgcagtgaagttacaaagttatacttctatgcaaatgaagatttggcccaaggccaamctgattggttgtgggaagggagcaatcagacataatttcaatttttcatctgccacacaagaaaagggtgggggatttgcaaagggagtagttctggtcc

SEQ ID NO: 34113 - DNA, 201 bp, Homo sapiens
aggcaggaaaatcacttgaacccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttaggg

SEQ ID NO: 34114 - DNA, 201 bp, Homo sapiens
gtgactcacgcctgtaatcccagcacgttgggaggctgaggtgggcggatcacctgaggtcgggagttcgagatcaccctgaccaacatggagaaaccccrtctctactaaaaatacaaaattagccaggtgtggtggcgcgtgcctgtaatcccagctacttgggaggctgaggcaggagaatcacttgaacctgggagg

SEQ ID NO: 34115 - DNA, 201 bp, Homo sapiens
tctcgcagtttttcagtactttacctctttctctgattcttcatttcaaaagcctaggaatcctctggcaaaaagtcacttaaaaggtttggggcaaggamacaagattccctttagctcacatggaaggaagtcaaagctgaattatcttcatctagcaatagaaagaataaagattgcaacgtttacaatttaatatat

SEQ ID NO: 34116 - DNA, 201 bp, Homo sapiens
gagatgatataggaatctctgctctagtggtgggtctgaggtttgctctagtggtgggtctgaggttttctctactgagggcaaaattggagctttttttwaaaaaaaaaaaaaatttaatttttttttgagacagggtctccttctgttgcccaggctggagtgtagtggtaccatcacagctcactgcagcctccatct

SEQ ID NO: 34117 - DNA, 201 bp, Homo sapiens
agaattagccttttcaactctttcctcatatgcatagcaacagtaatttatttcatgtgggttaatgtctttagcattaggacacttctggttttatggaytgatggccaatgtgtttttaataatgtattttgcttctattgaagtcatgagtacaaattcgtaattcatttgaatgagggatatggacaaacaggaaca

SEQ ID NO: 34118 - DNA, 201 bp, Homo sapiens
tgttttttgtcaaatgaagcagcagtgcacatcgattattgttagaggaagcaataagaacaaaactaagaggacatgaaccagccgggaagatcaggagwctgcaagtagtctttgaggttggatcatggtagggggccatggcttgagatgaagctgtgaaatagacaggagcctcactggctatgctagggaacctgc

SEQ ID NO: 34119 - DNA, 201 bp, Homo sapiens
gaggctaggagtgcagcactgagagagcagtggccactgccttacaaggccaagaagcgtcccatctccccaacaactgtcaggttccttcctgccctggraacagctctaatctgtctgtttaccacctacctgccagccttcagcaggaattccaggactgctgggcctatcagctgaagtagaggatgaaaaagaaca

SEQ ID NO: 34120 - DNA, 201 bp, Homo sapiens
agagttactggttttgtcctggttaagggaaggagaaatctggaaaccagtgggctatcccggtgaggagcacagctcagacctcagccatcaaacaagtrtcagaaactgcaagtgagttccttaatggtgtcctatgcaaacttgttgtcgtttgactcatatctaattctgagcgtaggctggttgcctcttgtccac

SEQ ID NO: 34121 - DNA, 201 bp, Homo sapiens
gtgagaggctagagttatctcagcaggggtttcgttttgttttgttttgttttgttttgtttttgagacagtctcactctgtcgcccaggctgaaatgcaytggtgtgatcttagctcactgcaacctctgcctcctgggttcaagtgattctctcgtgccttagcctccagagtagctgggattacagttgtgtgccacc

SEQ ID NO: 34122 - DNA, 201 bp, Homo sapiens
ttaaatgtaggacaactacatatcttgatagccagtgggaatgactgacaaagtccagtaagtctactcttgagagattctagaatgtagagatagcagcyggaccaggaagccctagctttatcatgtgccatctctgagatgctggatgtgggctgttcccactgtgcctcacttttcccatccactgtcatatatttt

SEQ ID NO: 34123 - DNA, 201 bp, Homo sapiens
ctgacaaagtccagtaagtctactcttgagagattctagaatgtagagatagcagctggaccaggaagccctagctttatcatgtgccatctctgagatgstggatgtgggctgttcccactgtgcctcacttttcccatccactgtcatatattttatggtcttgcacacactctgggattaagtaacatcaattatgca

SEQ ID NO: 34124 - DNA, 201 bp, Homo sapiens
taagattatgagctaatattttgtaaggtctgggcattgcacagaaaaccttggttgtaatacacattattattacattgatttgaatagcaatggtacartcatagccccggaaacatagcgactacataaaataaaagcttccgttaacactgagcacagcagccaggcttccgcattgttgttgtccctaggatttgg

SEQ ID NO: 34125 - DNA, 201 bp, Homo sapiens
tgagacaggagaatcgcttgaacccaggaggcagaggtttcagtgagccgagatcgcgctactgcactccagcctgggtgacagagtgagactcagtctcaaaaaaaaaaaaaaagaaagaaagaaaatactgtaggccttgcaggccatatggtctctgttataactacatttctcaactttgctgctcaaacttgaaaa

SEQ ID NO: 34126 - DNA, 201 bp, Homo sapiens
gctgccgccaaccaaaccagcctttttcattcaatcaggaaaccatctcttggcttttcttgtgaatttctcaaattcagggcattattacagcattccartttctgcaagcataagattacagtgtgcatgtggacagggtggagggtttgtgcgtgtgaagtgtggtggctatatatagaaattggatgagaatacttc

SEQ ID NO: 34127 - DNA, 201 bp, Homo sapiens
tcagctcactgcaagctccgcctcccaggttcacgccattctcctgcctcagcctcctgagtagctgggactacaaatgcccgccaccacgcccagctaatttttttttttttttggtatttttagtagagatggggtttcaccatgttagccaggatagtctcgatctcctgacattgtgatccacccgccttggcctcc

SEQ ID NO: 34128 - DNA, 201 bp, Homo sapiens
tgcccgccaccacgcccagctaatttttttttttttttggtatttttagtagagatggggtttcaccatgttagccaggatagtctcgatctcctgacatygtgatccacccgccttggcctcccaaagtgctgggattgcatattcatttttcgtctatgcatccattcatccatctttccatccatccatccatccatc

SEQ ID NO: 34129 - DNA, 201 bp, Homo sapiens
attaaaatactgtagttgagggaatttaggggatttgaattgcatttcctctctagaatggggtgagacagaagtggtgtccttctttcaggcatctaggkttgtttctttggggtgtgtatgtgtgtatgtttccatgtgtgtggcagcttaccaggctatgtcccaattaataaggagatgtatcatcctcattccagt

SEQ ID NO: 34130 - DNA, 201 bp, Homo sapiens
aagttattttattagttcacttacatactgctgataaagacatacctgagactgggtaatttataaagtaaaagaggtttaatggactcacaattgcacayggctgaggaggcctcacaatcatggtggagggcaaaaggcacatcttacatggcagcaagcaagagggagaattagagccaagtgaaagggatttcccct

SEQ ID NO: 34131 - DNA, 201 bp, Homo sapiens
gccccagtgagatgaaccaggtacctcagttggaaatgcagaaatcacccatcttctgcattgatcatgctaggagctgcagatcggagctgttcctattyggccatcttggaaagccctcacaaagtatctttttaaatgcagttggaggtcttttgtgcctctttttgatgaatctcaatttggaaaaacaactcttaa

SEQ ID NO: 34132 - DNA, 201 bp, Homo sapiens
gttagcagaagccttgggagtcagcagaaggctcccaatgaataaccaagctggattaccagaggaaaaaaacatagcaaaagctggacaaaggtggtgayccagagaagaatcaggcataagagccagcccaccaaagaagcacaacaggaacaaagcagttagatgtgttctgtgtgtgcaggcgacagaagcaagcaa

SEQ ID NO: 34133 - DNA, 201 bp, Homo sapiens
taaatgtttagaaaggatgttggggacctaacagcccccttcctaacagaaggaagtggtgaacatcagtctttggaaaagacagaagcgaaggcaactgyaggcatctaagtaccaggattcagtggacagttcttcaaggacccacagctggaatgaacaacctccaaccatgctcgtattctgagccactcaattgaa

SEQ ID NO: 34134 - DNA, 201 bp, Homo sapiens
attccacctgtcaaaaccttggttttgtaaactgcaaaataggaccagtaatacctatgattagctgctgctgttacgaattaagttcagtaacaagtccracatggctggcgcatgctgttttcaataaatataaattctgctcccaaccattcaacatcaaatgagttgatctgcaaaaagtgttttgaaaactacaga

SEQ ID NO: 34135 - DNA, 201 bp, Homo sapiens
agattgcctaatgctcataatttgtaatagatatgcaattgtaattgatcttggatacacatttatgatttttccctcttcaaactgaattcaaagataamattaacctagggtacatggagacctgggattaaatgttttgaagaactaagtatagctgaattagtatagcttacaagtatataaattataaagactctc

SEQ ID NO: 34136 - DNA, 201 bp, Homo sapiens
tgttgttcatcatttccatgcatggttttatacttatactacaaatgtgtatatacataaacaacaccttatttttgcatgtttgaagacattctataagyggtaaatcatgttgcagtatcttctgctcctgactttgttctgtctgcattgttttgagatgtgtccttgttgatcactgtggctctggttcattcttta

SEQ ID NO: 34137 - DNA, 201 bp, Homo sapiens
aactgaattcaaagataaaattaacctagggtacatggagacctgggattaaatgttttgaagaactaagtatagctgaattagtatagcttacaagtatrtaaattataaagactctctccctttatgtgcacccagtacccttgggaactggttattaagttcggatcacatcctatacctttaaagatgaaacaagat

SEQ ID NO: 34138 - DNA, 201 bp, Homo sapiens
ttaatttgcaaaatgttttattttctgaagccacagtgtaattcacagatgcaccaagatcaaaggtctctaagaagaagaggttgtggggaaagagcccwgtagaggtagggaggccacaatgaacccattgagttattccacctgtcaaaaccttggttttgtaaactgcaaaataggaccagtaatacctatgattag

SEQ ID NO: 34139 - DNA, 201 bp, Homo sapiens
tgagatgtgtccttgttgatcactgtggctctggttcattctttataactgctgtatggtattccattgaatgaatatatcactatttattcaatcttctrttatggaaatgtagactatttccagtttttcttaccgttagaaataatgcttttatgaatgttattatacatgtctctttatgtacctatggaagaacct

SEQ ID NO: 34140 - DNA, 201 bp, Homo sapiens
aaagaatgctaaatttcttaataaaatatcgaaagataccaaaaacaaaaattttcaacatcccaaattgagacaaatgacctattgttaccttctagaargaattttcactaattatagtcaatggagttgggtagagaaaagtagtcagggtcttaaccatgctctgcttcaggaaaagagaacagcttcacattcctt

SEQ ID NO: 34141 - DNA, 201 bp, Homo sapiens
tgcattgcactatctaaccatatcgcagaaattttgtgtcaacagagaagtaaccttgctaactagattagagtgtgttttacttctctatttaaattatwcttgttttcttgctctctgcctcccagcctcccattctctttctttccttgccaggactttgaattttttcaggttacttggccatatgctttaagtctt

SEQ ID NO: 34142 - DNA, 201 bp, Homo sapiens
taccgttagaaataatgcttttatgaatgttattatacatgtctctttatgtacctatggaagaacctgtctctatatttaggagtagaagcactggctastagcctgatacatcctaacatttactagatattgtaaattatttttcaagttggttgcattaacctgtagcataataagttttttggtctctctatttag

SEQ ID NO: 34143 - DNA, 201 bp, Homo sapiens
tgacaagatgcttcatttattagctgtgtgacttggtaaattaccttgatcattctgaattgttcatctgtaaaatggaataataatcctacctctctagwttcatgcaaaaggagagagtttttcaactcatatgtgctaatgttactttatatttggttcacatttattctgggaactaaccacttttgatcaatgact

SEQ ID NO: 34144 - DNA, 201 bp, Homo sapiens; identical to SEQ ID NO: 8731

SEQ ID NO: 34145 - DNA, 201 bp, Homo sapiens
agagtgttttcaatagaacaggctcagtgaccacagggagaagggctcagctatggttcaggtaacacacctcattggagtttctaatctgagaaactgcrgggggcaggcaaggaaataggagctgtcacctagagcagaatttttctatccaaggtgaattaccaacttcaagaaaatttctaatccatcacagccaat

SEQ ID NO: 34146 - DNA, 201 bp, Homo sapiens
catatgctggtttgtttgtcacttggccacacagttctactttttcctctttgtctgcaactgaacagcctaggaaacttacaagatttctgctttttttkgggggggcgggggggtaaggtatcgtattttgagttcaatctggtcgcaaactggattctgtccagatttttgttgggatttcagatgtttagccccaaa

SEQ ID NO: 34147 - DNA, 201 bp, Homo sapiens; identical to SEQ ID NO: 8733

SEQ ID NO: 34148 - DNA, 201 bp, Homo sapiens
gggaagtagcacttgttgatcaccttttgggaatgatgattcccttgaattcactggatggctctcaggattggatgacagagtacagtgcttggtttccygtctgtcctcaacagatatttatttcctgtcccctcctctcctcaccttgggtaactggtattagtgttgcaggagcaataaggatacttgaactctgct

SEQ ID NO: 34149 - DNA, 201 bp, Homo sapiens
tacaggcattaaaaatgatgtcatagaggtgtgcatatttaaaggaaaagatatccgtgttgcattaaagagtacataaaaaagcaagaatatgtacaatrtgtacaataattccaattatgcaacacacacatgtaactccaaaaaaagtcttaaaaagtaataagtttttattggagtgacatgaaaaagtagcaaaat

SEQ ID NO: 34150 - DNA, 201 bp, Homo sapiens
gaaatacaagtgacttgacattgaattattcacttcagactcatttacttctccctgcccagggacagatcctaagaggggttaggagggctgggcagtcrttcaacgttccctgcttatctccgttcttcttcccagggatgcatccttattagctcttcttctgactacatgtgagcattccattccaatccagccgct

SEQ ID NO: 34151 - DNA, 201 bp, Homo sapiens
aagtctatgtgattttcattctaatgtcttttggaattaaatgtaatgttgtaagaaaagaagcgtctgaccaataaagcaaggcagtctaggctgttttwtatatatatacgcactttatcctgtctaatgtagtgctcctattttctttttcatattctttctgttagagccaaattcactactctgactttgcataat

SEQ ID NO: 34152 - DNA, 201 bp, Homo sapiens
atctacagatattcctgaatattgtgggccacaaagcacatattaagatgaatttgaatttattctattaaatagtatgctttggtttatcttataaatgytgtatttaacagacttgtttctaaattaaatttttttaaagcactggaagagaaaggaagcacaaacatttgaatagtacttgctccatggaggcgggca

SEQ ID NO: 34153 - DNA, 201 bp, Homo sapiens
aacaaagataattaacaccgataattatgaccatgtattgaacaccagtagaggatgctgtggttcgtgcccaggatgaggttctcattccctcacccagyggctggcactctcaggtgagcccctctctaggaattgccctcacctgaaggcagccacctcccagggccagcacagacttgatgactggtggatgaggag

SEQ ID NO: 34154 - DNA, 201 bp, Homo sapiens
tagtaataatgttagatgcactgtggaaaaactaggcacgtagctgttaagctgggaatgtatgaacggtatacatgctatgctttaaaatctagctcaatttttttttttttgcattgaccttgaacatgctgacaacataggtcggcatgggtaaagctaaagaatggccttagggtttgaaaacaactacatgagctc

SEQ ID NO: 34155 - DNA, 201 bp, Homo sapiens
atttgcaaacctctgtttccaaccatccaagtgggtggaatggtcaaagacctggatattacctgtgcccaccaagtcaagacaaggacttggatgagcarctactagctgatccaacaaagataattaacaccgataattatgaccatgtattgaacaccagtagaggatgctgtggttcgtgcccaggatgaggttctc

SEQ ID NO: 34156 - DNA, 201 bp, Homo sapiens
attctattaaatagtatgctttggtttatcttataaatgctgtatttaacagacttgtttctaaattaaatttttttaaagcactggaagagaaaggaagyacaaacatttgaatagtacttgctccatggaggcgggcagtgttctgaggtattttaaacattagctcatttaagcttcataactttgatgtaggtattc

SEQ ID NO: 34157 - DNA, 201 bp, Homo sapiens
gtgagccgagatcgcgccattgcactccagcctgggcaacaggaatgaaactcggtctcaaaaaaaaaaaaaaaaaaaaaaaaatcgaacaattagctggrtgcttgtagtctcagctactcaggaggctaaagaggatcacctgagcccaggactttggtgctgcagtgagctatgatggcactaccgcactctaacctg

SEQ ID NO: 34158 - DNA, 201 bp, Homo sapiens
agagtaaaggcagccgatggcaggtttttctgggggcaaaatgaacactaccaatccaccttgctagagttctctctctactcactgaggtcttagggagrcaaccgtacataagattttctgaaatttgggatctggtctacagccgtaccaccctgaatatgcccgacctcgtctgaaacttgggatctggattaggaa

SEQ ID NO: 34159 - DNA, 201 bp, Homo sapiens
atccattcatccatctttccatccatccatccatccatccatccatccatccaatcaacagaaacaacagtagaaattaacttggtcttgtatgcggaagmagtgaggtttttctcaaggacttggaaacaagggaatcagctagttctttatggctatcttggtaaaattctcacacagttgatgagattggctatctga

SEQ ID NO: 34160 - DNA, 201 bp, Homo sapiens
ggtgctgagttcactgcatgaagggtcccaggagtcctctttccccttggtttttctactcctttccttttctgctctttctaccacctcctactgctggrcctctttgtatctgtactccaccatggaaaataagttttgtttgccccagatcttcccatttcccagagtggagcctttataattcatgatgtttactaa

SEQ ID NO: 34161 - DNA, 201 bp, Homo sapiens
aaatggcaagagtttgtttaaaatgcaaatctctgagccccaccctcagagaggccagcggggcagtggaatatgcactgaacacttcgggcactaactcrtgtgccaatggttgcacttggacatatactactctaggcctttgggctcctttcgtccctgcagcaccttctgtcctcaagacaggggctctcttgtttt

SEQ ID NO: 34162 - DNA, 201 bp, Homo sapiens
tgttatgaagtggatcagtggcacctgatgattttgtaaatcctatttgagcaaaaaagaaaaaaggattcttgggtgatcttacacagaggcaagatagyagagtgtacctcttggcttcaaatcccagatctacagctcactcggtgtgataccatggataagtcagttaatgttagcacctacctcatgggatgcttg

SEQ ID NO: 34163 - DNA, 201 bp, Homo sapiens
aaggtctcactatgttgcccaagctggtctacaactcctggaatcaagcaatcctcctgcctcagcctcccaaagtgttgggattacagacatcagccackgtgcccatctaggggcatatgatttttataacatttggagattattactgaagatgattgggagtcattaaagaagggagtcattgaagaagagtcttga

SEQ ID NO: 34164 - DNA, 201 bp, Homo sapiens
atccttatgattattattgttacatatattactgtatctagcaaaaacaatattagaattgttagtattataataattattatcatcattgatggggaagraaaaatgaagcccacctgagttcacagacaagaccctctccaaacagtaaaacaattaaaaaccaagttgtatttgtctgtgctcctttggattcaactg

SEQ ID NO: 34165 - DNA, 201 bp, Homo sapiens
tataaaagctgtgcccattgttaacttaggtgataagttgaatttttagtttttttaggttttttgtttgtttgtttgtttttgaggtggagtctcactcygttgcccacgctggagtgcagtggtgcgatcttggctcaccacaacctccgcctcccgggttcaagcgattctcctgcctcagcctcccaagtagctggg

SEQ ID NO: 34166 - DNA, 201 bp, Homo sapiens
tcttagtagaaaagaaaaatctaaaagattctcattttaagtgacttgagctatcagttaaattttaaaagccaattattttgaagcagtagagccttacraattctaaagtcacacactggaagccaaactatctagagtataaatatttccttttgagggggatactgacagattcttctattttatcccaattccagt

SEQ ID NO: 34167 - DNA, 201 bp, Homo sapiens
agcacctacctcatgggatgcttgtgaaagttaagtggatttacatgtaaagcacataaagcagtaagagttctataagaattatcattattgtcaccatyatcacccagtactatggctgcaaataccatttatgtatatatgactgccaaattgagaatcccagtcttccatgttcaactgcttttctgacatgtccgc

SEQ ID NO: 34168 - DNA, 201 bp, Homo sapiens
tgtgtgttgttcccttctacgtgtccgtgtgttccatcattagttctcacttataaatgagaacatgcagtatttggttttctgttcctgtgttagtttgstaaggataatggcctccacctctatccatgtccctacaaaggacatgatctcatccttttttgtggctgcaaagagtactaattattgcactgggctgta

SEQ ID NO: 34169 - DNA, 201 bp, Homo sapiens
aatgtaccaccatgccttttgattcttctgtctctcttctgtttcaagctaatatgctctgtcacttgaaccatgcaataaactcccatcacttgtacttwgtaatcctgccccttgcaatgtgttcttcctattgggcttagaagacacagcaaactccttaacaaggctacagaatcctacctaatctggcccctgcct

SEQ ID NO: 34170 - DNA, 201 bp, Homo sapiens
atactcacacacacccgtgtacatgcacatgctttttcttagaatacaaaggataaaggctaaactgttaccaaccatttatatcatatacatatatatakagagagagagtaggtgttattatagacagaaggcagaaaggatttggaaaataggataaaattagttacatgaccttttctatttttctttttgtttctt

SEQ ID NO: 34171 - DNA, 201 bp, Homo sapiens
cttctgtcctcctttcagaagcccctgtcaagtttccctttgtccagctgccagctccccacctgctccttccttgtattgacttgccatgatgacattcrtttgacaaatgtgaagtttgacagtccttagcaccttgggaggagtttgagaccagcctggccaacatggtgaaaccttatctctactaaagctatgata

SEQ ID NO: 34172 - DNA, 201 bp, Homo sapiens
gattacaggtgtgaaccaccgtgtccgtcctattctgtttttcttaagtgtcactgggaaacatggtcttccaatcaaattggcagtttaaccttggcttraatgcaaatatgttgttattatggtccaataggtggtaactcgcacttgtagaatgagccattgcgtgtggaggctagagtcttaaactgagactcagtt

SEQ ID NO: 34173 - DNA, 201 bp, Homo sapiens
taggggaccctgtgctttggatggtgcactcagtatacaccattccatttggagacatgttggagacaacataagggggatctggagtcagttaaggaagscttttgaattggtgatttcccctgaaagcatgactttggagccaagtagaaaatcaactatgctttttcggcttcttaaaaatgtctaaacacctttgtg

SEQ ID NO: 34174 - DNA, 201 bp, Homo sapiens
tctgcagggccttctgagggaggagtttcttctaccctggaagtcagcttctgcttctcttcatcttgctggcatcttctctaccacaatggttattagtrtctttaatcttcaatcccatgggaagaaagagctgttatctctcttcccataaaggacactcagtcacctaagacatttctctgtagttgaacatagctt

SEQ ID NO: 34175 - DNA, 201 bp, Homo sapiens
cttcagtgagccatctctcgggatcttccagctctggtattctgagtttctctaatttgaggagttggttagagatctcttttctcaacagtgtacctgtkccgagaaatgttactgttatagaaggaagtggttttggaaacgggtcagagtggaggaaagaggttgagttctcaaaaaactaaaggctaggtataagta

SEQ ID NO: 34176 - DNA, 201 bp, Homo sapiens
gaccaggcccactgccttttccagttttttttctttctttcttttttttgagacagagtcatgctctgttgcccaggttggagtgcagtggcgtgatcttyggctcactgcaacatctgcttcctgggttcaagcaattctcctgcctcagcctcctgagtagctgggattacaggtgctcgccaccacacccagctaatt

SEQ ID NO: 34177 - DNA, 201 bp, Homo sapiens
ttctcaaaaaactaaaggctaggtataagtaactgattcatcacagagatgactaattcatcagaacagctgtctgttctaaaatatgtcacatcaaataktcattgaataaaatattgaagtctcaactgctaacctagagagagccaagcagcttttaaaaaatcaggatagaagtgtacttttcatttccacattgga

SEQ ID NO: 34178 - DNA, 201 bp, Homo sapiens
tcattctggtaccactctctgtgtcagaggttgttgctcttttatttgccagttttctttctaaaagcagtcatgagcagacaagcttagaaagggtattytcttcgtgttgtttcagggaaaatagagaaagtcaaacctcctccatcccccaccactgaaggccccagcttgcagcctgacttagcccctgaagaggct

SEQ ID NO: 34179 - DNA, 201 bp, Homo sapiens
atttattttgtgcctacaacagattaagtatctgaataaaaatataaaaacatgaattgattaaaaaatggcctctcataatgtgcaaaacagggtctgtyggggaaattttgagaggtttttgtggagaacaatggttctgaatgttttgtagaaagagcaaccgatttgccccaccctttcccactttccaatggaaaa

SEQ ID NO: 34180 - DNA, 201 bp, Homo sapiens
ttggtgctttttgatgatcctcaggtgatcttaatggtcttccagggttgagcactgtggggaaaattgaggccaagatgtggaggcatctaactggctcktgcatgttaagaactggatgagatgggaagccagacattagaaataatggggtcagggcaccacttacatggtattaatagccagaggtcttgaatcttc

SEQ ID NO: 34181 - DNA, 201 bp, Homo sapiens
ctatggactccttgaatcctataaaatgtctaggattacaatttttttaaagaaggaattatattgaaaatcattaaaatattttaaaaacaaatctgtgytattgtaaggcatgtattttttattcattaactaaatactaagccaaacagcaaatagaataactaatttaaaagctgtggtgtgcataatagttatttt

SEQ ID NO: 34182 - DNA, 201 bp, Homo sapiens
gtggagattggaaagtagtctttgggtgaaaatatgctccattatggctaaagtgttggctatgccagtccttttaattaatgaacttaaagtaaccttakactccttcctcttccatcatctgtcatacctaaataattatatatgaattagatttcttaaaatgctatatgtacatgcatgctttagcaagtaactttt

SEQ ID NO: 34183 - DNA, 201 bp, Homo sapiens
attagaggtcatgcttagaattcagaccatttcttcttcttctttcttttcttcttccttcttccttctttcttcttctttgttaagcaaatatactcttytctatgtgttaccacttctgtggtgcccgtgtgattttgaagtgtttttcgtatgccattagacctggtcttttctgccagattgactggaactggtaga

SEQ ID NO: 34184 - DNA, 201 bp, Homo sapiens
caggagaaagtttcaaaaattttcaaaatatcttttgaaatgtaagccttccttaggcaggcaacactttctaccttgcattatggttgtttgtgtgcaaygtcttaatacacataggcatatacatacatctgcctgcacactttggtaacaggagacatgtctttcttttatttacattcctaacatcagagcccagca

SEQ ID NO: 34185 - DNA, 201 bp, Homo sapiens
gtacaggccaaagaggcagatgagtcatcatataaagatagcactagacgccatagaaggtcttcttcttttgaaaagcagaaacaattatgaaaaggtgsggataggcttttgaaggttgtgtctgatctctggctaggctcacaagcccagcaggagcctgtcctacaaagcctttccctgaggagagcttgcaggttg

SEQ ID NO: 34186 - DNA, 201 bp, Homo sapiens
gtgatcatgctgtgtccccccaccaactcaatctatgtctttaccaaatatttaatgaacaccaccatgctaccatgttaccaggtagcaaaagatgaccragaccccattcctgctgacaatggaactcataggagaatcaaataacaattgtacttgaagaaattgtctctaagatagtgcgacatggaattgagacct

SEQ ID NO: 34187 - DNA, 201 bp, Homo sapiens
ctttcaccctgatgggccacacagtccagatgaatggatggagatattgggtttgactctgctccatcacttaagtagcagagcatgttagaatctctcaraatcttggctttctggtctcttagacgaagatcaggatccccatcacctgggccattgtggagtttgggccaaataatatattttaaccatctatcatgg

SEQ ID NO: 34188 - DNA, 201 bp, Homo sapiens
ctgaagtgctttcctttgctttccaaccggggactgtcaaatgctaaccaaccatcctgaagcatgaattgtgtgaatttcttattaggaaatgcagatgktaaactaattacacctggagtgtatattgacgttaacttatatacatgtatacatacagacacccactgtctatgctgaactactctgaagtaattacag

SEQ ID NO: 34189 - DNA, 201 bp, Homo sapiens
cacatgggctatacttatactgctgtttatctgaatttcaaacgtaaatgggcattctgtatttcacttgctaaatctggcatctgtaagctggcaggtacctggaaagactcctccttccaaggaggaaaccaggtcatgggtgaaggctttagtcagggatagggggaaggaatatttcttagtggcagccaagtaggt

SEQ ID NO: 34190 - DNA, 201 bp, Homo sapiens
ataaccctatggcctatggcttttatctcccagacaagggaactctctctaaatgtaatttttccctcaattttaatcacagcatttaatgtaatcatttrggggaatcaatctgaaaatcatcagggattcttttttctttttactgctaccacgaatagtgattgtgcaacagagttggggaaagacttttgtttttga

SEQ ID NO: 34191 - DNA, 201 bp, Homo sapiens
tgttaaatagagataataaaagtttcttactccataggtcaattgaattaactgaatccactattaagaacagcaattatgtcactataattccccaatcyttctgccctgccccaagtcccactaagggaggagagaagaaaagaaggaatgaaccatgcttgcctctaacttcaagtctccccagcaagggatcaaaat

SEQ ID NO: 34192 - DNA, 201 bp, Homo sapiens
atgggctatacttatactgctgtttatctgaatttcaaacgtaaatgggcattctgtatttcacttgctaaatctggcatctgtaagctggcaggtacctggaaagactcctccttccaaggaggaaaccaggtcatgggtgaaggctttagtcagggatagggggaaggaatatttcttagtggcagccaagtaggtcaa

SEQ ID NO: 34193 - DNA, 201 bp, Homo sapiens
ggaaagacttttgtttttgatgttgcaatagcaggaaatagaaagttgctgctgtcagccacttggtcagagttacatttcttttgcaccacaaaagaagwcttgtaggagactggaatatggttccaggtaacccaactatacattcaatgatgaatgcaccactgcaaaggagaggtgtggccattgttgagtaatttg

SEQ ID NO: 34194 - DNA, 201 bp, Homo sapiens
catgtaactccaaaaaaagtcttaaaaagtaataagtttttattggagtgacatgaaaaagtagcaaaatggaatgtcacacttcacacagtctctcatcrtggcagctattttattttctctcacaaaactcccttttgctaacataccctcttacaattttttgacatatttcaatttccccatggtagcacgtagtgc

SEQ ID NO: 34195 - DNA, 201 bp, Homo sapiens
aaagtcatacagttaggaaaagagaataaaactgtctttattcatagaataatgattgtttaggtaggaaattaagaaatctacaaaaagttactagaacyaataagtgaatttagcaaggtctcaggataaaagatcaatataaaaacgtctatttctatacactagcaatggatgattgaaaaatgacatttaaaaaca

SEQ ID NO: 34196 - DNA, 201 bp, Homo sapiens
aaggttgttccgttattagctgattttcttatatcatcattaacactgctagcaaacttggtacattttgccagcccaatgcatacaagagagtgcagtttgtgtgtgtgtgtgtgtgtcaatgtaaagacaaatatttctttaaataataatgtatttgtattattttttgcagtggaattggaaattttctcacagtcc

SEQ ID NO: 34197 - DNA, 201 bp, Homo sapiens
tggctgggagctagggagtggcatgtcatccctggggagatgagaaagggtcagacttggtgtaagttttggagattgagctcacagatttgtgtgtgtttgtgtgtgtgtgtgtgtgtgtgtgtgtgtgtgtgtgtgtcaggttgtatgtatattgtggcaaaaagagaggactcacagaggaggccaaagtattttggc

SEQ ID NO: 34198 - DNA, 201 bp, Homo sapiens
gacatttaaaaacatttcacttacagaattcctggaaagcattaggatctgaatcatttatcattacggtagtcttctatccagaagaaaaagggagtcarcagagaagagttgctaggaaagtcaaatgtctacattttacttccaaagagttgagaatcctcagactctttacaccatgcccagagatactaaataatt

SEQ ID NO: 34199 - DNA, 201 bp, Homo sapiens
aggttgttccgttattagctgattttcttatatcatcattaacactgctagcaaacttggtacattttgccagcccaatgcatacaagagagtgcagtttgtgtgtgtgtgtgtgtgtcaatgtaaagacaaatatttctttaaataataatgtatttgtattattttttgcagtggaattggaaattttctcacagtcct

SEQ ID NO: 34200 - DNA, 201 bp, Homo sapiens
ggctgggagctagggagtggcatgtcatccctggggagatgagaaagggtcagacttggtgtaagttttggagattgagctcacagatttgtgtgtgtttgtgtgtgtgtgtgtgtgtgtgtgtgtgtgtgtgtgtgtcaggttgtatgtatattgtggcaaaaagagaggactcacagaggaggccaaagtattttggct

SEQ ID NO: 34201 - DNA, 201 bp, Homo sapiens
ggttgttccgttattagctgattttcttatatcatcattaacactgctagcaaacttggtacattttgccagcccaatgcatacaagagagtgcagtttgkgtgtgtgtgtgtgtgtcaatgtaaagacaaatatttctttaaataataatgtatttgtattattttttgcagtggaattggaaattttctcacagtccta

SEQ ID NO: 34202 - DNA, 201 bp, Homo sapiens
caacaaggactggctcctgaggctaggagactgctcggtatgtccaagaaacagctaaaaaataccaagtggagtgagtgaggtctggaatggtagaagaygaggtctggggaggttgcagggaccaggttttatagggctttatagaataatataaggacttttgccttttctttttagacggagtctcactgtgttgtc

SEQ ID NO: 34203 - DNA, 201 bp, Homo sapiens
ggtctggaatggtagaagacgaggtctggggaggttgcagggaccaggttttatagggctttatagaataatataaggacttttgccttttctttttagayggagtctcactgtgttgtcaggctggagtgcagtggtgcgatcttggctcactgcaacctccgcctgccgggttcaagcgattctcctgcctcagcctcc

SEQ ID NO: 34204 - DNA, 201 bp, Homo sapiens
tctcacataactgagaggagaagcaagctctcttgtgtctcttcttatatgggcactaatctcatcatgagggctccaccctcacaacccaattactcccygaaggcctcaactccaaataccattacattagggattagggtttccacatacgaatgttggggaacacaacattcaggccatagcaccatcctaataaat

SEQ ID NO: 34205 - DNA, 201 bp, Homo sapiens
aggtatttgtcctaatactctccctccccttgtcccccacccccaacaggccctggtgtgtgatgttcacctccgtgtgtccacgtgttctcattgttcamctcccacttatgagtggaacatgccgtgtttggttttctgttcctgtattagtttgctgagaatgatggtttccagtttcatccatatccctgcaaagga

SEQ ID NO: 34206 - DNA, 201 bp, Homo sapiens
ttattccaagtgagaagaaagttgctggggtgtcttaaattttcctcaaggcaataatagttgtcttgcataatagtggtctactttgcatattagatgtytattgcacttttaatacacatgtgcatgcacattgcacacactttgagaacaggaactacatcttgcttttatttttatcctcaacttcagtacctagag

SEQ ID NO: 34207 - DNA, 201 bp, Homo sapiens
acacacacacacacacacacacacacacacacaagcataaatagggcacacgtattctcccatgtaagggctgctgtcccttctccctcccacttatagcratgtgtgcctctctgtagctgaaggttgccttgtattaggacactgactgatgagtactccccaccagggtccggagagtgtgcttcattcacctttcag

SEQ ID NO: 34208 - DNA, 201 bp, Homo sapiens
caggctagcccccaggccaccacgctgattttcagttaaaaagtcactggtattgaggttttttaaaattataaatgccttcttaaacagatgttttactytagaaatgtttgttaaaatatattctattcaatttctagtaatggttagcaaatttgccttgacgttcttggggttcctgtcttggcattcatgcagaat

SEQ ID NO: 34209 - DNA, 201 bp, Homo sapiens
cccttattccacaggtattctttgctgtttctgttttatctacaggtttttatttttgttgttgttgtttgtctttttgtttttgtttttgtttttttctttttttttttttgagacggaatctcactctgtcaccaggctggagtgcagtggtgcgatctcagctcactgcaacctccacctcccaggttcaagagattc

SEQ ID NO: 34210 - DNA, 201 bp, Homo sapiens
ggtccgttcatcaaaccaggggctggtgttaatgtttgatcaacaaaacacatgtaggcctaggctctgatctaggtccaactgccaacatagccttttcrtgcctgcctttcctacttcaggtagagagaggagaaaaaacctattgaggaaaaaagaaagaataatattagcccaagcagtggttctactcacttaagg

SEQ ID NO: 34211 - DNA, 201 bp, Homo sapiens
agaagagttcagcacatgtaagtgctcagtaatgttacctgcagtcattgccgtcttcatcaccatcatcatgatcaccatcatcatgatcatgatcatcdtcatcatcatcatcatcatcatcatcaatgacatctgtggtttttaatagtggctgcatagtaaaatcacctgagaaatttacaaatagatcctgatata

SEQ ID NO: 34212 - DNA, 201 bp, Homo sapiens
tacaaaacagcatttctgagtagaaggcataatcaaatatgatttcatgaactgatgcatatatgagttagaggccaagaaatattgaatcatgaagtaargttcttctcatttctaaaatactgtaactccataatttttttcttttttttttgagacagagtctcactctgtcacccaggttggagtacagtggcatga

SEQ ID NO: 34213 - DNA, 201 bp, Homo sapiens
gcctgcatggactctttgtgagacagtgttgttggatactttatgaacattttaagggattctcatgagtaattttgattatagacgatttttactttatkcattgactaggaaccaaatgcaactttcttagagagacacaaaattcattgtccaaatagaccatagggtcagcaggctttgtaaacatgttttgtatgt

SEQ ID NO: 34214 - DNA, 201 bp, Homo sapiens
ctcttaatgtctctctcccttccctggattctaggtggaaaaaaggcagctgatctctagcacatgggacaatgcctggttcaaagcgtgggctaatacayttagcaggatggaaggagggaaggtgggatggaaggaaaagagggagagagggagaaaagaaggaaggagaaaggaaggaaggaaggagggagcaaaggc

SEQ ID NO: 34215 - DNA, 201 bp, Homo sapiens
agaaggaaggagaaaggaaggaaggaaggagggagcaaaggcaggtaggtaggaagaaaggaaggaaggaaagaaaaagagggaaggaaggaaagaaaaasagtgaaggaaggaggaagggagggaagacaggcaggaagaaaggtaagaagaaaggaaggaaagaaagaaagaaatggaaggaaagaaggaaggaggaag

SEQ ID NO: 34216 - DNA, 201 bp, Homo sapiens
aattctccttgaagaggtccttcacatcccttgtaagttggattcctaggtattttattctctttgaagcaattgtgaatgggagttcactcatgatttgkctctctgtttgtctgttaatggtgtataagaatgcttgtgatttttgcacattgattttgtatcctgagactttgctgaagttgcttatcagcttaagga

SEQ ID NO: 34217 - DNA, 201 bp, Homo sapiens
tgtacattttaatacctaccctggtggtagatgcacactatttatacagagcacattcaacaggcagcatgtcaccagtgatgcatagctgtttacgcatrttgaggtgtgggggtggatcctgtctataatcactgtaagagtatagttaggaataattctatgtgaacaaactcaagtctttaagcctaattattaaaa

SEQ ID NO: 34218 - DNA, 201 bp, Homo sapiens
aattagccaggcgtggttgcaggcgcttgtaatcccagctactcaggaggctgaggcaggaaaatcacttgaacccaggaggcggaggttgcagtgagccragatcgcaccattgcactccagcctgggcatcaagagcaaaattttgcctccaaaaaaaaaaaaaaaaaaaaagaatagtgctgttcttattgttgtttc

SEQ ID NO: 34219 - DNA, 201 bp, Homo sapiens
atataaccttagggtttagtacttaatcatatattgagggggctgctctgtcctctttctgatgccccattctccactcccttatctttctctcgctctcttttttttttttttgagtcagcatctcactctgtcacccgggctggagtgcagtggcgtggtctcagctcactgcaacgtccgcctccagggttcaagcga

SEQ ID NO: 34220 - DNA, 201 bp, Homo sapiens
aaagccctcttcactgactgaaaaaatctagatgcttagggtttgtggtcagctttgcaagctggcacaggtaagggaggaaacactctgaaattgcagtscagcatttcaacatttcatgtgtgttacttagcaacaatagcaggaggcctgccagatgtaccagagtcatcgtgcctcgctcaggttttgtaggatcca

SEQ ID NO: 34221 - DNA, 201 bp, Homo sapiens
tggggatactgttttgtttttcttttcttatgattgctgttaacgatgtcatgtttaagtaaggaaagaaggttttgatattcctctaagagttaccagcmtgtggaggagttgtgctccaagaggatcgaaggcttagaattcaaatgtaaaagtgtttaccttcttaggccagtcatctgatcaacacgtaatgtagct

SEQ ID NO: 34222 - DNA, 201 bp, Homo sapiens
catcaatttttaaatggtggagtagctcccatgatggatgttatgaaagggtctatgggtgcatatgaaagggagtggtcattactactcagtccaggtaraactccctggatggagggtgaagacaatgtggtttgagttgttaggtaaatgtttccttatcatttttcattatatgttacatttacattctgttcatcc

SEQ ID NO: 34223 - DNA, 201 bp, Homo sapiens
tcattcaaaaacaggcagatgtatgtatgtttgtgagccatgatagggatccagaaatatttacataattttcatctattaagagatttaacagctgtgtytgccatgtagttactttaaaatataaaatgcaaggtcagatctcttggggatactgttttgtttttcttttcttatgattgctgttaacgatgtcatgtt

SEQ ID NO: 34224 - DNA, 201 bp, Homo sapiens
cacctcccgggttcatgccattctcctgcctcagcctcccgagtagctgggactataggcgcctgcctccacacccggctaattttttgtatttttagtaragatggggtttcaccgtgttagccaggatggtcttgatctcctgacctcatgatctgcccgccttggcctcccaaagtgccgggattacaggtgtgagcc

SEQ ID NO: 34225 - DNA, 201 bp, Homo sapiens
aaaaaggaaggtggtggcaaaaactactatttaatgatggtcaaaaataaaaaataaagatattagcaattataaatattaattgtgttaagtatcactcyttaacaaagaccagacctagactggaagaaaatcagagaatggaagatgttgacaaaagaggaacactcattatttgtgcctgttaatggagaagacata

SEQ ID NO: 34226 - DNA, 201 bp, Homo sapiens
cttctttacatggcagcagcaaggagaagcgctgagcataaggggggaaaatctccttgtgattcatgcctgtaatcccagcactttaggaggttgagttsggtggatcgcttgaggtcaggagtttgagaccagcttggccaacatggtgaaaccccgtctctactaaaaatacaaaaaattagctgggcatggtggcag

SEQ ID NO: 34227 - DNA, 201 bp, Homo sapiens
atggagaaaattctggaccttcttatcttcaaagagagcaataagcatttgttggtttaaacaagacatcatctgatgataccaagcccagattcctgccyaatccggataggttagatttccagcccatttccatttacctggtgtagttgccagtggctttgattctatcaggccatcatgcatgaaggcaaattctta

SEQ ID NO: 34228 - DNA, 201 bp, Homo sapiens
ccactcccatgattcaattacctccccaccaggtccctcccatgacacatggggattatgggaactataattcaagatgagatttggatggggacacaacraaaccatatcaaatattaatagagtctggcagggaggaagcatgacttcatactggtggtgagtcagaaggggcatcttcatattttaaggaaggtggca

SEQ ID NO: 34229 - DNA, 201 bp, Homo sapiens
ttcccataaaggacactcagtcacctaagacatttctctgtagttgaacatagcttagttctcactcacagaatgacatttgaatagttctaaaggctcaytgcaaacatgagcaccctacggtgttacaaagtccctgtggattggctggcatggctctgctgatagggctgagctcacctacgtgactctaatctgcgt

SEQ ID NO: 34230 - DNA, 201 bp, Homo sapiens
ctctattcacccaacctccacaactccccaaatccagtaggataaaaaaagggagggatctttttccctcccttgaagcatgtgtaaagcttaactgcatmctgggaagtgtagttccagcacttaggtggatccaagaagtaagatttatggcagaagtattctacatgctgggattgtagcttttcatgcacagggtgt

SEQ ID NO: 34231 - DNA, 201 bp, Homo sapiens
gtagttccagcacttaggtggatccaagaagtaagatttatggcagaagtattctacatgctgggattgtagcttttcatgcacagggtgttgagtcagcrtctcaaagaatcagacaatgacggttaggagcaataccccacccgtgcagagctgcattagaatttagagttaggttagaagctgcgcaaacacctgttc

SEQ ID NO: 34232 - DNA, 201 bp, Homo sapiens
aaatttttattaacaaaacatctattttgcatatctagcattctgtatccttttcgtataatgctttgcaatgaagcatctatcataaaaaccactaaacygtacagatggtgtttatgcaacacaatttaatgtcccagcaagaactagtgatttgttacatacattatgcatcattgtgatgtatatatccagatttta

SEQ ID NO: 34233 - DNA, 201 bp, Homo sapiens
cttccttaggcaggcaacactttctaccttgcattatggttgtttgtgtgcaacgtcttaatacacataggcatatacatacatctgcctgcacactttgrtaacaggagacatgtctttcttttatttacattcctaacatcagagcccagcacactgcttggaatgtcataggaactcagtgaatgaataaagaatgaa

SEQ ID NO: 34234 - DNA, 201 bp, Homo sapiens
gggctgattttcttacctaagaaatgttgagctttatgatttctgaggttggctatatgtgaattgccctagtaagtgcaaatgtgttttcataggttagaaaaaaaaaaaaagcccaaaaagtattttctgggaattgagagttgtaagcacctacaattctagaatatactttattataaaagttaaaatgttatgcaa

SEQ ID NO: 34235 - DNA, 201 bp, Homo sapiens
gcgtgttctgggcatgtcctcaaagaaagaagggactttgcaaacgggaaggggttgggagctctatcctcattcattcccttgcagcctttgtgatgttkgattgcaatttgccacttctggtgaggcgggtacgcagaatacattatccagcttaaactcaacaaaccctgtttcaacaaactgaagaagtggcttaaa

SEQ ID NO: 34236 - DNA, 201 bp, Homo sapiens
attcctaggtattttattctctttgaagcaattgtgaatgggagttcactcatgatttggctctctgtttgtctgttaatggtgtataagaatgcttgtgwtttttgcacattgattttgtatcctgagactttgctgaagttgcttatcagcttaaggagattttgggctgagatgatggggttttctaaatatacaatc

SEQ ID NO: 34237 - DNA, 201 bp, Homo sapiens
tcatacccaaaaggagcttctgggtcttgaagataaaccactttctcttgttcctctcagttgctctgatattctaagacccagagcagattttttttttwaaccaggagtccatgagtcttctaagaatgtccttggaagaattcaaggaattcctgataccccagaaactatacataaaatgctgtatgcatgtgcact

SEQ ID NO: 34238 - DNA, 201 bp, Homo sapiens
ggggccagctgccttcacattctgtcctcttggaaatcctcataacagcctcagaaggtaggtgtattgatttcctagggcagctataacaaattctcacmaattacgtggttgaaaacaatagcaatttgttctctcacagttcaggagtcctgaagtctgaaattacagatggcagggttggttccttctggaggcttt

SEQ ID NO: 34239 - DNA, 201 bp, Homo sapiens
gttgcttatcagcttaaggagattttgggctgagatgatggggttttctaaatatacaatcatgtcatctgcaaacagggacaatttgacttcctcttttmctaattgaataccctttatttctttctcctgcctgattgccctggccagaacttccaacactatgttgaataggagtggtgagagagggcatccctgtct

SEQ ID NO: 34240 - DNA, 201 bp, Homo sapiens
agggtgttgattttagatctttcctgctttctcttgtgggcatttagtgctataaatttccctctacacactgctttaaatgtgtcccagagattctggtrcactgtgtctttgttctcattggtttcaaagaacttctttatttctgccttcactttcttatttacccagtagtcattcaggagcaagttgttcagtttc

SEQ ID NO: 34241 - DNA, 201 bp, Homo sapiens
attcaatatgatattggctgtggatttgtcacaaatagctcttattattttgaaatatgttccatcagtaccttgttttttgagagtttttagcctgaagsgctgttgaattttgtcaaaggccttttctgcatctattgagataatcatgtggtttttgtctttggttctgtttatgtgatggattacgtttattgattt

SEQ ID NO: 34242 - DNA, 201 bp, Homo sapiens
atccattgctgcttcaccaggtctctttagccgcctgacgccttcattgtttagtgttacattgtctccctttgttcaaagatgcaaagttggccgggcgyggtggctcacacctgtaatcccagcactttgggaggccgaggcgggtggatcacgaggtcaggagaccgagaccatcctggttaacatggtgaaaccctg

SEQ ID NO: 34243 - DNA, 201 bp, Homo sapiens
gccaggtgcacttccttccatcccaccctcaccccttctgcatttgccttcatgctggagacatcctgacttagccagaaagttaaaaatttaggaagaasctctctaaagatagccacacatagctcgtggaaccagttcttcatcatgattgtcattgcgtcctgcgcactgaaaacgtgacttacaaaagagaggcag

SEQ ID NO: 34244 - DNA, 201 bp, Homo sapiens
ccaaagggtgaaaatactctttgaaaatactctttgattttattacacttaatcttagccaaaggccaagaagcgattgtatgctttgattttaaatagtrgcatgtttatagggagatagggcaagtgttggaaggataagagtgctttctatacacataaatggattttcaagaaatgttttgtgaccaactggtttta

SEQ ID NO: 34245 - DNA, 201 bp, Homo sapiens
attcttatatccagaatggaaataatttcgggaataacaaactccttatgtttaccactgttccactgtttaagtcactgttttcttttttctttctttcttttttttttttttttcttttgtggcagggtctcactctgtcacccaggctggagtgcagtggtatgattttggctcactgcaacctctgcttcctgggtt

SEQ ID NO: 34246 - DNA, 201 bp, Homo sapiens
agataatcatgtggtttttgtctttggttctgtttatgtgatggattacgtttattgatttgtgtatattgaaccagctttgcatcccagggatgaagccmacttgatcatggtggataagctttttgatgtgctgctggatttggtttgccagtattttattgaggatttttgcatcgatgttcatcagggatattggtc

SEQ ID NO: 34247 - DNA, 201 bp, Homo sapiens
ggtggataagctttttgatgtgctgctggatttggtttgccagtattttattgaggatttttgcatcgatgttcatcagggatattggtctaaaattctcttttttttgttgtgtctctgccaggttttgatatcaggatgatgttggcctcataaaatgagttagggaggagtccctctttttctattgattggaatagt

SEQ ID NO: 34248 - DNA, 201 bp, Homo sapiens
atcagtgacaggtgaacctctgtgaaaattgaaagggcaatttagttgaaatggaagcatttattcaggaaacaggtgatctgggaaaatttgatgtgcatttttttttttttttttgagacagagtttcactcttgttgcccaggctggagtgcaatgatgtgatctcggctcactgcaacctctgcctcccaggttcca

SEQ ID NO: 34249 - DNA, 201 bp, Homo sapiens
tggttggtaggctattaattattgcctcaatttcagagcctgttattggtctattcaaagattcagcttcttcctggtttagtcttgggagggtgtattgyccaggaatttatccatttcttctagattttcaagtttatttgcgtagaggtgtttatagtattctctgatgatagcttgtatttttgtgggattggtgct

SEQ ID NO: 34250 - DNA, 201 bp, Homo sapiens
caaaatattatttttaaaactactcaaaattttaaaatactaaaagaaaaaatgggactcaaatttaatgagcccgtgtgtgcgtgtgtgtgtgcgtgtgygtgtgtgcgcatgtgtgtgcgtgtgcgtgtgcgcgtgcacgcgcaccttgtaggtaggtgaggagattactagattgactctcctgtacatttaagttaa

SEQ ID NO: 34251 - DNA, 201 bp, Homo sapiens
ctgcaacctctgcttcctgggttcaagtgattctcgtgcctcagcctcccacgtaactggggttatagagcccagctaatttttccatttttggtagagayggggttccagccatgttggcaaggctggtctcgaacttctgatctccagtgatccgcctgtctcagcctcccaaagcgctgggactacaggcgtgagcca

SEQ ID NO: 34252 - DNA, 201 bp, Homo sapiens
tagtcttgggagggtgtattgtccaggaatttatccatttcttctagattttcaagtttatttgcgtagaggtgtttatagtattctctgatgatagcttstatttttgtgggattggtgctgatatcccctttatcatttttttattgcatctatttgattcttctctccttgtatttgattcttctctcctttcttctt

SEQ ID NO: 34253 - DNA, 201 bp, Homo sapiens
atcaccagtgtatgaggatttgcattaaataaattataggtaattacattaacaaaccaagaagacttacagttaaagagggcaaaaatataatttacttwactgctctatgaaatctatttgtggatttctctcttctcaaaggagaattaatcagagaacaactttgttgttattgttgttgttgtcgtttaagaaaaa

SEQ ID NO: 34254 - DNA, 201 bp, Homo sapiens
tcaaggtcaagctcccaatatttcaagtacaaataagacttcacctgtgcacaaacatgtgcttacacacttccatcctcctgaattttctttccagactrttttacagataaggaagcagctctcaaaagacctctctcagacatttgaaaacacattttttttcagagtgctaaattcatgcttcttattttatatatg

SEQ ID NO: 34255 - DNA, 201 bp, Homo sapiens
ccacgctaccaaaagggattccaagctgacggagcacatcgtggtcattgtgctaaggtaaaccagactggcccctaagctctctgagaaaccaatgaccygactgtgtctactggcatcagataaccaggctggagtagaacctggccttcccaaagactttctagtttgtagctaattcatagccaaacctagaattgt

SEQ ID NO: 34256 - DNA, 201 bp, Homo sapiens
agagaagtaagtcttagctagagagggcataggatttgcatggattgttttaagaagaggaagtctaaattcttaggtgaaggagttaggagaaaatagtsaaagaggtgaaatgcaggtgagtggaggataaatgatggtatggggtccctgagaggtcagggcatgatggaattcaaggtactggttattagccttttt

SEQ ID NO: 34257 - DNA, 201 bp, Homo sapiens
cagagtgctaaattcatgcttcttattttatatatgttagaaataaacacataaataataaacagtcttgcctggactggttcatgttcaattcataggcrctgagtattctttattaggacatactcactattgtttgttgaattattgcacttttaagaaatcaatctgaagattaaacattaggagtctcgataaaaa

SEQ ID NO: 34258 - DNA, 201 bp, Homo sapiens
ctttgtcttctcactcttctgcaaaaagagctttggggtttactgtagcaaataatggaaaacattaaagaagtattgttagcatagttcttttgctttcaatttttacctaagttattgtccaattttacattctgaatggtgaactgggtggcctggccacactatttggctgcctctggcaaaaacttctgccctcac

SEQ ID NO: 34259 - DNA, 201 bp, Homo sapiens
agggacatattttggggaaaagtgatgagtttattttggacatgttgagatcataataccttcggaatatacatgtgagatgcctgataggaaataacatrtaggtatggaattcaggaaggagatctggttttggggacttcagtaaatctgcatcaaatagtaactttagccatggatgtgaatgaggctatccaggga

SEQ ID NO: 34260 - DNA, 201 bp, Homo sapiens
tgatgatgctactctccagcttcaaaccctttacctgttttccttggactataagataaagttcaacttccttaatttagcttagagagtcttttatgatrtgacctcctcttacttctctggccttgtctctcataattgtgtcattccattgctgaccactccagcaactacctgccattccttggatgtaccaagctc

SEQ ID NO: 34261 - DNA, 201 bp, Homo sapiens
accactcagaggtggctatcttgatactgatccaagaatgaaatagggatagactgacatgagagagtggctgtggagatggtgaagaaggcatggatttratagttatgtggttgaattgctggaacttggtactgattgagtaaagggtgagaggtatggagaaataaagttaatagccatgtttccagcatagacaag

SEQ ID NO: 34262 - DNA, 201 bp, Homo sapiens
ttcctgtgggcatatttaccttagagcttactgtgtcatagtacattggaagctgatttttttctctatcctcctctagcctcagctgcctaggggtaaasacactacagtgttcacccttgtattctcagatcttagtacactgccaggctcaatgggttttcaaacatatttacataaagaaagaaaacaatgacaaaa

SEQ ID NO: 34263 - DNA, 201 bp, Homo sapiens
agcttgaaatgctgtctgaacacctctatgccttgatcatttttctcttcaagatcctactgacatgttccaacctcctgaaatcctgccctgcctccccrcaagcagagttactcagactctcttctttgcattcctgcagcattttggtcttgcaatttgagctctactgtgcactgcattgtaactattcatatagct

SEQ ID NO: 34264 - DNA, 201 bp, Homo sapiens
tcagaggtgctgtttattctttggtgtccttttgggtagtttagggaaatccatgctgtaggtgaccacaagagagaatgttcccttttagaactatattsattgagcacaggctgtgtgcaaatactcttctaggcactgtggatgccatagcaatacatgctgtttctgctttcatagagcagtgatttccaaatcctg

SEQ ID NO: 34265 - DNA, 201 bp, Homo sapiens
ctacatatctgtgcatcttctacttatggttttatttaggtgagaataaataagagtacctcatagtagataagaatagtacattacacacgcgcgcacgmacacacacacacacacacctggggttagatgaaattgtatatttggggaacttggggtaaagagtacagagccacacagcagttaccttctgcatcctcc

SEQ ID NO: 34266 - DNA, 201 bp, Homo sapiens
agagagacttttttcccagtggaggagctggatgttgttcctaaaagaaaagggcagagggaccctgggcaggcaaaattttcagctgcctgccaccttakcccctgtccccacactcacttctgaaccacatgtgatcagtcttctcttcccaccacataactgaaacttcaaggtcatgggtgagctctatgttgttaa

SEQ ID NO: 34267 - DNA, 201 bp, Homo sapiens
ctctcaacactgttgtatttgggattaagtttccaacacatgaatttttgggagacacattgaaaccacagcagccacagataagctatatatatatatakagagagagagagagaactatagagagagggcaaactatgtatatagaataaagtgtgtatatatagtgtaagatacatatatatatatgtcgttttgtgt

SEQ ID NO: 34268 - DNA, 201 bp, Homo sapiens
cctctcctctgagcagcaaacacttcttctgaggttcttgttttggcaggttggccagacaggcaccccacttgactgctcaactatgaaactgcagttcyagagaagagaacaggtctgaattaagcaccttaagccagttggtcagcatctccttttattcggagagtagttactgagattcaaacccatgtcaactga

SEQ ID NO: 34269 - DNA, 201 bp, Homo sapiens
atctctcaacactgttgtatttgggattaagtttccaacacatgaatttttgggagacacattgaaaccacagcagccacagataagctatatatatatakatagagagagagagagaactatagagagagggcaaactatgtatatagaataaagtgtgtatatatagtgtaagatacatatatatatatgtcgttttgt

SEQ ID NO: 34270 - DNA, 201 bp, Homo sapiens
caaggtcagagctaaggaagtcacccagtgattttttctggaatgccatccattgctgcttcaccaggtctctttagccgcctgacgccttcattgtttastgttacattgtctccctttgttcaaagatgcaaagttggccgggcgtggtggctcacacctgtaatcccagcactttgggaggccgaggcgggtggatca

SEQ ID NO: 34271 - DNA, 201 bp, Homo sapiens
agttaatataggctataagttggaatcaataatccatgaaagaaaccctggatagggtttttaggacacaggcactgctataccctaatagaatggatcarctttcattcagttaaaaaaaaatctacttcttttttatgccacaaagtgccaccttaaatttatcttagtgattgaatgtcatacccaaaagaatcaaaa

SEQ ID NO: 34272 - DNA, 201 bp, Homo sapiens
tcctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttat

SEQ ID NO: 34273 - DNA, 201 bp, Homo sapiens
cctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatg

SEQ ID NO: 34274 - DNA, 201 bp, Homo sapiens
ctttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatgg

SEQ ID NO: 34275 - DNA, 201 bp, Homo sapiens
gtcagcagtgctgacttgcagaatgtacacggcattattgaaacatggttaacaatgaaagtgttgatggccacgctaccaaaagggattccaagctgackgagcacatcgtggtcattgtgctaaggtaaaccagactggcccctaagctctctgagaaaccaatgacctgactgtgtctactggcatcagataaccagg

SEQ ID NO: 34276 - DNA, 201 bp, Homo sapiens
tttgattttggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggc

SEQ ID NO: 34277 - DNA, 201 bp, Homo sapiens
aggaaaacagtatttataagccctagacacatggccctggaaaagtcacttaacttctctgaacctctttttcctatgaagtgggactaataatccctacsatagatttgtatggagaataaagtttaaaatgcctcatgcacaaaagaattgagagcaaggactcgaacagatatttgtataccaatgctcacagcagca

SEQ ID NO: 34278 - DNA, 201 bp, Homo sapiens
ccaaccccgcaggaaatttctctcttgtcagcagtgctgacttgcagaatgtacacggcattattgaaacatggttaacaatgaaagtgttgatggccacrctaccaaaagggattccaagctgacggagcacatcgtggtcattgtgctaaggtaaaccagactggcccctaagctctctgagaaaccaatgacctgact

SEQ ID NO: 34279 - DNA, 201 bp, Homo sapiens
tggtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcgg

SEQ ID NO: 34280 - DNA, 201 bp, Homo sapiens
cttcaaggtcccatctctcaacactgttgtatttgggattaagtttccaacacatgaatttttgggagacacattgaaaccacagcagccacagataagctatatatatatatatagagagagagagagaactatagagagagggcaaactatgtatatagaataaagtgtgtatatatagtgtaagatacatatatatat

SEQ ID NO: 34281 - DNA, 201 bp, Homo sapiens
gtatccaagggggtcctgaaaccaattctctgaggatactgagggatgactgtatgatgttgtcaggacagatttgctaacagcgtgtgtttgtttgtgtgtgtgtgtgtgtgtgtgtgtgtgtgtgtatgtgtgtgtgagagagagagccaattaagagacagagggagttgggtggggggacttatggccacatcggta

SEQ ID NO: 34282 - DNA, 201 bp, Homo sapiens
aatttaaactaattccagaagcacacagctgtattaaattgccccgatcaagtatgtgaaagtaaatggtaggcatcctaaccagctgttaactattctagaatttagtgggaagggcaggtttctgtgtcgtggtattagggctctacctggagggtgaactgggccgatctaaaaagctcccacagcccctttgcacct

SEQ ID NO: 34283 - DNA, 201 bp, Homo sapiens
gtgtcaggcaggcacagcatccataggtggtaggagctgaagctaggctttcccaatttcattattcattccccagccagcagggtggacaggatttagtrggcaggccaccatccctccactgccaaccccgcaggaaatttctctcttgtcagcagtgctgacttgcagaatgtacacggcattattgaaacatggtta

SEQ ID NO: 34284 - DNA, 201 bp, Homo sapiens
ttcaaggtcccatctctcaacactgttgtatttgggattaagtttccaacacatgaatttttgggagacacattgaaaccacagcagccacagataagctatatatatatatatagagagagagagagaactatagagagagggcaaactatgtatatagaataaagtgtgtatatatagtgtaagatacatatatatata

SEQ ID NO: 34285 - DNA, 201 bp, Homo sapiens
ggatggtgttgagcagagcccttagcttttgtctgtattgctgtcttgtcctgtggggggtcagaagcaacatctctgaagtggaatgtgtattaatgactttttttttttttagacagagtctcactctgtcacccaggctggagtgctgccatgacagctcgctgcatcctgaaaccatcctcccacctcagcctcccc

SEQ ID NO: 34286 - DNA, 201 bp, Homo sapiens
gaatttagtgggaagggcaggtttctgtgtcgtggtattagggctctacctggagggtgaactgggccgatctaaaaagctcccacagcccctttgcaccytagtttttctctgaccttagaaaacccagtttgatgattctttcatatcctcctgtttttgcattggggcatagttcatttcaaaaaggactttcctggt

SEQ ID NO: 34287 - DNA, 201 bp, Homo sapiens
ctcaacactgttgtatttgggattaagtttccaacacatgaatttttgggagacacattgaaaccacagcagccacagataagctatatatatatatatakagagagagagagaactatagagagagggcaaactatgtatatagaataaagtgtgtatatatagtgtaagatacatatatatatatgtcgttttgtgtgt

SEQ ID NO: 34288 - DNA, 201 bp, Homo sapiens
ctttcatatcctcctgtttttgcattggggcatagttcatttcaaaaaggactttcctggtgattgaatgaatgtgcatcttatctgaatctggaatcackttcgcctaatttgaagcatggagaaaattctggaccttcttatcttcaaagagagcaataagcatttgttggtttaaacaagacatcatctgatgatacc

SEQ ID NO: 34289 - DNA, 201 bp, Homo sapiens
cagataagctatatatatatatatagagagagagagagaactatagagagagggcaaactatgtatatagaataaagtgtgtatatatagtgtaagatacwtatatatatatgtcgttttgtgtgtgtgtgtgtgtgtgtgtgtgtgtgtgtgtgtatgtagttctacttccaagaatttctactacagccatggaggcac

SEQ ID NO: 34290 - DNA, 201 bp, Homo sapiens
atttgtacctctgagtatttcagtcttcagcttattgggacaaagagcagctactctgacaaactttaaaatgctctgagaaatagagcagttatcatggaaaaaaaaagtcatcatagaaaaagctaagtgaggggggttgtgggttatagtttgtcaatatttaaaggaaaaccagggcccagtagaattgtttctata

SEQ ID NO: 34291 - DNA, 201 bp, Homo sapiens
aaatactagttttttactcctacgaaagtgaaatggcaaaagtgtacctatgcacattatttttcccaccaatggtcatattcttagcaaataaacgtttyctctgtgggctgggggtgttacaatgtttttaaatagtgggattatcaagtttagggttttattggctcagagggcaagtgtgaaatcttgagtctgtct

SEQ ID NO: 34292 - DNA, 201 bp, Homo sapiens
atatccttgttaaccttccatctcattgatctgtctgatattgacagtggggtgttatagtctcccattattattgtgtgggagtctaagtctctttgtargtctctaaggacttgctttatgactctgggtgctgctgtattgggtgcatatctatttaggatagttaggtcttcttgttgaattgatccctttaccatt

SEQ ID NO: 34293 - DNA, 201 bp, Homo sapiens
gaaatactagaaaacacagaaggatataaagagcaaagatgaaagcattccaaatcctaccatctagatacaacctatgttgatatttagcatgtatgcasaggatagatgctatcctgtagcatgatcatttatatgcatgtgcgtacacatgcatttactttttataaaaatgatataatactgaacatgctattctgt

SEQ ID NO: 34294 - DNA, 201 bp, Homo sapiens
ttactgtatctagcaaaaacaatattagaattgttagtattataataattattatcatcattgatggggaaggaaaaatgaagcccacctgagttcacagrcaagaccctctccaaacagtaaaacaattaaaaaccaagttgtatttgtctgtgctcctttggattcaactgaccaacacccaggcaaagggaaaatata

SEQ ID NO: 34295 - DNA, 201 bp, Homo sapiens; identical to SEQ ID NO: 8735

SEQ ID NO: 34296 - DNA, 201 bp, Homo sapiens
gagaagactgcattagatttcagtcatgaaactacaaaacagtggcgtctgcagcctggctgggatgactgttgttaaccccatgacactctgttccttgsgaagctgctttgccccaggactcaggttttcctgagaaagagagcagcctggactgaccacaccctcagagcctggcccaaggccacatgtgaacttata

SEQ ID NO: 34297 - DNA, 201 bp, Homo sapiens
acatgggaagctgaggccctggcccctctttcatgccacagcctgggagatgctgccttctcagcagaaagcctcaggaggtattttgaaaagggaatttgttgttttcattctggttagataagttacaaactaattttttaaactgggaaaatattgaaaattgttttttaaaaatgaaatcacctttaattccattac

SEQ ID NO: 34298 - DNA, 201 bp, Homo sapiens
agaaagcctcaggaggtattttgaaaagggaatttgttgttttcattctggttagataagttacaaactaattttttaaactgggaaaatattgaaaattrttttttaaaaatgaaatcacctttaattccattactcagagacaactatcactgacatttttctgttttttcagtcttaattctcatgaaggtgtgccct

SEQ ID NO: 34299 - DNA, 201 bp, Homo sapiens
aatggggattccctactcacagggtcattgggaagtttggataaaataatccacatgaattcttagctcagttcctggcacagaataagtgctcagtaaayactggtggtaattattatcatttcactgaaagaatatggctgttgagactttccccaaatcatagctgcagctgctattctggaatatttccagagtctc

SEQ ID NO: 34300 - DNA, 201 bp, Homo sapiens
cctactcacagggtcattgggaagtttggataaaataatccacatgaattcttagctcagttcctggcacagaataagtgctcagtaaacactggtggtarttattatcatttcactgaaagaatatggctgttgagactttccccaaatcatagctgcagctgctattctggaatatttccagagtctcctggcagtgct

SEQ ID NO: 34301 - DNA, 201 bp, Homo sapiens
aggtgcatgctgttgtggtttgccatttcctgatgagttaaacgaaaatggcaagaaaaatgacttgtctccatatgtatttttttgtgcctgttctgaawtatgggactgcctcgaaatgttggagtccatgcaacagtgatatacaatggtgtggtttgctgtgctgtgctgtgggggcgagtgggagggtactgggga

SEQ ID NO: 34302 - DNA, 201 bp, Homo sapiens
cattcccatctggcagggagctatctcctggaggaggctgagacataagccctgggaatcacatgttctttcagatggaaaattccctgtctgtaagtagtttttttttttttgtttcttttttaaactgctaaaacattgagtatgcagacacacatgtgaccagtccatgagatctcacatgggctccagcctccatct

SEQ ID NO: 34303 - DNA, 201 bp, Homo sapiens
ttctttgtcctgtatattggagtcaccaatgagtatctccagcctcacttattaatggacctcttggctaattctgagggcaggaggattaccatccccamccctacccacttacccaaggctgtttaccaacctatgcaaggcctttgtgtgaattaggaaaaaaaaccacccttgttcctctatgaagatatgaagatg

SEQ ID NO: 34304 - DNA, 201 bp, Homo sapiens
agcacaggctggcaggggtcggcaaaatttttgtataaatggccagattttaactattttagactttgtggaccatatagtctttgtcacacattaattgktttctttctcttttctctttccttcccccatcttttcctccctctctttcttcttctccttcctcttcttttttcttccttctccttccccttctcttct

SEQ ID NO: 34305 - DNA, 201 bp, Homo sapiens
gaaggagaaagatagaatgtagctacggctgaagttttgctgagtgagaaaaactgatctttgccatcaaaacaagttcagtgtcccccgagcccccatcrggggtgtggtggcctctggggtcctgtccacagggactcagctcagggccctgctctctccagttttccactttataaaaagtcatatgcagagaggccc

SEQ ID NO: 34306 - DNA, 201 bp, Homo sapiens
aggagagtgaaagacagaaggagaaagatagaatgtagctacggctgaagttttgctgagtgagaaaaactgatctttgccatcaaaacaagttcagtgtyccccgagcccccatcgggggtgtggtggcctctggggtcctgtccacagggactcagctcagggccctgctctctccagttttccactttataaaaagtc

SEQ ID NO: 34307 - DNA, 201 bp, Homo sapiens
taactattttagactttgtggaccatatagtctttgtcacacattaattgttttctttctcttttctctttccttcccccatcttttcctccctctctttyttcttctccttcctcttcttttttcttccttctccttccccttctcttcttcttcttcttcctcttcttttttttttttttttttttttttaaagaaaca

SEQ ID NO: 34308 - DNA, 201 bp, Homo sapiens
attccctgctgttttattgccttttatatcctagctggctaagttaaaggatttctggagttgaagcccagatgctgaaagttgctttcaaaatatatggyggtaaagaaaggaagaaagcaaatggatatctggcagcctggcttctcacttggcatctcccaggctttcccttttgtttacacctgaactgcgtggagc

SEQ ID NO: 34309 - DNA, 201 bp, Homo sapiens
tgtcccagtttgggtgataaaccatctggtcaccttaaacttgaatgctatgaagttcacagtaagaattccctgctgttttattgccttttatatcctarctggctaagttaaaggatttctggagttgaagcccagatgctgaaagttgctttcaaaatatatggcggtaaagaaaggaagaaagcaaatggatatctg

SEQ ID NO: 34310 - DNA, 201 bp, Homo sapiens
tatagtctttgtcacacattaattgttttctttctcttttctctttccttcccccatcttttcctccctctctttcttcttctccttcctcttcttttttyttccttctccttccccttctcttcttcttcttcttcctcttcttttttttttttttttttttttttaaagaaacaaccctttacaagtgtaaaaccactc

SEQ ID NO: 34311 - DNA, 201 bp, Homo sapiens
ttttattgatgccttggcaattctccatgatacagacacaatgctgagggcacggcaagactcctgtacgcaaactgttctgaaggatcagagtgttgtarggtgacagtcagcctcatccacatcaaagcatttcctttttttcttcaccatttttgatcagtttcatattcctgtgggtactaatgaaaaggaacagca

SEQ ID NO: 34312 - DNA, 201 bp, Homo sapiens
tccttcaaagccgacactctaggcaatccctaacaatgttacagtgcttaaaagactgagtgtgtttggggctgttaacaagcccatgtgcatagcttgamagcaaagagccagtgaaaatgacagttgaaaaccacatggctactctgctacacccaagccctcggaactttgcacataacgttcaaattaactgtgaag

SEQ ID NO: 34313 - DNA, 201 bp, Homo sapiens
gtgaggagtctttgggccaaggtgacttgcctgctccctacccctgtcccctgactgtgcttcacctcccaagactctgaattgtctcctgaacggtcccrgctcacatccagaactcacatgggcctcttctctgcatctgtcttcccaaggatgggccactctgaagggtgtaccaaagggaagcagtttgccttgaag

SEQ ID NO: 34314 - DNA, 201 bp, Homo sapiens
ctctgacagtctaattctgtgatctgtgatagaatacatatctcaaaacaactggagccactgtcggtctgtccaacatatatttgcaaaatgcgtgctgkgcctgtttgatctaactgactttttggaacttggtgtccttgagatctttggatgggtttgtgcattaaccttaagtgctttgatccctgtaatataata

SEQ ID NO: 34315 - DNA, 201 bp, Homo sapiens
atggccaagcctggcaccaatggggtaggggagtatcctcctcccatagagcagcactgcagatctcttgacaatgagtgaggatatataatcctcccacrgggaaggcagaaaggatttgggggcaataatactgtctgccacatgctgtcatgaatgctatctagttttagtctcttgataactctgtgaggtaggtat

SEQ ID NO: 34316 - DNA, 201 bp, Homo sapiens
agttgccaagttagaagcctgggatgtaagatgaagaaaggtgagtccccttcggcttggaactggaagaggtcaaatggccctttcccctcccaaacggrgccatgcaagccccatttatcttgtgtgttttatccacattccttgttcacaggttttagccgcatcaaccacaaagggcataattggaaaaatcataat

SEQ ID NO: 34317 - DNA, 201 bp, Homo sapiens
ttccacgtcagttaaggattgtttctctaaacacacaccaaaaggggaaaacatagttacttcctaaattcttatatccagaatggaaataatttcgggartaacaaactccttatgtttaccactgttccactgtttaagtcactgttttcttttttctttctttcttttttttttttttttcttttgtggcagggtctc

SEQ ID NO: 34318 - DNA, 201 bp, Homo sapiens
ctggtaattggtgtctatttctggtcccagaagagatgcaaaaattttatgcagaatatgcatgaaattgttcatctcaccctatagtcacattattcttkgagattccaattaagtggtagctagaatcattagatgctttctgttctgaatattaaccttataaatattaactttgtcctcataataactatctgaggg

SEQ ID NO: 34319 - DNA, 201 bp, Homo sapiens
cactttcgaagattctcaaagggagtaactcctccccctaatactgagctgcagtccatcttaagccttgctggtatacatctcaaagaagaagatattgrggatagcttgtgcaacgtagctctggtggccgctaaggaaagagcaaacagctctatggctgcagacatcaggctttaaatgacaccaggatggtgaatg

SEQ ID NO: 34320 - DNA, 201 bp, Homo sapiens
cagaagcagatgctggtgttatgcttcttgaacagtctgcagaactgtgagccaaataaatctgttttccttataaattacctagtctccagtatttcttyatagcaatgcaaaaacagactaatacatatctcatacttgaaaagtcagttgttgtttagactgcttgccctacttttaatacttcaatttctctgtcaa

SEQ ID NO: 34321 - DNA, 201 bp, Homo sapiens
ctattgtttcttccttaaatgtttgatagaaatcactagtgaaatgatctggattgaatttttcttggttgaaaggtttctaattacaaattcaatttatktaatagatatagaactactcagatatttatatttctttttgtattctttcaataagtcgcatttttcaggaaatttttggtaatatcatctactttttaa

SEQ ID NO: 34322 - DNA, 201 bp, Homo sapiens
tgttaattctagctctgctgatcatttgctgtgtgaccttgggcaagtcttttgctctcttcagtctcagtttcctcatatcttcagtgagccatctctcrggatcttccagctctggtattctgagtttctctaatttgaggagttggttagagatctcttttctcaacagtgtacctgttccgagaaatgttactgtta

SEQ ID NO: 34323 - DNA, 201 bp, Homo sapiens
aaagtaattgaacttctgggcttcagatgcctcttgagtatgatctagactaataatattgggtttttcttaccccaatgggagatgcagagctactcaargcatggaattctaaagctcaaaagtcatctggcttagtctagccccaggtatgtgagctcaggggtatgagctctccatcacaattggacctgtgctaaa

SEQ ID NO: 34324 - DNA, 201 bp, Homo sapiens
ctgacctcacctcaggtgatctgcctgccttagcctcccaaagtgctgggattacaggggtgagccaccgtgcgggcttcttttttttttttctttttgakaccaagcctcacttcctcacccaggctggaatgctccaacttctgctctccgggttcaagagattctcttgccaaatagctaggattacaggtgtacacc

SEQ ID NO: 34325 - DNA, 201 bp, Homo sapiens
aaggttgcagtgagctatgatcacatcactgtgctccagcctgggcaacagagcaagagcctgtctcttaaaaaaaaaaaggaaggtggtggcaaaaactrctatttaatgatggtcaaaaataaaaaataaagatattagcaattataaatattaattgtgttaagtatcactccttaacaaagaccagacctagactgg

SEQ ID NO: 34326 - DNA, 201 bp, Homo sapiens
tgtctttgcacgtgagatgggtgtcctgaatacaacacactgatgggtcttgactctttctccaatttgccagtctgtgtcttttaattggggcatttagcccatttacatttaatgttaatattgttatgtgtgtatttgattctgtcattatgatatttgctggttattttgcccattaattgatgcagtttcttcata

SEQ ID NO: 34327 - DNA, 201 bp, Homo sapiens
gtttggcccatctgaaataagtccatacaattaaaaacatttctttctattgacagggactgagggttgagggaaagcactgcagattttccaggtgtattttttttttttttttgctccctggattttgcctgaaccctcacttttctctttcagggaactttaagcacacttagtgaaagactaaaggtcagagagcac

SEQ ID NO: 34328 - DNA, 201 bp, Homo sapiens
aatggaatatatattatatatatatattccatgtatatatacagaaatatacacacacacacacaaattatatccttattttattatttaatttaattttkgtttttgagatggagtcttgcctatcacccaggctggagtgcagtagcacaatctcggctcactgcaacctctacctcccaggttcaagtgattctcctg

SEQ ID NO: 34329 - DNA, 201 bp, Homo sapiens
ggtggcttaaacaacaacaattttatcatctcatagttctggaggctagaagtctgaaatcaagatgtccagctagattggtttcttctgagggttgtgaggaaggatctgttccaggcctctctcctggacttggggatggccagcttctccctatgtctcttcacatcatcttctttctacatatgtctgccggtgtgt

SEQ ID NO: 34330 - DNA, 201 bp, Homo sapiens
cttgggaagctgaggcaagaagtttgcttgagcccaggtgttcaaggctgcagtgagctgtgatcgaaccattgtactccaggctgggcagcaaagtgccaaaaaaaaaaaaaaaaaaaaaggagagagagagaataaaggaagcacctttgcaggtacatgagcctgatttgaaggggtaactcacacagtgctgtaaaa

SEQ ID NO: 34331 - DNA, 201 bp, Homo sapiens
taattttctaatttaagccttgtaatactcccatgaggtagtgatgatgatgatgatgatgaagagagaagagaagcacaggaggtgaagtaacttgctgccccccctaaaaaaattcaatggaaggacatacaagatgaatgaaaaataattttaaaaaagtgaaagagcaagtatttgaactcaactctgcctaattct

SEQ ID NO: 34332 - DNA, 201 bp, Homo sapiens
cctttgacaaaggtgcagagaagcaggttgagatggacccccgatctcccatctacccacaatctgcttatgtctgggctcccacctctgcctgtaactgyatctccttgcttctctggagttgccaactgtattagtccattttcatactgctatgaagaaataaccaagactgggtaatttataaagaaaaagaggttt

SEQ ID NO: 34333 - DNA, 201 bp, Homo sapiens
gtaaactacatcacaggagttcaaaatgtcaacagagctgcccccagtcctgtctgtgtttttgcttaggacccagtgttgtgtcactactccccattgawaataaacaaaacatgcctcatatgttcacagttatttagagtttacagaattctctccttctatcaatttgtttgtgcctgaaggagcaggaaaggtatt

SEQ ID NO: 34334 - DNA, 201 bp, Homo sapiens
gactcacagttccacatggctggggaggcctcacaatcatggcagaaggtgaaggaagatcaaaggcacgtcttacatggcagcaggcaagacagtgtgtkcaggggaactgccctttataaaaccatcaggtctggtgagacttattcactatcacgagaacagcatgggaaaactcgctcccacattgaattacctcct

SEQ ID NO: 34335 - DNA, 201 bp, Homo sapiens
tgcttgctagttccagaataggaagaaactagaatcagaatagtctgtgtttgtttgcttgcttgcttatttatttatttccaagaacaggtttttggggraaaaaaaagaaacactaacacattaaaatgtacacattaactgtaagatgcattgctatttcagtaacattataatgcgagaggaaacacaatagcatat

SEQ ID NO: 34336 - DNA, 201 bp, Homo sapiens
gggcagtaatgacagcccacaactgacaagtactgatgaatagttcttgaaggcaaaccctgccctcagggagctctgccatagcttggcatgtcttctaraactacgtgcaaggggtcgcagagcagctaattctgccgcggtatgggcagtcaccaggaaacttcaagggggagcaggtttaacctgaatccttgctga

SEQ ID NO: 34337 - DNA, 201 bp, Homo sapiens
gaaggtgggctgataactttccagcctttgtagtggaggaatatgggtttcttaaaataaaatgacctgaattagaattactgtgtcaaagagcagttgatttttttccccgaaattccagtctgattgcttatttggtgaaaagcaggatttaaaaacctgtgctccatttactaccatctcatttggcactggaaacac

SEQ ID NO: 34338 - DNA, 201 bp, Homo sapiens
caggatagtctcgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttc

SEQ ID NO: 34339 - DNA, 201 bp, Homo sapiens
ctgggggtcagattacagactggaccacactcctaactttctttacccctgagacctctggagtcctagatgtggacgtggtgtttatggtgcattcatgyttctgaactcttttttttttttttttttttttttgagatggagtctcactatcatccaacctggagtgcagtggtacgatcttggctcactgcaacctct

SEQ ID NO: 34340 - DNA, 201 bp, Homo sapiens
cacacagtcttggtgaaatgtcacatgcacggaagcatagtctagcttccaaaaaccattgaaaggagtttcaatcttttcttttaaattcatatatatgwatatatatatatatagagagagagagagagagagagagagcagagagagtttatttgggccaagcctggggactgcaacccaggagcatagattcaagtt

SEQ ID NO: 34341 - DNA, 201 bp, Homo sapiens
ccggcctgtgcccaccctaataccacttccttggagtcccttttgccattggagatgatgcattcacaggttccagggattagggcgtgggcatctttggrggctgttgccccatctacccctaccacaccattttgcaggtctctcacatgaatcctgcaggatcttgctggtttccctgcttacatcttcttccctgcc

SEQ ID NO: 34342 - DNA, 201 bp, Homo sapiens
aggatagtctcgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttct

SEQ ID NO: 34343 - DNA, 201 bp, Homo sapiens
aaatgtcacatgcacggaagcatagtctagcttccaaaaaccattgaaaggagtttcaatcttttcttttaaattcatatatatgtatatatatatatatagagagagagagagagagagagagagcagagagagtttatttgggccaagcctggggactgcaacccaggagcatagattcaagttgccctaaatatacac

SEQ ID NO: 34344 - DNA, 201 bp, Homo sapiens
aaaaagggggatagtccattctagctgcccaatgtgcatgaccttgtgaggtagtaagaaccatgaccaggaaaaggccatgtcatccatcaggtgacttygtagaggaggcttctgccctgatgggagagtagcttaggcagcctcgaggccccttccacttcaatttgggaaatatttaatgagctcccactgtgtgcc

SEQ ID NO: 34345 - DNA, 201 bp, Homo sapiens
ttagccactgtccccgactccatttgtgagaatgctgctgactggcatttatgagagtgcttagtacctgccaggcactgtgcctggggatttacatggattatctacttttaccctcaaaacaccgatatgagttaggcactattaatttcattttctgattgagagagctgatgtgagagaaatgcagtgattttctca

SEQ ID NO: 34346 - DNA, 201 bp, Homo sapiens
gtctcgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaagga

SEQ ID NO: 34347 - DNA, 201 bp, Homo sapiens
tagtaactttagccatggatgtgaatgaggctatccagggaaagaatgcaaaatataaggtcaacctggtgactcactgtgctgagggaagccagggaagyagaaggggagtcagggtagacagaaacaggggggtaggtgaagatgaaagaactttccaggaaggagggagtgatgcatggtgccaaatgccactgacag

SEQ ID NO: 34348 - DNA, 201 bp, Homo sapiens
cagtgaatgaatccatctccttatccaatgctgaacttcaggcttccatgtttatcccactcttagtcccttttttttttttttttttttttttttttttyacagagaaaaggggtctgtttgctctttgtgttctttgtgttcatagtgtttccaagccccaggccattcagagcttttgtctccagtgccccacacatt

SEQ ID NO: 34349 - DNA, 201 bp, Homo sapiens
tgtcacatgcacggaagcatagtctagcttccaaaaaccattgaaaggagtttcaatcttttcttttaaattcatatatatgtatatatatatatatagakagagagagagagagagagagagcagagagagtttatttgggccaagcctggggactgcaacccaggagcatagattcaagttgccctaaatatacactcc

SEQ ID NO: 34350 - DNA, 201 bp, Homo sapiens
ctcgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggact

SEQ ID NO: 34351 - DNA, 201 bp, Homo sapiens
attttcttttaccttatcatggacagagtggccccccagaagcacaggatgcaagacaacacacatttcagtggctgctccttctgcatacatcattgagytctgccaagggtttgaacacacacacacgtaaataaaggcctaattatgtgtgtgtgtgtgtgtgtgtgtgtgtgtgtgtgtgtgtgtgtattatatgta

SEQ ID NO: 34352 - DNA, 201 bp, Homo sapiens
tcgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggactt

SEQ ID NO: 34353 - DNA, 201 bp, Homo sapiens
cttctggactgacgtttctattgtacttgagtcccatcatttgacattagaagatctccttccaagaaatatttcttaccaccaaaagacagttaactttkacttcagacagaacattctggtctgcacccagaacctttaatacctgaatcttttaaatcagtgatggtctcttcttctaaaaagtaaaaggtaaatcaa

SEQ ID NO: 34354 - DNA, 201 bp, Homo sapiens
ttgtacttgagtcccatcatttgacattagaagatctccttccaagaaatatttcttaccaccaaaagacagttaactttgacttcagacagaacattctkgtctgcacccagaacctttaatacctgaatcttttaaatcagtgatggtctcttcttctaaaaagtaaaaggtaaatcaaattcagtatgtctcaattaa

SEQ ID NO: 34355 - DNA, 201 bp, Homo sapiens
tgagatctcacatgggctccagcctccatcttatttgaatgcagaaagtcaaattcaccaagatcccattccacagatttctggaaattatcagtgaatcwtggaagttctacaaatctgctctggtcatcccttctttcctaaactgaccctctagtcctagattactgcttcactcttcccacggacaattgtcaccca

SEQ ID NO: 34356 - DNA, 201 bp, Homo sapiens
ggcactcggcaggctgaggcaggagaatcaggcagggaggttgcagtgagccgagatggcagcagtacagtccagcttcggctcggcatcagagggagacmgtggaaagaggggagaggggagaggggagagggaatcacagaattttcaaactggtttagcatgctggctctgcagccagactgcctgagctcaaatgtc

SEQ ID NO: 34357 - DNA, 201 bp, Homo sapiens
agcagttagatgtaaccattgatgactgatggacgttccaggattttgtgatatggtcgtgatgcaaggaagggatcacatctcatggtgcccagctttcyggaatcttcctgctttcactttcccacttctttctggggtgtacccagatttgtcttgtcttacctcaggggtttcctcctttcctctgataccttggca

SEQ ID NO: 34358 - DNA, 201 bp, Homo sapiens
gccctgctatccttacatagggggagctcaccttcagcccagcctcagatgcagccttcacagtggccacacaaggcaggcaccggccccagatgggtaaytgaggaccaaatgggaaggagttctgaggaaatcatacggcatttcacctccgacttcgggggagtctttctttggtgtttgtggtccttatatctgtgt

SEQ ID NO: 34359 - DNA, 201 bp, Homo sapiens
taaagaatgagagagcccacaagacaaggctagaaaggaagtttgcagacacatcctgaagggaactatatgccatgctggggagtttggtgtttattttytaaagacacaaggaaccaacagagggtttatgactcaagtaactgtgggcaggatggagcacaggctggcaggggtcggcaaaatttttgtataaatggc

SEQ ID NO: 34360 - DNA, 201 bp, Homo sapiens
ggaagactgtgaagaaaccagtttggaagtatgaggtgtcacaagagtctataggacaggaaagagctgtccttagcaaccccagactggcagcaagagtkgggatgaattagaaaggatacaagactgagagacaggggcaaggggagggggagaccaggtaggaagctcttccaacaatctagggaagaggaagtgaat

SEQ ID NO: 34361 - DNA, 201 bp, Homo sapiens
attctgttgtatagtacagtggaggatagccatgacccacctatgaaaacctttgtggaaatgtagagaaaacgaaaacacttgatgaaagaggttttttyatttatttaaaattttggacctggaacacattttaaccaagggtttgtaaattgtctgtcagcctgggaagccctcagtcaaggtagtttgcatgttgcc

SEQ ID NO: 34362 - DNA, 201 bp, Homo sapiens
tcacctgaggtcgggagttcaagaccagcctgaccaacatggagaaacccccatctctactaaaaaaaaaatacaaaattagccaggcgtgatggcgcatkcctgtaatcccagctactcgggagactgaggcaggagaatcgcttgaacctgggaggcaggggttgcaatgagccgagatgtgcactccagcctgggcaa

SEQ ID NO: 34363 - DNA, 201 bp, Homo sapiens
ttatttctagcacataaacaactgtctaatataaagacatttcaatgctttctcctgattcccccaccggctgttgtccatcaggcttccccaccaggacygaggttgccttaaacaagtcagcatcctaaggcttgccactggcatcccagcaacccagtatcaatctccccagtacttccctctatgctaatgctgatc

SEQ ID NO: 34364 - DNA, 201 bp, Homo sapiens
ttatgttcttcttttctgtcctttttggtaaaaaaaaacgcaggttgtattccaaagctgtattaacacaacattctcttccccactcctacccagccttyttcagagctgtgaatttcattacaggagcattgaggcagaaccttgcaggtgtggcccaaaggggctaaagtgggcataggttgggatttacttctgccc

SEQ ID NO: 34365 - DNA, 201 bp, Homo sapiens
gtcacacatgacagaatcctaattcaaagtgccttaaaaaaaaaaaaaaaaagataatatcttcttgcaaatttgaaaagtccaggagttgttgttttggsttggactccatttcccagctttgccttcctctctgtgggctttctcttctgcatagtgtttccactaagaggtggccaccagggttcccaggtgttattt

SEQ ID NO: 34366 - DNA, 201 bp, Homo sapiens
caaatgtctttctgttttgaatcatttgagagtaaattgccaacatgatgccccatcacccccaattttgtagactgctccctaatgtgggtctctgatgytttcatatgatgattttcaggttgtgcatctttggtaggaataccaccaaattgatgctgtgttctcactgtatccaaacaggtagcacgtggtattagt

SEQ ID NO: 34367 - DNA, 201 bp, Homo sapiens
attaactttttaaaattggaaagaatctccaacctaaagaaaagttcccaagtacagtacaaatgtctttctgttttgaatcatttgagagtaaattgccmacatgatgccccatcacccccaattttgtagactgctccctaatgtgggtctctgatgttttcatatgatgattttcaggttgtgcatctttggtaggaa

SEQ ID NO: 34368 - DNA, 201 bp, Homo sapiens
catctgatttgggagttgtcctctactaactaaccccttctgaatgctggtttccttcccagcaatgatagtcatggcatggcattgcagactggtccatrcaaaatgcttttgttcatcttccgtgtaactgggtttttcttcttaagtcaccacaaagcaactactttggaatcaggagtggacgcatctgttcttgtc

SEQ ID NO: 34369 - DNA, 201 bp, Homo sapiens; identical to SEQ ID NO: 8730

SEQ ID NO: 34370 - DNA, 201 bp, Homo sapiens
actcaaagcatggaattctaaagctcaaaagtcatctggcttagtctagccccaggtatgtgagctcaggggtatgagctctccatcacaattggacctgygctaaaaaacaaaaacaaaaaaaccaaaactctcctcttctcccctagggtaaagaaacttctctggttgattattagactatcttattggtcttatgca

SEQ ID NO: 34371 - DNA, 201 bp, Homo sapiens
ctgaaataaaattcatgcctttcccacttaacagagggccatttttcaagcatcagctgacatatgtatgtgcatgtactgtgaaatgataagctattagrcatgtgtcaaccagaaaatggggatgccacacttacagcatgcccacaggacaggcttgtcagggctgtctcattcacttgtacatttacttggctagtt

SEQ ID NO: 34372 - DNA, 201 bp, Homo sapiens
aggtgatcttgggaaacgtccctctatttctctatacctcttattctgaagttttaagactgaaataaaattcatgcctttcccacttaacagagggccakttttcaagcatcagctgacatatgtatgtgcatgtactgtgaaatgataagctattagacatgtgtcaaccagaaaatggggatgccacacttacagcat

SEQ ID NO: 34373 - DNA, 201 bp, Homo sapiens
ttgtataaatgtgtgaattattgacatggatccaattaaatggggaatggtagcaagaagtagtccttggtccttcattgtagggagaaaaagttttagarggaggatactgcagaatggagtttctgatggaaaatgtttccaccctcacagattttaaataactcttctttagggaggtcagtgaggctacagggagcc

SEQ ID NO: 34374 - DNA, 201 bp, Homo sapiens
atgtcattttaaaagcctcctaatattgagactccattttgatgtatcaggatagaatgagaagaacccaccttcaaatcctggctagggcacttactagrcaggtgatcttgggaaacgtccctctatttctctatacctcttattctgaagttttaagactgaaataaaattcatgcctttcccacttaacagagggcc

SEQ ID NO: 34375 - DNA, 201 bp, Homo sapiens
ctggaaaagaaagatgatcataactagaacttaacctttgaaggttttatgagcatgaaaagatgtctggaaagaacttagcccaccaggacagggctccrtgaatgtcatctgtgactgtgggtacccttccttcaaatgagtgaacaataccctcctcattgacttggaaaacaagtgcccctagcatgctccttcaac

SEQ ID NO: 34376 - DNA, 201 bp, Homo sapiens
atcaccttggagctctgaggacctcgcacggcccaggctgagagcatatagctctgcagggtcccaggatatgcttatggatccaaggtagtgttgacctsttcaacttctgttcccttccttatgcttcgggttccctcggtttggggagttagcctcccccagacctcctgactgcagctttgcctggtttgtccaaag

SEQ ID NO: 34377 - DNA, 201 bp, Homo sapiens
ttctcttagtctggctcaacttactatagacagcaggacctcaatcaatacccttaatctggaggctgactaaagacaaaatattgaattcactcttcatrttttcatcataaaccccaaattctatgacaatgatgattttggaaacaataaattaagcatcaagcatcatatggcaaaatctattggaatgtaatattt

SEQ ID NO: 34378 - DNA, 201 bp, Homo sapiens
agtcgtctgtggcagatcacgctttgaagatggtgcaagtgtgtctgtgagaatctgtgtgcccttttccagaacaaaaccaagtgactcggtgattctgkcgcctcgtttcttagccatctagcatttgttcaagagactcagtcttgtggtctacagctagccttctgtttccatgctgtggaactcaccacattcaca

SEQ ID NO: 34379 - DNA, 201 bp, Homo sapiens
aatggaatttaggtttgctttctgaaatcaatccaggcaagcctttttgcacatgagcattcttagaaagtctttgaatgtctattcttactcacttctabgggtggcacaaaatccaaaaataaaattaccatgaggttctgcttgcttcctgctttagcgacactggaaatcctccagggatagctcatgtactttgta

SEQ ID NO: 34380 - DNA, 201 bp, Homo sapiens
atccttgtggcatgtgcctgtccttgtgtgagtgcttgtgtgtgtgtgtgtgtgtgtgtgtgtgagcaactcacctaaaaagtaggctctagagtaggctytaaagagcttggctgtgccttttgaactgacagatacatatactttatagaactgtgaactttttcacccaataaaacaggggtaatacaagagtcttct

SEQ ID NO: 34381 - DNA, 201 bp, Homo sapiens
cagagagacaattcacctccccaagtacttaaacactcattgtagccccagttgttctagcctatttcatatccattagaggtcatgcttagaattcagaycatttcttcttcttctttcttttcttcttccttcttccttctttcttcttctttgttaagcaaatatactcttctctatgtgttaccacttctgtggtgc

SEQ ID NO: 34382 - DNA, 201 bp, Homo sapiens
ccaggaggcggaggttgcagtgagccgagatcgcaccattgcactccagcctgggcatcaagagcaaaattttgcctccaaaaaaaaaaaaaaaaaaaaagaatagtgctgttcttattgttgtttcttccatccccctacagcagagtttcttaacagctgtgctattgacatttagggctggatagttatttgttgtga

SEQ ID NO: 34383 - DNA, 201 bp, Homo sapiens
aaatagatagataaactctatgtccagaaccaaggagtctattttggttgtctattgtctggatccactcattaggctggagaagggttaccagataaaayacaggattcccagttacaagtgaatttccaataaacagcagtataaatgtcaagtatcacatgggctatacttatactgctgtttatctgaatttcaaac

SEQ ID NO: 34384 - DNA, 201 bp, Homo sapiens
cctaagccctcgacagaaaagcacatgtttccatgaagtctgaagtctcaaatgattgcatttcatggagtttgccttgtgcaaagtcatagaaacaaatscaggtgcactgtgggcaccagagctaataaagaagagaatcttgtagacatgaaagagagaaagtaagagagataaaaggagatatgtggaaagagagag

SEQ ID NO: 34385 - DNA, 201 bp, Homo sapiens
tttcttttaccttatcatggacagagtggccccccagaagcacaggatgcaagacaacacacatttcagtggctgctccttctgcatacatcattgagctstgccaagggtttgaacacacacacacgtaaataaaggcctaattatgtgtgtgtgtgtgtgtgtgtgtgtgtgtgtgtgtgtgtgtgtattatatgtatt

SEQ ID NO: 34386 - DNA, 201 bp, Homo sapiens
taccttatcatggacagagtggccccccagaagcacaggatgcaagacaacacacatttcagtggctgctccttctgcatacatcattgagctctgccaagggtttgaacacacacacacgtaaataaaggcctaattatgtgtgtgtgtgtgtgtgtgtgtgtgtgtgtgtgtgtgtgtgtattatatgtattaagctct

SEQ ID NO: 34387 - DNA, 201 bp, Homo sapiens
cgatctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggacttg

SEQ ID NO: 34388 - DNA, 201 bp, Homo sapiens
atctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggacttgga

SEQ ID NO: 34389 - DNA, 201 bp, Homo sapiens
catttcagtggctgctccttctgcatacatcattgagctctgccaagggtttgaacacacacacacgtaaataaaggcctaattatgtgtgtgtgtgtgtrtgtgtgtgtgtgtgtgtgtgtgtgtgtattatatgtattaagctctttttcctttctccatagcactgcatatacaaagatcagccaccctgagttgaaa

SEQ ID NO: 34390 - DNA, 201 bp, Homo sapiens
tcagccctcaagaaaaccaacacgaggtcttcgacagcttactagatcttagagatcaacttcatcatttacagcaaaacatgccaaggttcaccaaaaakgtataggcttgtctatggtcataagacttagtgatagaaaagggatagatcccagatttctctttttttcattgatttatctatgtaactttttatgtat

SEQ ID NO: 34391 - DNA, 201 bp, Homo sapiens
tctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggacttggaa

SEQ ID NO: 34392 - DNA, 201 bp, Homo sapiens
tcagtggctgctccttctgcatacatcattgagctctgccaagggtttgaacacacacacacgtaaataaaggcctaattatgtgtgtgtgtgtgtgtgtrtgtgtgtgtgtgtgtgtgtgtgtattatatgtattaagctctttttcctttctccatagcactgcatatacaaagatcagccaccctgagttgaaataaa

SEQ ID NO: 34393 - DNA, 201 bp, Homo sapiens
atagtccgcaatatgtacagttgtgtgcattgatcatgaagagagaatccatgttcacttcccaattcagccctcaagaaaaccaacacgaggtcttcgasagcttactagatcttagagatcaacttcatcatttacagcaaaacatgccaaggttcaccaaaaatgtataggcttgtctatggtcataagacttagtga

SEQ ID NO: 34394 - DNA, 201 bp, Homo sapiens
ctcctgacattgtgatccacccgccttggcctcccaaagtgctgggattgcatattcatttttcgtctatgcatccattcatccatctttccatccatccatccatccatccatccatccatccaatcaacagaaacaacagtagaaattaacttggtcttgtatgcggaagcagtgaggtttttctcaaggacttggaaa

SEQ ID NO: 34395 - DNA, 201 bp, Homo sapiens
tggcgcccaggctggggtgcggtgttgtgatcatggctcactacagcctcaacctcccccagctcaggtgatcctcctgcctcagactcccaagtatctgrgactacaggcacataccactatgcctggctgatttttgtatttttgtagagacagggtctcactgtgttgcccaggctggtctcaaactcctaggctcaa

SEQ ID NO: 34396 - DNA, 201 bp, Homo sapiens
tgctttttcggcttcttaaaaatgtctaaacacctttgtgaaacaggattctctgagaccaggcccactgccttttccagttttttttctttctttctttyttttgagacagagtcatgctctgttgcccaggttggagtgcagtggcgtgatcttcggctcactgcaacatctgcttcctgggttcaagcaattctcctg

SEQ ID NO: 34397 - DNA, 201 bp, Homo sapiens
ccagtagcttcacctggttctggaatgaaatacaacacacattagggcttcagaccctcttctctctgaaagcctgccctttgtttttgagacagagtctygctctgttgcccaggctggagtgcagtggtgcgatctcggctcactgcaacctctgcctcctggattcaagtgattctcctgccctcagcctcccgagta

SEQ ID NO: 34398 - DNA, 201 bp, Homo sapiens
cttcatgtctaaaacaccaaaagcaatggcaacaaaagccaaaattgacaaatgggatctaattaaactaaagagcttctgcacagcaaaagaaactactrtcagagtgaacaggcagcttacagaatgggagaaaatttttgcagcctactcatctgacgaagggctaatatccagaatctacaaagaactcaaacaaat

SEQ ID NO: 34399 - DNA, 201 bp, Homo sapiens
cctcttctctctgaaagcctgccctttgtttttgagacagagtcttgctctgttgcccaggctggagtgcagtggtgcgatctcggctcactgcaacctcygcctcctggattcaagtgattctcctgccctcagcctcccgagtagctgggattacaggcatgtgccactacacccggctaatttttgtatttttgagta

SEQ ID NO: 34400 - DNA, 201 bp, Homo sapiens
tggccgaatgtcggtgtgccagctgtttcatgcaccagacctgtagttcacccctactcttttacctgtagttcatccctactcttctaaggcttgaatgraaaataatttctaatttgttgtaaaatttaccaatttggtattgctgctgtaaacaggattttatctagggtttagatgccttatcttcaaattccacta

SEQ ID NO: 34401 - DNA, 201 bp, Homo sapiens
tgcacaatggaatactatgcagccataaaaaaggatgggttcatgtcctttgtagggacatggatgaagctggaagccatcattctcagcaaactatcgcmaggacaaaaaaccaaacaccacatgttctcactcataggtgggaattgaacaatgagaacacagggacacaggaaggggaacatcacacaccggggcctg

SEQ ID NO: 34402 - DNA, 201 bp, Homo sapiens
cctgccctttgtttttgagacagagtcttgctctgttgcccaggctggagtgcagtggtgcgatctcggctcactgcaacctctgcctcctggattcaagygattctcctgccctcagcctcccgagtagctgggattacaggcatgtgccactacacccggctaatttttgtatttttgagtagagacaaggtttcacca

SEQ ID NO: 34403 - DNA, 201 bp, Homo sapiens
tcatcagtctaggaaagttattctcaaccctggctgggtatcagaattgtctgtagtgcttctaagaattatgagttatggccagacgcggtggctcatgmctgtaatcccagcactttgggaggccaaggcgggtggattacaaggagtttgagagcagcctccccaatatggtgaaaccccttccctactcaaaataca

SEQ ID NO: 34404 - DNA, 201 bp, Homo sapiens
cctctgcctcctggattcaagtgattctcctgccctcagcctcccgagtagctgggattacaggcatgtgccactacacccggctaatttttgtatttttkagtagagacaaggtttcaccatgttggccaggctggtcttgaactcctgacctcaggtgatttgcctggcttggcctcccaaagtgccgggattacaggc

SEQ ID NO: 34405 - DNA, 201 bp, Homo sapiens
aatcctcatgacaatcctaagtggaaggaagaactccccatgttaccagtgacgcagcggaagcccaggtgctactgaaggtcacgcagtcagcattgacraagtctacactagaatccaggcctgacacaacccaaagtctgtattttttccctctgcagtctcttaaaattggcaaaaggtaaaccttcatgcgaccct

SEQ ID NO: 34406 - DNA, 201 bp, Homo sapiens
tagagacaaggtttcaccatgttggccaggctggtcttgaactcctgacctcaggtgatttgcctggcttggcctcccaaagtgccgggattacaggcatragccactgcgcccgggccaaaagcctgctttttgatcagcaatattggagacagttgtaggaaacactgaaagactgcaggatgcagtggggagggcgaa

SEQ ID NO: 34407 - DNA, 201 bp, Homo sapiens
gttgaagtaggagctgttcaattggaggtgagatttttagtagggatttctaatgcattcttttttcccattgatggttgttaatacttcccctacacacmcacacacacacacacacacacacacacacacaagcataaatagggcacacgtattctcccatgtaagggctgctgtcccttctccctcccacttatagcg

SEQ ID NO: 34408 - DNA, 201 bp, Homo sapiens
cagtgggttctgaagatcagatataactgagggaaagttaggtcatgattgccacctggatgctgttctctctcttcacggtaggtctcagttacttttaytgtggacttttgcttgctgcagagggaacttacacctttcatgcctcaagctcattaaggcacatttctcttttattcttcagggacattgcatttatga

SEQ ID NO: 34409 - DNA, 201 bp, Homo sapiens
ggttcccatgcaaatcgcttaaattccttcatcaccagaatctctccaacaggcccaactccagcccagctgtgaacactgctgtcatggagacaactccaaaatgaaagaactatgcaattgcctgaaggtgctaatggagagccagtttactctaatctcttattactaaggaacctctcggtttcgagattaagtggg

SEQ ID NO: 34410 - DNA, 201 bp, Homo sapiens
ttgggtgccccttggtgggaatcctcatggcccacctgttgtagttggtttctacactaatccaatctcccaacatgtcctccctctaaccccctttgcaygtctctctccacaactgtcatccttttcttgttccttgcaagctcccagcagcagcccagactgtgatcaaacttgggctgccccttaggctaagtgaca

SEQ ID NO: 34411 - DNA, 201 bp, Homo sapiens
cagttgggagttctcatctggttgggttccatggtagattttttaaatgtctttatgcatggaaggtaactttaaagatggaaatatgagtggtgttttayagattgctcaaaccgccaggttaagattgacaagagtttcaaccaatagaacgtggaggaaatgcaagaacatcttgtcctcatcaaaagtgctggggat

SEQ ID NO: 34412 - DNA, 201 bp, Homo sapiens
atgaagtggacaagaattccaaatacaaagagtgtaaatacatgacattttactgtatatagaaacagatggtgcctgtaatcccagcactttgggaggcyggggcgggtggatcacgaggtcaggagatcgagaccatcctggctaacgtggtgaaaccctgtctgtactaaaaaatacaaaaaaattagccaggtgcgg

SEQ ID NO: 34413 - DNA, 201 bp, Homo sapiens
cattgtttttctcatttgctctctgattcttgaaattaaggacattaagcaaggattctggtgtctgtatctgaatgaggcaatgagagacaattatttgytgcacttgccaccagcattaattaatgaataagaacttaaaagataatatgtaaattacctagttacctaacacattttatggtaatattatgcattatt

SEQ ID NO: 34414 - DNA, 201 bp, Homo sapiens
caatgagagacaattatttgttgcacttgccaccagcattaattaatgaataagaacttaaaagataatatgtaaattacctagttacctaacacattttmtggtaatattatgcattatttaaatatgacttctcatctccccccttatctttctcatttgtcctctgagttctggaaataaagtagttaatcataaatt

SEQ ID NO: 34415 - DNA, 201 bp, Homo sapiens; identical to SEQ ID NO: 8834

SEQ ID NO: 34416 - DNA, 201 bp, Homo sapiens
gtaaacacctgttaagctgtatttttaattcatattatattgttatttctattggcttttgcctgaatatttttgatccaaatttgttgaatccaagttaygtgaaacccataagcatggagggctgactgtaaaaacataaatatagatatagagatagagatagagatcttgaactgagatgtgtattggtaacaaaaa

SEQ ID NO: 34417 - DNA, 201 bp, Homo sapiens
cctccatttgattactgcaaggtactcccagttggcctttctaccttcattttcaacaccatcgctagcacctcagtctattctccataattttgtctgcrttatctttccaaaaaatcaatctgatcatggtaagcctctgtcaaataaaagctgcatgattttgggcccgttacttaagcctcaattttcttaatctgt

SEQ ID NO: 34418 - DNA, 201 bp, Homo sapiens
ggatggtaagttttaaaacaagggaaaaaacagactttaagtattgaggcttatgtcagtgagctaggatatatattgattgtatctcacatttttaattkttttgaagattataaagatcaataactggaagcttctgctcttttgatagatggattttgagaagagttgaacattaatattcccaaatcaagggttatt

SEQ ID NO: 34419 - DNA, 201 bp, Homo sapiens
aaggaggtaaaataattttatactaaatactgtaaaacattgatgaaagtaatcaaagaagacacaagtaaatggaaagataccccacattcatagatggracagattaatatttttaaaatgtccatactacccaaagcaatatatagatttaacacaatttcaatcaaaattccaatggcattcttcagaaacaattgt

SEQ ID NO: 34420 - DNA, 201 bp, Homo sapiens
aaaacccatctctacaaaagtgaaaaacattagccagatgtggtggcacatgcctatagccccaactacttgggaggctgaagtgagagggtcacttgagsctgggaggtctaggctgcagtgagctgtgatcacagcactgcactccagtctgggtgacagagcaagatcctgtttcaaatatatatacacatacatata

SEQ ID NO: 34421 - DNA, 201 bp, Homo sapiens
tatataaaatatatagggataaacttaaagaagtaaaatagctctataatgaaaactataaaacattgatagaagaaattgaagaggacacaaaaaatagaaaaatatttcatattcatggattggaagaatcaatattgttaaaatcttcatactacacaaaatcatctacagatgcaattcctatcaaaataccaatgt

SEQ ID NO: 34422 - DNA, 201 bp, Homo sapiens
aagcttagcactcctgaaaattactaaagcacaaaggtaagcaacaagagagggaaaaagaaacaaagaatctataaaatgatcagaaaatgataaacagaatggcaggagtaggttcttacctatcaataacaaccttgaatataaatggattaaattctctaatcaaaagacaggtggctgaatgggttttaaaaaaga

SEQ ID NO: 34423 - DNA, 201 bp, Homo sapiens
cattagtactagcaagtacagtcagacaagaaaaaaaataaaaggtatccaaataaaaagaaacaagtaaaattatctctatttgcagatgacctaattcyatatgtcagaagttaatctagctagaactaactagaaccccaaagattctaccacaaaaagtgttagaactaataaatgaattcaacagttacaaagtac

SEQ ID NO: 34424 - DNA, 201 bp, Homo sapiens
actagcaagtacagtcagacaagaaaaaaaataaaaggtatccaaataaaaagaaacaagtaaaattatctctatttgcagatgacctaattctatatgtyagaagttaatctagctagaactaactagaaccccaaagattctaccacaaaaagtgttagaactaataaatgaattcaacagttacaaagtacaaaaata

SEQ ID NO: 34425 - DNA, 201 bp, Homo sapiens
acagattcaatgcaatccttatcaaaatactaatggcattcttcaaaaaatagaaaaaataatcctaaaacttatatggaaccacaaaatacccagaatastcaaagctatcccaagaaaaaagaacaaaactggaggaatcacattacctgacttcaaatcataatacagagctgtagtaaccaaaacagcatggtgctg

SEQ ID NO: 34426 - DNA, 201 bp, Homo sapiens
tcatagatggaacagattaatatttttaaaatgtccatactacccaaagcaatatatagatttaacacaatttcaatcaaaattccaatggcattcttcaraaacaattgttttaactcctgttataatatggaaccacacacacaagcacacacacatgcgtgcacacacccacacacacacagccaaagcaatactgag

SEQ ID NO: 34427 - DNA, 201 bp, Homo sapiens
aacaaaactggaggaatcacattacctgacttcaaatcataatacagagctgtagtaaccaaaacagcatggtgctggcataaaaacagacacacagaccratggaacattctagagaacccagaaacaaattcatacatctaaagagaactcatttccaacaaacgtgccaagaacaacagtggagaaaggacactctct

SEQ ID NO: 34428 - DNA, 201 bp, Homo sapiens
gaaaagctcctcaacattggtcttggcaatgagtttttgtatatcataccaaaagttcttactgcaaaaataaaaataaataagtgatattaaatctaacraaaaacacatttttatagaaaaggaaacaatcagcaaaacgaaaggcaacctactgactggcaaaaataattgcaattgataaggggttaacatccaaaa

SEQ ID NO: 34429 - DNA, 201 bp, Homo sapiens
gagctgtagtaaccaaaacagcatggtgctggcataaaaacagacacacagaccgatggaacattctagagaacccagaaacaaattcatacatctaaagrgaactcatttccaacaaacgtgccaagaacaacagtggagaaaggacactctcttcaataaatggtgctaggaaaaccggatagccatatgcagaagaat

SEQ ID NO: 34430 - DNA, 201 bp, Homo sapiens
aagcagaagtgcctttcccttcctgggacttccccttcaagggatttacatatattctgctataaacgcatttaacatacagcactgtaattgtgacccamctaagtctgtgacccacttaagttaccctcatcctatggccagtctcagcatggtgaaactgcaaaagaaactaaatccataaccaaatgtcttaaagaa

SEQ ID NO: 34431 - DNA, 201 bp, Homo sapiens
aataaatagaaaagacatttttaggaaaaaggacttttggttattcctaatttaggacaaatatgaatacctgaactatcctcctaagaatattgactagagaagaagtattacttataaaatagtaagggaaaaaattgagataaaattattcttgtttgtctttttcaatacagattaggaaatctttctaggtcaccc

SEQ ID NO: 34432 - DNA, 201 bp, Homo sapiens
aagataaatggataaagaaaatgtggcacatacgcacaatggagtactattgagccataaaaaataatgagatcctgtcatttgcacaacatggatggaawtggaggttattatgttaagtgaagtaagctagacacagaaagacaaaccacatgttctcacttatttgtgggagctaaaaattaaaacaattgaattcaa

SEQ ID NO: 34433 - DNA, 201 bp, Homo sapiens
agaaggaagaaactccagacatatctgaacatcagaaggaacaaactccggacacaccatctttaaaaactgtaacactcaccacgagggtctgcagcttrattcttgaagtcagtgagaccaagaacccaccagaaggaaccaattccagacacaaaactatccctgtttgcagacaacatgattctatatctagaaaac

SEQ ID NO: 34434 - DNA, 201 bp, Homo sapiens
ataccttacagtgttccccctttacttctacatgatcaaatctacttcattctgaattattaactgttgaaatcatatagcattctgatttttagcaagayattttctacttgatcttcccaagaatggtgtagataggggataaaagattaagttggtaaaatggtactttctcttagattatagaatttaccattcaag

SEQ ID NO: 34435 - DNA, 201 bp, Homo sapiens
ataaatagaaaagacatttttaggaaaaaggacttttggttattcctaatttaggacaaatatgaatacctgaactatcctcctaagaatattgactagagaagaagtattacttataaaatagtaagggaaaaaattgagataaaattattcttgtttgtctttttcaatacagattaggaaatctttctaggtcaccct

SEQ ID NO: 34436 - DNA, 201 bp, Homo sapiens
gatgactacaatcaacagtaatttatcgtacttttaaaataactaaaaggatataattggattgtttgcaacacaaagaaaagataaatacttgaggtgayggatacctcatttgccctagtgtgactactacacattgtatgcttgcatcaaaatatctcaagcgccctataaatatatacacttactgtattcataaaa

SEQ ID NO: 34437 - DNA, 201 bp, Homo sapiens
  misc_feature (1)...(201): n = A,T,C or G, or insertion/deletion polymorphism (see Tables 1-2)
actccatagaacagggagatgattttgtctgtgacttgttctttgtctgcaccagaagagtctttagccttgggctttgcatacatgaaaaggatggttcngtagaatataatcaccactgttaggtgggcagagcaggtggaggaggctttgtgccttccttctgcagaaggaattctcaggatggtggagagaataaaa

SEQ ID NO: 34438 - DNA, 201 bp, Homo sapiens
taaatagaaaagacatttttaggaaaaaggacttttggttattcctaatttaggacaaatatgaatacctgaactatcctcctaagaatattgactagagaagaagtattacttataaaatagtaagggaaaaaattgagataaaattattcttgtttgtctttttcaatacagattaggaaatctttctaggtcacccta

SEQ ID NO: 34439 - DNA, 201 bp, Homo sapiens
agaacacatggagacaagaaattactctgccatgactgaattctttctggtggggctttcccaatatccagagctccagctttttctgttcctgctctgcstcatcatgtacatgataatcctcctgggaaatagcctcctcattatcatcaccatcttggattctcgcctccatactcccatgtatttctttcttggaaa

SEQ ID NO: 34440 - DNA, 201 bp, Homo sapiens
  misc_feature (1)...(201): n = A,T,C or G, or insertion/deletion polymorphism (see Tables 1-2)
attgcaagggaggtttgcaacacagaattgatgcctcctccaatccaggaccccgcagccatggacatgtatgaagccttgctcatgatgatagggtatcntagagggttacagatggccacatagcagtcaaacgccatcatacttagaaggacacactctgttgctcccatagcaaaagagagaaacatttgcactcca

SEQ ID NO: 34441 - DNA, 201 bp, Homo sapiens
aagcatgtgaaacaaaaactggacaattaaaaaagggaaaaaatacgccactctactacatagatacaaaaaccttaaataaaatattagcaaatgtaatmcagcaatgtacaaaataataatacctaatgtccaagtaaaatatatatcagggatgcaagaaaatgttaacattagaaaatatgttaatttaatttataa

SEQ ID NO: 34442 - DNA, 201 bp, Homo sapiens
tgtctattttactaaatgcagaaaatttcataaaattcaacatgcatttataatgacaatatgagacattacatactttctaaatagtcagatactaaatkatagcatcataagtattgacaagaatatggagaaatcaagttcaattcattgccagtgaacatatgaattaatattttgaagagcaaataagatcaggta

SEQ ID NO: 34443 - DNA, 201 bp, Homo sapiens
ttcataaaattcaacatgcatttataatgacaatatgagacattacatactttctaaatagtcagatactaaattatagcatcataagtattgacaagaayatggagaaatcaagttcaattcattgccagtgaacatatgaattaatattttgaagagcaaataagatcaggtaaagttgatcccacaattccacttaca

SEQ ID NO: 34444 - DNA, 201 bp, Homo sapiens
aatatgaatacctgaactatcctcctaagaatattgactagagaagaagtattacttataaaatagtaagggaaaaaattgagataaaattattcttgttygtctttttcaatacagattaggaaatctttctaggtcaccctattgttctgcctgatatacacgatggataaaaagttgacctcagaaaaactctagtgt

SEQ ID NO: 34445 - DNA, 201 bp, Homo sapiens
tcaaaccataaataaatgtataaattaaagaatttcagtaatgagggatttgcttttttacctctaagtatgagaaaatacatattgccttcttcctgcakagaagtcagcttcctctgctcgaacagctgttctgctgatcttcctctcactgcatatttggaaatacccatgataatgagaggtaggtcactcaaaaag

SEQ ID NO: 34446 - DNA, 201 bp, Homo sapiens
tgcttttttacctctaagtatgagaaaatacatattgccttcttcctgcagagaagtcagcttcctctgctcgaacagctgttctgctgatcttcctctcmctgcatatttggaaatacccatgataatgagaggtaggtcactcaaaaagctcttaaacatagcaatttgctataattatttgtatccttatttgatgta

SEQ ID NO: 34447 - DNA, 201 bp, Homo sapiens
ggagtatttctatatttaaatgccaaaaacagaagtcctactttttaaaatcagattgctagcctcataagttccatctcaataacctcacaaagataacwaaaagaactatctgcttctcagttctcattaaaatcaagtagctgccattgctattgtagaagccaattaatcattggcaaaatagaaactagctctagt

SEQ ID NO: 34448 - DNA, 201 bp, Homo sapiens
  misc_feature (1)...(201): n = A,T,C or G, or insertion/deletion polymorphism (see Tables 1-2)
ctctcagaagcaattaaaacaaagttgttgatacaatttaattaaagtttaactcataaaacagtaacaattattctagctttacattctctgggaagagnaagttgaggaatgctacccaggtaaaacagccaagacatggaaattagaattcactatatctgatggagagatgtagcagtaacccgtgacgcttaatgc

SEQ ID NO: 34449 - DNA, 201 bp, Homo sapiens
caatggtgctctttttttgtcagtggacaatatttttaaaaagttattgagcaagagatgtaacataatcctgaagaatgggtaaactacttatgccatgaaaaattggtattatacgcttcaacaaatcaaatttgaaataaaaaattctcagagttgttaactttatgcaaggacatgttcagtgtactggttcgtaag

SEQ ID NO: 34450 - DNA, 201 bp, Homo sapiens
catgaaaaattggtattatacgcttcaacaaatcaaatttgaaataaaaaattctcagagttgttaactttatgcaaggacatgttcagtgtactggttcrtaaggcagatgttgggcatgttttctcactaatcaatactcaatggacaaaagaattaaacaggtcaaatgtgacactgtagaagctatactataatgta

SEQ ID NO: 34451 - DNA, 201 bp, Homo sapiens
gtagaagaatggaccaaaaaaaaagtgaatgtacatttcatcaaataaggatatttgaatatgcaataaatgtatgaaaaatgcttaacttcagggaaataaaaaaataaaataatatgctaccactcccaccacaacagctaaaatgaaaaacagagataataccaagtgtttccaaagatgtaaagcaacttaagttct

SEQ ID NO: 34452 - DNA, 201 bp, Homo sapiens
ttcctaccacagtaacactgataagaattactttttcttttatccactggcatcatatcccccagctgttttggagcatctctccattttccagctttgctttttttttttttcctccctctctcttgctttcatttcatatgataatattcttttgatgtaaatatcttttatcaggtaaaataaaatttctcttccttg

SEQ ID NO: 34453 - DNA, 201 bp, Homo sapiens
gctgaggcagaaaaatcacttgaacctgggagtcagaggttgcagtgagccgagatcacactactgcactccagcctggtgacagagcgaaactcagtctcaaacaaacaaacaaaaagcccacacaaaaaaattagctgggtgtggtggcgtgcacctgtagtcccagctactagggaggctgaggcataagaattgctt

SEQ ID NO: 34454 - DNA, 201 bp, Homo sapiens
ctgaggcagaaaaatcacttgaacctgggagtcagaggttgcagtgagccgagatcacactactgcactccagcctggtgacagagcgaaactcagtctcaaacaaacaaacaaaaagcccacacaaaaaaattagctgggtgtggtggcgtgcacctgtagtcccagctactagggaggctgaggcataagaattgcttg

SEQ ID NO: 34455 - DNA, 201 bp, Homo sapiens
tgaggcagaaaaatcacttgaacctgggagtcagaggttgcagtgagccgagatcacactactgcactccagcctggtgacagagcgaaactcagtctcaaacaaacaaacaaaaagcccacacaaaaaaattagctgggtgtggtggcgtgcacctgtagtcccagctactagggaggctgaggcataagaattgcttga

SEQ ID NO: 34456 - DNA, 201 bp, Homo sapiens
gttccctgaaagagatctttccaatattaaaatacatatgtacgcatttacattgacagaaaacttgtcaagttgaatgtatgatgcaagacagactctartggaggcaagactagtaagtggataaaaagaactgtgtcataaatttaaaccttctttaggaaaaaagttttatttaaaaacaaaaactttttaataggt

SEQ ID NO: 34457 - DNA, 201 bp, Homo sapiens
gaggcagaaaaatcacttgaacctgggagtcagaggttgcagtgagccgagatcacactactgcactccagcctggtgacagagcgaaactcagtctcaaacaaacaaacaaaaagcccacacaaaaaaattagctgggtgtggtggcgtgcacctgtagtcccagctactagggaggctgaggcataagaattgcttgaa

SEQ ID NO: 34458 - DNA, 201 bp, Homo sapiens
atttttttcacgtcatcaccaagaggttatactttattaaagcagtctttgcagggttccctgaaagagatctttccaatattaaaatacatatgtacgcrtttacattgacagaaaacttgtcaagttgaatgtatgatgcaagacagactctagtggaggcaagactagtaagtggataaaaagaactgtgtcataaat

SEQ ID NO: 34459 - DNA, 201 bp, Homo sapiens
gtcccgaggtctgagcccccaggaaatgttacagctctctctggttctgccgcctgcagctcagtgaacacgggcatgttacagcttgttcattccccaasctcgcagcctcagtgagatccgggttcctgtcccacaatcaagaagaataaggtgcgtggacaccggagagtgagtaaggcagagaatttatttagcaac

SEQ ID NO: 34460 - DNA, 201 bp, Homo sapiens
aatgttttttaagtccttgcactcatagagctttcattgaaataactgaatatatactcttttttttttttttgaggcagagtctcgttctgtcccccagkctggaatgcagtggcgcgatctcggctcactgcaacctctgccttctgggttcaggcaattctcttgcctcagcctcccaagtagctggaattacaggca

SEQ ID NO: 34461 - DNA, 201 bp, Homo sapiens
ccctcttctatgctacccagacctttacttctgctacagtggtctttcttttatgctataaccatttgttagtttctgaaatcttctcaatggcaggaccrtggctcactgttctctttatgaagtccaatgccatgttaatttaaaatagtaggcagcaataaactgctgaatgaactaattaattaaaattttaaaaga

SEQ ID NO: 34462 - DNA, 201 bp, Homo sapiens
ccagtcactgcaagacaaacactgtaggattacacttatatcaacttatatcaactaccaaaaagaaccaaattcatagaagcagaaaagagaatgatggyttccaggggctaggtggggggcagacagaaatgaagagttactattcaacaaatataaaagtttcaattataaaagattaatatcttctagatatctgtt

SEQ ID NO: 34463 - DNA, 201 bp, Homo sapiens
caacattgagtggacatcaagtttatttggcatcaaaatttagcaaagggccttatatatatgtgttctccaaatattaaatgaattgtgaatgttcttcragttgaggcttacacaattgcagaggtgcttacaaaaatgtaagtgtggttgagtttaaaaacacaaagacctggaagtaaaacagcagtatctggagcc

SEQ ID NO: 34464 - DNA, 201 bp, Homo sapiens
aattcaaaaaagaaagaaaattactgcttaataagttaggtatggccaggtgcggtggctcacgtctgtaatcccagcactttaggaggctgaggtgagcrgatcatgaggtcaagagttcaagaccagcctggccaacatagtgaaaccctgtctctactaaaaatacaaaaaattagcctggcatggtggtggacacct

SEQ ID NO: 34465 - DNA, 201 bp, Homo sapiens
aaggaggatttaaattggctaccagagccactggcaggtcctctggaaatattggggctcagaggaaggaaagtacttatgtgacacattaatttactatyggatataaaattatggctgaaagctttattgtttatctctcccatgccacttttaagagttgtgattgtgttctagagtatggctatagctcaaagagag

SEQ ID NO: 34466 - DNA, 201 bp, Homo sapiens
caaagagagagagctgagacgtcaactgattgagaaggagcagctacagtgacttcagtatgtggacacaagaagttagcaaaacactgatgaaaaagagkgagactgttttggaagaaactgaaatcccaataagtcatgctatccattgtaagtggagaagatgaggaccctatacagatgtttgaaatgggaacatta

SEQ ID NO: 34467 - DNA, 201 bp, Homo sapiens
aaagaataaattaaaatttaaaataaattctgaaacatggacttcttcacctgggatcttttctgaatagaaagaaagacagccattcttcttccttcatytttgtatcctcgacatccccacctatagggtaaacacataaagcatacccttagaatgacactgtaatgacagaggcacccgaatgtgtgttctgatcta

SEQ ID NO: 34468 - DNA, 201 bp, Homo sapiens
gtagccaacccagagatttgttctttctctgtgataaacagcctgtcccaaacatgggccgtgcagggaattgggtccctaagcttttggttggatgaagsttgccaggtggaggttgttaaggagaggattaagtgaaaatgccatataaaactgcatgattttacaggtagttgtggtttttctgtccagcccaccacc

SEQ ID NO: 34469 - DNA, 201 bp, Homo sapiens; identical to SEQ ID NO: 8833

SEQ ID NO: 34470 - DNA, 201 bp, Homo sapiens
taataaaccccatgtctcatttgctgactctgggtctcttggccttttgcacctggtgccgcccctattgagattaataggggtttagcacaacaccatcrcccaagatacaagtggtaagtttagtgttctttctatgctagcacaaatttgtttcttctccacctcttctttccttccactttcctctacttcaaaaca

SEQ ID NO: 34471 - DNA, 201 bp, Homo sapiens
ccaaatcatggtgtaggtagtactctctaagaggaagacaaaggatatggaaagggaatggagaaactttttcccttcatctccctggagccagtactccrctactccctggagccactactgatgccccaaatggtctgcaaagaccatgctgagtttcttctagtctccccataatagtacatttttcatcattatgca

SEQ ID NO: 34472 - DNA, 201 bp, Homo sapiens
tgaacctgggagtcagaggttgcagtgagccgagatcacactactgcactccagcctggtgacagagcgaaactcagtctcaaacaaacaaacaaaaagcmcacacaaaaaaattagctgggtgtggtggcgtgcacctgtagtcccagctactagggaggctgaggcataagaattgcttgaaaccaggaggcggaggtt

SEQ ID NO: 34473 - DNA, 201 bp, Homo sapiens
cacggtcattttaattttgttcactcatcccctctgttcaaatatatatgcaatatcccaacctcattcaacctgttctttagttatatccacactagcayggcacaacatgagtccaaccacgcaacaacttccgtgagtgagcaagccttactttaccttttttttttttttttttttttttgagacggaatctcactc

SEQ ID NO: 34474 - DNA, 201 bp, Homo sapiens
acatctacactactgaaatggctttcaaagtcatctccttgctttcattcttgttctgctacaagtcattctccagtagcttgggtggtttttttgtttgkttgttttgttttgttttgttttgagacagagtctcgcggtgttgcccgggctagagtgcagtggcgtaaactcggctcactgcaaccttggcctcccagg

SEQ ID NO: 34475 - DNA, 201 bp, Homo sapiens
aaacaagtgggatcactatgtgtagtgttagaaagaagggaataaaactggacaatggtgctctttttttgtcagtggacaatatttttaaaaagttattsagcaagagatgtaacataatcctgaagaatgggtaaactacttatgccatgaaaaattggtattatacgcttcaacaaatcaaatttgaaataaaaaatt

SEQ ID NO: 34476 - DNA, 201 bp, Homo sapiens
aaagttattgagcaagagatgtaacataatcctgaagaatgggtaaactacttatgccatgaaaaattggtattatacgcttcaacaaatcaaatttgaartaaaaaattctcagagttgttaactttatgcaaggacatgttcagtgtactggttcgtaaggcagatgttgggcatgttttctcactaatcaatactcaa

SEQ ID NO: 34477 - DNA, 201 bp, Homo sapiens
aatttttgtattttttgtagagatggggtctcaccatgtttctcaggctcatctcaaactcctgggctctagtgattctcctatgtcagtctcccaaagtkctgggattataagtgtgaaccaccacacccgatcagatgcttataatttattacaaacaacaaatacatttttaatataagtattatcaatgcaatattt

SEQ ID NO: 34478 - DNA, 201 bp, Homo sapiens
atgttaaacaaatattatgtactctataaatatttgttgaagaatgagcacacacattgcaggacagccctataacctgtacactttggaatatatatatygcaaaatatatttgtgtgtatatatatgcacacacattctggcattcactataagtttctgctttttttctgatttgattactgataggaaccctaagct

SEQ ID NO: 34479 - DNA, 201 bp, Homo sapiens
agcagattcagtatctaaatagggaccattcctcatagacatctgtttccaatggagcctcacatgaaggaagggttgaggaattttctgggatgactatktcaagggcagtattcctattcatgaaggctataccctcatgacctaatccctttccaaaggcctcacttcctaataccatcacccgggaattagggtttc

SEQ ID NO: 34480 - DNA, 201 bp, Homo sapiens
ctataaatatttgttgaagaatgagcacacacattgcaggacagccctataacctgtacactttggaatatatatatcgcaaaatatatttgtgtgtatatatatgcacacacattctggcattcactataagtttctgctttttttctgatttgattactgataggaaccctaagctggtaattaaaggagtattcttta

SEQ ID NO: 34481 - DNA, 201 bp, Homo sapiens
ggaattttctgggatgactatgtcaagggcagtattcctattcatgaaggctataccctcatgacctaatccctttccaaaggcctcacttcctaataccrtcacccgggaattagggtttcaacatatgaatgggaggggggacataaacattcattcagtcaattgtacagtgtattttgctaagccattctagtggat

SEQ ID NO: 34482 - DNA, 201 bp, Homo sapiens
acacattgcaggacagccctataacctgtacactttggaatatatatatcgcaaaatatatttgtgtgtatatatatgcacacacattctggcattcactrtaagtttctgctttttttctgatttgattactgataggaaccctaagctggtaattaaaggagtattctttatacatttttagtctacttacctttcctc

SEQ ID NO: 34483 - DNA, 201 bp, Homo sapiens
gcctcacttcctaataccatcacccgggaattagggtttcaacatatgaatgggaggggggacataaacattcattcagtcaattgtacagtgtattttgytaagccattctagtggatacaagattataacattatttgttgtctcaaatgtgcctagccaccacttaaatatcatctacagctgcaaccctccatccct

SEQ ID NO: 34484 - DNA, 201 bp, Homo sapiens
atttgattactgataggaaccctaagctggtaattaaaggagtattctttatacatttttagtctacttacctttcctccaggtttcactgatctttctckttttttataagctgcttgttacattttgtatgtgctggacttggctactcctggttttagggctctgatttatttcactttaaaggtaagtttagaatgt

SEQ ID NO: 34485 - DNA, 201 bp, Homo sapiens
cagtcaattgtacagtgtattttgctaagccattctagtggatacaagattataacattatttgttgtctcaaatgtgcctagccaccacttaaatatcayctacagctgcaaccctccatccctctccataatagtaagaaaaaacaattaagatgaacttataggttctcatgatgaagtactgctcttcaatatttcc

SEQ ID NO: 34486 - DNA, 201 bp, Homo sapiens
gtttttttgttctgtgtcttgcggttggaaatctggcaagctctgaacttctcttaaaattcatttgcttatctattaaatggggacaatgaaaacaaaakgtctgtttttggtgatagggagggtaataatatttactgctgtaaagagtcacatctcatttggagtacaagctgaaaatcagtttctaacttcacactg

SEQ ID NO: 34487 - DNA, 201 bp, Homo sapiens
ttttttttctggtttttttatttgcttgttttgttgtatttgagacagggtctcgctctgtcacagaggctggagtagagtggctcaatctcagctccctscaacctacacctcccaggctctcttgatcccctcacctcagcctcccaactagctgggactacagacatgtgccaccacgcccagctaattttttatatt

SEQ ID NO: 34488 - DNA, 201 bp, Homo sapiens
tttactgctgtaaagagtcacatctcatttggagtacaagctgaaaatcagtttctaacttcacactgacatactatgttctgtgttacatcatttgacattctttcgaaaattcagtgcacatttatttactaatgtaataaccgatgaaatgacacaccacacttgcaaaacaagaagttaaaactatcctaccatact

SEQ ID NO: 34489 - DNA, 201 bp, Homo sapiens
atctatctcctcaaactaaagtttatcaaaatagttaatattagctataatgcagctacatcatgatcagtatatttactctgtcaatcaagagagtctckgtcacagcctcattatcattctctttcttgcttgtatcctgtctgtttcctaacaggtgggttttgtccagattggaaggatagtaaaaggcagcaagta

SEQ ID NO: 34490 - DNA, 201 bp, Homo sapiens
ttactgctgtaaagagtcacatctcatttggagtacaagctgaaaatcagtttctaacttcacactgacatactatgttctgtgttacatcatttgacattctttcgaaaattcagtgcacatttatttactaatgtaataaccgatgaaatgacacaccacacttgcaaaacaagaagttaaaactatcctaccatactg

SEQ ID NO: 34491 - DNA, 201 bp, Homo sapiens
gggtttcactatgttggccaggctggtctcgaactcctgacctcatgatccgccagcctcggcctcccaaagtgctgggatgacagacgtgagccatcacrcccagccgtgttattttaaaaatgtagacatatgatgtcaggcatttactaaaaaccatcttaatattaccattatatttcgaataaaatccactcctta

SEQ ID NO: 34492 - DNA, 201 bp, Homo sapiens
aacacaatatcggaagcaaatttgtattgaaaatttgtagatgtacagatttacagattttgatgtatcaaacatttcaatttacctgaatcatgtccttytctatactacccagcaggcaggtgacctagaacacatggagacaagaaattactctgccatgactgaattctttctggtggggctttcccaatatccaga

SEQ ID NO: 34493 - DNA, 201 bp, Homo sapiens; identical to SEQ ID NO: 8836

SEQ ID NO: 34494 - DNA, 201 bp, Homo sapiens
tctccctggagccagtactccactactccctggagccactactgatgccccaaatggtctgcaaagaccatgctgagtttcttctagtctccccataatastacatttttcatcattatgcaacagggagctaggagggcttgccatctacgactacccagagagtaagcattcatcctgtcttcaaagtctctggatatg

SEQ ID NO: 34495 - DNA, 201 bp, Homo sapiens
caaatggtctgcaaagaccatgctgagtttcttctagtctccccataatagtacatttttcatcattatgcaacagggagctaggagggcttgccatctaygactacccagagagtaagcattcatcctgtcttcaaagtctctggatatgaaaaggccaaagcaaaagtgtggttgtagggtcagaataagatcagtaag

SEQ ID NO: 34496 - DNA, 201 bp, Homo sapiens
gaggctgaggagggtggatcacctgaggtcagggattcaagaccagcctggccaacatggtgaaatcccatctctactaaaaatacaaaaattagctgggygtggtggtatgcgcctgtaatcccaactacttgggaggctgaagcaggagaaccacttgcacctgggaggcggaggttgcagtgagctgagattacacca

SEQ ID NO: 34497 - DNA, 201 bp, Homo sapiens
aatgatatgtcactggcagtctataaaatcttttaaatagaggccagcttcatcaaaaaaacagctttaagttcaaaatctctttctacatttgaaagcascatgttcctaaactttatttgacacttcccagaataattctggcagtattggtagctttgaatgtgctgctgtgtagtcctaagatatattgggtttctc

SEQ ID NO: 34498 - DNA, 201 bp, Homo sapiens
tataaaatcttttaaatagaggccagcttcatcaaaaaaacagctttaagttcaaaatctctttctacatttgaaagcagcatgttcctaaactttatttsacacttcccagaataattctggcagtattggtagctttgaatgtgctgctgtgtagtcctaagatatattgggtttctcaatgtctcaattttcataatc

SEQ ID NO: 34499 - DNA, 201 bp, Homo sapiens
aaaatttatactgaacctgaatacttcagttgctaccactctagtccaagctactgttatcacatctacactactgaaatggctttcaaagtcatctcctygctttcattcttgttctgctacaagtcattctccagtagcttgggtggtttttttgtttgtttgttttgttttgttttgttttgagacagagtctcgcgg

SEQ ID NO: 34500 - DNA, 201 bp, Homo sapiens
tgttgcccgggctagagtgcagtggcgtaaactcggctcactgcaaccttggcctcccaggttcaagcaattctccttgcctcagcctcccgagtagctargattacaggcactcaccaccacacccggctaattgtttttgtatttttagtagagaccgggtttcactatgttggccaggctggtctcgaactcctgacc

SEQ ID NO: 34501 - DNA, 201 bp, Homo sapiens
  misc_feature (1)...(201): n = A,T,C or G, or insertion/deletion polymorphism (see Tables 1-2)
ttgaagagaggatagtaatataattctactgctgtacagagtcccttcttgattaaggtccaggcagtaagtttcctattttacactaacatactacttcntgggaaactccatttggcataccctctgatggaaataattcagtgaaataccaattattaatgtagtaactgcttgaaaaagtagaagatagtattacca

SEQ ID NO: 34502 - DNA, 201 bp, Homo sapiens
gtaaactcggctcactgcaaccttggcctcccaggttcaagcaattctccttgcctcagcctcccgagtagctaggattacaggcactcaccaccacaccsggctaattgtttttgtatttttagtagagaccgggtttcactatgttggccaggctggtctcgaactcctgacctcatgatccgccagcctcggcctccc

SEQ ID NO: 34503 - DNA, 201 bp, Homo sapiens; identical to SEQ ID NO: 8838

SEQ ID NO: 34504 - DNA, 201 bp, Homo sapiens
ttcactatgttggccaggctggtctcgaactcctgacctcatgatccgccagcctcggcctcccaaagtgctgggatgacagacgtgagccatcacacccrgccgtgttattttaaaaatgtagacatatgatgtcaggcatttactaaaaaccatcttaatattaccattatatttcgaataaaatccactccttaccat

SEQ ID NO: 34505 - DNA, 201 bp, Homo sapiens
tgtcttatggagtggtaagcccaatgttaaatcccatcatctatagcctcaggaataaagaggtcaaagaggctgtaaagaaagtcctgagcagacatctrcatttattgaaaatgtgaaaaaccttgggcatgtgatatcctcaatggggcaagagagcttgtcttttgtatttagatactgcaaaacctactgtcacga

SEQ ID NO: 34506 - DNA, 201 bp, Homo sapiens
cgctccagcctgggtgacagaccaagactctgtctcaaaaaaacagacaaacaaacaaacaaaaaacagtttaaatatcttataattataaaaatagatamataaataaataaataatattcagactttgaaataccaacacaattaggtgattgggtaactctcacagacatgtaaatgagaatagacaaatgtgtcatt

SEQ ID NO: 34507 - DNA, 201 bp, Homo sapiens
tacgcatttacattgacagaaaacttgtcaagttgaatgtatgatgcaagacagactctagtggaggcaagactagtaagtggataaaaagaactgtgtcwtaaatttaaaccttctttaggaaaaaagttttatttaaaaacaaaaactttttaataggttgcttacaactccaacaagggagcaaagcaaaataaaatg

SEQ ID NO: 34508 - DNA, 201 bp, Homo sapiens
aggactgcgcctaagaactagaacaaaataaggatgcccactctcaccattcctattcaatgtagtactggaaatcctagccagagaaatcaggcaagagmaagaaataaaatgtatccagaggtaaaagaaaaaaaaagaaagaaaatatatccaaatatgaaagaagaaggtcaaatgacctctgttcactgatgaaat

SEQ ID NO: 34509 - DNA, 201 bp, Homo sapiens
aaactacaatatccccttaccccagttaaaatgacttatatctaaaacacaggcaataacaaatgctagcgaggatatggagaaagaggaaccctcatacsatattggtggggatgtaaattagtacaactactttagagaacagtttggaagttcctcaaaaaactaaaaatagagctatcgtgtgatctagcaatccca

SEQ ID NO: 34510 - DNA, 201 bp, Homo sapiens
aaatttaaatgtactactgaaaactgtgaaaattctagaagaaaacctaggggaaaaactctcttggacatttgcctaggcaaagaatttttgtttagcayctcaaaagtaaatgcaacaaaaacataaatagacaaatagggcataattaaactaaataacttcttcacagccgaagaaacaatcaacagagtaaacaga

SEQ ID NO: 34511 - DNA, 201 bp, Homo sapiens
taatgagactgaagccaaaataataataattttttctttcccagcaatgaaaatcccaggacccaatgtcttcactgctgaattttaccaaacatttaaaraactaatgccaatcctactcaaactattcaaaaaaaagcttccaaactgattctataagcccagtgttaccatgattccagaaccagataaagacacatc

SEQ ID NO: 34512 - DNA, 201 bp, Homo sapiens
aatatgtgtaactttttgttatgtcaattgtatctcaatagaatgttttttaagtccttgcactcatagagctttcattgaaataactgaatatatactcttttttttttttttgaggcagagtctcgttctgtcccccaggctggaatgcagtggcgcgatctcggctcactgcaacctctgccttctgggttcaggcaa

SEQ ID NO: 34513 - DNA, 201 bp, Homo sapiens
gattttaatacggaatatcactgctgctaatatctgctagacatgctacctcacaaaggcctctcaacgccatttccctcttcagttcctggccagccacygtgttgctgagtcctcttcgtttcctccttttacaagcattggggttaacccagtaaaaatatataggtacataacttcaaagtatttatctttaaaagt

SEQ ID NO: 34514 - DNA, 201 bp, Homo sapiens
acaatatctctaaaacaagaatagtatcttgttaattttgtatccccaataaacacctagactattacaggtaataatataggtaaaaatgtttttttacyttacagggaaaaagaaacttcctgaaatcaagatcttgaaaagatatttgcatgccagtgtcattcagcattgttcacaatagtctaaatatggaaacaa

SEQ ID NO: 34515 - DNA, 201 bp, Homo sapiens
tgttctgagggaatctagttattactgtcaaaaactgcttatatgaatccaaaatctgttcttttgtgtgtatattttctactttttgtttttagttgtawtctttgaaacaattaccacttgagtttatttttagaactaaaattagaatttcagtctgtattttagacttataattagcaaagatcatttcattcattc

SEQ ID NO: 34516 - DNA, 201 bp, Homo sapiens
aaatccataggcctcatcccagatttctctcctgggcattttatggtagcatcttatctaaatgcagtaagtaaaacacatgtctttcactcaccatgttracttacactacattatcttcctgctactttcctattatgaaaagaaatgttaccccctgttcttttgatgatttccaaaatgcctaaactgaactgcaaa

SEQ ID NO: 34517 - DNA, 201 bp, Homo sapiens
tatgtatttttataatcagaaaatatacattcttttcaaaaagttagaaaatgaggcaaaatgaagaacagtaataatccctccaagaaccacattccagaaaaaaaaaaaaaactggttaagatttcaatgtaacttctttcagtcacatatatacaaaactgtgatcatttatatgcttatgagacagtcttctttttt

SEQ ID NO: 34518 - DNA, 201 bp, Homo sapiens
atgaaaagaaatgttaccccctgttcttttgatgatttccaaaatgcctaaactgaactgcaaagttgtctgagctctagatcctaaataactctttagcstcatatttcacaaaatttcacctctcccaactgttctttatcccatgtgcaaccaaaatggagcttcttttaatttttagaatataccaccttcccccac

SEQ ID NO: 34519 - DNA, 201 bp, Homo sapiens
tctaaatattatactataattcataaaatgcatgtgtataaaaatacatttaatattatatcttgtataaggtaaatataattatattacatatatgcatmcacacacacacacacacatatgccatgttggaaccattaggttctaggcacctaatattttatctaattctaactatactctaagaaataattattgctt

SEQ ID NO: 34520 - DNA, 201 bp, Homo sapiens
  misc_feature (1)...(201): n = A,T,C or G, or insertion/deletion polymorphism (see Tables 1-2)
aaaatttaatcttggcccctactttatacacaaaaatcaaatcaagattgattacagatttagatatgaaaaatggaacaatacatcttttagaataatangtagaagtattcttttagaagaatatatagaagaataaccacaaagaaaagattgtgaattggtctaattatatttaaattaataacttctattcattag

SEQ ID NO: 34521 - DNA, 201 bp, Homo sapiens
tcctaagaatattgactagagaagaagtattacttataaaatagtaagggaaaaaattgagataaaattattcttgtttgtctttttcaatacagattagkaaatctttctaggtcaccctattgttctgcctgatatacacgatggataaaaagttgacctcagaaaaactctagtgtacatttctcaatctataatcaa

SEQ ID NO: 34522 - DNA, 201 bp, Homo sapiens
  misc_feature (1)...(201): n = A,T,C or G, or insertion/deletion polymorphism (see Tables 1-2)
aattggataggtactcagtaccctgaagcctataagaaataagacaaggtaagtgctagaggctgatgaaggaatgtaaaacgggcctgactgaggatttntcggcaagagatttacaactttattatccccagtgccaaagtgagctttctaaagcaccaacccaaaaacatcagtttctttcttataactgtttgtaga

SEQ ID NO: 34523 - DNA, 201 bp, Homo sapiens
taacacatcaagagagatcccctaagctaagtctccccactgtgaagaaaatgaaaacacgaagatctctaaagcctttgccaccaagaaccctaacattytaccttgccaccactgctgccagtttcctgcagcctaggccactaaggtacctacagtcatcactgacattgattatagctgaaaaaacctcatggagac

SEQ ID NO: 34524 - DNA, 201 bp, Homo sapiens
tatcaaaataccaatgtcattcttcaaagaaatagaagaaacaatcctaagcttcacatggaactacaaaagaactagaatgatcaaagcaaccctgagcwaaagaacaaagccataggcatcactctacctgatttcaaattatattacaaagttatagtaaccaaaacagcatggtactggcataaaaacagacatgaa

SEQ ID NO: 34525 - DNA, 201 bp, Homo sapiens
aaattgtatcactttagtatatacagtttggatgtactttaattatggttataccatatacattcataaataagattatctatagttttcgtctatctttsaaagtttgggaaaacaaggctatttttgcttgataaaatgtttctacaaaatgttctataactttttcacattgaaacatattatacagcacagaaattt

SEQ ID NO: 34526 - DNA, 201 bp, Homo sapiens
gcaaggaagagggtagaaaatatagccctgaatctctgataacatgcctccttcatgaacccataatgatcatcagatcactagaagctactgtgaacaaygatatgccaataaactgaaaaacctagaagaaactgataaattcctagacatatacaacctaccaagattaaaccataaagaaatccaaaacttcaacag

SEQ ID NO: 34527 - DNA, 201 bp, Homo sapiens
taccactcccaccacaacagctaaaatgaaaaacagagataataccaagtgtttccaaagatgtaaagcaacttaagttcttacatactgctggtgggagyttaaattggtaccaatactttatagaactggagatgtgtatgaagctaagtatttgcataccctataactcagaattctttctaaactatatattcaata

SEQ ID NO: 34528 - DNA, 201 bp, Homo sapiens
accctataactcagaattctttctaaactatatattcaatagagtgattatatacaaatttacaccaaagatgcatataagtatgttaataaaagcactaktcataccttatacaaacactagaaaaatataaatgtttatcacaagtagaataatggaatatttagcatggagaatgaagaaggtgcaacttcaagcaat

SEQ ID NO: 34529 - DNA, 201 bp, Homo sapiens
ccagctgttttggagcatctctccattttccagctttgctttttttttttttcctccctctctcttgctttcatttcatatgataatattcttttgatgtmaatatcttttatcaggtaaaataaaatttctcttccttggaccagcagttcaggggatggtaagttttaaaacaagggaaaaaacagactttaagtattg

SEQ ID NO: 34530 - DNA, 201 bp, Homo sapiens
tccagctttgctttttttttttttcctccctctctcttgctttcatttcatatgataatattcttttgatgtaaatatcttttatcaggtaaaataaaatytctcttccttggaccagcagttcaggggatggtaagttttaaaacaagggaaaaaacagactttaagtattgaggcttatgtcagtgagctaggatatat

SEQ ID NO: 34531 - DNA, 201 bp, Homo sapiens
  misc_feature (1)...(201): n = A,T,C or G, or insertion/deletion polymorphism (see Tables 1-2)
taaaacaagggaaaaaacagactttaagtattgaggcttatgtcagtgagctaggatatatattgattgtatctcacatttttaattcttttgaagattanaaagatcaataactggaagcttctgctcttttgatagatggattttgagaagagttgaacattaatattcccaaatcaagggttattttttctgtcgcac

SEQ ID NO: 34532 - DNA, 201 bp, Homo sapiens
agggtaactaaaatccaggtagaaaacatcagtcttactggcctgaaggaacaggacagagttcatgaaggtcatggagattgaaaatctggaagataaarccacagaaaataggcagacagaccaacgagagcctcaaatttttgtgtttactatacccaaataccggctgatctctacactatacgtaagtgatgttaa

SEQ ID NO: 34533 - DNA, 201 bp, Homo sapiens
agtcaaagaacactaatacatctgatgagattattgggctgtcttatggagtggtaagcccaatgttaaatcccatcatctatagcctcaggaataaagakgtcaaagaggctgtaaagaaagtcctgagcagacatctgcatttattgaaaatgtgaaaaaccttgggcatgtgatatcctcaatggggcaagagagctt

SEQ ID NO: 34534 - DNA, 201 bp, Homo sapiens
ttataaagatcaataactggaagcttctgctcttttgatagatggattttgagaagagttgaacattaatattcccaaatcaagggttattttttctgtcrcactgtcgctaaactcaaatgtcacctcttctgtgaagcctttactaaaccctccaggaaaaaatcacttctcccacttcagtgtttctatatgcttctt

SEQ ID NO: 34535 - DNA, 201 bp, Homo sapiens
cagggtttcaccatattggccaggctggtctcgaactcctaaactcatgatccgcccacctcagcctcccaaagtgctgggattacaggcatgagccaccrcgcctggccttttggatatttcttttcagcctttattctgagtaagttttcttgctttaggttttggttttgtaaaacaatgcaaaatactgtttttgtt

SEQ ID NO: 34536 - DNA, 201 bp, Homo sapiens
tctatctaaaatcaaaatctctctaatctatcacaatccaagaccctcctcaaaagcctcctctgccttgaagctcctacttatcattttaactaaattgsatttgtttagcaatctttcataatatttataatatgaagatttattttctatttgtgtgttgtttgtatatcctgctttattgaaaggtcattagaagta

SEQ ID NO: 34537 - DNA, 201 bp, Homo sapiens
aggccaacacaggcagatcacttgatgtcaggagtttgagcccagcctggccaacatggtgaaaccccatctctactaaaaacacacaaaaggccaggtgyggtggctcacacctgtggtcccagcactttgggaggccgaggcaggtggatcagaaggtcaggagatcgagaccatcctggccaacatggtgaaaccctg

SEQ ID NO: 34538 - DNA, 201 bp, Homo sapiens; identical to SEQ ID NO: 8832

SEQ ID NO: 34539 - DNA, 201 bp, Homo sapiens
  misc_feature (1)...(201): n = A,T,C or G, or insertion/deletion polymorphism (see Tables 1-2)
atcaatctgatcatggtaagcctctgtcaaataaaagctgcatgattttgggcccgttacttaagcctcaattttcttaatctgttaataatattttaagntaaaaatgtgcaactaaagaagctaataggggatcaattgaatatccaaaaagaaaaaatttaatcttggcccctactttatacacaaaaatcaaatcaa

SEQ ID NO: 34540 - DNA, 201 bp, Homo sapiens
gccaagacaggaggatggcttgagctcaagagttggctgactgcctgcggaacatagcaagacctcatctttacattaaaaaaagaaaagaaaagaaaagraaaaaaaaaactgaaaattagcctgggcaaggtgacatgtacctctggtactagctactcagaaggccgaattgggggtttgaggggaatattgcttaag

SEQ ID NO: 34541 - DNA, 201 bp, Homo sapiens
gggtaaagaaaatgtgatgtctatccacaatgaaatattattcagccttttaaaaaaagagagagagagagagagattctgtcatttgccacaacatggakggacctgaaggacattacagtaagccagacatagaaaaatattgcaggatcttattcatttgtggaatttttttttgaaagaaaggtcatatacacagag

SEQ ID NO: 34542 - DNA, 201 bp, Homo sapiens
cagcctaggccactaaggtacctacagtcatcactgacattgattatagctgaaaaaacctcatggagactacagtactatgcccacccagacccacactytacccaaatgacagtcaacacactctatccaattgacacaataagacccatcttcaagggaaagtcttcccctataaaagctattgtataaaattaaaag

SEQ ID NO: 34543 - DNA, 201 bp, Homo sapiens
agctacttgggaggctgaggcagaaaaatcacttgaacctgggagtcagaggttgcagtgagccgagatcacactactgcactccagcctggtgacagagygaaactcagtctcaaacaaacaaacaaaaagcccacacaaaaaaattagctgggtgtggtggcgtgcacctgtagtcccagctactagggaggctgaggc

SEQ ID NO: 34544 - DNA, 201 bp, Homo sapiens
gtcaattaaaaaaacaatgtgtttcagtgttgtttacctggttttgtctcacctgagtgtaacaaccgcgactataataggtcaggcagagtctatctaaytgaattaaacacagataagaatcccagagctactttcttaaggtcattatttaacaagaagaaatattaatctataaaccagtaattcctacatatgtat

SEQ ID NO: 34545 - DNA, 201 bp, Homo sapiens
gttattttaaaaatgtagacatatgatgtcaggcatttactaaaaaccatcttaatattaccattatatttcgaataaaatccactccttaccatggcctmcaagggtctacataatctgacccaacctatttccgcagtgtcatccatctcctacctccttcccatgcttaccagagtccacatctgttgtcttcttgct

SEQ ID NO: 34546 - DNA, 201 bp, Homo sapiens
ttcctggtcccccaggtttctctctcatttaactcaagttttggtcaagaacttatcatactttgttttccttcatagcgctcacatttcccaaaattgcrttatatattcattgttttacgagtttattgccacaggaatgtaagctccacaaggatgaggactgtttcttttcttttttttttttttttttttgagacg

SEQ ID NO: 34547 - DNA, 201 bp, Homo sapiens
gttctgcggggtagtaatgctcatgctcaatcttatcatctatagcctggggaatatggaggtgcttggggttatgaagaaattgatcagtatgagtagamcctggtgctggaaaaatgatgagaacctgacatctttgagttcatgtacaaaataagctcacatattttgaggcaagaattttaaatataaatagaacag

SEQ ID NO: 34548 - DNA, 201 bp, Homo sapiens
catactttgttttccttcatagcgctcacatttcccaaaattgcattatatattcattgttttacgagtttattgccacaggaatgtaagctccacaaggrtgaggactgtttcttttcttttttttttttttttttttgagacggagtcttgctctgtcacccaggctggagtgcagtggcacgatctcagctcactgca

SEQ ID NO: 34549 - DNA, 201 bp, Homo sapiens
aaatatttataattaagcctttccaagaaaagacaacataagtccttaacaaataaaatatatttgtcagccctctttggaataccttttatatatttatytgtttatgcttatttgtttttttacccagggaccttatctggccctcacctacatttctagctacatacttcacccttttctgtccatacccatgttgcc

SEQ ID NO: 34550 - DNA, 201 bp, Homo sapiens
attactgataggaaccctaagctggtaattaaaggagtattctttatacatttttagtctacttacctttcctccaggtttcactgatctttctcgttttwtataagctgcttgttacattttgtatgtgctggacttggctactcctggttttagggctctgatttatttcactttaaaggtaagtttagaatgtcttgc

SEQ ID NO: 34551 - DNA, 201 bp, Homo sapiens
tgctggctacttattactcagtgctctctcactcttgctctctctctccccactgcaataaagctctttttatcccccaaatctaactgcttggactcctstcagtgtacttgcaataattcataggtttttttgttctgtgtcttgcggttggaaatctggcaagctctgaacttctcttaaaattcatttgcttatcta

SEQ ID NO: 34552 - DNA, 201 bp, Homo sapiens
gatcaacaaaattaaaatttcgttctttgaaaggataaacaaagttgataggccactagctaagttaaccgaagaaaaaaagagacaaaattccaataagygcaatcaaaaatgagaaaggtgacattacattgaataccacagaattaacaaaagatcctcagaaactgctatgaacatctccctgtgcacaaactagaa

SEQ ID NO: 34553 - DNA, 201 bp, Homo sapiens
tcagtttctaacttcacactgacatactatgttctgtgttacatcatttgacattctttcgaaaattcagtgcacatttatttactaatgtaataaccgaygaaatgacacaccacacttgcaaaacaagaagttaaaactatcctaccatactgtctagtggcaagattttcccaggggattcaagcaagacactttaaa

SEQ ID NO: 34554 - DNA, 201 bp, Homo sapiens
taaacctacatcaagcagatagaaatatttcaaattaacagcctaactctgcacctaaaagaactagataaacaagaacaaactaatcctaaagctagccraagaaaagcaataactaaaatcagagcagagctaaatgaaattgtgaccaagagtaccatatgaaagatcaacaaaattaaaatttcgttctttgaaagg

SEQ ID NO: 34555 - DNA, 201 bp, Homo sapiens
acactccctgcattgtcatatttcatcttctctgatgaaatgtttcaccctctagggagtcttccaaaactgccccagagtaatcaaagccttcctctctkcagtccttgccactttcccatactgtagtgcttagctattatattgtaatcatttgagaccttctcaaagtttcccaatggcaggaaacatggttctatg

SEQ ID NO: 34556 - DNA, 201 bp, Homo sapiens
gtgcacatttatttactaatgtaataaccgatgaaatgacacaccacacttgcaaaacaagaagttaaaactatcctaccatactgtctagtggcaagatyttcccaggggattcaagcaagacactttaaatatgacatactggtaaaaattcttgacttgtgactacagctatttctgacaaaattgttataaaggtta

SEQ ID NO: 34557 - DNA, 201 bp, Homo sapiens
  misc_feature (1)...(201): n = A,T,C or G, or insertion/deletion polymorphism (see Tables 1-2)
ttaataaatgaacatatggaagaaaaaattaaaaggataataaaaattcagtccaagaaacacatgtaacacatggaataaaagagaatgggagagtaacntcagcaggatggccaactagacgtgcctaattatcattcctaccacagaaagggaccaagacaatgaataaacaactacatttcaacaagaatgattaaa

SEQ ID NO: 34558 - DNA, 201 bp, Homo sapiens
gggaatgcacttcttgcatcagtgtgacctggatatgagaccagagtcaaaggagatcattttggagctttaaaatttaactgccctgctggatttcggarttgcatgggctctataacccctttgttttgtccagtttctccaatttggaacggttgtatttacccgatgtctgtatcctcattgtatctaggaagtaac

SEQ ID NO: 34559 - DNA, 201 bp, Homo sapiens
aaattcttgacttgtgactacagctatttctgacaaaattgttataaaggttaaactctatataagaaacattttaggccaggcacagtggctcacacctrtaatcccagcactttgagaggcagaggtgggcagattgtttgaggtcaggagttcgagaccagcctggccaacacagcaaaaccccatctctactaaaaa

SEQ ID NO: 34560 - DNA, 201 bp, Homo sapiens
cacctctccatttctgagtctccaccatcactgcaccatgctcacacatggtagtacgccatttatcagctgggctcaccaacccctggaaacaggctgcmtaggagacactccatcttccccatttcagtggctgctgcactccactcctgactattcaaagccttggcatcccatccccaggaaagcagtgcctgagcc

SEQ ID NO: 34561 - DNA, 201 bp, Homo sapiens
acagcaaaaccccatctctactaaaaatacaaaaaattagccaggcatggtggcgtgcacctgtcgtcccagctactcgggaggctgaggcaggagaatcrcttgaacccgggaggcggaggttgcagtgagctgagttcgtaccactgcgctccagcctgggtgacagaccaagactctgtctcaaaaaaacagacaaac

SEQ ID NO: 34562 - DNA, 201 bp, Homo sapiens
tcatgccttctcagcacctgcaccagcctggtacctcgaccccagaggactggagctttggctcagggaagcaactttgaccctgtacctgagcccctgtrgcaccctgctccttagggaccaggcactccagcacggctaagaaactgcacccaagccagcagagcagtcaagcctcctcagcgccctgaaccagcccag

SEQ ID NO: 34563 - DNA, 201 bp, Homo sapiens
tagccaggcatggtggcgtgcacctgtcgtcccagctactcgggaggctgaggcaggagaatcacttgaacccgggaggcggaggttgcagtgagctgagwtcgtaccactgcgctccagcctgggtgacagaccaagactctgtctcaaaaaaacagacaaacaaacaaacaaaaaacagtttaaatatcttataattat

SEQ ID NO: 34564 - DNA, 201 bp, Homo sapiens
cctcagcgccctgaaccagcccagtgcctcagccccaggggaatggagctttagcccaggagaacagctgcaaacttgatgcatgagcccagcccccaagsgaaacataactttggctgacctgtatcacccccaccttagggctgaacaaccacagtgccctacctcaatggatctggaccagccctccaaagtctgtgc

SEQ ID NO: 34565 - DNA, 201 bp, Homo sapiens
tggcgtgcacctgtcgtcccagctactcgggaggctgaggcaggagaatcacttgaacccgggaggcggaggttgcagtgagctgagttcgtaccactgcrctccagcctgggtgacagaccaagactctgtctcaaaaaaacagacaaacaaacaaacaaaaaacagtttaaatatcttataattataaaaatagataaa

SEQ ID NO: 34566 - DNA, 201 bp, Homo sapiens
ccccaaatgtgagcctctggaacacaccttcatccctggaaccatgccagccctatactctgatccccagaatcagagtcacagctatatccctaccccawgaaaccaaactgctggggagtgtctcatagtcacagtccttggcttgatggaaaagcttcagccacccatgcctaagagagtaaacctgcacccatgtca

SEQ ID NO: 34567 - DNA, 201 bp, Homo sapiens
ggaaatggaggttattatgttaagtgaagtaagctagacacagaaagacaaaccacatgttctcacttatttgtgggagctaaaaattaaaacaattgaaytcaaggaagtagagagtagaacgatggttaccagaggctgggaagcataaagtgagggagaactaaggatggttgatctgcagaaaaatatagttagata

SEQ ID NO: 34568 - DNA, 201 bp, Homo sapiens
gagtaaacctgcacccatgtcacaggttcaacagtagttcaacaagacacaatccacagccactccaaccacctgtgtggtgaaacacagccttgttgtgrcttccagtggccaatgtcagataacacatcaagagagatcccctaagctaagtctccccactgtgaagaaaatgaaaacacgaagatctctaaagccttt

SEQ ID NO: 34569 - DNA, 201 bp, Homo sapiens
ccatgtcacaggttcaacagtagttcaacaagacacaatccacagccactccaaccacctgtgtggtgaaacacagccttgttgtggcttccagtggccartgtcagataacacatcaagagagatcccctaagctaagtctccccactgtgaagaaaatgaaaacacgaagatctctaaagcctttgccaccaagaaccc

SEQ ID NO: 34570 - DNA, 201 bp, Homo sapiens
gccactaaggtacctacagtcatcactgacattgattatagctgaaaaaacctcatggagactacagtactatgcccacccagacccacactctacccaawtgacagtcaacacactctatccaattgacacaataagacccatcttcaagggaaagtcttcccctataaaagctattgtataaaattaaaaggcaactgt

SEQ ID NO: 34571 - DNA, 201 bp, Homo sapiens
aaataaagggcattcaaactggaaatgaaaagtcaaattatccttggagatgatatgattttatatttggaaaaacctaaagactccagcaaaaaactatyaaaactgagaagcaaattcagtaagctgcaggatagaaaatcaacatacaaaaattagtagcatttctatatgccagcagcgaacaagctgaaaaagaaa

SEQ ID NO: 34572 - DNA, 201 bp, Homo sapiens
aatttttaacaagggtaccaagaggacacaacaaggattgggtagtttttcaacaaatggtgctgagaaaactggatttctacgggcaaaagaatgaaatyggactcttacaccacacacaaaattcaactcaaaatgaataaaatacctaaatgtaagacctgaaatcataaaatacctagaaaagaacatagggaaaag

SEQ ID NO: 34573 - DNA, 201 bp, Homo sapiens
gactttgggggaccgttgggaaggcatgattggttttgaaatgtgaggacatgagatttggaggggccaggagtggcattatatggtttggctgtgttcckacccaaatctcagcttgaattctatctcccagcatgtgttgtgggagtgacataggggaggtaattgaatcatgggagccagtctttcctgtgctattct

SEQ ID NO: 34574 - DNA, 201 bp, Homo sapiens
taggtgattgggtaactctcacagacatgtaaatgagaatagacaaatgtgtcattgaggaagaagctagtttaagttttcttcttttgagaaaatgagcrtatatacaggtatatgaataaaaactttttaaaacaatttcagaaaaatttgagagagaacacatctgcattgaaatttggaataaacttatggattaag

SEQ ID NO: 34575 - DNA, 201 bp, Homo sapiens
aagatcgaataaaatatactgcagaggtcactgggttgagtaagacaaaaaagcatatcagtatacattattctctgataatcaactgacacgagattacygtcgatgactaaacttctttgaaagagcactaattctttctctctggttcagaaacaataaataactttattctaaatattttccccctataaaaatttt

SEQ ID NO: 34576 - DNA, 201 bp, Homo sapiens
agaaagtcattaacgaaattctttcagatgatatgttttcagttaaagttcgtctgtttttagttacttcggagggaactagattccccagggcatgccasactgtataaaccttagcaaaaggaccttagttattcctacagcatttattctgcaggaattaatttcacattcaatatacattgcatcatgaagatacct

SEQ ID NO: 34577 - DNA, 201 bp, Homo sapiens
gcggccaaaaaacaactattcttaaactttataacaatttctctcttgctctcctgtcttcctgaaatatctcttaaaagaaattatttcatttctctctytttttttttttttttttttttttttttgagatggaggctcgctctgtcgcccaggctggagtgcagcggcgtgatctcggctcgctgcaacctctgccta

SEQ ID NO: 34578 - DNA, 201 bp, Homo sapiens
  misc_feature (1)...(201): n = A,T,C or G, or insertion/deletion polymorphism (see Tables 1-2)
tagattccccagggcatgccagactgtataaaccttagcaaaaggaccttagttattcctacagcatttattctgcaggaattaatttcacattcaatatncattgcatcatgaagatacctttgataatgttatttctctgcatctacatgataacagcctatatatcgtatagtatcactgttcttaaaaccactaagt

SEQ ID NO: 34579 - DNA, 201 bp, Homo sapiens
gagttcaagaccagcctggccaacatggggaaaccctgtctctactaaaaatacaaaaattagccaggcgtggtggcaggcgcctgtaatcccagctactygggaggttgaggcaggagaatcgcttgaccctgggaggcggaggttgcagtgagccaagatcgcgccattgcactccagcctgagcgacgagagtgaaac

SEQ ID NO: 34580 - DNA, 201 bp, Homo sapiens
  misc_feature (1)...(201): n = A,T,C or G, or insertion/deletion polymorphism (see Tables 1-2)
aattaatttcacattcaatatacattgcatcatgaagatacctttgataatgttatttctctgcatctacatgataacagcctatatatcgtatagtatcnctgttcttaaaaccactaagttacattagtattcgcatttctcaggatctattttaatatgtaactttaataaaaactaaatgactgaagctcaacccaa

SEQ ID NO: 34581 - DNA, 201 bp, Homo sapiens
ttgctccccaaatgtgagcctctggaacacaccttcatccctggaaccatgccagccctatactctgatccccagaatcagagtcacagctatatccctaccccatgaaaccaaactgctggggagtgtctcatagtcacagtccttggcttgatggaaaagcttcagccacccatgcctaagagagtaaacctgcaccca

SEQ ID NO: 34582 - DNA, 201 bp, Homo sapiens
ttttctttctctgtgttactcatattcttacacagatgtgagattaaaagaacaatgattaaattatgcaacactattaattagaggctatctaaactaayagtagctaaattataataatgattccgttgatcaaggctgcagtaagccatgatcatgccactgcactccagccagggcgacagggtgagactctgtctc

SEQ ID NO: 34583 - DNA, 201 bp, Homo sapiens
agaagaaattgagaaaggcacagaaaggttatttaacaaaataattgctaaaaactgagtctcggtagagatatacacattcagatctgtaatacatgtaygcaattcaataaatgtgatgcctcatatgaacagaatgaaggacaaaaaactgtgattatgttaattgatgccaaaaatcatttgataaaattttacatt

SEQ ID NO: 34584 - DNA, 201 bp, Homo sapiens
ttacacagatgtgagattaaaagaacaatgattaaattatgcaacactattaattagaggctatctaaactaatagtagctaaattataataatgattccrttgatcaaggctgcagtaagccatgatcatgccactgcactccagccagggcgacagggtgagactctgtctcaaaaaaataaataaaataaaagtgaga

SEQ ID NO: 34585 - DNA, 201 bp, Homo sapiens
cagtaagccatgatcatgccactgcactccagccagggcgacagggtgagactctgtctcaaaaaaataaataaaataaaagtgagaggaggcaggacaayatggccaactagaagcctccaccaattgtcttccctgcaggaacaccaaattgcacaactatccacacaataaaaagcacattcataagaaccaaaacag

SEQ ID NO: 34586 - DNA, 201 bp, Homo sapiens
tggacccctttcttatatcatatacaaaaaattaactcaagatggattagagacttaaatgtaaagcacgaaactataaaagctctggaagaaaacctagrcaatactattcaggacacaggccacaggcacaggcaaagatttcgttacaaagatgccaaaagcaattgcaacacaagcaaaaattgacaaatgggatct

SEQ ID NO: 34587 - DNA, 201 bp, Homo sapiens
caccaaattgcacaactatccacacaataaaaagcacattcataagaaccaaaacagctgcgcaatcatagcacctggttgtaacttcatatcactaaaaraggcaaggaagagggtagaaaatatagccctgaatctctgataacatgcctccttcatgaacccataatgatcatcagatcactagaagctactgtgaac

SEQ ID NO: 34588 - DNA, 201 bp, Homo sapiens
gtgatacatcatatcaacaaaatgaagggcaaaaaccataggataatttcaaatgatgctaaaaaaccattttataaaattcaacatctcttcatgatacmaactctcaaaaactcggtatagaaggaacatacctcaacataacaaaagccatatacaacagacccacagatggtatcttactgaatggaaaaaaactga

SEQ ID NO: 34589 - DNA, 201 bp, Homo sapiens
ttgataaaagaagttaaagaggacacacaaaaaaatggaaagatattccatgttcatggattggaagaatcaatactattaaaatgttcacactacccaawgcaatctacagattcaatgcaatccttatcaaaatactaatggcattcttcaaaaaatagaaaaaataatcctaaaacttatatggaaccacaaaatacc

SEQ ID NO: 34590 - DNA, 201 bp, Homo sapiens
aaaaagacctgaatttggagttgctccaccaggaaacatttttttttttttttctgtcacccaggctggagtgcagtggaacgatctcagttcactgcaayctctgcctcccaggttcaagtgattctcctgccttagtctcccaagtagctgggattacaggctcccaccaccacatctggctaatttttttgtatttta

SEQ ID NO: 34591 - DNA, 201 bp, Homo sapiens
gttcttgggagtagaataggatttagcagtactagatcatttggtgagaaaaagacctgaatttggagttgctccaccaggaaacatttttttttttttttctgtcacccaggctggagtgcagtggaacgatctcagttcactgcaacctctgcctcccaggttcaagtgattctcctgccttagtctcccaagtagctg

SEQ ID NO: 34592 - DNA, 201 bp, Homo sapiens
gtgactcataatcatcataggaatagtaagacttcttgaaaatgtgacaaaaactatgaatccgctccccaggggtggaaatacacacacacacacacacactatgcataatcacacactgttttggcatacaagcctataatttcagggaattcaggttatgaattcctacctggtataacaggatgtgagtctcatctg

SEQ ID NO: 34593 - DNA, 201 bp, Homo sapiens
cagtgactcataatcatcataggaatagtaagacttcttgaaaatgtgacaaaaactatgaatccgctccccaggggtggaaatacacacacacacacacacactatgcataatcacacactgttttggcatacaagcctataatttcagggaattcaggttatgaattcctacctggtataacaggatgtgagtctcatc

SEQ ID NO: 34594 - DNA, 201 bp, Homo sapiens
ctaagccactgtgctgcctaaatggacaaccacttctcagttctggaattcttcaaacacctagggttaggagggtcttcgctttggcagttagagttttytcaattcttttatgacacaggttgcaccggactcactcaactatggagatcagatgtcctcaggaaaaaaaaaaaaaaaaaaaaaaaatacacacttaag

SEQ ID NO: 34595 - DNA, 201 bp, Homo sapiens
ggcagtgactcataatcatcataggaatagtaagacttcttgaaaatgtgacaaaaactatgaatccgctccccaggggtggaaatacacacacacacacacacactatgcataatcacacactgttttggcatacaagcctataatttcagggaattcaggttatgaattcctacctggtataacaggatgtgagtctca

SEQ ID NO: 34596 - DNA, 201 bp, Homo sapiens
gcatgaacccaggaggcggagcttgcagtgagccaagatggcgccgctgcactccagcctgggcgacagagcaagactctgtctcaaaaaaaaaaaaaaaraaaaagaaaagaaagaaatagtaacatagccccagcctaatgcatttcacaaggcagtgactcataatcatcataggaatagtaagacttcttgaaaatg

SEQ ID NO: 34597 - DNA, 201 bp, Homo sapiens
ggcatgaacccaggaggcggagcttgcagtgagccaagatggcgccgctgcactccagcctgggcgacagagcaagactctgtctcaaaaaaaaaaaaaaraaaaaagaaaagaaagaaatagtaacatagccccagcctaatgcatttcacaaggcagtgactcataatcatcataggaatagtaagacttcttgaaaat

SEQ ID NO: 34598 - DNA, 201 bp, Homo sapiens
tatgagatatctctgcacatagtgaaaaacaatacccggggccctggcctgaagagggtgaccaccacacgtgagtatcacctttaatacttatagaatgrtaaggctgattgtacctcatagcacctcctggttgagaaagtgccttctcatatagcatctacatcatttaacttttgctgcatttttaaaaatccagat

SEQ ID NO: 34599 - DNA, 201 bp, Homo sapiens
ctggcatgacactggccttggtttcccaacctggtaaataaatttttatctcacagtaatgctctgaataaaagtctataatgccaaaatctgaagaaatrattcaacactgataacatttaacaccaaggcaattgaaataagattaaagcttaacatttaacccttcttccaccccacactccccacaaaagctttcag

SEQ ID NO: 34600 - DNA, 201 bp, Homo sapiens
ctacctgttgctgaaagtgtataaagagaggatggttaataacctcttcacaggaatgctgttttgtctctataggaagtctgaccagctgatgtgcaagytcttcactagcccccaaattctaagaaatacaatttctgtgtttattaataaacactgcagcacaaacttgactataatcaactttcttttcttaagtag

SEQ ID NO: 34601 - DNA, 201 bp, Homo sapiens
gaaaagaaaaacattcattaaagtccatatttttcattacaaatgtttccttttattaagctcttactgctaccaaagactgtttgccatttctttcgcayacattatctcatgcacttttcacaatgatcctatgaggactcccttaacacatttattgatgacagtactctggcttatggtcacagataataaccttgc

SEQ ID NO: 34602 - DNA, 201 bp, Homo sapiens
ggcgctctgatcctgactctttcaattacagactgtgttaccttggacaatttggctaagtccttatgcaaaaaaagtatgatgccatttacttaataggrttgtgaggattaaatgagataattcatataaagcccatagcggaaggcctggcaggtagcaagggcccagcaaatgagagctattcacgttgccattaat

SEQ ID NO: 34603 - DNA, 201 bp, Homo sapiens
ttgagtttgataaatgctgtatctaagagagattcctattgcccctcaatcattccaccttctggtgatggccacattgcctccttcctccagtgagaaarcctcacacctgcgcagtcactgaagaagttttatctccctaagatcctgaggtgtggggcttctccactagagaaaggaggtaatgtggctataaccagg

SEQ ID NO: 34604 - DNA, 201 bp, Homo sapiens
taaatgctgtatctaagagagattcctattgcccctcaatcattccaccttctggtgatggccacattgcctccttcctccagtgagaaaacctcacacckgcgcagtcactgaagaagttttatctccctaagatcctgaggtgtggggcttctccactagagaaaggaggtaatgtggctataaccaggagatttacta

SEQ ID NO: 34605 - DNA, 201 bp, Homo sapiens
cctgaggtgtggggcttctccactagagaaaggaggtaatgtggctataaccaggagatttactagctagaattattctgtttctgaatgagagccccatrttggcattccaaagcctcagcagttgcatttccccaccacgcctccttaatgccatttcaaagatatcatgtttcgtatttaaagacattcttcagtgtg

SEQ ID NO: 34606 - DNA, 201 bp, Homo sapiens
tctgtttctgaatgagagccccatattggcattccaaagcctcagcagttgcatttccccaccacgcctccttaatgccatttcaaagatatcatgtttcrtatttaaagacattcttcagtgtgggaaaaatgtgcaaagttctttttattggttcttctccactgtccacagactatttcccccatccctttctccaca

SEQ ID NO: 34607 - DNA, 201 bp, Homo sapiens
ttcttcagtgtgggaaaaatgtgcaaagttctttttattggttcttctccactgtccacagactatttcccccatccctttctccacaggaaaaaatatayatgtttcatttaaggtgaagcagacgtttctttccctccttgaattctaacttttaaagccttctgcattcactcagtcaataaaatactatcaccatgc

SEQ ID NO: 34608 - DNA, 201 bp, Homo sapiens
gttctttttattggttcttctccactgtccacagactatttcccccatccctttctccacaggaaaaaatatacatgtttcatttaaggtgaagcagacgyttctttccctccttgaattctaacttttaaagccttctgcattcactcagtcaataaaatactatcaccatgctctgtgctaagttctggggttactaga

SEQ ID NO: 34609 - DNA, 201 bp, Homo sapiens
tataagtcctgaaatgttgcagagttttaggttcaaccatcagaagcaagaaccttccagctctgtatcactggattcttaatagcagaagcctgccaggmgccactcaatgtctgtggggcttacagagaaaaatgaagaatcagtggccctgaagaatttttcctggggaattccagggttttactgatggattgggcc

SEQ ID NO: 34610 - DNA, 201 bp, Homo sapiens
tggactcctgtaccccttccccaaggactgctcccaagcaatgctgaatggagacacgacctctggcctctacaccatttatctgaatggtgataaggctsaggcgctggaagtcttctgtgacatgacctctgatgggggtggatggattgtgagtaccaccagggactgcagagccctcaggcctaggggaagagggag

SEQ ID NO: 34611 - DNA, 201 bp, Homo sapiens
ggcacagtcaaggtattttaagtatataacaactcctcaatgctagttgaagcatttgcatgatcttcaaagtatggaagaattacctgatgctgtttttytaccccagtgcatctggggagctgaaaaaaaaaaattagtagagactggatggcatgccagaccttctgaatcatactctccagcctctttcattttaac

SEQ ID NO: 34612 - DNA, 201 bp, Homo sapiens
aaaatctctgtatttggatggatgtaaaaattcagctaaattgaatacgcagtgagattacataaaaacaactgtttcaaatgcatacttggctaaagacsaaatgcctattatctacaagattgacctgtcttttcattgtcttttgtaactggttttgtttttttgattgttttgtttttttaatcctaaagactgcaa

SEQ ID NO: 34613 - DNA, 201 bp, Homo sapiens
accccacactccccacaaaagctttcaggaccattgtttttatcttcttattttttgtagcgggctggggccataaatgtaccaggtatttggagaatggrggactaaatattaaagcctatattctacccagccttctcaacagatgactaactgtgagcagttaggcacctagccttacagaggtgccatattgcttac

SEQ ID NO: 34614 - DNA, 201 bp, Homo sapiens
aacttaggacaatgcgtctcgggccgctgcatctgcaacgagggctacagcggagaagactgctcagagggtgagtgccagggcgcagaccagcatataawggccatgatggagtggactcctagtatgggttggaaaactacgtttatatatataaacattcatgcacactgattctttgtacgtattaatatatccatt

SEQ ID NO: 34615 - DNA, 201 bp, Homo sapiens
cttggagtcggaagacctggttgtatatctcagcttaggcacctagcagatgtatgacctaggataagtcattaacttctctggtttttttagatgtgatmggggttggaagattgatgaaggttcaacctcagatggcagataaatttcaagtttaattaagccctacccattcactcaacttgacttcttgaacatttg

SEQ ID NO: 34616 - DNA, 201 bp, Homo sapiens
agggccgctgcgtggacggccagtgcatctgccacgagggcttcacaggcctggactgtggccagcactcctgccccagtgactgcaacaacttaggacartgcgtctcgggccgctgcatctgcaacgagggctacagcggagaagactgctcagagggtgagtgccagggcgcagaccagcatataaaggccatgatgg

SEQ ID NO: 34617 - DNA, 201 bp, Homo sapiens; identical to SEQ ID NO: 8854

SEQ ID NO: 34618 - DNA, 201 bp, Homo sapiens
caggaactgggctcagtccctgtactcgctccgaggtgccactgagcagctgctgcccagagcccaggcgagccctggtcccatttccagcttgaccaagyacaagaggggagccagggctgcggatcctactccctcttgctccccaggcatccgtctcacaattagaaaacccgtgtggggagcaaagcaaaaatcaca

SEQ ID NO: 34619 - DNA, 201 bp, Homo sapiens; identical to SEQ ID NO: 8853

SEQ ID NO: 34620 - DNA, 201 bp, Homo sapiens
attcctacctggtataacaggatgtgagtctcatctgatttcacacactacaacaaatggttctcaagccagatggagcctgagggtgcaaccgtccttcmgctgaatttgaatctgggtgccctgggtagatacagaaaaatgtggctgcttaagcctggctgagaacttctgtttcttttgttgcaggccgcttggaca

SEQ ID NO: 34621 - DNA, 201 bp, Homo sapiens
taatttcagggaattcaggttatgaattcctacctggtataacaggatgtgagtctcatctgatttcacacactacaacaaatggttctcaagccagatgsagcctgagggtgcaaccgtccttcagctgaatttgaatctgggtgccctgggtagatacagaaaaatgtggctgcttaagcctggctgagaacttctgtt

SEQ ID NO: 34622 - DNA, 201 bp, Homo sapiens
cacacacacacacacacactatgcataatcacacactgttttggcatacaagcctataatttcagggaattcaggttatgaattcctacctggtataacasgatgtgagtctcatctgatttcacacactacaacaaatggttctcaagccagatggagcctgagggtgcaaccgtccttcagctgaatttgaatctgggt

SEQ ID NO: 34623 - DNA, 201 bp, Homo sapiens
caccatcgatctcacagaggacgagaaccagtactccatcgggaacctgaagcctgacactgagtacgaggtgtccctcatctcccgcagaggtgacatgkcaagcaacccagccaaagagaccttcacaacaggtaaaaggcctccccctgttaacagatatagtaaaggaaagattgaaagatttccatcccactccat

SEQ ID NO: 34624 - DNA, 201 bp, Homo sapiens
aggtgtccttatagaattagaaagccattagctacctcattttagttgcggaaaattagaatgttttggttatataaacccacataccaacttgagccaamcttccacaaaaaactttggaaaataaaacagaaaaaaataacaaggacacaagagtgagctcttaaggggtttacttaactcggatataccccagggaag

SEQ ID NO: 34625 - DNA, 201 bp, Homo sapiens
agagagagagagagatagggattttgcatgtgcctgtgtgtctccagagctcatactctcccatggatgccctgtttccacatgcatcctatttcaaggarttttgctgctttggaattatgtctttatctccaataactaaagttgataaagctacatgagtttcaacaacttcaaatcagagctgaaaatctgtttctg

SEQ ID NO: 34626 - DNA, 201 bp, Homo sapiens
ttcaggcttctgataagtcctgctttgaaaaaccctattttaccttaattataagtttctaaaacgtatttgaccatgaaatctacccactttctaccccraaacctatgagtacgccatgaaatttctaccccagagagcactctctgataggtactgctgtggccccatcacctcattttacaaatagagaaactgagg

SEQ ID NO: 34627 - DNA, 201 bp, Homo sapiens
ttgcagtgagctgagatcatgccattgcactccagcctgagtgacaagagcaaaacaccatccgaaaaaaaaagagatagagagagagagagagagagagrtagggattttgcatgtgcctgtgtgtctccagagctcatactctcccatggatgccctgtttccacatgcatcctatttcaaggagttttgctgctttgg

SEQ ID NO: 34628 - DNA, 201 bp, Homo sapiens
gttgcagtgagctgagatcatgccattgcactccagcctgagtgacaagagcaaaacaccatccgaaaaaaaaagagatagagagagagagagagagagagatagggattttgcatgtgcctgtgtgtctccagagctcatactctcccatggatgccctgtttccacatgcatcctatttcaaggagttttgctgctttg

SEQ ID NO: 34629 - DNA, 201 bp, Homo sapiens
actttgggaagttgaggcaagtggattgcctgagctcaggagttcgggaccagcctggggaacatggtgaaactccaactctactaaaaaaaaaaaaaaaatacaaaaaatcagccaggcatggcagtgtgcacctgaaatcccagctacttgggaggctgaggcaggaggatcacttgaacctgggaggcggaagttgca

SEQ ID NO: 34630 - DNA, 201 bp, Homo sapiens
gcaagaaatagaagagagaaagcaagtgctctgcagttttatttcaaaaattgaaaccagaccacaccagggcagtttgtggtctgaatgtatcaatggatctagtcatatttcatctgagcatttcttaggtatactaaaccacaaatatgaatctcattattgtgtctggatggaaatattttatggattaagatttgt

SEQ ID NO: 34631 - DNA, 201 bp, Homo sapiens
ctctgtcgccgaggctggaatgcagtggtgtgatctcagctcactgcaacctctgcctcctgggttcaagcaattcgcctgcctcagccccccaggtagcygagattacaggcaccctccaccatgccctcctaatttttgtatattcagtagagacagggtttcaccatgttggccaggctggtctcgaactcctgacct

SEQ ID NO: 34632 - DNA, 201 bp, Homo sapiens
ggcaagaaatagaagagagaaagcaagtgctctgcagttttatttcaaaaattgaaaccagaccacaccagggcagtttgtggtctgaatgtatcaatggatctagtcatatttcatctgagcatttcttaggtatactaaaccacaaatatgaatctcattattgtgtctggatggaaatattttatggattaagatttg

SEQ ID NO: 34633 - DNA, 201 bp, Homo sapiens
accaattccaactagaaaagtctttctcctgttgtgctgaaatttgtcttctcataaccaaccctccctccctgcatcatccccagcacataaacgcacasacacacacacacacacacacacacacacacacacacacacacacacacacaggcacttgttctgtccttaggggctacaagaggcaagccagtgcctgct

SEQ ID NO: 34634 - DNA, 201 bp, Homo sapiens
aggcaagaaatagaagagagaaagcaagtgctctgcagttttatttcaaaaattgaaaccagaccacaccagggcagtttgtggtctgaatgtatcaatggatctagtcatatttcatctgagcatttcttaggtatactaaaccacaaatatgaatctcattattgtgtctggatggaaatattttatggattaagattt

SEQ ID NO: 34635 - DNA, 201 bp, Homo sapiens
gcccaggtctgtagtccttcctcctacaagatattttccagaccttttattgctgatcaattttcaataaagattagaatctgtgttttctaaagagtctytgtagaataagttgctcattctgaaattataaaagtcctactatcagaacatgattcttcatgtctgacctaaatacctccaactgcaatctcaagtaag

SEQ ID NO: 34636 - DNA, 201 bp, Homo sapiens
taggcaagaaatagaagagagaaagcaagtgctctgcagttttatttcaaaaattgaaaccagaccacaccagggcagtttgtggtctgaatgtatcaatggatctagtcatatttcatctgagcatttcttaggtatactaaaccacaaatatgaatctcattattgtgtctggatggaaatattttatggattaagatt

SEQ ID NO: 34637 - DNA, 201 bp, Homo sapiens
ggctaccctcagttccttgccacatgggcttctccaacaaggccatttacattaacaaagccaatgagaaagagagttaccgggcatggtcgctcacaccycttaatcccagcactttgggagcccgaggcgggtggatcacttgaggttaggagttcgagaccagcctggccaatatgctgaaaccccgtatctactaaa

SEQ ID NO: 34638 - DNA, 201 bp, Homo sapiens
ttggtatctcaggacacttctatctctgaaagccggggcatcactacatattgatacccctactggagagaagattgcacggactggtaaatgatgttgtytttcctccttctcccaccattttctctccctctagaagccgaaccggaagttgacaaccttctggtttcagatgccaccccagacggtttccgtctgtcc

SEQ ID NO: 34639 - DNA, 201 bp, Homo sapiens; identical to SEQ ID NO: 8862

SEQ ID NO: 34640 - DNA, 201 bp, Homo sapiens
aatgcttttcattcaatttgggaaggaaaaacaattcctctcaattttccaccaaaaatgagctgctccatctgttataaaaaactgtgctgtacatgagrtttctagaaatagcttcaaaaagggctatgggaaaaagggccaactttttggtgatagggtttctgtgctgagccctaagcccatgccccactctacata

SEQ ID NO: 34641 - DNA, 201 bp, Homo sapiens
cataaaattccaaaaataagggggccaggttttattcctgtgttgcctggaatatcttcagatcaaacaagagcaaaaagggcctttgagacaggtgtggyctgtgtgcaagatgctcatatcttcctctgtagtccgcaaacttttgtttttagcagtacaactccttttgcaaatgaaatcttccaaggaaccctacta

SEQ ID NO: 34642 - DNA, 201 bp, Homo sapiens
catgaaataatattcttctttggatttatttcccgaccatgtaaaaaagtaagaaaaactgttgttagcttgctgactaccaaaataagcagctggccagwtgtgggcctcgggtaacagtttgcggacctctgttctcgatcaaacaaaatttgaaggagtgtatgctctgacaatatgaaacaagcaggaagaatgttc

SEQ ID NO: 34643 - DNA, 201 bp, Homo sapiens
gaatcagcctgatggttttaattcacttctccagtgcttggagataactaaaagcttccctccctatatatgagttctggtggaacacagattatttactkctgagagtcttttgctagttggaaatggtgcttttctatctctaaatccctcaaggatatgggtagtgtggttcttgcatgtaagaaatgtttctttaaa

SEQ ID NO: 34644 - DNA, 201 bp, Homo sapiens
agccttcctctgacacagttttccgttgctcatctttattatgtgcctccatgggtttgaagctcggtagagactatcgcttcattttgcatatgactgcycccctttttaaataattattgcaactaaactttaatgcatacctgtacatcccagttgaatctagcaagagcatagctctgcattttaacctcagtcatt

SEQ ID NO: 34645 - DNA, 201 bp, Homo sapiens
tttaattaggaaatctttttccctcagattagtacctatcaacgtgttgtagattacactttagaaaatgctgtttaaagttacacagctaagttaaagcmaagttaagggggttagacatatctctatttttcagatttttctgcagtttttcctgtcctgcctgtagatcataaagatatttcattaccagtagtttct

SEQ ID NO: 34646 - DNA, 201 bp, Homo sapiens
tcagaccctgatggtccaagcaaccacaggtatttcctattatggcttcttcactcttcattgaatttcctctgaatagctttccaaaaatcacccgctayccacttttcaccctcctagttgctcccaatccttctcaaatttgatagagccatccaaatcaaagctttaaagctttaaaataactctcaccccaaatta

SEQ ID NO: 34647 - DNA, 201 bp, Homo sapiens
aacctgacttgctttggttgaatttctaaatcatcttttcatctgatcttgaataatctttttcaatcccacccattatcatctgcctgtggtcgttctamtcaaagtttgcctatgtcatgttcaaagaggtatgtgcatgccatttctggtgacttggtcagaaagatctacactctctttctctctagcaggatttta

SEQ ID NO: 34648 - DNA, 201 bp, Homo sapiens
tctcttgtgctttcttcttgacagccatgggctccccaaaggaagtcattttctcagacatcactgaaaattcggctactgtcagctggagggcacccacrgcccaagtggagagcttccggattacctatgtgcccattacaggaggtaggagactcggaaaggggagagagaggaggagtgttgtgggtttggatggat

SEQ ID NO: 34649 - DNA, 201 bp, Homo sapiens
gaaataaccctacttgcccccgaacgtaccagggacttaacaggtctcagagaggctactgaatacgaaattgaactctatggaataagcaaaggaaggcratcccagacagtcagtgctatagcaacaacaggtactgtaaataaacaggagagaacagagaaaagtcatgactcaggggtcttcttctcacagggctga

SEQ ID NO: 34650 - DNA, 201 bp, Homo sapiens
ataaagagagggcaatcatatttactgaattctcactgcatgccagatgctgtgctgggagtttcacatttgttatctctgctaatcctcaaaacatcccygtgggtgggtaccacttttccctctggacagatggagaaactgaggttcacagaagtgaagggacctgcccaaggtcacccagcctctcagtggtatttg

SEQ ID NO: 34651 - DNA, 201 bp, Homo sapiens
ttgggaagctggagggggctaatggaagtacaatttaactccctatcctagcagagactaggaggcaggaaccttacttgtatgacaacatgtttttcccraggcagtgagcaatctcaaggacactgcaggccaggtaaaatagaaacagcacaggttaacccttgacagtcccaaggacaaacactggtcaaatggatt

SEQ ID NO: 34652 - DNA, 201 bp, Homo sapiens
tcactacatattgatacccctactggagagaagattgcacggactggtaaatgatgttgtctttcctccttctcccaccattttctctccctctagaagcmgaaccggaagttgacaaccttctggtttcagatgccaccccagacggtttccgtctgtcctggacagctgatgaaggggtcttcgacaattttgttctca

SEQ ID NO: 34653 - DNA, 201 bp, Homo sapiens
tgctttgtgacttctctgtaaaggagaaaagtctgcaaaccaacctgattctaatcctggtggccagacatttttcagttatgcccttaagcctaaactcctttccctccaccttgtctcacatttccagcttctcttccactttagaaacaaccctgtcactatcattactctctttggcccttcatcatggaataaaag

SEQ ID NO: 34654 - DNA, 201 bp, Homo sapiens
ctgtgttttctaaagagtctttgtagaataagttgctcattctgaaattataaaagtcctactatcagaacatgattcttcatgtctgacctaaatacctycaactgcaatctcaagtaagtttccctgggttcatccacaaaggagacttaaaacagccagttgtctgcatgagaatattttacattcttaaaggtcatt

SEQ ID NO: 34655 - DNA, 201 bp, Homo sapiens
ccatgcatacttaatcataaagctgtcttttcttggaacatcttacagggcttgtgtccccagtacaaactttagaaaatgtagccttaatacccttcacrttactccaatctaccactctaatggcttgtctactcttcttcatacatgactagcaaatggtggtgtttatgctttaaaagaacacagatctaaaaaatg

SEQ ID NO: 34656 - DNA, 201 bp, Homo sapiens; identical to SEQ ID NO: 8844

SEQ ID NO: 34657 - DNA, 201 bp, Homo sapiens
gccagagacctcttaccggcaaactggtctagctcctgggcaagagtatgagatatctctgcacatagtgaaaaacaatacccggggccctggcctgaagmgggtgaccaccacacgtgagtatcacctttaatacttatagaatgataaggctgattgtacctcatagcacctcctggttgagaaagtgccttctcatat

SEQ ID NO: 34658 - DNA, 201 bp, Homo sapiens
cacccactgccctcagaccaccatgagccaataggaaatacacaatgctcaagaataacatactctttcccccaacgatgcaacatttggtggtaccagtktacgtctcttaaacacacagtgagaaatcctcactctactcacactctggtcattattaccctaaactcattgccttggagtctcaatcagcaactataa

SEQ ID NO: 34659 - DNA, 201 bp, Homo sapiens
tccgttgttacaaggtgacctatttaagggctgaagggctcagagaggttatataattgtcccagggacacacagctgacacatcacagagctggtattcragtctgcctaactcatctacatagagtttaaaataaagttggagaggccagaacacatctagtgttcaagatgaggtagataaagggatactctctcttt

SEQ ID NO: 34660 - DNA, 201 bp, Homo sapiens
atgtacaggtctctaatccttaattttctctggaaaggttttgactcctttgttatatatgaggtcatggtttagagaggataagtagcttgtcaaagttrcagggctagtgagtgacatttgaacccaggtatgcctaattccaaagcctaaccattttctacaacactgaaaatataatggatttttcccaaagtacaa

SEQ ID NO: 34661 - DNA, 201 bp, Homo sapiens
aagtcacaggtatttgtttgactctaaaaattaattttaataaagaaagcaaagtctgacacaagtgtgtcttgttttgcgttagatacataagctgaggyggagcaaaaagcagcacaacatgcttagcttggaaatagatttgtcctggatatgggaccccaaaaatctgcgttttgtgccaatgcaaagactatgtct

SEQ ID NO: 34662 - DNA, 201 bp, Homo sapiens
aagaccaaagctccatgcaaactcaggcgactcttgactcaggtgaaaaactgggtcagattcagccagttcctttgaaagtttccacaacccagaccaayagagagataggcaagaggcagctgtgatataccaaatggtcaaattgaaacagaactcatttagtttgaatgactaaatagcaatgatcagtgaacacct

SEQ ID NO: 34663 - DNA, 201 bp, Homo sapiens
atagatttattcatgcagagatggcaaaaaggcttctagaagccttcaaggcatctggaaccctcgctgaatgatcactgagaaatggaagcatcccaaaygtatctgtcagcttgcttcatctccacagcagccacaggctgtctggcatcttaatggtctacttctagaggattgatagtattctgctttgagccaggt

SEQ ID NO: 34664 - DNA, 201 bp, Homo sapiens
tgccaaaggagtttacttgatcatagagaaatcttgtctcaaagtagaaagtactgagctcttaaaagcccttgggttgatgtctagaatctcatgggaargagctaggtctgtctttgtcacttttgtaccttctgcacttagtgtggtgtttggaacgtagtaaatactcactgaataactgaatgaattaaaacgaac

SEQ ID NO: 34665 - DNA, 201 bp, Homo sapiens
ggatcttagaattggaaaccatacacagttgctcattttacaagagaaactgagacctcaagagtggatgcgacttgcccaaggtcacacaatgaccctgytggtcagacctgcttggcagaagaggagctcagagcttctcctccagatcttccatttattgcacttcctgttatatggcctcataagaggccaagtatc

SEQ ID NO: 34666 - DNA, 201 bp, Homo sapiens
agggatcttagaattggaaaccatacacagttgctcattttacaagagaaactgagacctcaagagtggatgcgacttgcccaaggtcacacaatgacccygctggtcagacctgcttggcagaagaggagctcagagcttctcctccagatcttccatttattgcacttcctgttatatggcctcataagaggccaagta

SEQ ID NO: 34667 - DNA, 201 bp, Homo sapiens
ttctgaaagagccaactagatttcttaaaattctggatgaagaccaaaatagaagaggtcattgttccattgggaaatgaattcaaatttatttttgaaayaattttccagaattttacaggaatctatattgttgccacttgtccagaaccactttttattttcttttctgtctaggcaagaaatagaagagagaaagca

SEQ ID NO: 34668 - DNA, 201 bp, Homo sapiens
tgcagtggctcacgcctgtaaccctagcattttgggaggcagaggtgggcagatcacctgaggtcaggagttcgagaccagcctggtcaacatgatgaaaycctgtctctactaaaaatacaaaaagttagctgagcgtggtggtgggcacctgtaatcacagctactcaggaggctgagacaagagaatcgcttgaacct

SEQ ID NO: 34669 - DNA, 201 bp, Homo sapiens
tggtgtttgatgaagatatagtttcatttctaaatcagatacactctttttgggggcaacagtgaataagtgtcagtgaggttcattattcctcatcttgsttttactgtgttccaggtacaccctccatggtaactgtggacggaaccaagactcagaccaggctggtgaaactcatacctggcgtggagtaccttgtca

SEQ ID NO: 34670 - DNA, 201 bp, Homo sapiens
aatctttttcaatcccacccattatcatctgcctgtggtcgttctaatcaaagtttgcctatgtcatgttcaaagaggtatgtgcatgccatttctggtgmcttggtcagaaagatctacactctctttctctctagcaggattttaaaaaataaaggtgccctgagcatgctgagaatagactctgaatcacaacccaag

SEQ ID NO: 34671 - DNA, 201 bp, Homo sapiens
atctgaactaagaaaattcctttaggagtcagcccagtgtagctcaatgtagttgaaagcagacattttagaaccacaaataaatcaggattcaaaagctrgctctgcctcttaagccagtcatggaaactccctgagtctcaaattaattttcaaataagcataataatacctaactcaccaggttgtcatgacaaatga

SEQ ID NO: 34672 - DNA, 201 bp, Homo sapiens
catctgcctgtggtcgttctaatcaaagtttgcctatgtcatgttcaaagaggtatgtgcatgccatttctggtgacttggtcagaaagatctacactctytttctctctagcaggattttaaaaaataaaggtgccctgagcatgctgagaatagactctgaatcacaacccaagaattgcatgagaggacccagtagtc

SEQ ID NO: 34673 - DNA, 201 bp, Homo sapiens
gctcttctttcaagccatcatcttgtccaaatcttggtgcatgtggtgaatattcagagcattaaattttgaaaatgtttctttttcctggaagcagctascatgtccatgagtcatttcagaaggtttaaagtggtgggagaaaaatgcccctcattttgcatggaacattgaccataccctaactaccactatctttct

SEQ ID NO: 34674 - DNA, 201 bp, Homo sapiens
tcttcacaacaagtatctgtttacatgtctgctttctatacctgactgtgagctcattaagggcaagacctatccatcattggcttctgaaacaccccacsaccactaggctatcccatagcccgttcttacacttgttcaacacatctctgttgaatgcaagaataaatcatttagaaattaattctcagtcctcttgga

SEQ ID NO: 34675 - DNA, 201 bp, Homo sapiens
ggcagataaatttcaagtttaattaagccctacccattcactcaacttgacttcttgaacatttgccaatgttcaatttggcaaatgctgccaaatggtgrcagcaaaaacttcaatggcaaaggctgcacatggtgtcagtttactaaattctagcccaaaaagcctcagaaaatatttagaagtctctttcttttcatt

SEQ ID NO: 34676 - DNA, 201 bp, Homo sapiens
gtttttaagagaactttggatgtgttttaatgtaagattaaaaaatgagtattttttcctatccagttacctaatgtgaattaaatcattcagatgagtcytcaaatgcagaacatggtaatttcttaagggactgagacaaggaggaacgagatgagattctcactcctcaggaggggagaaatggccacagatcccatc

SEQ ID NO: 34677 - DNA, 201 bp, Homo sapiens
aagcccttgattgcctaattagcctgaatgccctcactttcattggaattcactgctttgatggtgtggaggtgcaaagaggccagctatcaaagagagaygccacttatctaaacaaaatccaggaacagaattcgagacccttgtctctcagacgaagattgtttgcccagtataagagatttcatcctcgcttttgat

SEQ ID NO: 34678 - DNA, 201 bp, Homo sapiens
ctttgatggtgtggaggtgcaaagaggccagctatcaaagagagacgccacttatctaaacaaaatccaggaacagaattcgagacccttgtctctcagaygaagattgtttgcccagtataagagatttcatcctcgcttttgatagaattatgattcttgggaaatctttacgtggaaaaaactgcctcagaataaaca

SEQ ID NO: 34679 - DNA, 201 bp, Homo sapiens
agccacagcaaaatttaaatctctatttacaaaatgaaggtattcattcccttattcattcagtcaccaaacacttctttttaaaacatttttctttatgwctcatggattagaccctaggcattagtgaattaatgcaagagcatttatctctttgtaagtttccatttagctgtaatggaaaagaagtgtctaaactag

SEQ ID NO: 34680 - DNA, 201 bp, Homo sapiens
aataagtggcaagaaatcacccatgtaaaaataataatcagtatttgtaggcttggagaaaatgctagaatccaggcagcaacctagtaagagggaaaaaycctgtttcttattaacagggacaccctatcctgggatgcaggtctcagtctcctcctccctgtggctgcccataaaacgactccagatcagaggcagagc

SEQ ID NO: 34681 - DNA, 201 bp, Homo sapiens
tttggatgtgttttaatgtaagattaaaaaatgagtattttttcctatccagttacctaatgtgaattaaatcattcagatgagtcttcaaatgcagaacrtggtaatttcttaagggactgagacaaggaggaacgagatgagattctcactcctcaggaggggagaaatggccacagatcccatcaggccattgcttgt

SEQ ID NO: 34682 - DNA, 201 bp, Homo sapiens; identical to SEQ ID NO: 8856

SEQ ID NO: 34683 - DNA, 201 bp, Homo sapiens
gaagtggagtgggatcctctagacattgcttttgaaacctgggagatcatcttccggaatatggtaaggagtacaaaagagcagatccatttgatctcaargatttgaaagatgaccaaagggttctgaagacttctgtatcaactaattttccttagtttttggtggaggacaaggctctcattagcatcatttgtgttt

SEQ ID NO: 34684 - DNA, 201 bp, Homo sapiens
gcctatgggcaggaagttccataatcccatctgatctgtatctcaacaaatctattagaaggatctcagagaccaggagccttctttcttgctaaagagasagtactagcttttcaaaccctgctcctacctgccctctgcatgttttattcttatggttggggaaagcactggcaggaccatcttcaagacaaaatgtta

SEQ ID NO: 34685 - DNA, 201 bp, Homo sapiens
ataatgcaatccaaatcactcaattcaaaacaattgttttccttgctcttatataacagataaacttggtggttgctagaaactacataaaattccaaaartaagggggccaggttttattcctgtgttgcctggaatatcttcagatcaaacaagagcaaaaagggcctttgagacaggtgtggcctgtgtgcaagatgc

SEQ ID NO: 34686 - DNA, 201 bp, Homo sapiens
agccctaagcccatgccccactctacatatgctgccttttgataatgcaatccaaatcactcaattcaaaacaattgttttccttgctcttatataacagrtaaacttggtggttgctagaaactacataaaattccaaaaataagggggccaggttttattcctgtgttgcctggaatatcttcagatcaaacaagagca

SEQ ID NO: 34687 - DNA, 201 bp, Homo sapiens; identical to SEQ ID NO: 8860

SEQ ID NO: 34688 - DNA, 201 bp, Homo sapiens
aggcctcagcagattctggaagcccatttgatgccaacggaaactcgccaatatctacccaaggctaataagtgtttgcaaacagtacaccttggcttaartattctccaaaaaggaagtacataaaacttgagatccagccagaggttctgggagaaaaacagaggtcaaatattttggtgcttacatgtgcacagccac

SEQ ID NO: 34689 - DNA, 201 bp, Homo sapiens
tccgtgtatttgccatcctggagaacaagaagagcattcctgtcagcgccagggtggccacgtgtgagtgagcagaactcttttgggcagcctcacctgaygtcagcccacccagtgtataaccctccctcgccacggcccctacaatcctatagttgttctttacagttataccaaataagagcctagaattaagtccat

SEQ ID NO: 34690 - DNA, 201 bp, Homo sapiens
taacgtttcagccctcaactttgtcattcatataatggagatgacaaactatgtctcacagggctcttgcaacattcaaatgaggtaatatatggcaaacwcttggcatagtaccttccacatattaagggttcaataaatggaaacttttcttagtttctctgtttatcattttacaaggacttgtccaagattaatatt

SEQ ID NO: 34691 - DNA, 201 bp, Homo sapiens
ttggacaaggattgaaagggatgttgccaagctctacagtcattaaatatttttttcctctatgctttgttttaaaaacctagcttctctattttatcccmcactaacctcctccttccccactctaagaagtgactaacgtttcagccctcaactttgtcattcatataatggagatgacaaactatgtctcacagggct

SEQ ID NO: 34692 - DNA, 201 bp, Homo sapiens
cagaatgtcaggaggttttgagtttaggcatctgcagattctaaagctgacagctatgaagtacgatgctgttggaaactctttggaaaagctttctgtcyggagggagggcaggacagggagcaccacttgaagaatgaatgcctctttttcatgtttttgtagactttttcccccatttttacagagctttcccatatg

SEQ ID NO: 34693 - DNA, 201 bp, Homo sapiens
ggtatagaaagatcagcaatgactgcttaataactggaagtttggataatcattgtcattgccaaaaactgccatcactctggaagttaaaagaggcattkagccagtcttggattgtttcttgtgtgttgttcctcagcccgcccccagcccccgctttttatctcacccaatctgagggtgtctcactaggctggcagg

SEQ ID NO: 34694 - DNA, 201 bp, Homo sapiens
agcaaatcttatcatttcttagtgggttataaccatgagctattaattttgacacaaaaaaaaacttacctcctccctttatttcagcttgtgaggatatstcactaattgacttcattaatttgattcaaactgtgcactagaagtgggatagaaacacatgaagtataccggaaagaaattatactcgaaaaaaaaaaa

SEQ ID NO: 34695 - DNA, 201 bp, Homo sapiens
ctcaaccttggttttctcaactacaaaataaacctgcccaggtctgtagtccttcctcctacaagatattttccagaccttttattgctgatcaattttcwataaagattagaatctgtgttttctaaagagtctttgtagaataagttgctcattctgaaattataaaagtcctactatcagaacatgattcttcatgtc

SEQ ID NO: 34696 - DNA, 201 bp, Homo sapiens
atcatcgtcccttgtgatcaacctggctggtccccagctacatttcagccttctcaaaagaaatataccaatgagtatatttccaaaacgtatttaaaacytttgccatctcaaaatctcaaccatgatcttaacaaacttacccagtgggctcgtcattggaaaaccaaatgtgaacttattttatcggtaatcactaat

SEQ ID NO: 34697 - DNA, 201 bp, Homo sapiens
ccatgatcttaacaaacttacccagtgggctcgtcattggaaaaccaaatgtgaacttattttatcggtaatcactaatatcagagagactctgcaacacrgactaaatccataattttctcaagactaatgattcctacagaaattaacaacggaatagtcaaacatctgtgtttcccaaagtctttctagagattacta

SEQ ID NO: 34698 - DNA, 201 bp, Homo sapiens
tcccaaagtacaaaaacacccactgccctcagaccaccatgagccaataggaaatacacaatgctcaagaataacatactctttcccccaacgatgcaacmtttggtggtaccagtgtacgtctcttaaacacacagtgagaaatcctcactctactcacactctggtcattattaccctaaactcattgccttggagtct

SEQ ID NO: 34699 - DNA, 201 bp, Homo sapiens; identical to SEQ ID NO: 8865

SEQ ID NO: 34700 - DNA, 201 bp, Homo sapiens
agataatggagaagcagcacgtctatctatacacattaatatttataaaatgctacatgtgaataatcagtacggtgatcagcaaggataaaggagagagstggcaagattaacatgctactgtttatgaagctctctaactttgatactcataacaactctgaaaggcacctagagtgtccttggagtttaattaccttt

SEQ ID NO: 34701 - DNA, 201 bp, Homo sapiens; identical to SEQ ID NO: 8866

SEQ ID NO: 34702 - DNA, 201 bp, Homo sapiens
agatgcctaatttctatcttcacctcatcaagtttataaatttccccttttgttttttttttttaatcctttctcctctcctctcttcctccctcataccrttgtaaactcttctctgtaatgtcctatccctcttcctcctgagaaggccctgctgtagctcctcctctcactcacaaggtacctctccatagcacaagc

SEQ ID NO: 34703 - DNA, 201 bp, Homo sapiens
tgaaggggtcttcgacaattttgttctcaaaatcagagataccaaaaagcagtctgagccactggaaataaccctacttgcccccgaacgtaccagggacwtaacaggtctcagagaggctactgaatacgaaattgaactctatggaataagcaaaggaaggcgatcccagacagtcagtgctatagcaacaacaggtac

SEQ ID NO: 34704 - DNA, 201 bp, Homo sapiens
tgttccaggtacaccctccatggtaactgtggacggaaccaagactcagaccaggctggtgaaactcatacctggcgtggagtaccttgtcagcatcatcrccatgaagggctttgaggaaagtgaacctgtctcagggtcattcaccacaggtgagttggtggggttgtgtgtgtgtgtgtgtgtgtgttactatttttc

SEQ ID NO: 34705 - DNA, 201 bp, Homo sapiens
cagatcaccacattctccatcctaaaggcttggctcagacacaaattctaggcactgagttttcctaaataaggaattcaggaagaaccattgatgaacargacagttaactgtttctgggcttctcttgtgctttcttcttgacagccatgggctccccaaaggaagtcattttctcagacatcactgaaaattcggcta

SEQ ID NO: 34706 - DNA, 201 bp, Homo sapiens
ttctgggcttctcttgtgctttcttcttgacagccatgggctccccaaaggaagtcattttctcagacatcactgaaaattcggctactgtcagctggagrgcacccacagcccaagtggagagcttccggattacctatgtgcccattacaggaggtaggagactcggaaaggggagagagaggaggagtgttgtgggtt

SEQ ID NO: 34707 - DNA, 201 bp, Homo sapiens
cagccatgggctccccaaaggaagtcattttctcagacatcactgaaaattcggctactgtcagctggagggcacccacagcccaagtggagagcttccgrattacctatgtgcccattacaggaggtaggagactcggaaaggggagagagaggaggagtgttgtgggtttggatggattcatgaaaaagaccctgataa

SEQ ID NO: 34708 - DNA, 201 bp, Homo sapiens
gttctatttatgttgttacttacagacttacctgcacctgaaggcctgaaattcaagtccatcaaggagacatctgtggaagtggagtgggatcctctagrcattgcttttgaaacctgggagatcatcttccggaatatggtaaggagtacaaaagagcagatccatttgatctcaaggatttgaaagatgaccaaaggg

SEQ ID NO: 34709 - DNA, 201 bp, Homo sapiens
aaaaatccagatacagtggtttaaaataacaattctttgcatgttggtgatttgggtttgggctcagctgagcagcttatctgttcttgactgcactcctmatgtatctgtgtgcttaaggggtggattggcctaggatggcctcagccaggatggtgtctttctgtttcgcagagcctctcattctccaggatgctggtc

SEQ ID NO: 34710 - DNA, 201 bp, Homo sapiens
ctctctggacttgctcccagcatccggaccaaaaccatcagtgccacagccacgacaggtacatgtgcattctcccatttctaacgcactctctccacagwcttctttgcagggtgaagcctctccttctcctctcccattgatgtacaagccacagggcactaactcttccatggtgctaggctggggtgctgtttaaca

SEQ ID NO: 34711 - DNA, 201 bp, Homo sapiens; identical to SEQ ID NO: 8850

SEQ ID NO: 34712 - DNA, 201 bp, Homo sapiens
agacgtgccaggagaccgtaccaccatcgatctcacagaggacgagaaccagtactccatcgggaacctgaagcctgacactgagtacgaggtgtccctcrtctcccgcagaggtgacatgtcaagcaacccagccaaagagaccttcacaacaggtaaaaggcctccccctgttaacagatatagtaaaggaaagattga

SEQ ID NO: 34713 - DNA, 201 bp, Homo sapiens
ttcacatttgttatctctgctaatcctcaaaacatccctgtgggtgggtaccacttttccctctggacagatggagaaactgaggttcacagaagtgaagrgacctgcccaaggtcacccagcctctcagtggtatttggacaatgaagctctttcaggctccagagacccatgtggtttctgaaactttccatgggcagg

SEQ ID NO: 34714 - DNA, 201 bp, Homo sapiens
actttcttgcgtgaattctttctatcaaaaataagtttccatacactgtcaagacagtctattgcctcacttttctgcttggtaattctgatggaaaagtyttcaggaaacatccaggaagttttgcctaattaaaaatttaaagagactaagttcatcttttcaaataaagtatccccaaagcatgtttcctcaacttat

SEQ ID NO: 34715 - DNA, 201 bp, Homo sapiens
aaacccaggcagccacagagtctgggggtggctaccaggccacagaagaaagctgtaggaggagatgtcttagatgagagaaaaatgcagaaagaggaagraaaaaaaacccttgctgaatttctgtgggtttcagcatgtaataatccctgtgggttggagaggggaaaagatgaggaagtgagttccctagagcctgaa

SEQ ID NO: 34716 - DNA, 201 bp, Homo sapiens; identical to SEQ ID NO: 8857

SEQ ID NO: 34717 - DNA, 201 bp, Homo sapiens; identical to SEQ ID NO: 8858

SEQ ID NO: 34718 - DNA, 201 bp, Homo sapiens
gtggatggattgtgagtaccaccagggactgcagagccctcaggcctaggggaagagggagagggcaaagcaggggaggagaagagggtgatctcctcctratgcactctgacacccacatgtgtgaggccttgcaagatagtgcctgtcacacagaggcactcaggaattctctcttaaacaaaagaatgggaaacacgc

SEQ ID NO: 34719 - DNA, 201 bp, Homo sapiens
ttagtttgaatgactaaatagcaatgatcagtgaacacctcgcctaacagtaaccaacctggaggccttctctctctctctctctctctctttttttttttaacagggcgttaactggttccactggaagggccacgaacactcaatccagtttgctgagatgaagctgagaccaagcaacttcagaaatcttgaaggcag

SEQ ID NO: 34720 - DNA, 201 bp, Homo sapiens
agaaacaccacttcctatgtcctgagaggcctggaaccaggacaggagtacaatgtcctcctgacagccgagaaaggcagacacaagagcaagcccgcacrtgtgaaggcatccactggtgagtctgccctgagcttcctccaaactctaggttgattctgaggttagcagatctcctcagccagggtgtcctcacatgag

SEQ ID NO: 34721 - DNA, 201 bp, Homo sapiens
ctccttattccacagttggactcctgtaccccttccccaaggactgctcccaagcaatgctgaatggagacacgacctctggcctctacaccatttatctraatggtgataaggctcaggcgctggaagtcttctgtgacatgacctctgatgggggtggatggattgtgagtaccaccagggactgcagagccctcaggc

SEQ ID NO: 34722 - DNA, 201 bp, Homo sapiens
gcttggtggagaacactggctatgacgtcagtgtggcaggaaccaccttggctggggatcccaccagacccctcactgcctttgtcattacaggtactcartcagaggttctcacttgtctaacacagagagaaaaggagataagtcatcttaaaggaaaattcaacaaaaatacaatcttcactgcaaatgtgtactctc

SEQ ID NO: 34723 - DNA, 201 bp, Homo sapiens
gaggtaggagactcggaaaggggagagagaggaggagtgttgtgggtttggatggattcatgaaaaagaccctgataattttcatcctctaacatcatgakcaaagaaaatgaattctttatttgtgagaccatctggagagaagagaactcatttgtaaagtgctatgaggttcttagaagaaactttcttgtgaagggt

SEQ ID NO: 34724 - DNA, 201 bp, Homo sapiens
ggctgttttatccctagtttagagattctgcctaaaaagtgactcctaagttagtaaaggcctaagatcgaaatcctgttcataaatcatgctaggtaacrcagttcatatatgtgccaaaagtataaccatctttttctttaaaaaataattattcttaaaactgacaacacagatgcagctagatgcagctaatttgaa

SEQ ID NO: 34725 - DNA, 201 bp, Homo sapiens
gtttagagattctgcctaaaaagtgactcctaagttagtaaaggcctaagatcgaaatcctgttcataaatcatgctaggtaacgcagttcatatatgtgmcaaaagtataaccatctttttctttaaaaaataattattcttaaaactgacaacacagatgcagctagatgcagctaatttgaaattcctgtctcctttt

SEQ ID NO: 34726 - DNA, 201 bp, Homo sapiens
tataaccatctttttctttaaaaaataattattcttaaaactgacaacacagatgcagctagatgcagctaatttgaaattcctgtctcctttttttcttytgattaaaaaaaaaatgcatttaccagtactgtcagaaaaaaaaaaaaaagaaaaaaaagaaaaaagaaaaatcacctagaaaagagacgctgaaccttc

SEQ ID NO: 34727 - DNA, 201 bp, Homo sapiens
aaaggctgcacatggtgtcagtttactaaattctagcccaaaaagcctcagaaaatatttagaagtctctttcttttcattagtgataattttcagaagayggactttgccatctgattttcacattaaaccaggtctctcccagggtctaaattgccatcactaagacatgtcaattagtacaattaaatatttaattat

SEQ ID NO: 34728 - DNA, 201 bp, Homo sapiens
aggtaagttgaccaacttgtccccgcttgcctggtactgtctcagttttagcaccagaagttccacacctaggaaatcccgcagtccctggcaaaccaggrtggttggtcacctgtgaataggaaataaacacatgcccccaagcaatgtgatcagtattgctttccaccactggacatgacccagcaggcctgagagata

SEQ ID NO: 34729 - DNA, 201 bp, Homo sapiens
taaattataaaagggcatgtgaaaaagtgacaaagagaggagagcatgcatcaggacaaattaagcatgggcagcaggcttggggatgtcccctccgaccrtcctctacctcggtctcagtggcaaagcgattccagccagtaccatgtgggaaaaaaatctcctgacccccagttccccttccttctgatttggggcctg

SEQ ID NO: 34730 - DNA, 201 bp, Homo sapiens
caaccaccttatttatacagaggaagttcttgccaaaggtcacgtagttcagtggtagggaaaggacttgaacccagtcttcttgatacccagcccgaatwtctgccctacatttgctgatcttatccgatattaatcatcctgtcttctccagacctcgattctccaagagacttgactgctactgaggttcagtcggaa

SEQ ID NO: 34731 - DNA, 201 bp, Homo sapiens
acagggtttcaccatgttggccaggctggtctcgaactcctgacctcagatgatccgcccaccttggcctcccaaagtgtggggattatgggcgtgagccvccgtgcctggcctgtaaggcactttagagtttaaaaagtactttcaccaccttatctccttggatcttcactaatgcactgggaggttggaagtggggca

SEQ ID NO: 34732 - DNA, 201 bp, Homo sapiens
aacccagtcttcttgatacccagcccgaatttctgccctacatttgctgatcttatccgatattaatcatcctgtcttctccagacctcgattctccaagrgacttgactgctactgaggttcagtcggaaactgccctccttacctggcgacccccccgggcatcagtcaccggttacctgctggtctatgaatcagtgg

SEQ ID NO: 34733 - DNA, 201 bp, Homo sapiens
ctcaatgctagttgaagcatttgcatgatcttcaaagtatggaagaattacctgatgctgtttttctaccccagtgcatctggggagctgaaaaaaaaaaattagtagagactggatggcatgccagaccttctgaatcatactctccagcctctttcattttaaccagactccagttctgataggcagccaagatcaaga

SEQ ID NO: 34734 - DNA, 201 bp, Homo sapiens
ctgttaataccatttttatccagtgtttatattatttatattcgctacccaagaattttctttcttttaccttttaatttgaaataactttagatcttcaracaagcgaaggagatttcctaaactttaccttccaaacttgttattgaatttttcattttggttatctcactttatatttccaagatcttttgcttgttc

SEQ ID NO: 34735 - DNA, 201 bp, Homo sapiens
cctcatgcctttgccatgtggatggtgaatgatgcaggtgttgccctttctgatctccagccccccagcctttcatactttacctggctgattctacatcktttttgaatgatgaatttttgtttcaggaatcagcctgatggttttaattcacttctccagtgcttggagataactaaaagcttccctccctatatatga

SEQ ID NO: 34736 - DNA, 201 bp, Homo sapiens
ccaggagaagacaggaaagggggctcttgagcacagaagatgcctaatttctatcttcacctcatcaagtttataaatttccccttttgttttttttttttaatcctttctcctctcctctcttcctccctcataccattgtaaactcttctctgtaatgtcctatccctcttcctcctgagaaggccctgctgtagctcc

SEQ ID NO: 34737 - DNA, 201 bp, Homo sapiens
tgaaactcaattctcccattgaagaaaacaggataaggtaccttcccagttcccaggatgcaggagaaccttccaggggcttctgcactgatgcatgactkcccaaactaagctggctgtttgcaggttgtagagaagatcgttgtgcttggtttactaggagtgtaggttgaattccaatcccagacactaaggtcattt

SEQ ID NO: 34738 - DNA, 201 bp, Homo sapiens
tctttgattttcttctctagagcctagtagcttatagccaaagagaggtgcccatgcgcgtgcgtgcttgtgtgtgtgtgtgtgtgtgtgtgtgtgtgtgkctacatgcctgtgctccaggaccaggagaagacaggaaagggggctcttgagcacagaagatgcctaatttctatcttcacctcatcaagtttataaatt

SEQ ID NO: 34739 - DNA, 201 bp, Homo sapiens
agtctacagcagtgctctcatccttaccagatgcggtctctccctccttatattattttaacttgctctgcaccttctggcccaaggacctttgcttgtgytgtactctccccatctctgatatctcagcagtgcacatggagcctggtagagagtgggtactcaatgaattcttgtccagtaagtaagtgaatggatggg

SEQ ID NO: 34740 - DNA, 201 bp, Homo sapiens; identical to SEQ ID NO: 8872

SEQ ID NO: 34741 - DNA, 201 bp, Homo sapiens
ctctttgattttcttctctagagcctagtagcttatagccaaagagaggtgcccatgcgcgtgcgtgcttgtgtgtgtgtgtgtgtgtgtgtgtgtgtgtgtctacatgcctgtgctccaggaccaggagaagacaggaaagggggctcttgagcacagaagatgcctaatttctatcttcacctcatcaagtttataaat

SEQ ID NO: 34742 - DNA, 201 bp, Homo sapiens
accaccagggactgcagagccctcaggcctaggggaagagggagagggcaaagcaggggaggagaagagggtgatctcctcctgatgcactctgacacccmcatgtgtgaggccttgcaagatagtgcctgtcacacagaggcactcaggaattctctcttaaacaaaagaatgggaaacacgctggctactttttgaaac

SEQ ID NO: 34743 - DNA, 201 bp, Homo sapiens
atagcggaaggcctggcaggtagcaagggcccagcaaatgagagctattcacgttgccattaatgcatcatcatcgttacaattatcatctttttttttttacgttccaaagattcttccttctatctattatctcatcatatctcatctcatcatatcatatctcatcattttatccagagatacacttccttgttcttt

SEQ ID NO: 34744 - DNA, 201 bp, Homo sapiens; identical to SEQ ID NO: 8875

SEQ ID NO: 34745 - DNA, 201 bp, Homo sapiens
ttctctcttaaacaaaagaatgggaaacacgctggctactttttgaaacggggagataagtttcttgtagtttatctcatccaatcctcatcaaacaactstgtgatgtataaatgacagttgatcattgaacccattgcttacattaattagcactgactaagcatttattatctaccaggcactgtgctaagagtttaa

SEQ ID NO: 34746 - DNA, 201 bp, Homo sapiens
cagtatgtagcacaaaaggttccaacctcagttctaccatctgaacatttatctaatagttaataaaataacaagaaagaatgcaaaaaaaaaaaaaaaaagtcaagggtaggagccttctttagtgaaacagcactaagaacaaagcaaaaagaccataacattttaaaagccattttgggcaggctcaaggagaatgta

SEQ ID NO: 34747 - DNA, 201 bp, Homo sapiens
tctaactttatccaggaaaataaacagcaaaagatttagcaaatcttatcatttcttagtgggttataaccatgagctattaattttgacacaaaaaaaaacttacctcctccctttatttcagcttgtgaggatatgtcactaattgacttcattaatttgattcaaactgtgcactagaagtgggatagaaacacatga

SEQ ID NO: 34748 - DNA, 201 bp, Homo sapiens
cagagtaccttgtcgtgtacacgcccacccacgagggtggtctggaaatgcagttccgtgtgcctggggaccagacgtccaccatcatccgggagctggarcctggtgtggagtactttatccgtgtatttgccatcctggagaacaagaagagcattcctgtcagcgccagggtggccacgtgtgagtgagcagaactct

SEQ ID NO: 34749 - DNA, 201 bp, Homo sapiens
acgctgaaccttctccactaatcctccttatccctcaggattgccatcactgattggggttggctttgggtatggaaagaacatagaacttggagtcggargacctgattgtatctcagcttaggcacctagcagatgtatgacctaggataagtcattaacctctctggtttttttagatgtgatcggggttggaaggca

SEQ ID NO: 34750 - DNA, 201 bp, Homo sapiens
cgctgaggttgatgttccaaagagccaacaagccacaaccaaaaccacactcacaggtgagctctgcatctctgcaagcctgagccagccagccctagagsgcccttaaaggatgggcacctgctcccacatgtccccatttgcaaccctcagaaataagtccaatttcctgaaatactgcttattggattgcagtgagtt

SEQ ID NO: 34751 - DNA, 201 bp, Homo sapiens
ttctgatggaaaagttttcaggaaacatccaggaagttttgcctaattaaaaatttaaagagactaagttcatcttttcaaataaagtatccccaaagcawgtttcctcaacttatgagaacagtaataataataataataacaaaagaacaacctttttttttttcatgtgacatccatgggccagtctctgtgctagat

SEQ ID NO: 34752 - DNA, 201 bp, Homo sapiens
tgtaagtttccatttagctgtaatggaaaagaagtgtctaaactagatgcagctaatttgaaattcctgtctcctttttttcttctgattaaaaaaaaaaatgcatttaccagtactgtcagaaaaaaaaaaagaaaaaagaaaaaacacctagaaaagagacgctgaaccttctccactaatcctccttatccctcagga

SEQ ID NO: 34753 - DNA, 201 bp, Homo sapiens
tgtcttctccagacctcgattctccaagagacttgactgctactgaggttcagtcggaaactgccctccttacctggcgacccccccgggcatcagtcacmggttacctgctggtctatgaatcagtggatggcacagtcaaggtattttaagtatataacaactcctcaatgctagttgaagcatttgcatgatcttcaa

SEQ ID NO: 34754 - DNA, 201 bp, Homo sapiens
ctccttcctctcacaacgatgccctctttcctgcaatagcttaagtacacccagattcatcgatatgtttataggtgttcctgagacgcaaaaacggacgygagaacttctaccaaaactggaaggcatatgctgctggatttggggaccgcagagaagaattctggcttggtaatgcagccctgcatgtttatatctaaa

SEQ ID NO: 34755 - DNA, 201 bp, Homo sapiens; identical to SEQ ID NO: 8848

SEQ ID NO: 34756 - DNA, 201 bp, Homo sapiens
agtacaaaaattggggtcaggcgcagtggctcacgcctgtaatcccagcactttgggaggccaaggcgggcgaatcacgaggtcaggagattgagaccatyctggctaacacagtgaaaccccgtctctactaaaaatacaaaaaaaattagccaggcgtggtggcgggtgcctgtagtcccagctacaggctgaggcagg

SEQ ID NO: 34757 - DNA, 201 bp, Homo sapiens
caggcagatcatgaggtcaagagatggagaccatcctggccaacatggcaaaaccctgtctctactaaaagtacaaaaattggggtcaggcgcagtggctsacgcctgtaatcccagcactttgggaggccaaggcgggcgaatcacgaggtcaggagattgagaccattctggctaacacagtgaaaccccgtctctact

SEQ ID NO: 34758 - DNA, 201 bp, Homo sapiens
aagcatgtttcctcaacttatgagaacagtaataataataataataacaaaagaacaacctttttttttttcatgtgacatccatgggccagtctctgtgstagatgctttgcaagctttatctctcttaagatttgaaaaaaacaaaaacaaaaaacactagaggtagctgctgttatccctacttatagcttatcaaac

SEQ ID NO: 34759 - DNA, 201 bp, Homo sapiens
aaaaaaaaaaggagaagaagaagaaagaaagattcaaagattcactgaatacccagaatatgcctgtctctgctgggaatttaaaagactcactctctcartcaatgaataaccctacctaaattgactcaaactgtacagaaatctgttatgaaacaatgagacacgtatgatattagaatgctcttcaaggacagtggc

SEQ ID NO: 34760 - DNA, 201 bp, Homo sapiens
tccatctttaccattcaccatcaccttggaaaaatctatttctttaagctccagatccaacagctgaaaaatgggtttatagtattctccttgtggggtcrtcataagactcaagacataaataacaaagcaccatgtttgcacctgataaatacagagcattgttagtttctgctattcaagggtcccaaatctaggggg

SEQ ID NO: 34761 - DNA, 201 bp, Homo sapiens
tttctgctgtctcccaacattattaggaaagtggctttcttaaaaataaccaataaggctagatagaacaatagacctatgcaatcatgaactccctctcktttttaagagaactttggatgtgttttaatgtaagattaaaaaatgagtattttttcctatccagttacctaatgtgaattaaatcattcagatgagtct

SEQ ID NO: 34762 - DNA, 201 bp, Homo sapiens
attggagtttctgctgtgaaggaagacaaggagagcaatccagcgaccatcaacgcagccacaggtggggcacacctggaattcccatcccactgagctgstgctgggcagatgagacagagtcaatgtggccaaaacctatttaaagagaaaaagtagaagcctggaggaaaaagggccctgtagtaccatctagcccca

SEQ ID NO: 34763 - DNA, 201 bp, Homo sapiens
agtagagatggggtttcagcatgttggccaggctggtttccaactcctgacctcaagtgatccacccgcctcggcctcctaaagtgctaggattacaggcrtgagccaccgtgcacagctgcaattttttaaaaagaaaaaaatgcataattttgcacttccatataggaaaacctctttattttcttcaagataacatat

SEQ ID NO: 34764 - DNA, 201 bp, Homo sapiens
tgatgcatagtaagtgcctaatgaatcgatgaaagaataacagaggaatgaatgaatgcagagtgaatgaatcacataaattaagagactggcacctcccytaactcttaccaagctgcctctatctctcagaataaagaagatgagggagagatcaccaaaagcctgaggaggccagagacctcttaccggcaaactggt

SEQ ID NO: 34765 - DNA, 201 bp, Homo sapiens
gtcttctgggttcatccgtgttgttgaaaatgacagaattttcctcttttttaaggctataaagtattccattatatatatatgtgtatatatatatatatgtatatatacacacatatggaatgtatatatttatatataaatatgatctatctatctatacaccacattttctttatccattcatccattgacagacac

SEQ ID NO: 34766 - DNA, 201 bp, Homo sapiens
tgtcttctgggttcatccgtgttgttgaaaatgacagaattttcctcttttttaaggctataaagtattccattatatatatatgtgtatatatatatatatgtatatatacacacatatggaatgtatatatttatatataaatatgatctatctatctatacaccacattttctttatccattcatccattgacagaca

SEQ ID NO: 34767 - DNA, 201 bp, Homo sapiens
tatggctacattctggaaaaatccactgcttcctctaataatgtctctctctttctctctgcccatattccttctttagaaccaaagccacagttgggcaygctaatctttagcaatattactccaaaaagcttcaacatgtcatggaccactcaagctgggctttttgcaaagattgttatcaatgtgagtgacgctcac

SEQ ID NO: 34768 - DNA, 201 bp, Homo sapiens
attactccaatctaccactctaatggcttgtctactcttcttcatacatgactagcaaatggtggtgtttatgctttaaaagaacacagatctaaaaaatraaataaaaataaagaacacaaatatacacctgcagagaaagcaatatattttctatcatcatattcaatgcaggtgtagacacagcctaacatactgtct

SEQ ID NO: 34769 - DNA, 201 bp, Homo sapiens
ttggtaacattgcttccttccatcatagccctgaattatcagatctctctacccagcaatggttctattaacaacctcaatcttaaaacacagccaaatawctcaaatttatttttttcttctcccctaccccttccttttacagccaaagaacctgaaattggaaacttaaatgtttctgacataactcccgagagcttc

SEQ ID NO: 34770 - DNA, 201 bp, Homo sapiens
ctgcccatatctcagggctaccccctagtactgattttattgtctacctctctggacttgctcccagcatccggaccaaaaccatcagtgccacagccacracaggtacatgtgcattctcccatttctaacgcactctctccacagtcttctttgcagggtgaagcctctccttctcctctcccattgatgtacaagcca

SEQ ID NO: 34771 - DNA, 201 bp, Homo sapiens
ataagagaactgaattaccctcctccgggcagttctctcagatactgagtcattgttagaacatcaaattagcaaatagctagaccagaaggaaaaaaaaagaaattacacaattatgactggagactgtaccaaagagaaagccattcattagcacaagtacacacagcagcttttggaacaaggaatgtcctgggctat

SEQ ID NO: 34772 - DNA, 201 bp, Homo sapiens
tcaataggaaaataccatttccaagagaaaaacccaaatatgcatgaaggcaaaagaaattttttgtttgtttgttttgagacagagtctcactctatccyccagactggagtgcaatggcgccatctcagctcactgcaacctccaccttctgtgttcaagcgattctcctgcctcagcctcctgagtagctgggattac

SEQ ID NO: 34773 - DNA, 201 bp, Homo sapiens
taagaggcaaacatagatgtgttaaatggaatagctaaagaagtagaagcccaggcacctgaccttggtaagcatagaggaagaaagaaaacaggaaaagygagagctcttgggtgaaggagccatgtggctataagtcctgaaatgttgcagagttttaggttcaaccatcagaagcaagaaccttccagctctgtatca

SEQ ID NO: 34774 - DNA, 201 bp, Homo sapiens
tacagcccctgcagtggatttttccttaggggtatttatggaccttaaggcaggagcttaaggataatttggaccctattagccatgtagaacatgatacrtgattacatttgtagacattttggtgccttaatgtcagcaagggttgcaaaatgagttttgatatgcatgtattccagagatgtatagaagttccagtta

SEQ ID NO: 34775 - DNA, 201 bp, Homo sapiens
agaaactgatgaaatcccaatataaactatacaacagacctcccataggatattgaggcagcacaaaaaagaagaggctttttttttttttttttttttttgagatggagtctcgttctgtcacccaggctagagtgcaatgactcaatcttggctcactgcaacctcaacctccagggctcaagcgattctcctaactca

SEQ ID NO: 34776 - DNA, 201 bp, Homo sapiens
ctcttagtttaaattgctcaagatcctctaacatagagcttcacattttatcccagagaggtcatagttaggtatatctctacttccttctaatacaggargaaatgaaaggagtaagggtctaggatttgttctctatcagttcttcccccatcgtgtgccatccaacctaatcctgtgactcacttcaaacagaataat

SEQ ID NO: 34777 - DNA, 201 bp, Homo sapiens
tagaaactgatgaaatcccaatataaactatacaacagacctcccataggatattgaggcagcacaaaaaagaagaggctttttttttttttttttttttttgagatggagtctcgttctgtcacccaggctagagtgcaatgactcaatcttggctcactgcaacctcaacctccagggctcaagcgattctcctaactc

SEQ ID NO: 34778 - DNA, 201 bp, Homo sapiens
atttaaagacattcttcagtgtgggaaaaatgtgcaaagttctttttattggttcttctccactgtccacagactatttcccccatccctttctccacaggaaaaaatatacatgtttcatttaaggtgaagcagacgtttctttccctccttgaattctaacttttaaagccttctgcattcactcagtcaataaaatac

SEQ ID NO: 34779 - DNA, 201 bp, Homo sapiens
aaagtgaagatagaataactatctgtggagatatctggccttttatctgtagcatctgcttagggacaaaaggagaggcagtttctcccatgactcggctktcagtttattttttttcctattggcagagttaaattggggtcccaagattttattttcctttcacaaaaagtaaaatctgattaaggaagaaccaaaact

SEQ ID NO: 34780 - DNA, 201 bp, Homo sapiens
gatatctgtattacttatgatggtgatgatgatgatgtcaacttcctgattattattattatgtcaacttcttaatgatcttccaaggccttttcaaccamtatttggtgattgtaattctttccttttctaggaagccccccatgaacttcccagtgcaaagtggcacataattatctcattcaggctggcattaatacc

SEQ ID NO: 34781 - DNA, 201 bp, Homo sapiens
ccatgcactagaatgaagtgttttgtgccacagacttgccatgcctataccaaatgatcttctacagttgcttctaagtcctgctcaagcatgattttgaycctataatttgatgtctgtctgtgtctttggaaagtactgagaagctgggccaaatgtttcccgttaggaacacagtcttgaaagactaaaccacaggca

SEQ ID NO: 34782 - DNA, 201 bp, Homo sapiens
aacggacgcgagaacttctaccaaaactggaaggcatatgctgctggatttggggaccgcagagaagaattctggcttggtaatgcagccctgcatgtttrtatctaaaatgcctgattctgccctccttgtcacttttcctaacccacagggacctatgggagagaaagagatgaggaagaagaactacttctggtggca

SEQ ID NO: 34783 - DNA, 201 bp, Homo sapiens
cagaaaagagccccacaccaggctaattcatttgcttttcttgctactgagttagaagagataggataacaggaaaaccagggctgtagccacagcctccwcattttcctaaaaattttagagtgtccctgctacttgacaaattgaaatactaagatttatacatttccatggaaaaagcaacagtgggaaagagagggc

SEQ ID NO: 34784 - DNA, 201 bp, Homo sapiens
cagtttatttctctaactttcattccttcctcattaatccagcaatttattaaatcaacaaatatttaagtacctactgagtgccaatccagaaaaactayaattcaaaagtgttgggtagatatttgggtcctgaaacattgagtatgttgggaatcagggcaatcaggattgatttctaatgaccatctttcaaaaaaa

SEQ ID NO: 34785 - DNA, 201 bp, Homo sapiens
agaaaagagccccacaccaggctaattcatttgcttttcttgctactgagttagaagagataggataacaggaaaaccagggctgtagccacagcctcctyattttcctaaaaattttagagtgtccctgctacttgacaaattgaaatactaagatttatacatttccatggaaaaagcaacagtgggaaagagagggct

SEQ ID NO: 34786 - DNA, 201 bp, Homo sapiens
catcatcagttaaaaaggtatctgggttcctttgacaacttgctccaaattatgacggtagaatgcctcagagtcttgaaatgtttgtgcacagcacttgkctggattgggagtgaggagacccacaaagcaatggtactgaaatgcttcaaaaattcaatatattaaattacaaattagatttccaaatagtagtacatg

SEQ ID NO: 34787 - DNA, 201 bp, Homo sapiens
tctgctttctatacctgactgtgagctcattaagggcaagacctatccatcattggcttctgaaacaccccaccaccactaggctatcccatagcccgttyttacacttgttcaacacatctctgttgaatgcaagaataaatcatttagaaattaattctcagtcctcttggataatcactggctcccccagcatcttaa

SEQ ID NO: 34788 - DNA, 201 bp, Homo sapiens
tcacatccctgtaagactcagaaactgcccatgtcagtgaatgccaaacaattagaagcaaataaagtgtctctatttttttcccatctcactagccattracttccccacagtggggcaaggggccatgtggggtttcatggattgactctaccatctgcagacttcgctgaagagtcaaagttgaaacctggaagccaa

SEQ ID NO: 34789 - DNA, 201 bp, Homo sapiens
ttaagactatttatctctcaagtaagaacactgatatttaaccctatatgtcaaattgtaaaactgtgttttgttgagctgttcgttctgctattccatamcaaacccctatcaaaatactccataggaatctcgtgaattacagacacacacacacacaccatgtatgtagctattcaattctagaacttctaataatga

SEQ ID NO: 34790 - DNA, 201 bp, Homo sapiens
ttgaaactggctttttttccttcagcataattctctcgagattcatctaaattgcttcttttatcaatagttggttccttttaactgctttaaatctgagyagcattttatggaatggatattccatgacattattttcaatcttctcagactccgatggggtcatgtgggtgatgtataattagacctattttacaaaag

SEQ ID NO: 34791 - DNA, 201 bp, Homo sapiens
acccagagatgtgactctcctgtggtccctcagctcctctgtggcagacctaggattccagcccagatgcagttgactttcagccccagaagcagccctgycttgcagcctgaagagcattcatctctctgttctcctcccagagttggacacgcccaaggaccttcaggtttctgaaactgcagagaccagcctgaccct

SEQ ID NO: 34792 - DNA, 201 bp, Homo sapiens
ccgctgcgtggacggccagtgcatctgccacgagggcttcacaggcctggactgtggccagcactcctgccccagtgactgcaacaacttaggacaatgcrtctcgggccgctgcatctgcaacgagggctacagcggagaagactgctcagagggtgagtgccagggcgcagaccagcatataaaggccatgatggagtg

SEQ ID NO: 34793 - DNA, 201 bp, Homo sapiens
cctctcattttctcttttctcttagtcattaagacattaacctagtttgtctatgacgacagcttaatcctgacattgcggcccatgcaacttgtgtccaytctggcccatgcaacctgttcactgaacctgcggccatgcttactcggtggctaaactgaagagacaaccaggtttttaaaatatttcttcctttatgaa

SEQ ID NO: 34794 - DNA, 201 bp, Homo sapiens
tacctactgcatacattgtaccgtactgatatttgaggaaaagtagttcccaaagtcagcattgttatgtggactcatttgtgcctgctcatagtgcttgyggaagactagatactcagaatgctagacagaactcgagaaaaagagtgatccaaggaaatcaggagagctggcaaaggtgttatggcaagggatgttatt

SEQ ID NO: 34795 - DNA, 201 bp, Homo sapiens
tagtgcttgcggaagactagatactcagaatgctagacagaactcgagaaaaagagtgatccaaggaaatcaggagagctggcaaaggtgttatggcaagrgatgttattccagttgaagcttgatatgcaagaaaagggttagaagtgtggacatatttggaaatggcttgaagagtctttctcacaatatcttcagtct

SEQ ID NO: 34796 - DNA, 201 bp, Homo sapiens
gcttccattctcaaagtcatctcagtgtcacaacatggctgctgtaatacagccattccatctgtgttctaggcagcataagggaggaagaaccaaaactyccaaagaggagcaccttctgggtgagtctttctggaaaccccaccaatcacttctccccatagttcattggccactcctagctgtaagggaggcagggaa

SEQ ID NO: 34797 - DNA, 201 bp, Homo sapiens
agaaccaagaagaaataaatctatagtagagatttaaatttcagctttataaacatgagcttgttataaagtgtcaaggggcaacaaatgaatcagaaatrcccaaaagatgaaatccctctcttttctttctctttctctctctttcttccctcttccctcactcctgctcttcttcctcctcctccttcctctgcccct

SEQ ID NO: 34798 - DNA, 201 bp, Homo sapiens
gaagaaataaatctatagtagagatttaaatttcagctttataaacatgagcttgttataaagtgtcaaggggcaacaaatgaatcagaaatgcccaaaaratgaaatccctctcttttctttctctttctctctctttcttccctcttccctcactcctgctcttcttcctcctcctccttcctctgcccctctccctta

SEQ ID NO: 34799 - DNA, 201 bp, Homo sapiens
tggtggaggacaaggctctcattagcatcatttgtgtttgcatctatattttaagggatgttggtttttccctgattttaataagtaagtgtagcacttasggctgacaccctagacaaatagaagttgtcacctcaaggttccaattgtccatcatcaccttagaaatctctactcagaggcaaagaagagaagaaacag

SEQ ID NO: 34800 - DNA, 201 bp, Homo sapiens
ctgtcggaaataagtactggggtgacactcatgtcccattcagttccgcattcaatgctgactctgggatcaatgttcaaggccagtcccacacccagaayctttcaattgtcacctctggttctgccctttactgtccaggagggaaatttcagctgagatttctcaggtccatattttctgtctctcccaggtgactcc

SEQ ID NO: 34801 - DNA, 201 bp, Homo sapiens
ttccaagtgaagaaactcaggcttagagcattgtgtgcaattgctcaagttcacattgatagtagagcttagattctaaccccaagtctgtctgattccamagcctgcgttcattttagatttaaacatatgaaattgccaaaattaatcataccatttttcctaatattaatttttatacagcctcatagagacctcatc

SEQ ID NO: 34802 - DNA, 201 bp, Homo sapiens
ttgagcttccacattatgcgggatgcaaggccggacatttacatgccaattctttttttttaatcttttgattttgagataattgtagattcacatgcaaytgtgagaaagcatacagacagatcccctgtgcccatcacccaggttcccccaagggtagcgtcttgcataaatgtagactaatataacaactgagaaatt

SEQ ID NO: 34803 - DNA, 201 bp, Homo sapiens
acacactggagtggagtatatcactcactcctcaatgcattcccaagaagtagacatatttaccttctttttccaagtgaagaaactcaggcttagagcaytgtgtgcaattgctcaagttcacattgatagtagagcttagattctaaccccaagtctgtctgattccacagcctgcgttcattttagatttaaacatat

SEQ ID NO: 34804 - DNA, 201 bp, Homo sapiens
atttattcaacttgttctgcatgccacgaaccaggcccagcagtctacacactggagtggagtatatcactcactcctcaatgcattcccaagaagtagayatatttaccttctttttccaagtgaagaaactcaggcttagagcattgtgtgcaattgctcaagttcacattgatagtagagcttagattctaaccccaa

SEQ ID NO: 34805 - DNA, 201 bp, Homo sapiens
cggctactcaggaggctgaggcagagaatagcttgaaaccaggaggcagagtttgtagtgagctgagatcatgccactgtactccagcctgggtgacagaktgagactctgtctcaagaaaaaaaaaaaaaaaaaagagtcctcattatatgagttagtatatgtatgaaataggagctattgttaaccccattttacaga

SEQ ID NO: 34806 - DNA, 201 bp, Homo sapiens
cgggcatggtggctcatgcccgtaatcctagcactttgggaggccaaagtaggtggatcacctggggtcacgagttcaagaccagcctggccagcatggcraaaccctgtctctactaaaaatacaaaaattagtcgggcctggtggtgcatgcctgtaatcccggctactcaggaggctgaggcagagaatagcttgaaa

SEQ ID NO: 34807 - DNA, 201 bp, Homo sapiens
atgcgggtcacagagtaccttgtcgtgtacacgcccacccacgagggtggtctggaaatgcagttccgtgtgcctggggaccagacgtccaccatcatccrggagctggagcctggtgtggagtactttatccgtgtatttgccatcctggagaacaagaagagcattcctgtcagcgccagggtggccacgtgtgagtga

SEQ ID NO: 34808 - DNA, 201 bp, Homo sapiens
gaaacacccaagggcacactgctgacctgggactccagcctgaaggaaatggactaaggaacagccaccacaggtcttaagatggatcacagcagggggtscctgatgccatctgcattttagaggcaacagaagatcttcagacctctgtggctgacagtggaaaagacaggtcaaacaaacctagagagattttagagg

SEQ ID NO: 34809 - DNA, 201 bp, Homo sapiens
agggagtgaggctcagactgcactttcccatgccaacagcctgcatctgagctaagacccaggaagcacagaaagttggagaggccagaaacacccaaggscacactgctgacctgggactccagcctgaaggaaatggactaaggaacagccaccacaggtcttaagatggatcacagcagggggtccctgatgccatct

SEQ ID NO: 34810 - DNA, 201 bp, Homo sapiens
agagcagggagtgaggctcagactgcactttcccatgccaacagcctgcatctgagctaagacccaggaagcacagaaagttggagaggccagaaacaccmaagggcacactgctgacctgggactccagcctgaaggaaatggactaaggaacagccaccacaggtcttaagatggatcacagcagggggtccctgatgc

SEQ ID NO: 34811 - DNA, 201 bp, Homo sapiens
gcccaaaagatgaaatccctctcttttctttctctttctctctctttcttccctcttccctcactcctgctcttcttcctcctcctccttcctctgccccyctcccttagctttcccttgagtttgataaatgctgtatctaagagagattcctattgcccctcaatcattccaccttctggtgatggccacattgcctcc

SEQ ID NO: 34812 - DNA, 201 bp, Homo sapiens
aacatggcaaaaccctgtctctactaaaagtacaaaaattggggtcaggcgcagtggctcacgcctgtaatcccagcactttgggaggccaaggcgggcgratcacgaggtcaggagattgagaccattctggctaacacagtgaaaccccgtctctactaaaaatacaaaaaaaattagccaggcgtggtggcgggtgcc

SEQ ID NO: 34813 - DNA, 201 bp, Homo sapiens
caaatatttacctgttcattttgtatttttagtagagacaggatttcaccatgttggccaggctggttttgaactcctgatctcaagtgatccacccgccycggcctcctaaggtgctggcattacaggcatgagccgccacggccggccacaatttaccacatatacctgaaacctttaaacctttaaccttttttccag

SEQ ID NO: 34814 - DNA, 201 bp, Homo sapiens
tggcctgaggactgcactttgaatggcaagggccaaataaccaagtttttgtttttttccaggaagtggagaagaatttggggttgggactagactggggktgagctggggagatggaagatggaagtggggtcagtgggaggcaatgatggtaggtatcttggaagaaggatgcttaattttaacacggaaagactggaa

SEQ ID NO: 34815 - DNA, 201 bp, Homo sapiens; identical to SEQ ID NO: 8949

SEQ ID NO: 34816 - DNA, 201 bp, Homo sapiens
  misc_feature (1)...(201): n = A,T,C or G, or insertion/deletion polymorphism (see Tables 1-2)
agtgttgaactctcacttggagcccacactggaatatggtgaggagttcattatatttcataatgtgaaaaaatatttcataatatgaacaatagcaaggngctcatagctcagacctctctgatacagtccatttctttttatgaggtctcatgccaagagacggaaaagagctctaacagccctgagcagctttagagt

SEQ ID NO: 34817 - DNA, 201 bp, Homo sapiens
caattccctggacagagagttgccagaacaatttgtggtgggttctttaggctctgttttttatctgtgggcaagagagggctgcaaattggttagtcccrggacagcagctggtatgatcttgagttcccatgcagactgactagcagagcctgccactatgttgagagagtatgaagctctccgggctctgcaggaaag

SEQ ID NO: 34818 - DNA, 201 bp, Homo sapiens
tcactgcaacctctacctcctgggttcaagcgattctcctgcctcagcctcccaagtagctgggaatacaggtgccctccaccacgccaagttaagtttgkttttttttgtttttcttttttttgtatttttagtagagacagggtttcactatatgttggcaggctgctctcaaactcctgaactcaggtgatccaccca

SEQ ID NO: 34819 - DNA, 201 bp, Homo sapiens
ataacttgttttttcctccctttttggtgctggtttagatattcatttcaggggcaaaacaaaatcctttccagaaggtgagtgagctgctgggcttcccrttcgtcatttcagaatgggcaaagacactatttttaaaaatggaattacagagtggttaggtccgaggatgtggtaagacgcacccacaggtgggaacca

SEQ ID NO: 34820 - DNA, 201 bp, Homo sapiens
ctctggaaccttttgatgatacatgttctgggtgtgatcagccactgaggccctgtcccaccatatatctctcctttttaccactctttctttgcccccasagctgtctgaagagcagcagtttgtggctgaggccctggagaaggggacccttcctctgttgaaggaccaggtgagacagcctgggctgagggccatggt

SEQ ID NO: 34821 - DNA, 201 bp, Homo sapiens
gctggtatagggattgagagggactggagaaagggaacttacagagtgataactggtctctccaataacttgttttttcctccctttttggtgctggtttrgatattcatttcaggggcaaaacaaaatcctttccagaaggtgagtgagctgctgggcttcccgttcgtcatttcagaatgggcaaagacactattttta

SEQ ID NO: 34822 - DNA, 201 bp, Homo sapiens
ttgagtggagcgggtaccttttttcttttccttttccttttttttttttttttttttgagatggagtttcacttttgttgcccaggctggagtgcaatggyacattcttggctcactgcaacctctgcctcctggattcaagagattcttctgcctcaacctcccgaggagctgggactacaggtgcccgccaccacgcct

SEQ ID NO: 34823 - DNA, 201 bp, Homo sapiens
tttatttttatttttcttttccctgcttttcatgagctttgtgggggactggctctctagggcagcctctcgctctctacttccaggattccctcagccckcccctttacgcaagcacgccttcctcttctctgcctccagaagccttctcattcacccaggagcagtctccaggaagccttctgatgcccccaattcact

SEQ ID NO: 34824 - DNA, 201 bp, Homo sapiens
caattattccaaccccctgcctctgatctcagttattcctggggtacttgggtttcagaagccccagggttaagtgttgaactctcacttggagcccacastggaatatggtgaggagttcattatatttcataatgtgaaaaaatatttcataatatgaacaatagcaaggagctcatagctcagacctctctgatacag

SEQ ID NO: 34825 - DNA, 201 bp, Homo sapiens
gtcaggtgagggtattggtatctgtatgtggggtggggcactggataggtaggggaaagtcatcggaggcagggacccatgtcttgagggccttttgattrcaaatagaaactccatcagactgttttaggtctcaacatgagtttcccccagcgggaatggaatctgatgcttcatgagcctaagggcagatgatgcagc

SEQ ID NO: 34826 - DNA, 201 bp, Homo sapiens
cagtcagacaaataacagagccttagaaataaaaccttttgggctgggtggcccaggttctcaattgctgcctctacaggaaagtctttgggttcggaggrttccagaaacatgaaggagaagttggaggacatggagagtgtcctcaaggacctgacagaggagaagagaaaagatgtgctaaactccctcgctaagtgc

SEQ ID NO: 34827 - DNA, 201 bp, Homo sapiens
cagtggttctcattggttataccccaaaatcacaccaggaaactttaaaactagtgacgactgagtcccgtctccagaaactctgacttaattgtgggggkgtggcctggacatcaggatttgtaataactcctcaggtgattctcatgtagtcaaggttgagaaccactgctttaactttctccaaatcctaattacttc

SEQ ID NO: 34828 - DNA, 201 bp, Homo sapiens
agattcaaagaggttaagtgacttacccaaggtcatgtggtaagaaggtggaggagtgggctcaaatctgggatcctgtgaccccaaggtaactgtgcttytggtgagaacagcatttcctggacagccacagctgtggcgctccctcagaagggagggggatggtggcacggaacccaggatggggctgccccagggagg

SEQ ID NO: 34829 - DNA, 201 bp, Homo sapiens
ggtatctgaggtcctgatttccggggagctacacatggaggacccagacaagcctctcctaagcagcctttttaatgctgctggggtcttggtagaagcgygtgcaaaagccattctggacttcctggatgccctgctaggtgaggaagggtctcgctgtaggctggggtggaggaagtgtgagcagagaggcctgtgggg

SEQ ID NO: 34830 - DNA, 201 bp, Homo sapiens
ccgaggtgggtaaagtgaactgcgatggggtgctgtgttccttggttttccagtctcagaagcgattaatcttaaataggagctggctcacagagagggaraagagtcagtgggaggtaaggccctgagatccttaactctcatctctctccactctctccaggaagctgaagagggaactacccttttcattccgatcaa

SEQ ID NO: 34831 - DNA, 201 bp, Homo sapiens
attaactcctctcccagtctccaaatagaataattgtcttttttggctggacgtggtggctcacgcctgtaatcccagcactttgggaggccaaggtgggyggatcacctgagatcaggagttcgagaccagcctagccaacatggtgaaaccctgtctctactaaaaatataaatattagctgggtgtggtggtatgcgc

SEQ ID NO: 34832 - DNA, 201 bp, Homo sapiens
gaaggagaagttggaggacatggagagtgtcctcaaggacctgacagaggagaagagaaaagatgtgctaaactccctcgctaagtgcctcggcaaggagratattcggcaggatctagagcaaagagtaagggaccctaagaaagccttggggcagagagagataggagccagaggggatggcagttggcacagtgagga

SEQ ID NO: 34833 - DNA, 201 bp, Homo sapiens
ctagggtgggtggctggtgagcttggaggttggggaggggtccagggaaaagggtgggttcagcactaggaaggactgaggctccatgctctgacctgggkacctggacccgctgacccaggatttgcctgaacatgacataagagtcattaactcctctcccagtctccaaatagaataattgtcttttttggctggacg

SEQ ID NO: 34834 - DNA, 201 bp, Homo sapiens
  misc_feature (1)...(201): n = A,T,C or G, or insertion/deletion polymorphism (see Tables 1-2)
gtcaattattccaaccccctgcctctgatctcagttattcctggggtacttgggtttcagaagccccagggttaagtgttgaactctcacttggagcccanactggaatatggtgaggagttcattatatttcataatgtgaaaaaatatttcataatatgaacaatagcaaggagctcatagctcagacctctctgatac

SEQ ID NO: 34835 - DNA, 201 bp, Homo sapiens
gtagggtaaaaggcatgtgctgcaacactgaagacagaaagaagaagcctctggacactgccagagatgggggttgagcctctggcctaatttcccccctygcttcccccagtagccaacttggagtagcttgtagtggggttggggtaggccccctgggctctgaccttttctgaattttttgatcttttccttttgctt

SEQ ID NO: 34836 - DNA, 201 bp, Homo sapiens
gtgaggataatctgctatggtgagactgctgctcatctcccacacttcctggccctaggtatctgaggtcctgatttccggggagctacacatggaggacycagacaagcctctcctaagcagcctttttaatgctgctggggtcttggtagaagcgcgtgcaaaagccattctggacttcctggatgccctgctaggtga

SEQ ID NO: 34837 - DNA, 201 bp, Homo sapiens
gaggggatggcagttggcacagtgaggataatctgctatggtgagactgctgctcatctcccacacttcctggccctaggtatctgaggtcctgatttccrgggagctacacatggaggacccagacaagcctctcctaagcagcctttttaatgctgctggggtcttggtagaagcgcgtgcaaaagccattctggactt

SEQ ID NO: 34838 - DNA, 201 bp, Homo sapiens
agtggttctcattggttataccccaaaatcacaccaggaaactttaaaactagtgacgactgagtcccgtctccagaaactctgacttaattgtgggggtgtggcctggacatcaggatttgtaataactcctcaggtgattctcatgtagtcaaggttgagaaccactgctttaactttctccaaatcctaattacttct

SEQ ID NO: 34839 - DNA, 201 bp, Homo sapiens
agtgccatgatggattattacgtctgcctatcagctcagcagcaaggagtgtggccaaatatttgccatttctggtatatcgttgttcctagctgttacartctggggggtttccttccaggtgaaatctgtcatggagcagaactgggatgagctggccagcagtcctcctgacatggactatgaccctgaggcacgaat

SEQ ID NO: 34840 - DNA, 201 bp, Homo sapiens
atattggccaggctggtctcgaactcctgacctcaagtgatctgcctgccacagcctcccaaagttctgggattacaggcgtgagccactgtgcccagccytaatttccctaaatataggaagtagacattagtaatattctcctactatagatgaagaaacagattcaaagaggttaagtgacttacccaaggtcatgtg

SEQ ID NO: 34841 - DNA, 201 bp, Homo sapiens
cctgagtagctgggattacagatgtgtgcctggtgatccactcacctcagcctcccaaaatgctgggattacaggcgatagccaccgtacctggcctctcrccctactttgtaccccacccctacctccaccccgaggtgggtaaagtgaactgcgatggggtgctgtgttccttggttttccagtctcagaagcgattaa

SEQ ID NO: 34842 - DNA, 201 bp, Homo sapiens
actttgtaccccacccctacctccaccccgaggtgggtaaagtgaactgcgatggggtgctgtgttccttggttttccagtctcagaagcgattaatcttmaataggagctggctcacagagagggagaagagtcagtgggaggtaaggccctgagatccttaactctcatctctctccactctctccaggaagctgaaga

SEQ ID NO: 34843 - DNA, 201 bp, Homo sapiens
agtctggaggctgcatctgtctcctctaaacacagtggttctcattggttataccccaaaatcacaccaggaaactttaaaactagtgacgactgagtccygtctccagaaactctgacttaattgtgggggtgtggcctggacatcaggatttgtaataactcctcaggtgattctcatgtagtcaaggttgagaaccac

SEQ ID NO: 34844 - DNA, 201 bp, Homo sapiens
ccttggcttcttcctcaatcatctaggcacagtcctatgactgcctgtttttgaggatgtgggaagggtctgcaaatacagtgctttcccattgacacacrctggtgaggatgcaggctccctggcaccagcagtgagggctcagattgcaagagtaaaaacttccatcactgggaagagaagtctgcaggggactggagg

SEQ ID NO: 34845 - DNA, 201 bp, Homo sapiens
ggcaaagacactatttttaaaaatggaattacagagtggttaggtccgaggatgtggtaagacgcacccacaggtgggaaccatggcaagcgcaggggaaraattagcctgttgaagagtctggattgcacatcggactagggtttccaggctgctcctaggacaacttcgtgctggcagtcagctggatcctgagcttac

SEQ ID NO: 34846 - DNA, 201 bp, Homo sapiens
  misc_feature (1)...(201): n = A,T,C or G, or insertion/deletion polymorphism (see Tables 1-2)
cctgggctggagccttctcccctccccagttggactaggggcagtgttaattttgaaaaggtgtgggtccctgtgtcctcttccaggggtccaagggaacnggagaggtcactgggcctgttttctccctcctgaccctgcatctcccaccccgtgtatcatagggaactttcaccttaaaatctttctaagcaaagtgtg

SEQ ID NO: 34847 - DNA, 201 bp, Homo sapiens
gatctcggctcactgcaacctccacctccaaacctggtggtttaagaggcactctcctttgctctcctctgctctcctgcactgagctgcccacatcagtrttttgtgcttgtttccctctgccttgtgggcaagccagtggcttccatgttcgtctttcccactggactggaagcaacttgtgacaagggactgacttta

SEQ ID NO: 34848 - DNA, 201 bp, Homo sapiens
atttttcttttccctgcttttcatgagctttgtgggggactggctctctagggcagcctctcgctctctacttccaggattccctcagcccgcccctttaygcaagcacgccttcctcttctctgcctccagaagccttctcattcacccaggagcagtctccaggaagccttctgatgcccccaattcactcatatccct

SEQ ID NO: 34849 - DNA, 201 bp, Homo sapiens
ttgaaaaggtgtgggtccctgtgtcctcttccaggggtccaagggaacaggagaggtcactgggcctgttttctccctcctgaccctgcatctcccacccygtgtatcatagggaactttcaccttaaaatctttctaagcaaagtgtgaataggatttttactccctttgtacagtattctgagaaacgcaaataaaagg

SEQ ID NO: 34850 - DNA, 201 bp, Homo sapiens
gatatcccagcagtatctggctacccttgaaaacaggtgaggttggagttgggcagcagggaaggaggggaagaagcccatcttgggcaccaagggattcragggtggcagaccggctctttttaaaatttatttatttttatttttcttttccctgcttttcatgagctttgtgggggactggctctctagggcagcctc

SEQ ID NO: 34851 - DNA, 201 bp, Homo sapiens
gctgccccagctccacggagtccggatttttggaatcaataagtactgagagtgcagccccttcccctgcccagggtggcaggggaggggtagggtaaaargcatgtgctgcaacactgaagacagaaagaagaagcctctggacactgccagagatgggggttgagcctctggcctaatttcccccctcgcttcccccag

SEQ ID NO: 34852 - DNA, 201 bp, Homo sapiens
ccccagctccacggagtccggatttttggaatcaataagtactgagagtgcagccccttcccctgcccagggtggcaggggaggggtagggtaaaaggcaygtgctgcaacactgaagacagaaagaagaagcctctggacactgccagagatgggggttgagcctctggcctaatttcccccctcgcttcccccagtagc

SEQ ID NO: 34853 - DNA, 201 bp, Homo sapiens; identical to SEQ ID NO: 8969

SEQ ID NO: 34854 - DNA, 201 bp, Homo sapiens
cggaaaaaggggcgtgcacgcgggcgcggctgcgtgagaggcgcgcggcggcgcagtgaacagtctccttccacaaaaccatggcgtcgctcaaatgtagyaccgtcgtctgcgtgatctgcttggagaagcccaaataccgctgtccagcctgccgcgtgccctagtgagcggggaggtcgcggggtccaggggcgcggg

SEQ ID NO: 34855 - DNA, 201 bp, Homo sapiens; identical to SEQ ID NO: 8971

SEQ ID NO: 34856 - DNA, 201 bp, Homo sapiens
atcccatctggtatctggtttacagcagctatttcaaacacctcagttaattgtggtgagaattttgtaagattcggcagggtagggaggatggggacagkttcttggggtgcatgaatgagtcctgctttctcagcctgctggcggttttccttaatctctctcttgctttgatctctcacttcttccacattcctgggc

SEQ ID NO: 34857 - DNA, 201 bp, Homo sapiens
gccccctcctgctgaggagagcacacagcttgcctctgtaacctcctcatccccaaaccagctcaccatagagtcagtcatgaacaccttggtcctgccayagtgcatgggggctggcatggcctcagccgagtcaccagttatggctgctgcctgagttaggaccggcagagtgtggagaatgtcctggatgagaggttc

SEQ ID NO: 34858 - DNA, 201 bp, Homo sapiens
catcacagggttggagccatgttgaggtggggatgggtattaagttattagacaaccggggtctaagcctaaagaccacaggaccacatatacagtaaggktgtgaacactagagtgcatttgttaaaatcaccaattctttcacttagcctccctcttctaaaaaaggagtgttagtatagtcacagactccggagaaga

SEQ ID NO: 34859 - DNA, 201 bp, Homo sapiens
gcttgtcaatcgttgagatacatttactgtgttgtaaggattgtgattttttaaaaagtttttaatttcttgaataagtatggcatgtagggctcttactrtctagccacataatctgtaaacatacagggtttcacacctcccagcctgcccacaccattccttctgcctggaatcctgctggtcttgtgggttggcaaa

SEQ ID NO: 34860 - DNA, 201 bp, Homo sapiens
cttcatgttgggaacactcgcaatcctctcttgtagctatttgaaagtataaattgctgccaacatggtcacactaaggtactgtgtaacactagaacttmttcctcccatctagctgtaattttgtatccattaagcaacttctccctagccccctacactctactcttcctagcctccagttaccactattctgctctc

SEQ ID NO: 34861 - DNA, 201 bp, Homo sapiens
gagctatgtttcaaaggaaaccaacatcctgtggggtctgtgagcagtgctgacaggtgacctgcccacctacctgcctggatgagcatgacggcccgccrctgccgctcctgctctcggtgccggtgtcgcctccagccaccctggatgcagcgggcacactgctccagcacccgggcacgcccacattccagaagctcc

SEQ ID NO: 34862 - DNA, 201 bp, Homo sapiens
  misc_feature (1)...(201): n = A,T,C or G, or insertion/deletion polymorphism (see Tables 1-2)
ctgcccctggggagctggaggcaagcccagaccactaatttcctctgaaagctgcctacacccatagccgtattggccaggaccagtcccaggggccagangcggattattgcctccaggagcctggtctgcagcggcgaggtgctcagggaacagggagcttgagagaagtgtttttcttccacaccatccagctcttta

SEQ ID NO: 34863 - DNA, 201 bp, Homo sapiens
aaaatgggcagaagacagagatgagaaaggccatggctgtggtttgggggtttgcggtgggccctgctggcaggagccttctctagcccatagctgctggwctccctccatgaatctggctgggactgtcagttcacctgaactcagcccaggcaggaggctttctttgtcctagatcatctcgctgctgctgggggttca

SEQ ID NO: 34864 - DNA, 201 bp, Homo sapiens
aattttgtaagattcggcagggtagggaggatggggacaggttcttggggtgcatgaatgagtcctgctttctcagcctgctggcggttttccttaatctytctcttgctttgatctctcacttcttccacattcctgggcacccacccacatcccttaccccagacacttgcttcctacctagatgctaccttggtaggg

SEQ ID NO: 34865 - DNA, 201 bp, Homo sapiens
ttttgcctacctgctgagcgctgattggtccccgtttaggaaacggaaaaaggggcgtgcacgcgggcgcggctgcgtgagaggcgcgcggcggcgcagtraacagtctccttccacaaaaccatggcgtcgctcaaatgtagcaccgtcgtctgcgtgatctgcttggagaagcccaaataccgctgtccagcctgccgc

SEQ ID NO: 34866 - DNA, 201 bp, Homo sapiens
gctgcaagcaaatttccttaaaaaacaaacaacaaaaaacattactttttctaaacctaaagtttgtggtggcattcaagtcccatcatagcccatctatmcagactcatctgcctgggatccccgtcttgggactagtggtcactggcctgcttcctggtcaattagcttccgggactagggggaggtgtgaggagccta

SEQ ID NO: 34867 - DNA, 201 bp, Homo sapiens
tgaagtggcacgaagttacaatatttacaaagataccaagaactggtatctgttactgcatttaatgcggaaatagtttgatatgctggtcttacctttcrttttatagaggtggggtctcgccatgttgcacaggctggtcttgaactcctgagctcaagcaatctgcccaccttgacctccccagttgctggtattaca

SEQ ID NO: 34868 - DNA, 201 bp, Homo sapiens
ggagtttgagaccagcctgggcaacatagcgaaaccccgtctctataaacaaacaaagccaggcgtggtggcctgtgccagtggtcccagctactcaggargcagaggtgggaagatcgcttgagcctgggaggaggaggttgcagtgagccaggatcgtaccactgcactccagcctgggagacagcaagactgtctcaa

SEQ ID NO: 34869 - DNA, 201 bp, Homo sapiens
taaaaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgt

SEQ ID NO: 34870 - DNA, 201 bp, Homo sapiens
agggacttcacatagaataagtcgaaggaaaaggggagagtggggctggtcagggaatccagaacaatagcttcattgggaaggaacagcttccttagccytgagcatcaggagtggggccatgtcatcatgggtgatattgaggcaacagcctgaaagcagtattcaggagaagaaaaatgggcagaagacagagatgag

SEQ ID NO: 34871 - DNA, 201 bp, Homo sapiens
aaaaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgtt

SEQ ID NO: 34872 - DNA, 201 bp, Homo sapiens
  misc_feature (1)...(201): n = A,T,C or G, or insertion/deletion polymorphism (see Tables 1-2)
aaaaattttacagactgtgaagtaccatgcaggtattattgttggttccctgctactggtgctgctgcatgccaaatggcatgcttagacatcattcagantatttcgtatagccgtcttcaccactggcaacttttatggctagaaagaaagaaaacatgccagcagcttaatgctactatttgctttgtgattgtgctg

SEQ ID NO: 34873 - DNA, 201 bp, Homo sapiens
aatgggcagaagacagagatgagaaaggccatggctgtggtttgggggtttgcggtgggccctgctggcaggagccttctctagcccatagctgctggtcwccctccatgaatctggctgggactgtcagttcacctgaactcagcccaggcaggaggctttctttgtcctagatcatctcgctgctgctgggggttcaga

SEQ ID NO: 34874 - DNA, 201 bp, Homo sapiens
aaaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgttt

SEQ ID NO: 34875 - DNA, 201 bp, Homo sapiens
aaatgggcagaagacagagatgagaaaggccatggctgtggtttgggggtttgcggtgggccctgctggcaggagccttctctagcccatagctgctggtstccctccatgaatctggctgggactgtcagttcacctgaactcagcccaggcaggaggctttctttgtcctagatcatctcgctgctgctgggggttcag

SEQ ID NO: 34876 - DNA, 201 bp, Homo sapiens
aaataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgttta

SEQ ID NO: 34877 - DNA, 201 bp, Homo sapiens
ggaagcacaaaggtgagccccgtccccgccagccctcgtaccactgcgcacggggcagcccccacgtccagcctccgtcttgggggcgtggacccttgggstgcgcttcctttcccgcctcgggtctccgcgggttctgcaggaaccttgcttcctctgacttggtccctggtgtctctgtgtgtcggacagttccctctg

SEQ ID NO: 34878 - DNA, 201 bp, Homo sapiens
aataaagactagtgcatacaagttctagctcactgacttaaaggactgtatgttatttcattatatagttggtacgaccattatttatataaagcctcctattggttgatttttctttttaatatttgtttttaattgacacataattgcatacaatttgagttacagtgtgatacttcgatacctgtatacaatgtttaa

SEQ ID NO: 34879 - DNA, 201 bp, Homo sapiens
gttagtatagtcacagactccggagaagaggatttttgtctgtacctgcttgaatacccctatcactatcacatgtgcgtgcacacatttttatcctgttsaagtagtggttaaaatctggtgcccaggcctcctttttagccatgagccattgactgttttgtattccttagatgatgatgactctatagctgattttct

SEQ ID NO: 34880 - DNA, 201 bp, Homo sapiens
cccccagaacaacttctagcccatctatattcttgttacactttgcagatagctctattatagcagctgtcacattgcattcaattatttgtatgtctttytcatcaaccccagggtgttttcattcttgtgtccctagtatctaacgcagcgtcgggtatagaatgtgaactcaataaatatttatgaatgggtgatccc

SEQ ID NO: 34881 - DNA, 201 bp, Homo sapiens
gaattgtgctttaaaataagtgatgagctgttgaaatagatttggattgttttgacaaacaggtgcaggttaaagattcgcttgaccagttggtaggaggrgtcccagtaacactgaatgcacaaacaattgatgtaaaccaagagacatctgacttggatccaagcaaaagtgtaacacgtgttgatgatggagtagctt

SEQ ID NO: 34882 - DNA, 201 bp, Homo sapiens
caaataaatggagacccaaatttaaaaattaaggtctactaaggaagagtgtcctttcttaaagactcttattcacttatttattatattttctaacctcytttttattttagctacaagcccagcagggaagaatcatcatctggatcctctcatgcggtgatggacatctccttgcctactggaatcagtgcaaatgaa

SEQ ID NO: 34883 - DNA, 201 bp, Homo sapiens
  misc_feature (1)...(201): n = A,T,C or G, or insertion/deletion polymorphism (see Tables 1-2)
actttggcacgagggagaaattttcagatgcatcttatcaaagtataaacattccagtaacacagaacatggttccttcatcccgacttctggtctattanatcgtcacaggagaacagacagcagaattagtgtctgattcagtctggttaaatattgaagaaaaatgtggcaaccagctccaggtaagccacaaattat

SEQ ID NO: 34884 - DNA, 201 bp, Homo sapiens
tgcatcctaaagcacaggttttgtttttgtttgtttattttttacttattgttgctgctgctgtttatttttagattttatccaagggcaaaattatccaytttggcacgagggagaaattttcagatgcatcttatcaaagtataaacattccagtaacacagaacatggttccttcatcccgacttctggtctattaca

SEQ ID NO: 34885 - DNA, 201 bp, Homo sapiens
tatctttttttaaaaaaaccagatgaaccttgtaaagaaattctcaggccaagaagaacgctgcaaaagaagatagaagaaataggtactgtaagattcawgtgattgtaaaaaggttatggtcatatcattcaaaaactggacaaaattaaatgttatataaattcccctaattgaaataaaatgaatgaaaagaaagat

SEQ ID NO: 34886 - DNA, 201 bp, Homo sapiens
tggcccaggggttggggacccctaccatacacaattcaaaattaaagcaatactaaacttaaaaacataaagcttctataaatactgaaattaaagtagcrttatatccctaaatttttctaattacaaaactctttataaattccatttagtacaacagttgaaaatgttaattctggaaacgggctgctcaggttcgat

SEQ ID NO: 34887 - DNA, 201 bp, Homo sapiens
ccagatgaaccttgtaaagaaattctcaggccaagaagaacgctgcaaaagaagatagaagaaataggtactgtaagattcatgtgattgtaaaaaggttrtggtcatatcattcaaaaactggacaaaattaaatgttatataaattcccctaattgaaataaaatgaatgaaaagaaagatatgtatggaggtctagct

SEQ ID NO: 34888 - DNA, 201 bp, Homo sapiens
tgaaccctccccaggagaggccggtacagaagagtttggcggacagcctgacccctggggacctgaccacagctgggctcttataaaataaatcaggctgrgcacggtggctcacacctgtaatcccagcactatgggaggccaagacgggcagatcacaaggtcaggagatcgagaccatcgtggctaacacggtgaaac

SEQ ID NO: 34889 - DNA, 201 bp, Homo sapiens
tgagaattgaaggagactttcaagataaatgaaattcaagaggccaacatggggaggaatgcattccaggtaggggaactggctacttgtgagttctttgrgaatcccaaaattactatctttgaagttttccaagtctttcacattttgtacttttccacaaagttaacagttgccaaataccaaataattttatatttt

SEQ ID NO: 34890 - DNA, 201 bp, Homo sapiens
aaatcagacacagtccatgccttaagaagtttctagtctagctagaaggacagatgtgggacaaaaaattgtgacagaaattcaagtgtaaaagaggtaargaggagacagaaagatatttaaaacaaagagcatccaggaatattttactggatactgtgagaattgaaggagactttcaagataaatgaaattcaagag

SEQ ID NO: 34891 - DNA, 201 bp, Homo sapiens
atcatcttgttctgttcatggaaaacatgtgggtggcaaacagggtaagaatgttgccatgaagtcacagagggagcttattctgtgaaacctgcccctcytggtggacacagacagggatgggaaattgaaggtcagctgcagccttggcaatgacttcaaaagtgagggcaagatagccttgtattaggcatccctaaa

SEQ ID NO: 34892 - DNA, 201 bp, Homo sapiens
gtctggacagtcaactagccataactattgtgggtagggggatcatatagcaacagaaaccaggtatcccttgagattccttctaagcctgagatgttatsactctgcgtcatcaagagcacttgcattattaccatttcagctgctaaatataaacattcagtagtgaagaaatgttgttacgatggagcctgcgttaat

SEQ ID NO: 34893 - DNA, 201 bp, Homo sapiens
tactaaaaatacaaaaaaaatagccgggcgtggtggcaggcacctgtagtcccagctactcgggaggctgaggcaggagaatggcgtgaacccgagaggcrgagcttgcagtgagctgagatcacgccactgcactccagcatgggcgactgagcaagactccgtctcaaaaaaaaataaagaaatcaaattcagcttttc

SEQ ID NO: 34894 - DNA, 201 bp, Homo sapiens
ctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgatatc

SEQ ID NO: 34895 - DNA, 201 bp, Homo sapiens
tctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgatat

SEQ ID NO: 34896 - DNA, 201 bp, Homo sapiens
ctctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgata

SEQ ID NO: 34897 - DNA, 201 bp, Homo sapiens
gttcataacctgaggttaatctgggggacactgtttggtaaactgttctttctcagaagtagaaatgctatctcagctaattgaaagctaatgattccttsagcattgtaaaactacattttcacagttcctgaacaacctgatagttcatgctgtacagaggcagggaaacaccatcgagagggttgttgaatattatag

SEQ ID NO: 34898 - DNA, 201 bp, Homo sapiens
actctcagaagagctctgagagaggaggctggtacatgtcaacccacttttcatagctctatcctccctccctatcaaatgatgaaagaaagcatggtttgtttctctattatctttccaggtgcttctcaatgatgacctcattgtcagtacaggatttggcagtggcttggctacagtacatgtaagtatttaattgat

SEQ ID NO: 34899 - DNA, 201 bp, Homo sapiens
  misc_feature (1)...(201): n = A,T,C or G, or insertion/deletion polymorphism (see Tables 1-2)
tgttccagtagagtggtctgttgagattattgatcaagtgaggaaagagaatagatgactcaaagatctcttgcaactctaaagtcagagattttaacccntacattgtagaaaagcaaataaatggagacccaaatttaaaaattaaggtctactaaggaagagtgtcctttcttaaagactcttattcacttatttatt

SEQ ID NO: 34900 - DNA, 201 bp, Homo sapiens
ttttataaatataaaaataccacacactacttacagaagaattgtggcacagtgaccataagccatttagaatcaagggcaaactgtagtttgaggataamgataaattggtatttctccaaagcacagagtgcttagaataggtaaggatatagaagaataaaagtttagttattgttgaagcccagggtagttgcctgt

SEQ ID NO: 34901 - DNA, 201 bp, Homo sapiens
ttaagatgcatcctgatctccagtattttttccatcgaagtctactgaattctcttaatagtaattcaggcaacagaataagttttatatggttaataacwtttctttctttgaatttatattgattttggaaaaaaaaaaaagctaaaaagctgcctgactcagcctaggcccactgcagtttgttaaatacatgaagac

SEQ ID NO: 34902 - DNA, 201 bp, Homo sapiens
agtcaaagggaacttttgagaagccacagaggtataagatttcagttctgtactcttccaattgatagaccagaggcagaggcaaaggtgatttagggggyttggtttttaaaaaaatatcttcagggtaaaaatataaataccaaataatttttaatatattcaagattgcaatccatgtttgagacactctccatttga

SEQ ID NO: 34903 - DNA, 201 bp, Homo sapiens
ctcagcactgaaccactagcttctgttccttttctcttatacttcccagttaatggaattcggtttattgtccagttccatttagtctttcctaaattgargaaagccttcttggccaaggaaaagatccagaactcaccaataatcaacagctggctccatgagggtctcagttagttttggttttttcaaaatcctcaa

SEQ ID NO: 34904 - DNA, 201 bp, Homo sapiens
  misc_feature (1)...(201): n = A,T,C or G, or insertion/deletion polymorphism (see Tables 1-2)
ttactttcacctagtctttttatcatataagaccagaggctcagcactgaaccactagcttctgttccttttctcttatacttcccagttaatggaattcngtttattgtccagttccatttagtctttcctaaattgaagaaagccttcttggccaaggaaaagatccagaactcaccaataatcaacagctggctccat

SEQ ID NO: 34905 - DNA, 201 bp, Homo sapiens
cactctccactcgggaggcccttttccatcctgctgacaaagtgtttgcatctgtgagcaagagtgctctgcttctacccatccaattagggagatgttcrgatgtcacattagagttccaagtgttttatattctgttctaaattgttaatttggtgaagaatagggttaaatttttatgagtcagagattttagaatac

SEQ ID NO: 34906 - DNA, 201 bp, Homo sapiens
aagtgatccgtccaccttgacctcccaatgtgctgggattatgggcgcgagccaccacgcccagctggcaggtgcaaatttttctaggctgtttaagtatkttcatgcattcttaaattgcatgttctgagcataaattaacatcctattaataattttaatcacgctcttatctttagtgcattcattccttcaaggact

SEQ ID NO: 34907 - DNA, 201 bp, Homo sapiens
ataaaggtgccttacataattataaaatgacagacaagaatttccttgggaggccagtagaggtaaatgaagaactttctgtagtattttacaattggctragaccattgaaatcatctgttccactctttattttataaatctatctcttcactacttaaacatatattgagtgtcagctatgtcctaaacagggatgcc

SEQ ID NO: 34908 - DNA, 201 bp, Homo sapiens
gacatcgatgtttcttacaagcataaaggtgccttacataattataaaatgacagacaagaatttccttgggaggccagtagaggtaaatgaagaactttstgtagtattttacaattggctgagaccattgaaatcatctgttccactctttattttataaatctatctcttcactacttaaacatatattgagtgtcag

SEQ ID NO: 34909 - DNA, 201 bp, Homo sapiens
  misc_feature (1)...(201): n = A,T,C or G, or insertion/deletion polymorphism (see Tables 1-2)
aaacacctcccattaggcctcacctcctaacactgccacattggggaccaagctttccaacacatgaactttgggggacacattcaaaccacagcaggcancaagaaaaatatattacctacttgcctcacaaatcttatattgcagtggggtaggccaacaataaactataaataaaagcattacaaattgagatgaatg

SEQ ID NO: 34910 - DNA, 201 bp, Homo sapiens
cagattatctgaattcttcaagttcagtttatttaaaaggagactatcctcaaaagtgttatatccgtggtttcctgctacctccaaccatgggccttttkggaatactttgttttttaatcttcctggggaaaacctggggacaggagcaaacgtaagtaaaacaagctatcttcatttttcaatgcatcttagttatga

SEQ ID NO: 34911 - DNA, 201 bp, Homo sapiens
taagtgtgttcaaagatttgctcattaatgattctgttctgacaggttccaaagcagctgaaaacagtttactcttatatttgtctgtttgttttcttgtyttatgtgccagcatcccactacagaggctacggaaactctgattacaaacgcatagtagcatgtgccaggtgagcctatttccacaaaggggagcataga

SEQ ID NO: 34912 - DNA, 201 bp, Homo sapiens
tttaactttcttttaaaattttaatagtctaattataagtcttttattttgaaatattctttggaagtagatacattataaataatctgcaaacagtcttmccctggaaactctgtataaatccaaattttctaaattacaggtaccattagcagacgaaaggagttcccatacaggatacccttagatttggtccccaaa

SEQ ID NO: 34913 - DNA, 201 bp, Homo sapiens
agagaattttagcaaaaaaatcatgagatggactctactatataaataaatattatttctgtagcattttggctcaacttaccaaaatgcctgaatgagargcaaggcacctgcattccaaactacagaacacttccttccttttcgaatgagatcagaatgttctacttgataattcccaattcgagcaattcatatact

SEQ ID NO: 34914 - DNA, 201 bp, Homo sapiens
catttgaaaaatatcatctgtgtatttcactggtttgtgataaccatgtaacaattagtaccttttagatctttagaggaatgatttatacatctcaatgkgctcaacattttgcctttctggacaggtatttcaattcttagagaagagtgatctgggctgtggggcaggtggtggcctcaacaatgccaatgtgttcca

SEQ ID NO: 34915 - DNA, 201 bp, Homo sapiens
caatagcatactcatctctcagccaaagttacctttatattgattggactgataaccataaggctttgctagtgggagaacatctgaatattattgttacycccaaaagcccatatattgacaaaataactcactataattacttggtaagtacataatgatggatttacatcttattcccccacctggaacattttcctt

SEQ ID NO: 34916 - DNA, 201 bp, Homo sapiens
  misc_feature (1)...(201): n = A,T,C or G, or insertion/deletion polymorphism (see Tables 1-2)
agtcatgtttctcagttttatagatgagaaagatgaggtccagaaagataaagtttattcatttattccttcaacaaatatttatgtacctgctaaatgcnatggacattgccttagtccattgtgtgttgctgtaacagaaaaaacgacacactggataatttacaatggacagaaatttattacctcatggttctgggt

SEQ ID NO: 34917 - DNA, 201 bp, Homo sapiens
acagagtagaggccaggtgcggtggctcacgcctgtaattgcagcactttgggaggccaaggcgggcggatcatgaggtcaggagttcaaaaccagcctgrtcaatatggtgaaaccccgtctctactaaaaatacaaaaattagccgtgcgtggtagtgcacgcctgtagtaccagctactcagaaggctgaggccggag

SEQ ID NO: 34918 - DNA, 201 bp, Homo sapiens
agtccgttgtttctatttattgccattgccttttttcaaagatgtaactaaagcatctttatatatacagatgtatagataagtggagaggcagcctggcygtataactgcactcatatgcctttctagcctgctaaaagaagagagacttccaaaagccaaaatcccaagagagacccaatgtaaaatgtgggccaatct

SEQ ID NO: 34919 - DNA, 201 bp, Homo sapiens
cgcaaaaagctagagcgaattgtatttgctttacctttagggaagtgctgtctagactctcactccttaaggataccagggatgagacacccaagagtacsaaagagaaagagagataggagtaagagcttataaaaaccaggtgcagtggctcacacctataatcccagcactttgggaggctgaggcgggtggatcacc

SEQ ID NO: 34920 - DNA, 201 bp, Homo sapiens
aatcaatattccactgtatttgaatatcaacattttaacttccagaaaacagttgcagtttgccctacctgattctctaaccacctgggaaattcaaggcrttggcatttcaaacactggtaagcaggtttaagtgatatatgcatttaaatagtgatttgattagcaagatgtaattctttgttagtatctatttagttt

SEQ ID NO: 34921 - DNA, 201 bp, Homo sapiens
gagtttggggcaagactgaaacatacacccaactccatgagttccttgaaagaaataatagacatagaagaaaatgtccagcacctaaataccctcaaacwtttcttgagaaatacaaagcagattttttaaagtacgaatatcattcatattagcaaaacccaaaattgatgatgatgaacattttttatattcgtcttt

SEQ ID NO: 34922 - DNA, 201 bp, Homo sapiens
ctaaacatatttttgtgccttgctgattgctgacaggacacaatcaatgccattgagggcctgacggaatattcactcctggttaaacaactccgcttgartatggacatcgatgtttcttacaagcataaaggtgccttacataattataaaatgacagacaagaatttccttgggaggccagtagaggtaaatgaagaa

SEQ ID NO: 34923 - DNA, 201 bp, Homo sapiens
tttcattctgacccattaattgaaaagcagaaactgaagaaaaaattaaaagaaggtaaaaaaaaaaagtatttcacataaaaattgggtgattctaaacyaatatttttattaaactaatatttaagttgtgaattatagaaaactttgtaagagaattttagcaaaaaaatcatgagatggactctactatataaataa

SEQ ID NO: 34924 - DNA, 201 bp, Homo sapiens
  misc_feature (1)...(201): n = A,T,C or G, or insertion/deletion polymorphism (see Tables 1-2)
agtctaattataagtcttttattttgaaatattctttggaagtagatacattataaataatctgcaaacagtcttcccctggaaactctgtataaatccanattttctaaattacaggtaccattagcagacgaaaggagttcccatacaggatacccttagatttggtccccaaaacagaaatcaaaaggattttgagtg

SEQ ID NO: 34925 - DNA, 201 bp, Homo sapiens
ctgtggagctaatgttcaatatatagttgattaagaaattacatgttagttattcttagctttcagttccaggaacaattttctgtctttgggcaagctgrcatgctatattttgctggtgaataagatttatataacctatttatttcacatcttataatgaccaggaagcttacagccaaatttaatgctttatttaat

SEQ ID NO: 34926 - DNA, 201 bp, Homo sapiens
aatacaaagcagattttttaaagtacgaatatcattcatattagcaaaacccaaaattgatgatgatgaacattttttatattcgtcttttttttttttttaaagaacattgtggatattgaacttttctctttaactacaagcctccatcttatttctgtttctttcccccaagggcattcactatcatgagtttatgca

SEQ ID NO: 34927 - DNA, 201 bp, Homo sapiens
ttcctgatttctgcagagctaaagagggaaaagataaaaattctgttcagcttatttcagatattttattaaatacttctaatatttattattttttttttgtggggtggggggacagggtctcactctgttgcccaggctggagtgcagtggcgccatgtcagctcactgcaacctccacctcctgatttcaagcgattc

SEQ ID NO: 34928 - DNA, 201 bp, Homo sapiens
gttgagtctcttcaagataatgaggagagatggggaagattggaaaaagaagaagggaaatggctgaaatgaaccatatttcccttctataacatttaacwgatcttcatccttcatatttaatttgaagacatgggtatttgtcttcaaatatttgatctataaatattttgtacatcaaagattgtataatcagttaaa

SEQ ID NO: 34929 - DNA, 201 bp, Homo sapiens
ttaggcagctttcctgatttctgcagagctaaagagggaaaagataaaaattctgttcagcttatttcagatattttattaaatacttctaatatttattwttttttttttgtggggtggggggacagggtctcactctgttgcccaggctggagtgcagtggcgccatgtcagctcactgcaacctccacctcctgattt

SEQ ID NO: 34930 - DNA, 201 bp, Homo sapiens
gaattgcttgaatccaggaggcggaggttgcagtgagctgagatcatgccgctgcactccagcctgggcgacatagcaagagtctgtctcaaaaaaaaaaatgtattttgatataattcttcacttgtatttcagttctgtgttaaaatgtctgctgtggagggaatctgcacttcggaaagcccagtcattgatcatcag

SEQ ID NO: 34931 - DNA, 201 bp, Homo sapiens
agaaaactttgtaagagaattttagcaaaaaaatcatgagatggactctactatataaataaatattatttctgtagcattttggctcaacttaccaaaaygcctgaatgagaggcaaggcacctgcattccaaactacagaacacttccttccttttcgaatgagatcagaatgttctacttgataattcccaattcgag

SEQ ID NO: 34932 - DNA, 201 bp, Homo sapiens
tttgtaattctttattgtggctagttgagaattatcaattagataatggatctttcaaggaaaattcacagtatcaaccaataaaattacaggtaaggaarccaaatgcacaaattagcaatagttttatttagtttgagttttattctcatctgattatgggaggatgaagaagaagaagaaaaaaatgtaattctgcaa

SEQ ID NO: 34933 - DNA, 201 bp, Homo sapiens
ttttttgtttcaggactgcttgtaggtgagatcttgtctgcagttctaagtcaggaaggcatcaatatcctaacccacctccccaaagggagtgcagaggyggagctgatgagcgttgtcccagtattctatgtttttcactacctggaaacaggaaatcattggaacatttttcattctgacccattaattgaaaagcag

SEQ ID NO: 34934 - DNA, 201 bp, Homo sapiens
tatcatcagtgtcatttcctctgggaaagcaaagaattaataccctttacactttaattcatctgagtatcatgaactgaggagtgttatttcagtagagraataaaaagtaaaatccatctatgtacatgcgtccacatgcttacttgtttctccaattttttcttcacacagacctcctccttgcctgctcattgtgaa

SEQ ID NO: 34935 - DNA, 201 bp, Homo sapiens
agcaggaagggaaagagtgggagataaggcttaaaacacagagtagaggccaggtgcggtggctcacgcctgtaattgcagcactttgggaggccaaggcrggcggatcatgaggtcaggagttcaaaaccagcctggtcaatatggtgaaaccccgtctctactaaaaatacaaaaattagccgtgcgtggtagtgcacg

SEQ ID NO: 34936 - DNA, 201 bp, Homo sapiens
tccttctttccaataacttgaaaataacttaaactccagaattgaaagatttcagaacaatgatagatattagagaccacctagtccaacctactcatcgrcagttgagaaagctgaggactaagtaaggtgaattcagtttcccagtgtcacaggctaataaattgtagagctgggtctaaaactgatagctgggactgg

SEQ ID NO: 34937 - DNA, 201 bp, Homo sapiens
gaggccaaaataacattcttgcctctctgcaagctcagtaacctgatcctctgcagcaattgaaagacaaagaaaactatgaaattatttatatggatagwttatgctactgataagtcaataagaaccaaaatctttataaagggtggttccagaatattcttttaggggcttctaaacactatgtatttttgcttgacg

SEQ ID NO: 34938 - DNA, 201 bp, Homo sapiens
tgctgcttatatccatgtaagtatttatacatagtttgccttttccaagaaaaataattttttagtttgaaaagtggtccagaaaagttgatccagggaaytcaggttatataaacttatgtttttaactgaatgttttctgcctttattttagccagaaggtgtcaaaagggaaagctattctggtgttactttggatcc

SEQ ID NO: 34939 - DNA, 201 bp, Homo sapiens
gatttccatgtgtgtcagtctcctcatctgtcgaatgggagtaataacagcaccaacctcatagaggtttttagaggttaaatgagttaatacatataaarcacttagaacaattatctggcttataaataacttctttttaagcatttgctctggtcaatatgcaaatagccataaaatcttattgctgcttatatccat

SEQ ID NO: 34940 - DNA, 201 bp, Homo sapiens
tcaggaggctgaggcaggagaattgcttgaatccaggaggcggaggttgcagtgagctgagatcatgccgctgcactccagcctgggcgacatagcaagastctgtctcaaaaaaaaaaatgtattttgatataattcttcacttgtatttcagttctgtgttaaaatgtctgctgtggagggaatctgcacttcggaaag

SEQ ID NO: 34941 - DNA, 201 bp, Homo sapiens
ccgtgcctctactaaaaatacaaaaattagctgggtgtggtggcgcatgcctgtaatcccagctactcaggaggctgaggcaggagaattgcttgaatccrggaggcggaggttgcagtgagctgagatcatgccgctgcactccagcctgggcgacatagcaagagtctgtctcaaaaaaaaaaatgtattttgatataa

SEQ ID NO: 34942 - DNA, 201 bp, Homo sapiens
taatcaaggtcaacttttttagagataaagtatttcgagtctgggcacggattacagcatcatgcctgtaattccagtactttgggaggctgaggtgggcrgatcacctgagatcaggagttcgagatcagcctggccaacatggagaaaccgtgcctctactaaaaatacaaaaattagctgggtgtggtggcgcatgcc

SEQ ID NO: 34943 - DNA, 201 bp, Homo sapiens
gggccaaatctagcctgccatctcttttgtatgtcctttgcaataacacaattatatataacttgacagcattttttttttttttgagacagagtctcgcyctgtcgcccaggctggagtgcaatgggaagatctcgggtcactgcaagctccgcctgccaggttcaagcgattctcctgcctcagcctcccaagtagctg

SEQ ID NO: 34944 - DNA, 201 bp, Homo sapiens
ttccatatatgtggatctatttatagattctctcctctgttttgtttacatcagtatcacactgatttaaagtaccatagatttgtggttatattgtatawctattaggcaagtactctctggtattcttatttttcaaacgtttttgatgttgttattcttacacatttactctgccagataaactttggaattagtttg

SEQ ID NO: 34945 - DNA, 201 bp, Homo sapiens
agaagggtaaagatcaaaaaatgacctattaggtactatgcttattacctgaatgatgaaagaatctgcacaccaaacctctgcgacacgccatttacctrtacaacagacctgcacatgtgccccgaacctaaaataaaatgtttttctaaagaactgttttttctatattttctatagtacttttatagttttttgtga

SEQ ID NO: 34946 - DNA, 201 bp, Homo sapiens
gttactcagctgggaagaggaaaattttgatttgagctgaggactctgactcctgttctaataacactttttaccaaagagagcctagttattccaaagcragaacctgattaaatcatgttgcctctgttctctttcatggccaaagattatatgcctagacccagttcggataagtgaattttattgtcaaaaaatggg

SEQ ID NO: 34947 - DNA, 201 bp, Homo sapiens
tagcaatattatatagaacataagcttaaaatatgtttatataaaagtaaaataacaaactatatctgtgtggaattgtgtgtgtatatatatatatatatggcagtgagaggtagatgttaaaggaaaaaaggtgtatctatttttgtttctcatattcaagggacttattcccagaagcgattgcctcattttctcctt

SEQ ID NO: 34948 - DNA, 201 bp, Homo sapiens
atagcaatattatatagaacataagcttaaaatatgtttatataaaagtaaaataacaaactatatctgtgtggaattgtgtgtgtatatatatatatatatggcagtgagaggtagatgttaaaggaaaaaaggtgtatctatttttgtttctcatattcaagggacttattcccagaagcgattgcctcattttctcct

SEQ ID NO: 34949 - DNA, 201 bp, Homo sapiens
ggtgggttccaagtctttgctagtgtgaatagtgctgcagtaaacatacgtgtgcatgtgtctttatagcagcatgatttataatcctttgggtatatacrcagtaatggaatcactgggtcaaattgtatttctagttctagatccttaaggaattgccacactgtcttccacaatggttgaactagtttacactcccac

SEQ ID NO: 34950 - DNA, 201 bp, Homo sapiens
gtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccattttttat

SEQ ID NO: 34951 - DNA, 201 bp, Homo sapiens
agtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccatttttta

SEQ ID NO: 34952 - DNA, 201 bp, Homo sapiens
tagtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccatttttt

SEQ ID NO: 34953 - DNA, 201 bp, Homo sapiens
ctagtccaacactattttctggctcctaaattcctaatatattcatttgaatatttaagatattcttattttgaaataaattatattaatagactaacaagtaacgtaaatagtttaatctttcatttcttatagtagtttactagcatttctgtgtgctctgctatcaaatttaactttcttctgcttgaagccattttt

SEQ ID NO: 34954 - DNA, 201 bp, Homo sapiens
ggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatggct

SEQ ID NO: 34955 - DNA, 201 bp, Homo sapiens
gggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatggc

SEQ ID NO: 34956 - DNA, 201 bp, Homo sapiens
aagccattgcactccagcttgggtgacagagtgagactccatctcaaacaaacaaacaaaaaacagagtagaatcaggtcatttcgccttaaagacaccayttcactccccttttaaaacattgcttctttttagggtaccttgcctgttgaagcccgagagaacagcttatatcttacagcctttactgtgattggaatt

SEQ ID NO: 34957 - DNA, 201 bp, Homo sapiens
gttttacagaaagcattacatcacagtatacatgtctttttgaaatttctcttttcaggtcaaaactgatgctccagatcttccagaagaaaatcaggccrgggaaggttaccgagcaatagcatactcatctctcagccaaagttacctttatattgattggactgataaccataaggctttgctagtgggagaacatct

SEQ ID NO: 34958 - DNA, 201 bp, Homo sapiens
gaacaatgatagatattagagaccacctagtccaacctactcatcggcagttgagaaagctgaggactaagtaaggtgaattcagtttcccagtgtcacasgctaataaattgtagagctgggtctaaaactgatagctgggactgggatggaagaatgatccagtgcccccagcttctctgtcttatctttgctaaatcc

SEQ ID NO: 34959 - DNA, 201 bp, Homo sapiens
agtatcatctctgaatgagaaagtcatggaagcattttgatttgatgagtagctaacaacatgacagcttttatggaattgttatttattaaaatttacgtaagtgattattcaaattcctcttcaaaaaagcacaaaagaaactccagataataaactttcttgacattttttgcttattttaacttggtgtttagtttt

SEQ ID NO: 34960 - DNA, 201 bp, Homo sapiens
atttccattaggtcagtcctcttttcacccccatattgcttgctccaggatagtgggatctgagggtagttcatatcaattgataggtggttgcttgacakagaaactgaagtatcttctcttgtttccagaaaatcgacacagctctaattaaagctgacaactttctgcttgaaaatacactgccagcccagagcacct

SEQ ID NO: 34961 - DNA, 201 bp, Homo sapiens
atagcccataatcccatcattcttgtctgtagtctttgtaaagttgcttgacaccacagctgtataaacactgaagtaatggagggttttttcccctttascatttgttattgtgaaatttagaaatttataaagcaaggaaaataatttgaaaggtatgttttacagaaagcattacatcacagtatacatgtctttttg

SEQ ID NO: 34962 - DNA, 201 bp, Homo sapiens
agggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatgg

SEQ ID NO: 34963 - DNA, 201 bp, Homo sapiens
gagggttaaagtgagccaagatcatgccactgcactccatgttgggcaacaggagcaaaactccaactaagatagaaagaagaaggaaggaaggaaggaaggaaagaaagagggaggggagggaggaaggaaggagggaagaaaagaaagaaagaaatttataatagagcagaatgaataagacaagtgcatctatacatg

SEQ ID NO: 34964 - DNA, 201 bp, Homo sapiens
aagccagccaaaagagaaactgtcttaactttcatagtaagtattttatttatttaaataatactttaattcatttttcaggacaagaatctcatttcatwaccctgtcctcacactacactaaatcattcaatgttccataaatggttattgaacatctgcaatgagtatagaatcatagatctatacctctgtaataca

SEQ ID NO: 34965 - DNA, 201 bp, Homo sapiens
gagaattgcttgaacatggcaggcagaggttgcagtgagatcgcgccactgcactccagcctgggcaacagagcaagactgtctcaaaaaaaaaaaaaaaagagaaaaaaaaagaagacgatgtaatatcctcatccattctaatcgtagagtaaaatgagagaagtttgctataaatattggcccatttctgcaagatag

SEQ ID NO: 34966 - DNA, 201 bp, Homo sapiens
tcacatggtgggtatactataatttattgaaccatgtttctattaaagacatttgggttgtttacaggttttcactattataactgattttgcaaagtctscatttatgcatacatatcttcctacatgtatatttctgtaggatagatgttttgtcttggagtgaactaactgggctaaagggcatggacattttacctt

SEQ ID NO: 34967 - DNA, 201 bp, Homo sapiens
ttacttctccaatcctcttctataaagcaaagatattgcactaccttatctcaagttttctgccagttctaattatccacaattctgccgtacagaaaaaygctgttatcaaaaattcattcatttgacttcattgtcaggaggcctaattccagattatcaatatacaaaagaaagcaaggagaaatgcaatcttgaata

SEQ ID NO: 34968 - DNA, 201 bp, Homo sapiens
ctcctccaagcacacggattctctttcctgctgtgcagcctgtggttggaggaggggtggtataggcaatacagggagatcttcccccctacccccacccyatcttcaatgcctctttccttatcattacggtaaaagtaggcactgtgatcactcacctgattttatggcttttatgaaggtgctgtcttgcgtggatag

SEQ ID NO: 34969 - DNA, 201 bp, Homo sapiens
gctgtaaagttgcctttacattatttcttttaaacccactagcttttctgcagacagaatgcttcatgaatttaagataatcataactcagatagagataycaaaggccatttctccatcaggttcctgtagtggttttcatgtctcaaaatcctgattcaagatgggcttgaggcttggaaactgagatactaagacagt

SEQ ID NO: 34970 - DNA, 201 bp, Homo sapiens
agaatatactcacaacaaacatctttttctttgtttgtgtgcttggattttgcaatgtttcaaaggcattcttctgaacttgaattctcatcatagaggtrcaatgtctaaaaacatgcaatatataagagagttactgaatatatttttcttgatgaggttttccttaatgatgtgatttcatctcgtgaatttttttct

SEQ ID NO: 34971 - DNA, 201 bp, Homo sapiens
aactgtcagatgctttaaaggatttaattgctgataaattaattccattgttactaaaaacttcctgcttttaccagactcttaaaatgtcacaatgttggcaaaagcctggaataattctgccaggtggggtggtgggtgccctccaagcttgttgggccacttgaattagtcgatcactatgcccttttgggttaaaac

SEQ ID NO: 34972 - DNA, 201 bp, Homo sapiens
acattttttcctgtagagttgtttgaactccttatatattcttgttattaatctcttgtcagatgggtagctgcaagtattttctcccattctgtaggttktctgcttactttattgattcctttgctgtacagaagctctttaacttgatgtgatcccatttgtccattttggctttggttgtctgtgtagtggggtatt

SEQ ID NO: 34973 - DNA, 201 bp, Homo sapiens
tcttttagttatttttaaatgtacaattaaattattattgactgtagtcaccctgttgtgctgtcaagtactaagtcttattcattctttctattttttgkacccataaaccatccccacatccccctcatcctcctactacccttcccagccttctactctatatctccataagttaaattgttttgatttttagcaccc

SEQ ID NO: 34974 - DNA, 201 bp, Homo sapiens
tttttttttttttttttcagtaggaatctggctctgtcacccaggctggagtgcagtggtgcaatcttggcttactgcaacctctgcctctgggttcaagygattctcctgcctcagcctcctgagtaactgggattaaaggcgcctgccaccacacctggttaatttttgtatttttagtagggacagggtttcaccata

SEQ ID NO: 34975 - DNA, 201 bp, Homo sapiens
cttaccttcctcactaatgcaaatgcagatgactcccaagaaaatggtaaaatgctcagcatgtttattactgaaaatcccattgatcatttgccccccaratctcatttttatccttcttcccaaatattctgtaccctgatcttagaatgccaagactacataactcacctgtataaaatgtttcactggccttcaaga

SEQ ID NO: 34976 - DNA, 201 bp, Homo sapiens
tttttttttttaatcttaaaccttcaatttagaatctaaaccctggctttaaatccccaaataagatgcactccacttattcatctatttttttttaatcrgtgaaacaaaaggggttttagtgacagtgtgatgactttgaacagtttttgggttcaaattttagctctctaatttactagttgtgtgattttgaattaa

SEQ ID NO: 34977 - DNA, 201 bp, Homo sapiens
tgataaagggaaactgtttatggactagataccaaatccatgtatgcagttctggtctctaaggacaatttaagggacctctgagggcattttggcttcaygtgattttttttttttaatcttaaaccttcaatttagaatctaaaccctggctttaaatccccaaataagatgcactccacttattcatctatttttttt

SEQ ID NO: 34978 - DNA, 201 bp, Homo sapiens
  misc_feature (1)...(201): n = A,T,C or G, or insertion/deletion polymorphism (see Tables 1-2)
tatgcctagacccagttcggataagtgaattttattgtcaaaaaatggggaagcaaaatcctctcctgagaattgaatcctatcttgcctgttccaattcngtagctgagcaacatccctattgcatcatttatattaaacagaggtggatcgatgaagcctgttggtgaaaccaagaaaaaaacttacagaaaatattaa

SEQ ID NO: 34979 - DNA, 201 bp, Homo sapiens
tagccttgtagtatagtttgaagtcaggtagcatgatgcctccagctttgttctttttgcttaggatgaaagacactttaaagtgcctcaagtgctttacrtaatttcaaattgttacattttatctgaatcctgttattgtaaccatgttagtaaaacagttttatgctattgtctgacagatatttttataataaagta

SEQ ID NO: 34980 - DNA, 201 bp, Homo sapiens
gccaaagttacctttatattgattggactgataaccataaggctttgctagtgggagaacatctgaatattattgttacccccaaaagcccatatattgayaaaataactcactataattacttggtaagtacataatgatggatttacatcttattcccccacctggaacattttcctttgcctctagagaggcattaga

SEQ ID NO: 34981 - DNA, 201 bp, Homo sapiens
actcctaaaaactgtcaacatgatgcttgccatttccttaggtggattttctgaagaggcagaaatacctggcatcaaatatgtcctctctccctacaaamtgaatttggttgctactcctcttttcctgaagcctgggattccatatcccatcaaggtagattgggtgagggggtagacgttgctacatatgatcatctt

SEQ ID NO: 34982 - DNA, 201 bp, Homo sapiens
aaatagactcctttctctcactatgtttttgcctccagtgtgtctcatttgcttccctctgtctctgtgttgtctttgtgcataactctgttcaatctctygtctctgtattgctctctgttcttttcatttttgcttctttccgtccctgaatctctttttttctgtcttttttgcttactcctctgcattcatttttct

SEQ ID NO: 34983 - DNA, 201 bp, Homo sapiens
acactgaagcatttgatgcaacaatctctattaaaagttatcctgataaaaaatttagttactcctcaggccatgttcatttatcctcagagaataaattycaaaactctgcaatcttaacagtatgtatttatcctttattttctttatatatatatacagaatattctcaataaaaatgtgtacaaagtttgaatattg

SEQ ID NO: 34984 - DNA, 201 bp, Homo sapiens
tctctctttcaccttcttttcctcctctaaatgctgacagtatagaattgaaacattcatgtggtttttagatttttatctatcattatatattttattayaaataatatattttattatgttgattaaatggaaatgtttattccctgcccttaatttagaaatccagagcaaaatttttttttgttctttgaaaatgtg

SEQ ID NO: 34985 - DNA, 201 bp, Homo sapiens
tcccatctgcagcagcagtgttgccataatacctttgtcactttcccactttaaatagaatcttcttgcttacttgtccccaatgtaggtaacaactgtakttcacaaaaccagtacctctgaggaagtttgcagcttttatttgaaaatcgatactcaggatattgaaggtaaaaacagcaggatttacgctgtaatttt

SEQ ID NO: 34986 - DNA, 201 bp, Homo sapiens
tgtcagatgctttaaaggatttaattgctgataaattaattccattgttactaaaaacttcctgcttttaccagactcttaaaatgtcacaatgttggcaraagcctggaataattctgccaggtggggtggtgggtgccctccaagcttgttgggccacttgaattagtcgatcactatgcccttttgggttaaaacact

SEQ ID NO: 34987 - DNA, 201 bp, Homo sapiens
  misc_feature (1)...(201): n = A,T,C or G, or insertion/deletion polymorphism (see Tables 1-2)
gggccacttgaattagtcgatcactatgcccttttgggttaaaacacttttttttcctatgtaatagcgtatgtagttctcgctattcaaattagatactnttgtgatatacacttagtaatccagtttatatttgtaagtttttaaataaaataatttttaaaaatcactcaaaagcatgtatagactcacttccattat

SEQ ID NO: 34988 - DNA, 201 bp, Homo sapiens
tggatttacatcttattcccccacctggaacattttcctttgcctctagagaggcattagaattatcctttatacttttattcccaaagcactttcaagaycatcatctaacttgaacatcagtttctcaaaaaacctttgaaatagggcatgattttcatgaccatttcacagatgaggaaactgagggacagagaagtt

SEQ ID NO: 34989 - DNA, 201 bp, Homo sapiens
ccctcatttcctgacacaccatcctcattggtttaggcaggcccctctcgttttattttttccttcatcccggaccccattcccattccccttcctccaartgtacccactcaaatgtgtttgctgtatacttttgaatagaaaggtaatgttgttttgtatgtatgtacctctttaatctatgtatatgtaacattgtgc

SEQ ID NO: 34990 - DNA, 201 bp, Homo sapiens
cttccattagcagtgcacgagggttctcgtctctccacaacctcaccaacacttgcctctctaaaatgtggcatttttaatgggtataaagcactatctcwttattgttttaatttggattcttctggttactaatgattttaagcatttcttcatatacttgtccatttgggtttcccatctgtcaattgcctattcata

SEQ ID NO: 34991 - DNA, 201 bp, Homo sapiens
  misc_feature (1)...(201): n = A,T,C or G, or insertion/deletion polymorphism (see Tables 1-2)
tagcaagatgagttagaatattatctttgccattgtgtggctcaggaaatggaggcttctaacctctcttttgattaactaattttatccagagttaatangtggtggtactggtatgtgaaccagtgtgtacctgactccagagcatgagctaataacacttctgctgtctgagggtagatattgctgccatgatatcat

SEQ ID NO: 34992 - DNA, 201 bp, Homo sapiens
  misc_feature (1)...(201): n = A,T,C or G, or insertion/deletion polymorphism (see Tables 1-2)
accctagaatcacaaaatgttagtactggaaaggatctttttgatcatgtgcaaccctgctgttggatataaaagaaagtggcatgtccaaggttgcacantgaattatagacagtcatgtcagcactccctgttcaggctctttgctttgcttcctggaagggattggtaaatatggtttataatgtctaaagctaacag

SEQ ID NO: 34993 - DNA, 201 bp, Homo sapiens
  misc_feature (1)...(201): n = A,T,C or G, or insertion/deletion polymorphism (see Tables 1-2)
agtatctttgtatcaaaaattattttgattatgttataaataataaaaagccaatgctgagggtcctccatgacttttgtcctttaaaaggactatgcatnttactcaagtttaagaaacactaatctaaaaaatttctagtcaaacataggaattctttaatgttcttagcagtaaatgctcatatctcttaacaaattc

SEQ ID NO: 34994 - DNA, 201 bp, Homo sapiens
ttggtggcaaattcttaaaaagccttaagatggagatatcattccttgaaaatagactcctttctctcactatgtttttgcctccagtgtgtctcatttgyttccctctgtctctgtgttgtctttgtgcataactctgttcaatctctcgtctctgtattgctctctgttcttttcatttttgcttctttccgtccctga

SEQ ID NO: 34995 - DNA, 201 bp, Homo sapiens
gtgtgtatatatatatatatatggcagtgagaggtagatgttaaaggaaaaaaggtgtatctatttttgtttctcatattcaagggacttattcccagaarcgattgcctcattttctcctttatccagtcctaaaccaatcaaagaaatacagaagttagatagcagaagaccttatcacacctactccttgactgactt

SEQ ID NO: 34996 - DNA, 201 bp, Homo sapiens
taacgtattgtttctttacatattttcaaattttggtatgtccagaagatacaaaattgttcaattgtttaaaaatgcagaacatatatattcttaaattkctacttaccataaaaaacagccttggttttgctcataatagttttctctgtctgttttgtcttctgattcaaacagtgtaatattaattttttctctttc

SEQ ID NO: 34997 - DNA, 201 bp, Homo sapiens
cattaaaatgtaaatacctcaaaggcatgaactaaattcagattactgttttatatccaggacttggcctaggatactgaaaataaatgtgttgaacgaawgcacactgcctctgaactcttataatgccttattggtacaattattacagtgcagtgtaatttatttacttaactatttcttccactagattgtaaactg

SEQ ID NO: 34998 - DNA, 201 bp, Homo sapiens
gtacattcttgaaaatactacatgttccatagtgcagaattaaacctattattttattactgctatcatttctccaacttcatcttgtgccacttgccccrtggcaaattatgtgctagccatggtctggcatgtccagtgctttcctacctccgtgcctttgcacatgtcatcccctctacttggaatgggcttcacctg

SEQ ID NO: 34999 - DNA, 201 bp, Homo sapiens
  misc_feature (1)...(201): n = A,T,C or G, or insertion/deletion polymorphism (see Tables 1-2)
gttcatgctcctaggagaatctaatgccaccactgatctgacaggaggcagagctcaggtggtaatgctcctttgccccactgctcacctcctgctgtgtngcctggttcctaacaagccatggactggtatttgtccatggcccaggggttggggacccctaccatacacaattcaaaattaaagcaatactaaacttaa

SEQ ID NO: 35000 - DNA, 201 bp, Homo sapiens
attatgctactgataagtcaataagaaccaaaatctttataaagggtggttccagaatattcttttaggggcttctaaacactatgtatttttgcttgacrgctaccatcacatagaccagcagtccccaaccattttggcactagggacaggttttgtggaagacaatgtttccatggaccaggattggggtggggatgg

SEQ ID NO: 35001 - DNA, 201 bp, Homo sapiens
ttcagaaaaaaatacataaataatttatactttggtggggaggaaggaaaattatttcagaattgtgctttaaaataagtgatgagctgttgaaatagatytggattgttttgacaaacaggtgcaggttaaagattcgcttgaccagttggtaggaggagtcccagtaacactgaatgcacaaacaattgatgtaaacca

SEQ ID NO: 35002 - DNA, 201 bp, Homo sapiens
atagaattaaatctttctataagctgagaatacacttctctttactaaattaaacataagtaaaccaggtgtggtggagcatgcctaaatagttccagctwcttgggaggctgaggtgggaggatggcttgaggccaatagttcaaggttgcagtgcgctatgattgtgcctgtgaatagccactgcactccaacctgggc

SEQ ID NO: 35003 - DNA, 201 bp, Homo sapiens
  misc_feature (1)...(201): n = A,T,C or G, or insertion/deletion polymorphism (see Tables 1-2)
caatgaaggaggctgccaaagttttagctgcttctgaaaagtcttgtctcatacaaatgatcttttcttttctttttcaaatgaacttttaggttcatctntctcctgatgcagatgcatattctccaggccaaactgtgtctcttaatatggcaactggaatggattcctgggtggcattagcagcagtggacagtgctg

SEQ ID NO: 35004 - DNA, 201 bp, Homo sapiens
gctccaggtaagccacaaattataagtcacaattgaattttcttttcaatgaaggaggctgccaaagttttagctgcttctgaaaagtcttgtctcatacmaatgatcttttcttttctttttcaaatgaacttttaggttcatctgtctcctgatgcagatgcatattctccaggccaaactgtgtctcttaatatggca

SEQ ID NO: 35005 - DNA, 201 bp, Homo sapiens
  misc_feature (1)...(201): n = A,T,C or G, or insertion/deletion polymorphism (see Tables 1-2)
tgtactcactgtttagttcccacttataagtgaaaatatgtgatatttggttttctgttactgtgttaattcacttaggatagtggctttatttctgggtnctgtaacctgttccattggtctacgtgtctttttttgtatcagtaacatgttgctttggttactgtagccttgtaatatagtttgaaatcaggtagtagg

SEQ ID NO: 35006 - DNA, 201 bp, Homo sapiens
  misc_feature (1)...(201): n = A,T,C or G, or insertion/deletion polymorphism (see Tables 1-2)
gtacagaggcagggaaacaccatcgagagggttgttgaatattataggggcaacatgatgtgagattttactttcacctagtctttttatcatataagacnagaggctcagcactgaaccactagcttctgttccttttctcttatacttcccagttaatggaattcggtttattgtccagttccatttagtctttcctaa

SEQ ID NO: 35007 - DNA, 201 bp, Homo sapiens
aactcaagctgcacattgaagtcagctggagagctcttagagctgtccaaatgtcccgggctccagaggtcattctaatggtagccagggttgagaaccamtgatgttaaaccctctcccaactaaataccgaggcctcaattggccactgtattagtttcctgttattgctaggtaacaatttattgcaaatgtaatggt

SEQ ID NO: 35008 - DNA, 201 bp, Homo sapiens
ttaaagactcttattcacttatttattatattttctaacctcttttttattttagctacaagcccagcagggaagaatcatcatctggatcctctcatgcrgtgatggacatctccttgcctactggaatcagtgcaaatgaagaagacttaaaagccgtatgtgttttcttttaaatcgtgttgtgaatgcttcattttc

SEQ ID NO: 35009 - DNA, 201 bp, Homo sapiens
atgctgtaatcaaaatataggcaaagtgcttctggattgacctctgattgttggagtgggaaggttctgcagagattgttgttggtgatgacgatgatgaygatgatgattatgataataaagtggatgttgtgttgatgttacagcttgtccaactataccagaaagtctagctgtttgctaggctttaaagtctgctct

SEQ ID NO: 35010 - DNA, 201 bp, Homo sapiens
ttccttataagttcttctccgaaataactcctcctttttctccttttaaaaagttgataaatggaattgctcaagtcacatttgattctgaaacagcagtsaaagaactgtcatactacagtttagaagatttaaacaacaagtacctttatattgctgtaacagtcatagagtctacaggtaagtgtgtgtgtgtgtgtg

SEQ ID NO: 35011 - DNA, 201 bp, Homo sapiens
aagagggaatcctccctaactcattttatgaggccagcatcattctgataccaaagccgggcagagacacaaccaaaaaagataattttagaccaatatcsttgatgaacattgatgcaaaaatcctcaataaaatactggcaaactgaatccagcaacacatcaaaaagcttatccaccatgatcaagtgggcttcatcc

SEQ ID NO: 35012 - DNA, 201 bp, Homo sapiens
gtgccattgagggggttggcaggccccaccccaggatggcttcctcactgtggctctatgtgttacagttccgggaccctgcgaccccgaagacttgatcratggaatcatttttgccgccaattaccttggctccactcagctgctctcagacaaaactccttccaaaaacgtgcgcatgatgcaggcccaggaagccgt

SEQ ID NO: 35013 - DNA, 201 bp, Homo sapiens
caatggtgtgatctcggctcaccgcaactgcctcccagattccagcatttctcctgcctcagcttcccatgtagccaggattacaggcatgcaggcatgcrcccggctacacgggagatgcctggcttttactagagacagggtttctccatgttcgtcaggctggtctcaaactcctcacctcaagtgatccacctgcct

SEQ ID NO: 35014 - DNA, 201 bp, Homo sapiens
  misc_feature (1)...(201): n = A,T,C or G, or insertion/deletion polymorphism (see Tables 1-2)
aggtttgctttctgtttaatggcatgcatatcctaagctgttgttttgtgaccttgaataataacttaataagttagaggaaaatatagtcaggaaacttnactttggttgttgtctaccctgaaagctgtcagatagcaattatgtgtaagatttggaagtcggcttgcactttactgtggcttttaaagtacttgctgt

SEQ ID NO: 35015 - DNA, 201 bp, Homo sapiens
acttctccaggctcaggtgatcctcccacctaagcctcccaggtagttgggactacagacacatgccaccatgtccaggatttttgtactttttgtagagrtggggtttcactgtgttgcccaggctggtctcaaattcctgggctccagtgatcagctcgcctcagcctcccaaagtgctgtgattacagaatgtatttt

SEQ ID NO: 35016 - DNA, 201 bp, Homo sapiens
cttcaaagaccaggaacattttccaacagcacttccctctgctaatggaagaacccatgaaacctagccagacctacctgctcctataaggaactagacasagacatgctcatatttaatcacctttggagattaagcccttggtgtaggattcatttctttgtttcactttctagagatgattttgctggaggagatgtg

SEQ ID NO: 35017 - DNA, 201 bp, Homo sapiens
gcaaacacactaaatgttgagtgaattaaattgagtcaagagaagctgagtggttcctagaaaagtcactggtgtcaatgcatggcttctgtagggagccmatgaagagtctgagaagacctggggatgttccaccaagttagtgtctattgtgtgtgtttaccagagtgcctgagctgtgttcaatttctatggacctgt

SEQ ID NO: 35018 - DNA, 201 bp, Homo sapiens
tttttttattatactttaagttttagggtacatgtgcacattgtgcaggttagttacatatgtatacatgtgccatgctggtgcgctgcacccactaactyggcatctagcattaggtatatctcccaatgctatccctcccccctccccccaccccacaacagtccccagagtgtgatattccccttcctgtgtccatgc

SEQ ID NO: 35019 - DNA, 201 bp, Homo sapiens
tgtttgtgggtcattaacagtgactccacccagaacagtttaatgatagcttttctttctcttccctttaatattatttttctttcctgtgttattcagasaaaaggtgctttttcttttttctatttttttattgtatttattttttatttttattttttattatactttaagttctagggtacatgtgcacaacatgca

SEQ ID NO: 35020 - DNA, 201 bp, Homo sapiens
gttggagcattcagtaatgattaatatttgcttcctgttgataattagatatttgaagagatttaatgtgtttgaaatctctttccaactgaagaattttrggtttataaggcaaagaaagttaatttgtttgtgggtcattaacagtgactccacccagaacagtttaatgatagcttttctttctcttccctttaatat

SEQ ID NO: 35021 - DNA, 201 bp, Homo sapiens
cattcgtttggatcacagaattgagaggcagtagatccagagaggcaaatggaaagaaaatacccaaaaacatctatttcctttaaaatatggattgttcwatacagcaaaatgataagtatgaacaagtgacttcatgtatctgattccaaatcactgaatgggtgtgaagtgagaaccccaagggtagttgaactaata

SEQ ID NO: 35022 - DNA, 201 bp, Homo sapiens
tcctcaaaaaaaaaccttcatctgcaaatgaagaaaccaactttatttctctctatctctctctatctctctctctctctttcacaaaaacatatagaatratatttgaccaagtatctgggcactgtggctctgccaatttaattcataaaattaaccactagattgccaaactgttttccaaagtggttcttccatttt

SEQ ID NO: 35023 - DNA, 201 bp, Homo sapiens
ttaatcaggtttatgtcccagggaagctgtgagagaaaatggttttgcagatatcgagtcctatatggaaatgtgaaacaagaatcacaagtttgttgtgrcagttacatttggaagtcaaagctcacttaacatttggggttggttactggcgatctgaattagggggctggcctttagtagcccttcctcaccctctct

SEQ ID NO: 35024 - DNA, 201 bp, Homo sapiens
cctcctgggttcaagcgattcccctgcatcagcctcctgagcagctgggagtacaggtgcacaccaccacacccagctaattttttgtattcttaaaaaakatttatgtactgggatggtctctataaatacctctccccaccccaaaacaagggactgcataggaaagaaaatagttaaatcataaaacctataacagtg

SEQ ID NO: 35025 - DNA, 201 bp, Homo sapiens
  misc_feature (1)...(201): n = A,T,C or G, or insertion/deletion polymorphism (see Tables 1-2)
aagaagctattgcctaaggctaggtttatggattctgtgatgaattttgggttattcattgttcttcattgccaggagttcacctctaggtgaagttgtgnaaaatcttgctttgaagatactgaaaatggatgaaataattttcttcctggatgaagataaggctttatttatctactagaacccatttaataagcacct

SEQ ID NO: 35026 - DNA, 201 bp, Homo sapiens
cagctactaagagacagaagctggacttgaagtaaggtcatctggtcctaaaccatggtgctgtttctgcagaatcgccatcaccatagtcagcggaaatygtttttggccacagcctatgctctccctgccttctttgcatttccttgaaggcagagagaggggagttaacaggagtcccaatttttatgggaggcacag

SEQ ID NO: 35027 - DNA, 201 bp, Homo sapiens
tgatgaaatgttttgactggtgtatcatggaggcactgaggaaagctgttcttatgagcacataggtctttgttgtataatatttaagctccttgtgtgcygctggaaacttctagagtttctctgggtgctgatcattttggaatggagatattagaggtttgcagttctcatcatcaaaaaccactaatggatcacaag

SEQ ID NO: 35028 - DNA, 201 bp, Homo sapiens
  misc_feature (1)...(201): n = A,T,C or G, or insertion/deletion polymorphism (see Tables 1-2)
aacaaattgggttgtaaattcatcttcccagcttgggtttgttaaaatcctccatgggggtagtgggggaataagttacttagagatgaatgtgagtgtgnatttgaactcaatgtgaattgattttcgtgcaggacatcttcattttatacataaataatgagccattagctgattactctccattcgctctgtggtacg

SEQ ID NO: 35029 - DNA, 201 bp, Homo sapiens
tggtacacaggttttgcactgatagagatttcatggaacctttcaacagccttgtttctccttgccttcaaactccatgatacagagtaattaggattttygttccagcaataaaaaagttcacccagacttcttttgtaataaaatcgtgtaatattggcagaaaaaatacagaaaacaaagagattggtcctgaaattc

SEQ ID NO: 35030 - DNA, 201 bp, Homo sapiens
ttctttctcttccagggtttcagtccttccccatcttttcctttttcttgcttacctcctgagcaccctattgccttttaccctttaatggcctccagtcygttaatttgtcagaaactgtttctgtgcaggtaaggagacatttcatttattagcttgcttaaagctatgaagaatatttcggaagagcttgcagcctct

SEQ ID NO: 35031 - DNA, 201 bp, Homo sapiens
  misc_feature (1)...(201): n = A,T,C or G, or insertion/deletion polymorphism (see Tables 1-2)
ctatcaacatctaggttgtagttccaactgtacatgaattcttagaacagagaagtagtactgattttatatgacatagtattgatcttagttatattttnttttcaaaaaaagtcagtgaatcacacaaaataaccttcaaatcacatgtgacttttgtagcatgttcagaaagggtcatctcaatcatgaagagaaaca

SEQ ID NO: 35032 - DNA, 201 bp, Homo sapiens
ggcagctgcatctggtaagggtctcatgctgcttccactcatagtggaaagtggaaagacagcgagtgtgtgcgaagagataacatggtgaaagaggaaasgagagaaaaaccaaggaagccagattctttttaacaatccactgtctaggaaactattccatccttgcaagagtgagaactcattcatcactgcaggagg

SEQ ID NO: 35033 - DNA, 201 bp, Homo sapiens
aaacgagcatgtcttgaagacctggtttgttgatgttggatagatatatttaggggagaaaacagactttttttccccttttttaaagttcttagctgagwcacttttctgaaaacaaaaatcagattaacaaaagaaaagcatgcaaaagtttattaacatgcactgtacctatcacatgggaaaggcctcggttcaaaa

SEQ ID NO: 35034 - DNA, 201 bp, Homo sapiens
  misc_feature (1)...(201): n = A,T,C or G, or insertion/deletion polymorphism (see Tables 1-2)
ttgtgaaagcctttcctaaaacacttttaatttctctgtttcaagcaccaccttagttttagaaaaatgagtagattattttacatctttactctgataantagttcagcacaggaagcagctgtgtaaactcaagatgagcttgatgtttaaggataaaaataaaaagcatttcagattagccttccaagaggaaaaagc

SEQ ID NO: 35035 - DNA, 201 bp, Homo sapiens
tctgcgcactgtgtcctagatagacatccgggttcagcccttacctttgtgaactcctgaccctgcatttgcatcctaccctcacaagcacatgtctcattgcttaaaattggatatccatccagtagcccagaaggcgtgagtctccagacagagatatatgtgacaataattttactttttctatcatatttcattgcc

SEQ ID NO: 35036 - DNA, 201 bp, Homo sapiens
atatgcagtttagaaaacactgctgtattgtattacatttatcagaagagtgtttattttcttatagtatgaaataatttcatgtcaaaagttgttttttygttttttgaattgttagcatatttggatatttggtggtatggacaaatgatgcagtaatcacagagagaaactttatttttgagtagacattttgtttcc

SEQ ID NO: 35037 - DNA, 201 bp, Homo sapiens
ttaaagtatatggaactcttggttctttgcttcatcatactttaggctgaatttttttgttgactaaggagagagctaagtggcttcattctagtaaaaartacttatttggggttgttagttgtaatgggcagccaggtcttcccttatatttcccacctctacagagttcttagaaaatgcagatatagctcatttttt

SEQ ID NO: 35038 - DNA, 201 bp, Homo sapiens
aaatttgattttccttggaatctgtctatgtgtgggcacaggccaagaacattataacctgtaagtgaacaagattgacagcatgggactgtggctttgargtcacattatctgtcttgcacaattgaggtcagaagccattacaggaatccagacattctgaaacagatatcctatttttctgatctataaatttgtttc

SEQ ID NO: 35039 - DNA, 201 bp, Homo sapiens
tgttgactaaggagagagctaagtggcttcattctagtaaaaaatacttatttggggttgttagttgtaatgggcagccaggtcttcccttatatttcccrcctctacagagttcttagaaaatgcagatatagctcattttttaggcaacaaggagaggatgatctggaagcagcattgggaattaaggaagacaccaac

SEQ ID NO: 35040 - DNA, 201 bp, Homo sapiens
  misc_feature (1)...(201): n = A,T,C or G, or insertion/deletion polymorphism (see Tables 1-2)
tacaagcaaattactctggcgtgaggaattcattatagagtggtaaaattaaatggttacatttcatttataacttataagtatcattttacaatgtgcanctatgcattggaaggaactgttgcctgtcattaaatattttctgtttcatgttccttttacatccattaaaatgcttatcagattggttgacgttatatc

SEQ ID NO: 35041 - DNA, 201 bp, Homo sapiens
tccattgttgctacctaatagttgcttagtggattttgttctttgggagttgtgaagctgaattgtcaggaagtgagccttcctgaatgtggctgcttttmatcatttagtgtagccctagcatagcagatttgaggcataaccaaaaatatgtttgaggattatgaccagcatagtctttgctgctttcctgatctatga

SEQ ID NO: 35042 - DNA, 201 bp, Homo sapiens
gccaggtattttctacttaatgtgaaaagaaacaaaggaatttggccccaaatgccaactgttgctgtgcagactcctgtgataggccctttaggaataaatttaaccaatacacagttcttgagcttgagaaacttgcagtaaaaacaagccaaaaagaatgttaggtaacaaaaatacaaggtaagctgagggctctga

SEQ ID NO: 35043 - DNA, 201 bp, Homo sapiens
taaattagcttgttgcccaggctggtctcaaactcttgggcttaagcaatcctcccaccttggcctcccaaagtgctggggttacaagcaggagccactgygcccagccaaattgtattcttcttcttcttctttatttatttattttttttgagatggtcttgctctgtcgcgaggctggagtgcagtggtgcgatctca

SEQ ID NO: 35044 - DNA, 201 bp, Homo sapiens
gatcccttgaacctgggaggcagaggttgcagtgagccgagatcacaccactgtactccagccttagcgagagagtgagaccctgtctcaaaaaaaaaaaagaaagaaaataaaatacgtatgtttcaattgcagattaaaatgcctttttaagtagactgttatacagttatatattaatcacagacacgttttaatttc

SEQ ID NO: 35045 - DNA, 201 bp, Homo sapiens
  misc_feature (1)...(201): n = A,T,C or G, or insertion/deletion polymorphism (see Tables 1-2)
gggcaatacttttgtagtattatgttggatggaatgacatgggaaaaggctggcaggagggagaccagatagactctattgtcaaagtaggggaaagatgnaaagaggcagtgggaggcaagaagggaacacacctaagaggtggtgtgcgggaattatctgaggagcttgaacagtcactggaaagtgaggaagggaaaa

SEQ ID NO: 35046 - DNA, 201 bp, Homo sapiens
acaacagacactggggtctgtgagggtggaggatgggaggaggaagagtaactattgggtactaggcataacatctgggtgacgaaataatctgtacaacragcccccgtgacatgaatttacctgcataacaaacctgcacatgtacccctgaacctaaaataaaagttatacatataatgtgtatatatatatatatat

SEQ ID NO: 35047 - DNA, 201 bp, Homo sapiens
ctccaggagattctgctctgcaccagcgtttgggaaccactgccttagagaaaggtggacccgccagtgtgtgaagcatctttcctcccactgtgccctgyagcattctagtcaggctaagtgcttgtcattaatagagttccactggcaaataagctcaagaaaatagacctccttttcggacatttgctacaggtgtct

SEQ ID NO: 35048 - DNA, 201 bp, Homo sapiens
cccctcccccagcctcgctgccgccttgcagtttgatctcagactactgtgctagcaatcagtgagactccgtgggcgtaggaccctcagagccaggtgcrggatataatctcgtggtgcgccgcggtccgaaaagcgcaatattcgggtgggagtgacccgattttccaggtgcgtccgtgacccctttctttgactcag

SEQ ID NO: 35049 - DNA, 201 bp, Homo sapiens
ggaagggcatgcttgggggaggaacagtgtagcacaggcctggcagtggaaggtgtatgcctacacaggaaacaaaaaaatggtgtgctttggctgaagcrctaggaatgccaagagatgtaatgagggataaagcaagaaagagaggtttgttcaaggtggtggagcaacttgtacgccaagctaaggagtgtggatttt

SEQ ID NO: 35050 - DNA, 201 bp, Homo sapiens
gtctttttgtttgtctgtgccctgcccccagaggtggagcctacagaggcaggcaggcctccttgagctgtggtgggctccacccagttcgagcttcccagctgctttgtttacctaagcaagcctgggcaatggcaggcgcccctcccccagcctcgctgccgccttgcagtttgatctcagactactgtgctagcaatc

SEQ ID NO: 35051 - DNA, 201 bp, Homo sapiens
ggttcttttagaatgaactctggaggtgtatacgtatagagagatgcggtggggcggggggcggtcttttaaaaagaagaaaaatatcacacggagaaatrtttggtgcccacttggtcagcatcacacagccagggcgttttcctcaggaaacaggatactttatttctactgctggtgacatccactctcccagctgtc

SEQ ID NO: 35052 - DNA, 201 bp, Homo sapiens
gactgtgtcgtggtgcctctgtgtgagctaaccttactccttctgcatctgggtcagggtagtgtggtcaaactttctcttggtgcattttttcttctcargctcctgaaggcgaatctcagccaatgactgaagtggatctcttcatttctacccagagaatcaaagtgctgaacgccgacacacaggtatcagctggct

SEQ ID NO: 35053 - DNA, 201 bp, Homo sapiens
  misc_feature (1)...(201): n = A,T,C or G, or insertion/deletion polymorphism (see Tables 1-2)
aaagagcagtggaggttagaattgtgtttttaaaacaccgctctagagattttctggtttggctttttctgcccatcagaatttcacagagaagccttccngtgtggtgggcaggaggatgggctctggattcagcccccagccccttctcaggaagtgtgcagtttaacccctcaacctccatatcctgttctacccagt

SEQ ID NO: 35054 - DNA, 201 bp, Homo sapiens
ctgtctttttgtttgtctgtgccctgcccccagaggtggagcctacagaggcaggcaggcctccttgagctgtggtgggctccacccagttcgagcttcccagctgctttgtttacctaagcaagcctgggcaatggcaggcgcccctcccccagcctcgctgccgccttgcagtttgatctcagactactgtgctagcaa

SEQ ID NO: 35055 - DNA, 201 bp, Homo sapiens
catttctttttattctttttttctctaaacttcccttctcgcttcatttcattcatttcatcttccatcgctgataccctttcttccagttgatcgcatcrgctcctgaggcttctgcattcttcacgtagttctcaagccttggttttcagctccatcagctcctttaagcacttctctgtattggttattctagttata

SEQ ID NO: 35056 - DNA, 201 bp, Homo sapiens
gaatggataactagaataaccaatgcagagaagtccttaaaggacctgatggagctgaaaaccacactacaagaatgtgacaaatgcacaagcctcagtarccgatgtgatcaactggaagaaagggtatcagcaatggaagatgaaatgaatgaaatgaagcataaagaggattttagagaaaaaagaataaaaagatag

SEQ ID NO: 35057 - DNA, 201 bp, Homo sapiens
aaactgtttctgtgcaggtaaggagacatttcatttattagcttgcttaaagctatgaagaatatttcggaagagcttgcagcctctgccaacccacttayattagtttcctattgttgctgtaacaaattaccacaaacgtagtgacataaaacaacaaaaacctattatcttaaggttctgtagatgggaagctgacac

SEQ ID NO: 35058 - DNA, 201 bp, Homo sapiens
cgtcggcagggctctgtcctttctggaggatctaagggatgatccattttcttactcattcaggttggcaaaatgtaggtccctgaggttgtaggactgawgtttccatttccatgcagctgtgggctgagggtcattcccagctgcttgcattgcttggtttatgttcctttctcccgtcttccaagtcagcagcaggag

SEQ ID NO: 35059 - DNA, 201 bp, Homo sapiens
acttacttaagctagttctagttaaggaggaattggtcacacctatagaaagacctctcagaaaagaggatggccagaccctaggaatggatctgtgaccrtggaagccattagggggcagcgccctcttggttatcttactccctccagttttcttggtcttccctaattaaatcatggcagctcaggcagagtccctga

SEQ ID NO: 35060 - DNA, 201 bp, Homo sapiens
ccagcactgaagtagactgacctccgcatcagaataactcgctctgctactgttgtgaatgctctgatcagaaggatttcagatttccacagtttcatggrttagcctgaaaggcaaaatgctgatttttatgctgatgaaataaaatgtaggccaaaaaatacaaatgataccccccaaatacaaatgacaacctcattt

SEQ ID NO: 35061 - DNA, 201 bp, Homo sapiens
  misc_feature (1)...(201): n = A,T,C or G, or insertion/deletion polymorphism (see Tables 1-2)
tttctttgaagaggtgacttccacctgtatcttccatgatgtttacaagcatatatactgaaggtcattcatttgtaagttaattggcaaaaatatcttgntttcaaatactctttctttttgcattcaaagtcatttcacatctgagccaaaatgagaagattcaggacattataaaatcatcatcatgaatgcgtgatg

SEQ ID NO: 35062 - DNA, 201 bp, Homo sapiens
tagtaaaaaatacttatttggggttgttagttgtaatgggcagccaggtcttcccttatatttcccacctctacagagttcttagaaaatgcagatatagytcattttttaggcaacaaggagaggatgatctggaagcagcattgggaattaaggaagacaccaactgttcctcctagtccaggaaaacaagggctgtgt

SEQ ID NO: 35063 - DNA, 201 bp, Homo sapiens
caaattgtagcagaataggctcaggctctgacatcaacgtgtttagaatccagagggagagacagattgaacatgtgataaataataagaacaaaaaaatscaacgctttatgactatctgcaagcatcttccgtgagttagcaggtgtctccctgcctgatgtgatcctgtgttcttgtttatattggctagaattttcg

SEQ ID NO: 35064 - DNA, 201 bp, Homo sapiens
tcactgcttaggatataagtcttatgaacagggagagagtccacttttcataccgtgagtacagatcagaaacagtcaaggggatctggacactgggcccygtatgttagaccagagctccagaaatcccaccagcagcaggtcaggactgaattgtggggacctgggtggcctgagcctacagctggagtcagatggtac

SEQ ID NO: 35065 - DNA, 201 bp, Homo sapiens
gcaacgctttatgactatctgcaagcatcttccgtgagttagcaggtgtctccctgcctgatgtgatcctgtgttcttgtttatattggctagaattttcrgtttcaagtagtagagactaactcaagctagcttaaagaggaaagaaaatggggacaagatataaagaattgggaagtgtcttacaggttccaagaacca

SEQ ID NO: 35066 - DNA, 201 bp, Homo sapiens
gatgccaaaggagcaagcaggacaaatcagtggtatttcccccattttgacagagtcagaagcaggtaccaggctagaagaaactggggaggtggaatggsaagtaatattgagccagaggaaagagtagcagacaacttgcctaaaatctgcaagaatacccagtttgcacattcctttgtctgtggtttggtttgatag

SEQ ID NO: 35067 - DNA, 201 bp, Homo sapiens
agaaaatggggacaagatataaagaattgggaagtgtcttacaggttccaagaaccagaggtgcagcctggccatatgagggactggaaagccagcaagartctaggcagctcttgttttttgtgtgttttgattttggttttggctttttgtcccagtctcccacatctgtcctttctttctccattttaatttttcttt

SEQ ID NO: 35068 - DNA, 201 bp, Homo sapiens
acaaaatgtctcagagggaagccaggcccttgtccttatcctcaaattaccctcaaagagactaaaactcagctcagcagctgaggtgacttgaccggggycacatagctgggaggtaactgaggtgggatttgaattcagatctgctcttcctcagtgcaatagtccttcccccatgccccgcttattccctagggcatt

SEQ ID NO: 35069 - DNA, 201 bp, Homo sapiens
acctgcacatgtacccctgaacctaaaataaaagttatacatataatgtgtatatatatatatatatatatgtgtgtgtgtgtgtgtatgtgtgtgtgtgtatatatatataatttaagatagtcacaagaacaatagaaacagaatgatgtctaactttcatatcagttaattggaaaacaagaataagaagttattgaa

SEQ ID NO: 35070 - DNA, 201 bp, Homo sapiens
aattagttatatgttttagtcatcatatgtcttcaatatcaatagtaaggctattcttttgtgggaggagtccctattatgcaaaataatgaaggaccctrtgtataaggttaggtatggactaaaagtctgtatgagtagtgaggattggctgggatgttcaacagaaagctctgcacatgaattttattttattagttc

SEQ ID NO: 35071 - DNA, 201 bp, Homo sapiens
aacctgcacatgtacccctgaacctaaaataaaagttatacatataatgtgtatatatatatatatatatatgtgtgtgtgtgtgtgtatgtgtgtgtgtgtatatatatataatttaagatagtcacaagaacaatagaaacagaatgatgtctaactttcatatcagttaattggaaaacaagaataagaagttattga

SEQ ID NO: 35072 - DNA, 201 bp, Homo sapiens
  misc_feature (1)...(201): n = A,T,C or G, or insertion/deletion polymorphism (see Tables 1-2)
gtctgtatgagtagtgaggattggctgggatgttcaacagaaagctctgcacatgaattttattttattagttcccttattttcttatattatcatgaacntgtctaaagacatcttactgcatgggagtatgttatatgcatgtataataaattggtagaaagccattctgaatgatagataatatttaaattgactttg

SEQ ID NO: 35073 - DNA, 201 bp, Homo sapiens
ccccgtgacatgaatttacctgcataacaaacctgcacatgtacccctgaacctaaaataaaagttatacatataatgtgtatatatatatatatatatatgtgtgtgtgtgtgtgtatgtgtgtgtgtgtatatatatataatttaagatagtcacaagaacaatagaaacagaatgatgtctaactttcatatcagtta

SEQ ID NO: 35074 - DNA, 201 bp, Homo sapiens
cccccgtgacatgaatttacctgcataacaaacctgcacatgtacccctgaacctaaaataaaagttatacatataatgtgtatatatatatatatatatatgtgtgtgtgtgtgtgtatgtgtgtgtgtgtatatatatataatttaagatagtcacaagaacaatagaaacagaatgatgtctaactttcatatcagtt

SEQ ID NO: 35075 - DNA, 201 bp, Homo sapiens
caaaaacaaaaacaaaacaaaaccagtaaataacaagtcctggcaaggatgtggagaaattggaacccctgtatactattggtgggaatgtgaaatggttyggccgatatagaaaacagaatgggggggggggtccctaaaacaattaaaaatagaactgccttatgatccagcaatctcagtcaaactcaccaaaagaat

SEQ ID NO: 35076 - DNA, 201 bp, Homo sapiens
  misc_feature (1)...(201): n = A,T,C or G, or insertion/deletion polymorphism (see Tables 1-2)
acagattcctgggtcccacccctaggttttctgattcagtggggcttgggtagagcccagaatctgcacttctaaaaagtggccaggggctgctgctgctnctgtgtggggtttaagagccattggtgtacacctgctggccaagcatagtaaagctggataaccagaggcaaaatagcccctacctctccctcaatctaa

SEQ ID NO: 35077 - DNA, 201 bp, Homo sapiens
acactggggtctgtgagggtggaggatgggaggaggaagagtaactattgggtactaggcataacatctgggtgacgaaataatctgtacaacaagccccygtgacatgaatttacctgcataacaaacctgcacatgtacccctgaacctaaaataaaagttatacatataatgtgtatatatatatatatatatatgtg

SEQ ID NO: 35078 - DNA, 201 bp, Homo sapiens
  misc_feature (1)...(201): n = A,T,C or G, or insertion/deletion polymorphism (see Tables 1-2)
tgattcagtggggcttgggtagagcccagaatctgcacttctaaaaagtggccaggggctgctgctgctgctgtgtggggtttaagagccattggtgtacncctgctggccaagcatagtaaagctggataaccagaggcaaaatagcccctacctctccctcaatctaaagcatatcctgtaactcagatacaaaagggg

SEQ ID NO: 35079 - DNA, 201 bp, Homo sapiens
  misc_feature (1)...(201): n = A,T,C or G, or insertion/deletion polymorphism (see Tables 1-2)
ggtataggtcatttctgccactccaagaagcactcttgctacagattctgtttgcagtgaagttgtctaacaccagtttcacgcctctgccaggcagggtncctgagcagggatccatagttccagtcctgaccccacagagcccttggacaaagcaatctgtgtctatgtcttcatctttaaaatgtgaaatgtaagtcc

SEQ ID NO: 35080 - DNA, 201 bp, Homo sapiens
acaaaccagagcacctctcctcctgcaaaggaacacagctccttaccagcaacggaacaaagctggatggagaatgactttgacgagttgagagaagaagrcttcagaagatcaaactactctgagctaaaggaggaagttcaaaccaatggcaaagaagtgaaaaactttgaaaaaaaattagacgaatggataactaga

SEQ ID NO: 35081 - DNA, 201 bp, Homo sapiens
  misc_feature (1)...(201): n = A,T,C or G, or insertion/deletion polymorphism (see Tables 1-2)
cttcctctggcctcatgacatggggatgtggaagtgagcatgttgctttgaggcacatggcagggaaataggataaccgttacacattctgggcttgctantgtacctggttttgaaggggccttccatcctgtgatactacttctctccttagcacctgttccataagggtcttgtactccctgactgtgcagtttctat

SEQ ID NO: 35082 - DNA, 201 bp, Homo sapiens
ggcgcaaactggacccactcacttgtgaactgagcaggtgctgtctctgagcgatactgtgggcttggatagaacagagcttgccttttccctgagtcccwcctcattccctggtagctgttctctcctgcaggaaaagttacccacctctcctcccacccaccccacagttccctttggagtagtgggcctggggctgaa

SEQ ID NO: 35083 - DNA, 201 bp, Homo sapiens
aaccagaaactctacaaaccagagcacctctcctcctgcaaaggaacacagctccttaccagcaacggaacaaagctggatggagaatgactttgacgagytgagagaagaaggcttcagaagatcaaactactctgagctaaaggaggaagttcaaaccaatggcaaagaagtgaaaaactttgaaaaaaaattagacga

SEQ ID NO: 35084 - DNA, 201 bp, Homo sapiens
agaccaaaggagggattaagacatggatctacatgccatatggatccactcatttcctacaatgatctgaaaatttggctttgagtttcctgccagcgaargcacagagtaacaagagcacttaagacaatgattcatgctatccagaagaaataggaatatgtgtttttcatgggggtgggggagggagggaaatttcca

SEQ ID NO: 35085 - DNA, 201 bp, Homo sapiens
atcctcctgcataccatgacttgaaaggggtgggaaggcacctgctatcagccattccttctcctccatgtggcaatgaggagtttgttgaggcacagcasgcaccctggggagactggaagtggacatttgtttcagggctgagttccttttgcctggcaccctcctctagggtgaagctgacaagtcagtggtcaggcc

SEQ ID NO: 35086 - DNA, 201 bp, Homo sapiens
cttttggtatgtgaagatgctagaagttggccatctgcaactcagaaggggctcttgccagaacctgacagtgctggtacgctgagcgcagacttccagcstccagaactgtgagggataaatgcctgttgtttataagccacctagtctgtggtactttgtcatggcagactaagaacagactcagacaaggggaggact

SEQ ID NO: 35087 - DNA, 201 bp, Homo sapiens
  misc_feature (1)...(201): n = A,T,C or G, or insertion/deletion polymorphism (see Tables 1-2)
tgctgtgagttagatgtcctttgttagaagaggagtcattgctagagtttgcctttcagaagaaaagtccatttcccactcatgttgctcctggctggggnaaatagtgtgcctccttcatctttgaagccaaaaaggacatctgatacttcctcatagttgcacaagtactttgatcagatcccttgaacccagcccact

SEQ ID NO: 35088 - DNA, 201 bp, Homo sapiens
cccagcaagctctcttttggtatgtgaagatgctagaagttggccatctgcaactcagaaggggctcttgccagaacctgacagtgctggtacgctgagckcagacttccagcctccagaactgtgagggataaatgcctgttgtttataagccacctagtctgtggtactttgtcatggcagactaagaacagactcaga

SEQ ID NO: 35089 - DNA, 201 bp, Homo sapiens
gagaaactgcctgagcggcataggagttcagatgcaagagagagaaatcgatgagagagggaagctggttagggatggtttgtggggagttggtctgagtytagaagggttggggaggaggagcggggatagggggttaagtaaagtattgagtaatatttgtgttccctccaaatacatattgaaaccctaatcccaatg

SEQ ID NO: 35090 - DNA, 201 bp, Homo sapiens
  misc_feature (1)...(201): n = A,T,C or G, or insertion/deletion polymorphism (see Tables 1-2)
tgaaatgtgagcaaatgcttttgaagtgtttttaaaatatcccttaatggtaccttacatatgcaggtactgtttgcaaactcttttcatagatattgagnaaggaaagtttaaattcagcctaaaaataataataacaaaaaagagtagtagaaggtagtattactacgcagtttcttgatacgagcactccacacttta

SEQ ID NO: 35091 - DNA, 201 bp, Homo sapiens
  misc_feature (1)...(201): n = A,T,C or G, or insertion/deletion polymorphism (see Tables 1-2)
agtgtttttaaaatatcccttaatggtaccttacatatgcaggtactgtttgcaaactcttttcatagatattgaggaaggaaagtttaaattcagcctanaaataataataacaaaaaagagtagtagaaggtagtattactacgcagtttcttgatacgagcactccacactttataaacataattttattcttgcaac

SEQ ID NO: 35092 - DNA, 201 bp, Homo sapiens
agatcagatagttgtagacatgcggcgttatttctgagggctctgttctgttccattgatctatatctctgttttggtaccagtaccatgctgttgtggtkactgtagccttgtagtatagtttgaagtcaggtattgtgatgcctccagctttgttcttttggcttaggattgccttggcaatgcgggctcttttttggt

SEQ ID NO: 35093 - DNA, 201 bp, Homo sapiens
ggccacggcccctcccaggcctgccagtctgttttaaatccattgagtgctgttcttagaaactaaggaaccctaactaattggacaataaaggaagattytggtcttgagaggatggcacagtaaatggagtttgcagcgattttgattgcactcttactctgcagctggctggctggggcctgcagaagcctcttaacc

SEQ ID NO: 35094 - DNA, 201 bp, Homo sapiens
ctgttttaacacatgataatttgacatccatggtgaagtattaaggaggcacagttatgtctaaaggagctcaggggaacagtttgagctgtcattgtaartttcagaattgccattgtatagacggtagataaaccatgagccttcatgtgatcacctgggaggacagtgtagatacttaacagttgagtccaaagactg

SEQ ID NO: 35095 - DNA, 201 bp, Homo sapiens
  misc_feature (1)...(201): n = A,T,C or G, or insertion/deletion polymorphism (see Tables 1-2)
tttgctaagtggcatcactaaataaaacttttaagtttctctatggaaagagaaactataaagccagtcaaaagacagatgatacactgggggaaaacatntgcaacaatgtgacagacaaaaagttaatacccttaatgttaaaaagcctcctggcaagtgtttaaaaaaaaaacaactcagtagaaaaccaggcagttc

SEQ ID NO: 35096 - DNA, 201 bp, Homo sapiens
aggagagttttaggagagcagatcagacaggaagccaggagccaaatcatgcaaagcttgactggccatgaaaaggactttgaatttcattctgagatgcraaatcattgagcagaaaagtgacatgatcagatttatatttgtaagagtcactatcagagcattttcatcatcttttattcaaacagcatttaccaagca

SEQ ID NO: 35097 - DNA, 201 bp, Homo sapiens
aaggctctgaggagagaatgagcttggagtgcttgagaaaggagagttttaggagagcagatcagacaggaagccaggagccaaatcatgcaaagcttgaytggccatgaaaaggactttgaatttcattctgagatgcgaaatcattgagcagaaaagtgacatgatcagatttatatttgtaagagtcactatcagagc

SEQ ID NO: 35098 - DNA, 201 bp, Homo sapiens
ttgtaaattcctcagggtaagttccatgagggcaaagaccttgttcattttattcactttatatccctcgtgcttatcacaatgccatataatagaagctyactaaatatttacagaatgaatggatgaatgagtgacttaaaggtaatttgctccaaccctctaccataatacatgatttctctttgtattatttcaaat

SEQ ID NO: 35099 - DNA, 201 bp, Homo sapiens
ttttttcttcttcctcggacactttataactattgattgaattgatatgaatcgaatttttcggatgtaaaaggttcttcactgtgcagttaccctctttyaccacgagaggtcacctacaggccagtgaggccgaggggttttgagaagtcgtagacgaacttgagagttaaaattcatgggccatgtcatgattctgat

SEQ ID NO: 35100 - DNA, 201 bp, Homo sapiens
ccttctcagcctagagcctgtgcacttggtatgtcagcacaactgagggactgctcccagagctatttcttctttaagtacagggggccagatcagtggcrgtctggaaaggtagcagggtacaaaatcaagtacttcctcagacctataatgctttactttctaatggtttccaggtttccttgctctgccccagagtag

SEQ ID NO: 35101 - DNA, 201 bp, Homo sapiens
  misc_feature (1)...(201): n = A,T,C or G, or insertion/deletion polymorphism (see Tables 1-2)
ttagaattgggccagtgataggacagtggccgacttgtggcccacctacatgtcttttaagcttcagttaaggttagttttgttaaagtgaagcagtctcncttgtatattttaattaatggaatgtatacatatacagtttattttgtatagcagcatagatttacagaaaaatttaatggaaagtacagagtactcata

SEQ ID NO: 35102 - DNA, 201 bp, Homo sapiens
gcccacctacatgtcttttaagcttcagttaaggttagttttgttaaagtgaagcagtctcgcttgtatattttaattaatggaatgtatacatatacagyttattttgtatagcagcatagatttacagaaaaatttaatggaaagtacagagtactcatattcccccttccccctctgctacacacacacaacctcccc

SEQ ID NO: 35103 - DNA, 201 bp, Homo sapiens
atatctttggagtgagaaaccattattgtaaggtatttgttcattttacttacacataaagagctacgcaggtcagagtggtagcattcacctcctctttraggaatagtcagcattttctgttagccgattaggaaaggttggaaaccagtagggaagggaacttcattctccccagcaaggggacagcattgggtcagt

SEQ ID NO: 35104 - DNA, 201 bp, Homo sapiens
agcatgggctttgcagtgagccctggagcccaccctgcatgcgaaccatacttgactggctgtaaggtggcaggcgctttcttaggtcattagatgctgarctggacttacccgccctctcttcctgcctccaggagacaatgatggaccaccctctgaggaccatttcctacattgcggacattgggaacatcgttgtgc

SEQ ID NO: 35105 - DNA, 201 bp, Homo sapiens
tctagaaagctctgagaaacaaaagggatttttgaagtcaggtggctgataaacttgccttgcctgctggcaggccgtttatagaatttgtctagcttacratgaatcttacagattttgccacagaaatgttactgtgctctgtgtacttccccagaccgtcagggggttatggcacaatgtacagtatttgcaccctgc

SEQ ID NO: 35106 - DNA, 201 bp, Homo sapiens
agccccccaaaaatacacatacacactctgttgggtgcttccaagaggtgtggtaccttttagtggcatatctgcaggcctccccagagtgcaagtatccracatcaacccctgtcttctctgccctgccagtgaaggttgtgaaaagtctgtgtatccaggatatgcacttcctgtgtgcacacccagccttttggttgt

SEQ ID NO: 35107 - DNA, 201 bp, Homo sapiens
  misc_feature (1)...(201): n = A,T,C or G, or insertion/deletion polymorphism (see Tables 1-2)
ctctccctcaatctaaagcatatcctgtaactcagatacaaaaggggtataggtcatttctgccactccaagaagcactcttgctacagattctgtttgcngtgaagttgtctaacaccagtttcacgcctctgccaggcagggtacctgagcagggatccatagttccagtcctgaccccacagagcccttggacaaagc

SEQ ID NO: 35108 - DNA, 201 bp, Homo sapiens
gtcccatccctgtgcttgcttgttttatttgcccatccattcagaagatgtttatggagcaccttctgtgtacactgacctgggagcttcctatacacgtstagcagggcctgcctgcacagggagctggggtcccatcagcccaggcaataccacacccaaccaggccattctccctgagcctatttttctaagccttat

SEQ ID NO: 35109 - DNA, 201 bp, Homo sapiens
  misc_feature (1)...(201): n = A,T,C or G, or insertion/deletion polymorphism (see Tables 1-2)
ggcgttactctgttttgtattaccttcataaaatgtttccctatgaagttatcttgtttacttacttacataattattgtctgcccttttttccctctganccccgacccagtgcactagaatggggacttcctgaaagcagggaagcctcctctggcttgctcactgttctgccccagtgcctcgaatgtgcctggaggc

SEQ ID NO: 35110 - DNA, 201 bp, Homo sapiens
ttactctgttttgtattaccttcataaaatgtttccctatgaagttatcttgtttacttacttacataattattgtctgcccttttttccctctgaccccygacccagtgcactagaatggggacttcctgaaagcagggaagcctcctctggcttgctcactgttctgccccagtgcctcgaatgtgcctggaggctggc

SEQ ID NO: 35111 - DNA, 201 bp, Homo sapiens
acatgctcactctcccatctcctgtatcttcacccttgtttattctctttacagcacttctcagagctcacaggatatgtttaattatttctattgtaaaytcctcagggtaagttccatgagggcaaagaccttgttcattttattcactttatatccctcgtgcttatcacaatgccatataatagaagcttactaaat

SEQ ID NO: 35112 - DNA, 201 bp, Homo sapiens
  misc_feature (1)...(201): n = A,T,C or G, or insertion/deletion polymorphism (see Tables 1-2)
caggatgacagagttgctaccttcaaactttttcagagcagactattcactgtgaactcatggcgaccagtaagaacagcagggcatctgtgtgggagtgnggttgccctggtttcccgggtgtaccagagattcgctatgtggtgtctggatggctgacttatccagtttctctacaatgaggtagtataggcaacatat

SEQ ID NO: 35113 - DNA, 201 bp, Homo sapiens; identical to SEQ ID NO: 8994

SEQ ID NO: 35114 - DNA, 201 bp, Homo sapiens
tcattgttgccattcatcactcctatcagtcatcactactgtcagtcatcactgctgtcattcatcactgctgtcagtcatcactgctgtcattcatttatcactgctgtcagtcaacactgctgtcattcatttatcactgctgtcagtcaacactgctgtcagttaccactgctgtcagtcatcactgctgtcattgat

SEQ ID NO: 35115 - DNA, 201 bp, Homo sapiens
tataatgcatctcactactagagagtccatcagatgtccctggtcctcctggggttgtctgttattatatttaagagttcacttcccatccattgtgtccrtttgtaagaaaggctctccaaaagaacataatagcaagtttacacatactgttgagcctatttaccatagggatctcaaaatcataggggtcctgcctgt

SEQ ID NO: 35116 - DNA, 201 bp, Homo sapiens
ggtcctgcctgttttgttgtggttgtttacattctttgtgtctatttctatatactgcacagattataccataaagctattttgtgataagaagaattgaragagactgaaaccaaatctttctctcgagctacaagtttctctgaaaatagaaagagacctacccatatttttaaaaaattacacctgttatccagttct

SEQ ID NO: 35117 - DNA, 201 bp, Homo sapiens
ttctcataatacctaatacaatataaatgctatataaattgttgttatactgtatttttacttgcattattttttattgttgtattgtgttggattttttyccctaatattgtcttccgtggttggttgtatcctggatgctgagtgtgcaatagggaagcctaactattagaaaccagctgctatgtaacattggcctct

SEQ ID NO: 35118 - DNA, 201 bp, Homo sapiens
tggatcactgggttatgaatagttaatataaagtgaaactgaaaacctgtgctttaaagtattccagcagtcatttttaagctatttgtgggttgtatttmatctgtcatgccatatttataggaaagaccttcctttgctgcctctttaatggtctactgagaatataatgatattatattctgttgatttccatctcag

SEQ ID NO: 35119 - DNA, 201 bp, Homo sapiens
ttttattttgttttgtaaactttccctgagattcgtaagcatgtgaaagattgagaactactgatttaaaggaaaaaatgtattatctgggcactttcccyatgtaagtgctgtggatataagatttaactaaatcttttattagcacagataaagttttaacaaaaagaggtatctcactgtgattatggtcagcagacc

SEQ ID NO: 35120 - DNA, 201 bp, Homo sapiens
gacgatttagctagagagaattttgttgtcagttgctagtcagagttgcagctcataggccacagttcgggtgtctgacatgcttgctgaataagtgtatrctcaataaactgcccagtagtctttagaaaaattgtgtcctctgccccgactatgcactctttagagacaatctcactctgtgaccgaggctagagtgca

SEQ ID NO: 35121 - DNA, 201 bp, Homo sapiens
ggaagtcatggttttttgtaacccagtcacagggtgatatcctatcacctttgctgtattttattgcttagagtaagtcactcagccgtgctccctccccrgggaggagattacccaagaggctgaataccaggaggtggagatgattgggagccatctgagaactctgccttccacatttggtatctgtcatcgttccat

SEQ ID NO: 35122 - DNA, 201 bp, Homo sapiens
gagctgctcttaaacttgctgttttccagagttttcaagtacaattttgccatttgagccaaagatcatgtcagatctttctagtgggacccctggacagrctttggagaggacccctagctctgccaagagtgtggacacttgaattatgaagtcattcttgcagattctgttgctgcctgtgctaatcatgaagacaat

SEQ ID NO: 35123 - DNA, 201 bp, Homo sapiens
atcattgttgccattcatcactcctatcagtcatcactactgtcagtcatcactgctgtcattcatcactgctgtcagtcatcactgctgtcattcatttatcactgctgtcagtcaacactgctgtcattcatttatcactgctgtcagtcaacactgctgtcagttaccactgctgtcagtcatcactgctgtcattga

SEQ ID NO: 35124 - DNA, 201 bp, Homo sapiens
cttcttctagggtttttatggttttaggtctaacatttaagtctttaatccatcttgaattaatttttgtataaggtgtaagaaagggatccagtttcagstttctacatatggctagccagttttcagcaccatttattaaatagggaatcctttccccattgcttgtttttgtcaggtttgtcaaagatcagatggttg

SEQ ID NO: 35125 - DNA, 201 bp, Homo sapiens
ttgctgagaatgatggtttccagcttcatccatgttcctacaaaggacatgaactcatccttttttatggctgcatagtattccgtggtgcatatgtgtcacattttcttaatccagtctatcattgatggacatttggattggttccaagtctttgctattgtgaatagtgccgcaataaacatgcgtatgcatgtgtct

SEQ ID NO: 35126 - DNA, 201 bp, Homo sapiens
catcattgttgccattcatcactcctatcagtcatcactactgtcagtcatcactgctgtcattcatcactgctgtcagtcatcactgctgtcattcatttatcactgctgtcagtcaacactgctgtcattcatttatcactgctgtcagtcaacactgctgtcagttaccactgctgtcagtcatcactgctgtcattg

SEQ ID NO: 35127 - DNA, 201 bp, Homo sapiens
tcatcattgttgccattcatcactcctatcagtcatcactactgtcagtcatcactgctgtcattcatcactgctgtcagtcatcactgctgtcattcatttatcactgctgtcagtcaacactgctgtcattcatttatcactgctgtcagtcaacactgctgtcagttaccactgctgtcagtcatcactgctgtcatt

SEQ ID NO: 35128 - DNA, 201 bp, Homo sapiens
gccttgtttctccttgccttcaaactccatgatacagagtaattaggattttcgttccagcaataaaaaagttcacccagacttcttttgtaataaaatcrtgtaatattggcagaaaaaatacagaaaacaaagagattggtcctgaaattccataagctaatgtttacaaagtaaacagattattttactttttttttt

SEQ ID NO: 35129 - DNA, 201 bp, Homo sapiens
actgtcagtcatcacagctgtcagtcagtcatcattgttgccattcatcactcctatcagtcatcactactgtcagtcatcactgctgtcattcatcactrctgtcagtcatcactgctgtcattcatttatcactgctgtcagtcaacactgctgtcattcatttatcactgctgtcagtcaacactgctgtcagttacc

SEQ ID NO: 35130 - DNA, 201 bp, Homo sapiens
cgtgtcattactgtcagtcatcacagctgtcagtcagtcatcattgttgccattcatcactcctatcagtcatcactactgtcagtcatcactgctgtcaktcatcactgctgtcagtcatcactgctgtcattcatttatcactgctgtcagtcaacactgctgtcattcatttatcactgctgtcagtcaacactgctg

SEQ ID NO: 35131 - DNA, 201 bp, Homo sapiens
ggcatgacgtgtcattactgtcagtcatcacagctgtcagtcagtcatcattgttgccattcatcactcctatcagtcatcactactgtcagtcatcactsctgtcattcatcactgctgtcagtcatcactgctgtcattcatttatcactgctgtcagtcaacactgctgtcattcatttatcactgctgtcagtcaac

SEQ ID NO: 35132 - DNA, 201 bp, Homo sapiens
tcagcccaaaatctccttaagctgataagcaacttcagcaaagtctcaggatacaaaatcaatgtgcaaaaatcacaagcattcttatacaccaacaacaracagagagccaaatcatgagtgaactcccattcacaattgcttcaaagagaatacaatacctaggaatccaacttacaagggatgtgaaggacctcttca

SEQ ID NO: 35133 - DNA, 201 bp, Homo sapiens
acctataggggtaaggggaagtattggctgagaaggggcaaaaaggaattttctagggtgatggaaatggtttatatcttacaaggatgtgtatacaagcrcacacacacatacacacattcatcaaattgtacatttaagatctgtgcatttatggtatctaagttatacctccattaaaagaaaagtgccagctgggca

SEQ ID NO: 35134 - DNA, 201 bp, Homo sapiens
ctctctgggttacaataattaatttgcaaacatttgttaattgcctcccgcatctcagatccactgtacctttggataggggacagggaatgttgagaagrgttggaggttcaaagaatgctaagtcttagatcctggccagaggtggatcatgatctagaaggagaaaagaggaaatatgttactaactgtaaaaatagt

SEQ ID NO: 35135 - DNA, 201 bp, Homo sapiens
ctgtctcagcccaaaatctccttaagctgataagcaacttcagcaaagtctcaggatacaaaatcaatgtgcaaaaatcacaagcattcttatacaccaayaacaaacagagagccaaatcatgagtgaactcccattcacaattgcttcaaagagaatacaatacctaggaatccaacttacaagggatgtgaaggacct

SEQ ID NO: 35136 - DNA, 201 bp, Homo sapiens
  misc_feature (1)...(201): n = A,T,C or G, or insertion/deletion polymorphism (see Tables 1-2)
tatcctttcttcctaaaggagtatatttatgatctctgcaacccagcacttctgtatgtcttgtgtaaagacatccaagacaagcaattgtaaagctcctncccaggaatatttacttcaattggtgttaaaatcatggcctcctttactctgtattcattcagtcatttatcttctttcaattgcatagccttcagaagt

SEQ ID NO: 35137 - DNA, 201 bp, Homo sapiens
aacgcttcatgctaaaaaactctcaataaattaggtattgatgggatgtatctcaaaataataagagctatctatgacaaacccacagccaatatcatacygaatggacaaaaactggaagcattccctttgaaaactggcacaagacagggatgccctctctcaccactcctattcaacatagttttggaagttctggcc

SEQ ID NO: 35138 - DNA, 201 bp, Homo sapiens
aaaaagataattttagaccaatatcgttgatgaacattgatgcaaaaatcctcaataaaatactggcaaactgaatccagcaacacatcaaaaagcttatycaccatgatcaagtgggcttcatccctgggatgcaaggctggttcaacatacaaaaatcaattaacataatccatcatataaacagaaccaaagacaaaa

SEQ ID NO: 35139 - DNA, 201 bp, Homo sapiens
atctgtcatcgttccatgccagcaaagagctactgggcttcaaatttagggcagagcagctgctggccttgtcctctcccactgaccttgtcaaccattcygaactcctgggctgcatttgttttgttgtctggctgagatgaggcagatttgcagatcccgaagtgaccgatggacgatgaaaccaaagtggcgtaaaag

SEQ ID NO: 35140 - DNA, 201 bp, Homo sapiens
ttatacataaggcaactttctcttttctgaaatacacattttggaggacagaatctcatctttttgtatatgtaaagtgatcacaggaggttgtcaaggtrtggtggcaaaaccaatccctacacactaagtttccttttcagcctcctcttctgttccatgtggattaattagcatacaatttgtatgaaaaatacagca

SEQ ID NO: 35141 - DNA, 201 bp, Homo sapiens
ttcatcatctatttggaaggaggcaggaaccctttacctccagctttgggggattcttattatcatcctatccacttttcctacttgtaaaagtttctttytgcagatctccaaggggcgagagtggtaactcaatctctcactcctttagatcttttggttcaactcaggaaatagttctgaatgccagtattaggcttc

SEQ ID NO: 35142 - DNA, 201 bp, Homo sapiens
  misc_feature (1)...(201): n = A,T,C or G, or insertion/deletion polymorphism (see Tables 1-2)
caaatttagggcagagcagctgctggccttgtcctctcccactgaccttgtcaaccattctgaactcctgggctgcatttgttttgttgtctggctgagangaggcagatttgcagatcccgaagtgaccgatggacgatgaaaccaaagtggcgtaaaagggaaggtgtgtgagagctagcacagagatggtgcaggggg

SEQ ID NO: 35143 - DNA, 201 bp, Homo sapiens
ctgaaatacacattttggaggacagaatctcatctttttgtatatgtaaagtgatcacaggaggttgtcaaggtatggtggcaaaaccaatccctacacamtaagtttccttttcagcctcctcttctgttccatgtggattaattagcatacaatttgtatgaaaaatacagcaaatacagcaatgatttatttcctaat

SEQ ID NO: 35144 - DNA, 201 bp, Homo sapiens
ccccaagggactgccattgtcaaaagaatttgctgtaaagaccctttcataagttaaggcagagcttttcaagcagtgtgctgatgatactctcggacttyggggatggagagtgacctgggccactgggcacgttgtcttcaacccttgtgcagcctcatcgtggcctccaggtcccctctgtgtggcccagtgtattgt

SEQ ID NO: 35145 - DNA, 201 bp, Homo sapiens
acaggaggttgtcaaggtatggtggcaaaaccaatccctacacactaagtttccttttcagcctcctcttctgttccatgtggattaattagcatacaatytgtatgaaaaatacagcaaatacagcaatgatttatttcctaatggaattaattggccaccattccaaataatgtaatcgttatgtttctgactattgat

SEQ ID NO: 35146 - DNA, 201 bp, Homo sapiens
taaagaataaaaacccaacacctgattctcaggttctctgtgtcgttctacatacgtgaaattactgaataactgagtctcagatggatttggcaaaactstgtaatttttaaagaattatgttctcctgcccttcattaccatgaatttctgttgccgagtttcgttggaggaaagaggccaacaagtattggaactcat

SEQ ID NO: 35147 - DNA, 201 bp, Homo sapiens
acctctaatgttaccactctttccattcatcactccttctctaaccagtgcaaccccgccagtttctccattgtcagcagctggtttgagaaagactccamctttcccctcttcaactttatgcagttctactatccatctatttatttttgcaatatttgcacctctgcactttatttgctattatttgtttttgttttg

SEQ ID NO: 35148 - DNA, 201 bp, Homo sapiens
cactttcggaccccttgggtttctccttgctatctgtagaaggaagaggtggcactctgtctctcagttttgttttgttttttttgagatggagtctcgckctgtcgcccaggctggagtgcagtggtacgatctcggctcactgcaacctccgcctcccgggttcaagcaattctcctgcctcagcctcccaagtagcta

SEQ ID NO: 35149 - DNA, 201 bp, Homo sapiens
gaaaaaaaaaatatctactcccggggcagagagtaggagctgagctgtggctgttggtaacaccctgtgctatcctccatggggctccagctgctagtccyagcccggctccgcagcctcatttctcacctgccagagctgtgctgttcctcctccctgcctgtgtttccagtatcttcctctgctttcctgtcccatact

SEQ ID NO: 35150 - DNA, 201 bp, Homo sapiens
  misc_feature (1)...(201): n = A,T,C or G, or insertion/deletion polymorphism (see Tables 1-2)
acatgtctcattgcttaaaattggatatccatccagtagcccagaaggcgtgagtctccagacagagatatatgtgacaataattttactttttctatcanatttcattgcctaaattttgcctccaaattattctttgaaagttaatagtattatgtaatttctgtttttttcctccatttttaagagtatatcaaggtg

SEQ ID NO: 35151 - DNA, 201 bp, Homo sapiens
gccatgtctgttttgaagctgtttgtccacccttgacatttaggcaatggtgtggagatttttaggcttccattagacagggtcctctctcatttggggayagctttctgcatcaagagtgtccttggagcccaggtgacagtcatcaaaggcaaagactatttctctaattcaaaatgcaaattgaggccagccacagtg

SEQ ID NO: 35152 - DNA, 201 bp, Homo sapiens
ttccattagacagggtcctctctcatttggggacagctttctgcatcaagagtgtccttggagcccaggtgacagtcatcaaaggcaaagactatttctckaattcaaaatgcaaattgaggccagccacagtggctcacacctgtaaccccagtgtttttggaggctgaggcaggaggattgcttgagcccaggagttca

SEQ ID NO: 35153 - DNA, 201 bp, Homo sapiens; identical to SEQ ID NO: 8991

SEQ ID NO: 35154 - DNA, 201 bp, Homo sapiens
agtaccatgctgttgtggtgactgtagccttgtagtatagtttgaagtcaggtattgtgatgcctccagctttgttcttttggcttaggattgccttggcratgcgggctcttttttggttccatatgaactttaaagtagtttttttccaattctgtgaagaaagtcattggtagcttgatggggatggcattgaatctg

SEQ ID NO: 35155 - DNA, 201 bp, Homo sapiens; identical to SEQ ID NO: 8992

SEQ ID NO: 35156 - DNA, 201 bp, Homo sapiens
  misc_feature (1)...(201): n = A,T,C or G, or insertion/deletion polymorphism (see Tables 1-2)
cagccagagagctaaatcagcaagtacccaccagctctctttggtgccaaataaaagttgtgtgtgtttcttcttgaaggcatgtggggctactttattgnagccaggggctgtggggtctggggttctttatgccagctgttaccctgggcctgccctcttggcttccccacagagtgtctgatgtctgcatgtgaatgt

SEQ ID NO: 35157 - DNA, 201 bp, Homo sapiens
aagtatagacttggaagtggaattattataacatatgtaaattgacatttcttctcaaaatggacagaaactgtatgctggaattatggcagggctgtttgtggtattccacatagtctatgatcaatatgttactctataataaggattgtgtgtaagtgtgtgcacgtgggtatgtagttaaggggtgggaagaaataa

SEQ ID NO: 35158 - DNA, 201 bp, Homo sapiens
  misc_feature (1)...(201): n = A,T,C or G, or insertion/deletion polymorphism (see Tables 1-2)
agtgtctgatgtctgcatgtgaatgtttaaggggtttgttcgttgtcctgacctccctgcctagaatcaggtgtatgggatcacaagaaacaaattcaagnctcacagcattaggctgggatcatacaacttcttcatctgaattaaaatgaatttcactgcattatctttctgttcatttgtggccctttatattttcca

SEQ ID NO: 35159 - DNA, 201 bp, Homo sapiens
tcactcctatcagtcatcactactgtcagtcatcactgctgtcattcatcactgctgtcagtcatcactgctgtcattcatttatcactgctgtcagtcawcactgctgtcattcatttatcactgctgtcagtcaacactgctgtcagttaccactgctgtcagtcatcactgctgtcattgatttatcactgctgtcag

SEQ ID NO: 35160 - DNA, 201 bp, Homo sapiens
agggtagtgtttggatgttaaaatgctgaaatgtctctgaattttcaatagcctgtagactaaatcagacaaaatatttgaaatctgaattgactaggaaratacaggtggtatggtttctagccatcaaaatcaggcccagctacctctttaaaaatgtgtgttttaatttttactttttcatttggggcaggcaatttt

SEQ ID NO: 35161 - DNA, 201 bp, Homo sapiens
  misc_feature (1)...(201): n = A,T,C or G, or insertion/deletion polymorphism (see Tables 1-2)
aggcccagctacctctttaaaaatgtgtgttttaatttttactttttcatttggggcaggcaattttataagacattcggtaccctaaatatttggcttcntcagtaagaaaaaaatgttttaaacatgtttgtgtaatatccttagctcaattcatttaggattttttaatttcaaccttttctgtattttctttcaaca

SEQ ID NO: 35162 - DNA, 201 bp, Homo sapiens
gtgcagtgtggcatgacgtgtcattactgtcagtcatcacagctgtcagtcagtcatcattgttgccattcatcactcctatcagtcatcactactgtcaktcatcactgctgtcattcatcactgctgtcagtcatcactgctgtcattcatttatcactgctgtcagtcaacactgctgtcattcatttatcactgctg

SEQ ID NO: 35163 - DNA, 201 bp, Homo sapiens
  misc_feature (1)...(201): n = A,T,C or G, or insertion/deletion polymorphism (see Tables 1-2)
gtttgaatctcattaatcaagacataaaaggaacgagcctgtttgatccaggaggaaccactcttatctggtttaagtcattcacaactagtttgaaccanccagaactggtttattcccatgaataaatgcagcaacacagagctctagaatctccaccacgataccaaaactacctagaatcatgggcaaaccaggact

SEQ ID NO: 35164 - DNA, 201 bp, Homo sapiens
  misc_feature (1)...(201): n = A,T,C or G, or insertion/deletion polymorphism (see Tables 1-2)
ctctcatcaacactgaggagatgtgttaaagaggtaaaccacatgatgaacgatggtttccttttccctcattttgctgataattttatgttaaatgcaangaaaaagaaatctctgtttaaactgagtggcagatcgcttttaaagggagtcttagttaaaatttacccttaaggcacccttgaataccatatatttgcc

SEQ ID NO: 35165 - DNA, 201 bp, Homo sapiens
ccacacctactacagaggagggacagaggttgatggaaacatcagaaaattagggctcaaagttgggaaagtgtacttgataggaatgtgaccaaaaccarcttctcagtatgggtgccctttaattcagtttgctttagataattgcatataattaccctctaagactttatcaccacttcgagggagaaggggactcaa

SEQ ID NO: 35166 - DNA, 201 bp, Homo sapiens
  misc_feature (1)...(201): n = A,T,C or G, or insertion/deletion polymorphism (see Tables 1-2)
gtttctccaagagcagagtgtaggggcagggggctttcaggaaagacggccttccagccccaccgcactgtctgcaatgagggtaactctgcctttgactntggcagatctgcagcctcatgcgagggggaatagctgagagaggaggcgtccgtgtggggcaccggatcattgaaatcaatggacagagcgtcgtggcca

SEQ ID NO: 35167 - DNA, 201 bp, Homo sapiens
gctgataattttatgttaaatgcaatgaaaaagaaatctctgtttaaactgagtggcagatcgcttttaaagggagtcttagttaaaatttacccttaagrcacccttgaataccatatatttgccattaaatatttacacaaaggaaaagtattttttattaatctgttcatattaaaccaaacaaacaaacatagacct

SEQ ID NO: 35168 - DNA, 201 bp, Homo sapiens
acctcgggtcactgtggtacctggctgtgccatcacaaaatccagcctcactgtcttttctgtgggaagggagtttgaacaggggccgctgaattgggaayctctgaaggagtctctcccctccagccagccacactttggaacacggagtggagttccagccccatggtggctcaggcaatcgtgaccctaaaaacagtc

SEQ ID NO: 35169 - DNA, 201 bp, Homo sapiens
  misc_feature (1)...(201): n = A,T,C or G, or insertion/deletion polymorphism (see Tables 1-2)
ggggcatatgaagcactgagatataagacaatggaagggaagaaaggccacaaagtcacttattcacaatgttagcagtcttaggatcttagactcaaagnatgatagctgggagcctctcagaaatcctcctcacgtctttgctcattatgtggatgaggactctgaaattggagtcgaagctgtgggctttacccagtg

SEQ ID NO: 35170 - DNA, 201 bp, Homo sapiens
ggttaccagggctcataaaccttcatgaacccttgggctcaaagcccaggacaagctcacagttttggtttagttacttaggtttctctcttgaatcatcrtaaattatttgcatcatttttgtgaggccctgaaattctgtgagagcattctgggaagttttctgaagtttgaaagctcccgtcttcatattcatccccc

SEQ ID NO: 35171 - DNA, 201 bp, Homo sapiens
ataacaggcttccttatttaattactacatagatgctttgtgaaagcctttcctaaaacacttttaatttctctgtttcaagcaccaccttagttttagawaaatgagtagattattttacatctttactctgataagtagttcagcacaggaagcagctgtgtaaactcaagatgagcttgatgtttaaggataaaaata

SEQ ID NO: 35172 - DNA, 201 bp, Homo sapiens
aactaaaaggaatcaatagcagttgtttttatggttatctgaatactcagctcataacgactgtttgcaccacgtgacagcctctccccttcttgtttttycagcccagtggagcaaaatgagagcgcagtgagccgggcccagcttctctcctagccgttccgactcccaccatgaaccacttggaggggtctgcggagg

SEQ ID NO: 35173 - DNA, 201 bp, Homo sapiens; identical to SEQ ID NO: 8990

SEQ ID NO: 35174 - DNA, 201 bp, Homo sapiens
ggtgaaaccccgtctctactaaaaatacaaaaaattagccgggcgcggtggcgggcgcctgtagtcccagctactcgggaggctgaggcaggagaatggcrtgaacccgggaagcggagcttgcagtgagccaagactgcgccactgcagtccgcagtccggcctgggcgacagagcgagactccgtctcaaaaaaaaaaa

SEQ ID NO: 35175 - DNA, 201 bp, Homo sapiens
atgtatcttttctttctgttacaaacaatccaattatagtgtctttgttactttaaaaggcataataaattattgttgactgtagtcaccctgttgtactrtcaaacactagatcttatttattctatctaactatatttttgtgtccattaatcatccctacttcatcctccccaacccttcccagcctcttgcagcttt

SEQ ID NO: 35176 - DNA, 201 bp, Homo sapiens
  misc_feature (1)...(201): n = A,T,C or G, or insertion/deletion polymorphism (see Tables 1-2)
aaacactgcaatctaggtaagggcactgaaaaagttaaatgatggtgccaggtacaggcactaatcaaaaccaactacacttggacaaacagagaagatcncaagtttcagacaagaggtgctgtgcttctctggggatggcctgtggcttcaaactgagctattcaggaatgcctgtaggaagatgaggctatccaagct

SEQ ID NO: 35177 - DNA, 201 bp, Homo sapiens
  misc_feature (1)...(201): n = A,T,C or G, or insertion/deletion polymorphism (see Tables 1-2)
tttccccagggagaatcacactcattccattgctgtgctttggaatcatttccttaaccagagcagttccctggagatgttccaaaaccaccaggagatgncacatgaatgtgaatgctaagtcgcatggtacatcgaggccacaagctgagtgacagccatggggaggctcaagtcctgcagaaagcagaggaattcaga

SEQ ID NO: 35178 - DNA, 201 bp, Homo sapiens
  misc_feature (1)...(201): n = A,T,C or G, or insertion/deletion polymorphism (see Tables 1-2)
tgggtagagcccagaatctgcacttctaaaaagtggccaggggctgctgctgctgctgtgtggggtttaagagccattggtgtacacctgctggccaagcntagtaaagctggataaccagaggcaaaatagcccctacctctccctcaatctaaagcatatcctgtaactcagatacaaaaggggtataggtcatttctg

SEQ ID NO: 35179 - DNA, 201 bp, Homo sapiens
ggtttctaaaataggtaaagcatgttcccaccccaagaggaactcatagtctaggagggagggagaaacattgatagtacatcttgttatttttaaaaaaygaagagaggaatgagcacagggatagaaactcagaggaagagcatgtggaccatcccaggagtgctgaagcaggtgtcattggagctgaggcttaaagga

SEQ ID NO: 35180 - DNA, 201 bp, Homo sapiens
ggttaccatgaggcttgtagataatacactcattattttaaactgatcacaacttaacaccaattgcataaacaaacaagtaaagagaaaagtaataacarctgtatgctttaacttcatcccctgattttaaactttttcttttctgtttatatcttattgtactatgtcttgaaaagttgttatagtttttttgactag

SEQ ID NO: 35181 - DNA, 201 bp, Homo sapiens
ccagattctgtgccatatctttaggatcgaaagcctgtactaaatgattggaaaactcagttccaatttttcagcaatcctgggaaataagttagaaaaaratgaattagaaaattatatctcctctgtcccaatgtaagccttctttccgtgtttctatccacctcaaagtattccttttttgaaaaagttacgatttgt

SEQ ID NO: 35182 - DNA, 201 bp, Homo sapiens
cactcaacaaatatatgtgttgagaccgtgatgtgctagccctcaggttcagcatcaaatacatatcaaaaaaatagaaactctgataataagagatgtayaaacaatcacagcataatatagggagatctgattctgagctgcttgtatacagtaaggggcaaggagatgccaatagtcaatctggacacaacattcagc

SEQ ID NO: 35183 - DNA, 201 bp, Homo sapiens
gtagtgctgagatggccttacagggaaaaagcgggcacggggcacatcacttgaacgtaaagcaatgttcggggtacacagcatccctgtaccaaagctcytcagtgccaattatattgtgaattacattttcttatttccaaagtggtgtcctatagagttgttattccttctttaaagtccagctgcctcataagaaat

SEQ ID NO: 35184 - DNA, 201 bp, Homo sapiens
tttccctgagtccctcctcattccctggtagctgttctctcctgcaggaaaagttacccacctctcctcccacccaccccacagttccctttggagtagtrggcctggggctgaacttgagcggtttcccaggcagctggccttatagatgggagtccagttgggcaggtgcttcccactgagggctatgacccccgctgc

SEQ ID NO: 35185 - DNA, 201 bp, Homo sapiens
aacaatcacagcataatatagggagatctgattctgagctgcttgtatacagtaaggggcaaggagatgccaatagtcaatctggacacaacattcagcaygtagagttagttgctgtaaaggccaagccctagaagcatactgatctgtttttatagtggttattatgtatggatgggtgttgagtgatggctctagctg

SEQ ID NO: 35186 - DNA, 201 bp, Homo sapiens
  misc_feature (1)...(201): n = A,T,C or G, or insertion/deletion polymorphism (see Tables 1-2)
taaagcagcagtctgcccccaaaggagtactgaagacttctgaggttgaaaactgcacgttgccttgaggttagttttttctaggttctatccatcaaggnttcaaacattttaaggttcaggtttcatttgggacaccttgtttattagccctctgatagctttggactcctacagacagaacatttatgcctttccagt

SEQ ID NO: 35187 - DNA, 201 bp, Homo sapiens
gaacatcaccatgttcttggggagctgcccatccaagcttggcctagttccctttcactgtcttcctgtttccacgaagtagtgacattgtgccagcaagrctccccaaggtcttctccatcttaatttagttgtcttccaggcacagcattcaaaacaacaacccacaaacctctcagagagagcaagctgcttctcagg

SEQ ID NO: 35188 - DNA, 201 bp, Homo sapiens
ctgggcaagttctcattgctccagatgactcctgcaccacctctcttttgctagaaggagaagcaatgagttaagtgccttctcaagcttcttagatccckgattaatattctctgattctctgtcttggaatgcatttaaaatctctgcctcgattctgacctacctggcatgggaacaagaatttacaatgttactcac

SEQ ID NO: 35189 - DNA, 201 bp, Homo sapiens
cagatgtgttgtcttttgaaagaaagaaacaacaccatattcagaggttgccaatgctgctcagttgtgaattctgcaagaaggcattcatggtaatgtcytgactcatgaattatgtgctatatttgagcagtgaggtcagctgttgtagcacataattcattatctcacattcatgatttttcttcctttctctatttc

SEQ ID NO: 35190 - DNA, 201 bp, Homo sapiens
tgggcttcccctcccaccagatttcttaatttgctgtaccgttccactgttgtcatggggaccaaatgaccctttatttaattggcacctccaataaaatkgcagctcagaaatccaagttaatgggacccaacatgaaacattgattaggaacagcagagcaaatgcatggtctcgttatttcaaattgctatttctcta

SEQ ID NO: 35191 - DNA, 201 bp, Homo sapiens
ctcccaccagatttcttaatttgctgtaccgttccactgttgtcatggggaccaaatgaccctttatttaattggcacctccaataaaatggcagctcagraatccaagttaatgggacccaacatgaaacattgattaggaacagcagagcaaatgcatggtctcgttatttcaaattgctatttctctaagcttcatct

SEQ ID NO: 35192 - DNA, 201 bp, Homo sapiens
tagtagtactctttattcagatgcatcagaaatgggacctgaatcgtatgcgtggtggagaacaaaacgttcctgaggcgctcagtgtgaggggtgggaamggagaaaggcaataagcaattaaacaagtagatatgtaattacaaattatgatgcgtgctatgtatgtgctgtcagattgaacttaaatttgcagtcttt

SEQ ID NO: 35193 - DNA, 201 bp, Homo sapiens
tttttgttgccattgcttttggtgttttagacatgaagtatttgcccatgcctatgtcctgaatggtattgcctaggttatcttctagggctttttttttwaaattttattattattatactttaagttttagggtacatgtacacgatgtgcaggttagttacatatgtatacatgtgccatgctggtgtgctgcaccca

SEQ ID NO: 35194 - DNA, 201 bp, Homo sapiens
tcccacaactgctgttgtgaatattgtgaagctgttattgtacatgttttacagatgtggaaactgaggcacaaagagaataaataacttgctcatagacycacagttaataagtgatgggccaggacttgaaccggagcagtctgactcaagagccatgcactcagccactgcaccatacagtttctccatggataagaa

SEQ ID NO: 35195 - DNA, 201 bp, Homo sapiens
agaaattctacatagggcatgggggacattctcaggaagcccttgtggctttctgttgctcttctctacgtggaaaacgttcctgtgtctcctacccaggyagtttagtagtccatactgcaaggaagtgtagactgaccttatcctatgtcatttctcatacttactgtgtttgttaagcatttttggcaaaaggtgtga

SEQ ID NO: 35196 - DNA, 201 bp, Homo sapiens
ttgatggatactttcaaattacccttcatggaccaattttatagatggaagaaaggttgtaagaattaatgattgcaaatcaagggctgcaaacagcttgmctacttagaagtgtgattttcctgagttggatgtggatgggtatgagtaacacaaggtcaaagaggtttggtattgtacactgaagcaggctgctgtgag

SEQ ID NO: 35197 - DNA, 201 bp, Homo sapiens
  misc_feature (1)...(201): n = A,T,C or G, or insertion/deletion polymorphism (see Tables 1-2)
taatgacatggaatacacagtgataggaaagaaaaaagtgataacaacaatagtctcacaaacatgttcagtgaaagaacccagacacagagtacccaccntaggattccatttatataaaattcaaaaaataggctaaattaatagggataaatgtctgaatagtggagtgagtaatgacaaagaaggggcatgagagtg

SEQ ID NO: 35198 - DNA, 201 bp, Homo sapiens
  misc_feature (1)...(201): n = A,T,C or G, or insertion/deletion polymorphism (see Tables 1-2)
cgtccctctcatggcttcctcctcaggctgctcactgccgctcctgctgctgggcctctgtgtgtcacccactgatctgaccacctctctgtacttggagnaaatgcttctcccccaagctcagagctggcccttctcttaactcctcctaggacagtaaagcccatgccgtaacttttgacatgactacgatgtttttat

SEQ ID NO: 35199 - DNA, 201 bp, Homo sapiens
tgtccagttatcctgcagttcccaggatgctgtgtgaatggccccacgtccctctcatggcttcctcctcaggctgctcactgccgctcctgctgctgggmctctgtgtgtcacccactgatctgaccacctctctgtacttggagaaaatgcttctcccccaagctcagagctggcccttctcttaactcctcctaggac

SEQ ID NO: 35200 - DNA, 201 bp, Homo sapiens
  misc_feature (1)...(201): n = A,T,C or G, or insertion/deletion polymorphism (see Tables 1-2)
aacctggaccgtctccaagcaaaatgactttctgatgttgcaatgctcttgtctgccatgcctcacttagttttgaatgcctgaattatgggaatgtcgtnttcttagaacacgtgcgggacgtaggaatcatcagttgtgctccagctctcttagcttagtctgtctccatgctatcatctgttatgtctgcgatgaatg

SEQ ID NO: 35201 - DNA, 201 bp, Homo sapiens
ggagaggcagttggtttgggcctcatgcccaagctgattcttacgttagtcacgtgtccagactctgccatgtggtgaatagctcataccatcaccaacascgtaaatatgatgcgcctgaaccctcagctgtccagttatcctgcagttcccaggatgctgtgtgaatggccccacgtccctctcatggcttcctcctca

SEQ ID NO: 35202 - DNA, 201 bp, Homo sapiens
caaattgcttaaattgattttagaatttcctgcccatgcaagtggccagatgaaacatggataactggggaactactaataggtttcagtgaggttacccwtgtcaaccaagggaaagagataaaaactattatagcaagtcttttagtgcatttttttttcaaggctccagcctttttcaatgggcttttgtaggatttt

SEQ ID NO: 35203 - DNA, 201 bp, Homo sapiens
cctgagaggtagaaaggaacagtaagtgaccaacaattccaagaggtgcttgcagaggagaggcagttggtttgggcctcatgcccaagctgattcttacrttagtcacgtgtccagactctgccatgtggtgaatagctcataccatcaccaacaccgtaaatatgatgcgcctgaaccctcagctgtccagttatcctg

SEQ ID NO: 35204 - DNA, 201 bp, Homo sapiens
  misc_feature (1)...(201): n = A,T,C or G, or insertion/deletion polymorphism (see Tables 1-2)
ccaggtggtcgggaagcgacctcccatgccagtcaggttcctgccacccacacttggactcattgggtcttagaattgggccagtgataggacagtggccnacttgtggcccacctacatgtcttttaagcttcagttaaggttagttttgttaaagtgaagcagtctcgcttgtatattttaattaatggaatgtataca

SEQ ID NO: 35205 - DNA, 201 bp, Homo sapiens
  misc_feature (1)...(201): n = A,T,C or G, or insertion/deletion polymorphism (see Tables 1-2)
ttttaggtgcaattagcacagtagattaaaatcattttgaagtgacctcattcactccccaaattgcttaaattgattttagaatttcctgcccatgcaantggccagatgaaacatggataactggggaactactaataggtttcagtgaggttacccttgtcaaccaagggaaagagataaaaactattatagcaagtc

SEQ ID NO: 35206 - DNA, 201 bp, Homo sapiens
tcatataatgtatgtattttatgtatatttacttatatatttatacatatatctatgtttatacatatctatgtatgcatattgatagactgtacacatayatccatgagatgtccaataaattacttacacatggtagaggactgtatgatgctcctctttgctcccacctcaggactttagaacttgctgttcactttg

SEQ ID NO: 35207 - DNA, 201 bp, Homo sapiens
tagctgataaagtgagatccttgttctcaagctcagcagtatgaatgagggaatgacaaagcaagccagggagtgtgtggggtgtgcccaaggagaggacrgtgtcagaggccgagtgccaccagagtgcaggggaagcctgcagatgcgaacacctctgaccactgccttctgcctgagaggtagaaaggaacagtaagt

SEQ ID NO: 35208 - DNA, 201 bp, Homo sapiens
gtttcactatgtttgtcaaactggtcgcaaacttctgacctcaaatgatccggctacctcagcctcccaaagtgctgggattacaggcttgagccaccacyccgggccaatatcacagtacattcttttattttttctggaacatctccatggctgctaccaaaggtgggtcgtggggaagtactggagaatcttattgga

SEQ ID NO: 35209 - DNA, 201 bp, Homo sapiens
  misc_feature (1)...(201): n = A,T,C or G, or insertion/deletion polymorphism (see Tables 1-2)
tggtaattcttacggttataattctttgaatatcttttcagttatgattggaggaggtctaagcaagtgaaatatgacacattgcctttttcctgtcaaancaaccccgtatcatatatgcatgatagtgtggttgctgctttaaaaaccaattctagaaggaaaaatgtcatgtttcctagagattataaataactagac

SEQ ID NO: 35210 - DNA, 201 bp, Homo sapiens
aagacatgtaccactggatttccactgacagctggaggtcagtggcaaacattcatgttacagagttggtttaaactaggtggcattgcttttgaaccagrccatcctgttcaagctagattgaacttgcttgcttcaaggaaaatgaaccctttgatcaaatctaacctggctagtctaaggtcagtgcaaggctaatcc

SEQ ID NO: 35211 - DNA, 201 bp, Homo sapiens
caaccttttctgtattttctttcaacatttggcctaaggggaaaaacggcccatagctatgaaagctcctttgaaagcatggcaggacttgaaaaagaaarcttgaaaaccacaagtgttttatgtacagttggcagctcctttttaagaggttttctccccactgcagtgtctgttcgattgtgttctgctttgcttctc

SEQ ID NO: 35212 - DNA, 201 bp, Homo sapiens
agctcctttttaagaggttttctccccactgcagtgtctgttcgattgtgttctgctttgcttctctctcccggcccctttcccccagccaagtgtctgcmgagtctctcaagttctcactgtgtttcctcttgctgtgttctagtctccgtctcctggcagctcctcccccttgggtgcagagtcatcaagcacatctct

SEQ ID NO: 35213 - DNA, 201 bp, Homo sapiens
tcacactattttatagtttcctaatcataagacactgtattctaaaactgtcattgtttcctagtaagttttaaagcaacattttttgtttaaatatgcayatataatgtgtgagtgtgtgtgtaagtaatggctttaggagttgtacatatgcaaaatagatgggcattacacctggataacgcttattttattaatctt

SEQ ID NO: 35214 - DNA, 201 bp, Homo sapiens
ttctgtgcttcctaatacagcatcctacagcgctcctgacccacattaccctggtgagaacaatcctgatttctcctctccagtgtgcagttcacctgttmaagccatgtcatccagtttgatagccactggctgcaggtgcctaattaatgaataaaatgaaaagtttatttcctcaagcacagtagccacatttcaagt

SEQ ID NO: 35215 - DNA, 201 bp, Homo sapiens
  misc_feature (1)...(201): n = A,T,C or G, or insertion/deletion polymorphism (see Tables 1-2)
acacaagaagggagtgtggctcacagctggagagattactaatcttagccattcctcagttgcctgatagaaaagcatttacacatagaaaacggctggcntttattctgcactcactatgtgctggacactgtgctaagcactttacatggattacgcccttgaatcctcatctcatgccttcacattaggtaccattat

SEQ ID NO: 35216 - DNA, 201 bp, Homo sapiens
atttacacatagaaaacggctggcatttattctgcactcactatgtgctggacactgtgctaagcactttacatggattacgcccttgaatcctcatctcwtgccttcacattaggtaccattatccacattcaagagatgaagagatagaagcctgggaggctaagtacttgcctggggttccccagctggctcgtgcat

SEQ ID NO: 35217 - DNA, 201 bp, Homo sapiens
tgccatgggcttgcagttgctgtgtgctttgggaaatgtgttagtttcttaaataccctttatttcaggcccaaatgagatatctttcgtaagaatagagrggccatacattcccagtttacctagggtgtggttccagttcacacctgttgtccaggcagcccatcttatgagcgcccttctctcttgctggtgcagtgc

SEQ ID NO: 35218 - DNA, 201 bp, Homo sapiens
cacagaacatttgtgggaaggatagcagcaggaatactaactgcagtgggagtgatgcttgctgaggtgaagtgtgatgcgttcatttctcctcaggtttrtatacttatgtaggtaaatggtctttacttcaaaaatgaaatgtttttgagatgtcttcttttaccagggtgcatttaatggcccattctgcaacttaga

SEQ ID NO: 35219 - DNA, 201 bp, Homo sapiens
cttccattactagctgtgtgaccttggccaaattacataatttcttataacctcaaagtcctcagcaataaaatggggctggtaacagcatcattttactktcacatagatgaatataaaatgtagctcctgccttcattgtaaatgaggaattggactggttaaaaaatgaaacagaaaaatacagacattcctcctata

SEQ ID NO: 35220 - DNA, 201 bp, Homo sapiens
tttttcagagcagactattcactgtgaactcatggcgaccagtaagaacagcagggcatctgtgtgggagtgcggttgccctggtttcccgggtgtaccayagattcgctatgtggtgtctggatggctgacttatccagtttctctacaatgaggtagtataggcaacatattttagtcactaatgaaacagagatgtgc

SEQ ID NO: 35221 - DNA, 201 bp, Homo sapiens
  misc_feature (1)...(201): n = A,T,C or G, or insertion/deletion polymorphism (see Tables 1-2)
ttttaggtctaagatttaagtctttaattcatcttgaattgatttttgtataaggtgtaaggaagggatccagtttcagctttctacatatggctagccanttttcccagcaccatttattaaatagggaattctttccctatttcttgtttttgtcaggtttgtcaaagatcagatagttgtagatatgcggcattattt

SEQ ID NO: 35222 - DNA, 201 bp, Homo sapiens
  misc_feature (1)...(201): n = A,T,C or G, or insertion/deletion polymorphism (see Tables 1-2)
ggctagccaattttcccagcaccatttattaaatagggaattctttccctatttcttgtttttgtcaggtttgtcaaagatcagatagttgtagatatgcngcattatttctgaggactctgttctgttccattggtctatatctctgttttggtaccagtaccatgctgttttggttactgtagccttgtagtatagttt

SEQ ID NO: 35223 - DNA, 201 bp, Homo sapiens
tctgggtcatgcgccaggacattagccccaccagggactgtgacgaccagaggccgatggacggagatgtaagtaggtgcgggtttgggcttcctcggccycacgcggtgggagggaagatggcgccccatggccttgtgtgcccttgggtagtgactttacgggaagtagtctgtggggacgctaagaacttttccaccg

SEQ ID NO: 35224 - DNA, 201 bp, Homo sapiens
gacaggaactcatctgggttggtgtccccagggaagtgtctttctttaggcaagacaggaatgggggagaggctttcatttctacctaccccagatggtcyctgatggaggttttctaaatgtttttctccttccaggttttcatagagaagcagaaaggagaaatcctaggtgtggtgattgtggagtctggctggggat

SEQ ID NO: 35225 - DNA, 201 bp, Homo sapiens
tctgaagtctgtctgggtggtacttattagaaatgcaagttactgcccttcgtttccaaaccagaatacctgatgtgggtctcagtgatctggttgtttcrttttattttattttgttttgtaaactttccctgagattcgtaagcatgtgaaagattgagaactactgatttaaaggaaaaaatgtattatctgggcact

SEQ ID NO: 35226 - DNA, 201 bp, Homo sapiens
  misc_feature (1)...(201): n = A,T,C or G, or insertion/deletion polymorphism (see Tables 1-2)
gatgtaccagtcaagtcaaataaaatacacaaggctaggcatggtggttcatgcctgtaatctcagcactttgggaggctgaggcgggcaaattgcttgancccaggagtccaagaccagcctgggcaacatggcaaaaccccatctctacaaaaactacaaaaattagttgggcatggtagtgcctgtagtttcagccac

SEQ ID NO: 35227 - DNA, 201 bp, Homo sapiens
gggacagctgaggaaaggcctgcatgtagctggggagccagcattgaagacgcctcggggacagtgggttcatgtggagagggccgcaggtgcaaaggctstgaggagagaatgagcttggagtgcttgagaaaggagagttttaggagagcagatcagacaggaagccaggagccaaatcatgcaaagcttgactggcca

SEQ ID NO: 35228 - DNA, 201 bp, Homo sapiens
  misc_feature (1)...(201): n = A,T,C or G, or insertion/deletion polymorphism (see Tables 1-2)
gtgtaaactcaagatgagcttgatgtttaaggataaaaataaaaagcatttcagattagccttccaagaggaaaaagcaaattgtttccattacaagttanctaatttaagaccctgaggttttaacagtgggttaaaatgtatattttagtctctgcagatgtaccagtcaagtcaaataaaatacacaaggctaggcat

SEQ ID NO: 35229 - DNA, 201 bp, Homo sapiens
  misc_feature (1)...(201): n = A,T,C or G, or insertion/deletion polymorphism (see Tables 1-2)
gcggacagagtccagtggtggtgggctggactagataaccaacagtggtggtggactgggtgggaaagccacaactgcttgcaagcagcatgcagtctatntagcatttccacttaataccttccccctaatgacctccacctggcaattcatttaatccaaatcacaggggtcaatcgcctgtactgcgcctgttccaca

SEQ ID NO: 35230 - DNA, 201 bp, Homo sapiens
  misc_feature (1)...(201): n = A,T,C or G, or insertion/deletion polymorphism (see Tables 1-2)
cttcctagttttccctcagtctcatgtcaccatcacagctgttgccatgtctatgcaccctgtctactcatgatgactcaatattttcttcacatagaccnagttgattatttactcaataaaattattcacaaattacagctagatagggaagagtaaattctagtcttctataccattgtaggatgaccatagttaaca

SEQ ID NO: 35231 - DNA, 201 bp, Homo sapiens
ataatgattatgtttccataacactataaatgcatcaccaggaacttatcatagaagaactgacaatcttttactttatataaagtgtaatgtggattcaracctgttcatatattattttgtatgcttccctgctatacaactgaaactgtatatcatatatagcccgaatccatctcacatctataaaagattcagagc

SEQ ID NO: 35232 - DNA, 201 bp, Homo sapiens
  misc_feature (1)...(201): n = A,T,C or G, or insertion/deletion polymorphism (see Tables 1-2)
ttggttgatttaacttctcactttagaggaagaaagtaagatcgatgttttctaatttgcctctaggctccttttacacttaccttcaacacagccaatcnagggtccttcattttaggtgagctgagaggtacagaagaaagtgtttgcagggtcccttgggatgataggctttctccagttgggccagtgctggtgatt

SEQ ID NO: 35233 - DNA, 201 bp, Homo sapiens
aaggaacgtatggtgagttttgctcctctgatagcaggcagttaagctgccatctagtcaggctctaaaaggtgtctagctcatcatctctgcttccaacrgtgctgtgagaacgctgacctttgctctgaggtgcaaaagaaattccagggtttttaatttactcctttgttgtgttcttattcagataacacacaataa

SEQ ID NO: 35234 - DNA, 201 bp, Homo sapiens
  misc_feature (1)...(201): n = A,T,C or G, or insertion/deletion polymorphism (see Tables 1-2)
ataatgatttatataatggagtttttcaactaaaataaatcagtaggagatgaagagatttttaaaaactctagcacacatttttagcacagtgagagatnactgtggcaaagagtaaaataaatttctctgagagaattcttaatttcagctataatcatagcattggtgctttcactaatcagtttttcacatggaaat

SEQ ID NO: 35235 - DNA, 201 bp, Homo sapiens
actgtgccttctatttgaaaatgaggtgtgggtgcagatagacacagagagatgcctcagaccagcaggttggctctgcctcacctgtgccagcagtgagkcatgggagaggggagatgtgccattgagggggttggcaggccccaccccaggatggcttcctcactgtggctctatgtgttacagttccgggaccctgcg

SEQ ID NO: 35236 - DNA, 201 bp, Homo sapiens
  misc_feature (1)...(201): n = A,T,C or G, or insertion/deletion polymorphism (see Tables 1-2)
gttgtgttcttattcagataacacacaataatgatttatataatggagtttttcaactaaaataaatcagtaggagatgaagagatttttaaaaactctancacacatttttagcacagtgagagatcactgtggcaaagagtaaaataaatttctctgagagaattcttaatttcagctataatcatagcattggtgctt

SEQ ID NO: 35237 - DNA, 201 bp, Homo sapiens
agccatttattcagtaaacatttattgagtgcctactgtttacaagacccaaggcgaggcagttggaggatgaacatgaacaagacaaggtccctatctcytgagagctcttgggggagaaggggcataacgtgaacagatgattacacagcatggcacgtggctgtggagaaaaggaatgtactgtgaatagggtctgcg

SEQ ID NO: 35238 - DNA, 201 bp, Homo sapiens
cctctccacatcatggccctgctctctgagatcctgcctcagtcctcaggcctttctagaatagaatgttgttcatcatctatttggaaggaggcaggaascctttacctccagctttgggggattcttattatcatcctatccacttttcctacttgtaaaagtttctttctgcagatctccaaggggcgagagtggtaa

SEQ ID NO: 35239 - DNA, 201 bp, Homo sapiens
cctcccaggtggaggatgagttaacatccctattttatttttatattttatttattttttattttattttatttatttatttatttatttatttattattwttttttgagacgaagtcttctctgttgcccaggcgggagtgcagtgacacatcttggctcactgcaacctccacctcccaggtccaaacgattctcctgc

SEQ ID NO: 35240 - DNA, 201 bp, Homo sapiens
taagcctcccaggtggaggatgagttaacatccctattttatttttatattttatttattttttattttattttatttatttatttatttatttatttattattattttttgagacgaagtcttctctgttgcccaggcgggagtgcagtgacacatcttggctcactgcaacctccacctcccaggtccaaacgattctc

SEQ ID NO: 35241 - DNA, 201 bp, Homo sapiens
tagcttaagctgtggaccagagtttaacactcaactctttaggatctcattttccgcttttcttgcgtgagttaacctgttgcctctgtaattcactgtcygtgtctcatcgttctcctgtatctctctcagagcaagtcacacagatgcgctgctcagagtgtccatcgtatgtaaatatttggctcacagtcgatctgc

SEQ ID NO: 35242 - DNA, 201 bp, Homo sapiens
agtagtgggcctggggctgaacttgagcggtttcccaggcagctggccttatagatgggagtccagttgggcaggtgcttcccactgagggctatgacccrcgctgcctcagctcttatagcagggccaggggctgcagggcctgcagctacaacagtgtggtctgtttaccccagcatgcaaacatgatcctcctgcata

SEQ ID NO: 35243 - DNA, 201 bp, Homo sapiens
  misc_feature (1)...(201): n = A,T,C or G, or insertion/deletion polymorphism (see Tables 1-2)
tgggagacactgctctgtaaggaagatggtgccacgctgtttcctaaagagagactgacctttcaggacaagttattctaggccaccttgacagaaaggangtagagcacagcaaagctgcagactttatagcgtccgtccaggaaggaaggagaaagaaaagctctgtggatttattttgcaatccatttagcaatgtcc

SEQ ID NO: 35244 - DNA, 201 bp, Homo sapiens
agctatcaaaacccagtgtagaagccagtgccacctcctgcaagctgtgtgaatttgagaggttcctttgtgtctctgggcctccatctcctcaactggayaatgcagggttggaccagtcagagttctcaactctgttagacccaaccctccctttctacaataaatatcttattaatgacccattactatcctgaaatg

SEQ ID NO: 35245 - DNA, 201 bp, Homo sapiens
  misc_feature (1)...(201): n = A,T,C or G, or insertion/deletion polymorphism (see Tables 1-2)
ttgttttctgattcctccttcttccctcactccctgcagggacccccgttttgtccctctcttcctctgcctacattgtttgtttgaccagatggatgtgnctggatgtgaatgagaactgctcaccacgcgccctgttattcgtggtgctttatctctgaacagacgctgaccttgaagcttaggtttccatttcaaagt

SEQ ID NO: 35246 - DNA, 201 bp, Homo sapiens
  misc_feature (1)...(201): n = A,T,C or G, or insertion/deletion polymorphism (see Tables 1-2)
acagagcgtcgtggccaccccccacgagaagatcgtccacattctctccaatgctgttggggaggtaggagaggtccggggctgagggtggtgctgagggncgcgtctggtgcccctgcctcgtatgctcaccgtggccctgagcagaccttccaggaaagctccctgagtttccaatcctgaacactccccaacaagcag

SEQ ID NO: 35247 - DNA, 201 bp, Homo sapiens
agaacagcagcacttaatatgagtcacaaggtgttacaattgttgtcattgttttaactctgggctgcttttgtatcttgagtatatttctattttgcacytatcaccaggtatcataactgtcagagctgtctgccctaaaccatagtttagaaacttttacatcccctttgccttgcacagtgactggtacatgtctga

SEQ ID NO: 35248 - DNA, 201 bp, Homo sapiens
aatatgagtcacaaggtgttacaattgttgtcattgttttaactctgggctgcttttgtatcttgagtatatttctattttgcacctatcaccaggtatcrtaactgtcagagctgtctgccctaaaccatagtttagaaacttttacatcccctttgccttgcacagtgactggtacatgtctgataaatgcccattgga

SEQ ID NO: 35249 - DNA, 201 bp, Homo sapiens
ggcagcaaagatttaagatagaaagaagaaatgagttcttctccaaaggctgatcatgccaatgtctagaagtctataaggccccaactattgggtgggasgggtgggggataaagatttttcctttttcagttactaaaaattccttgaccaccttctgtataccctctgtgcttggcatcagaaaatcaaagatacatg

SEQ ID NO: 35250 - DNA, 201 bp, Homo sapiens
gctgatcatgccaatgtctagaagtctataaggccccaactattgggtgggacgggtgggggataaagatttttcctttttcagttactaaaaattccttkaccaccttctgtataccctctgtgcttggcatcagaaaatcaaagatacatgacaaaacatctttttcttaaggacttgatacttacaaagaattaccac

SEQ ID NO: 35251 - DNA, 201 bp, Homo sapiens
  misc_feature (1)...(201): n = A,T,C or G, or insertion/deletion polymorphism (see Tables 1-2)
agagaaatagaaaagccaatcccagtttaaattgtttgaatctgattcaatcaggatctcagatcttccggttcacgatttcagcttgttttgaaagctanctgaattgaggagggggcagggcacagaatgagttttggctttaatacactaaagactaccccaataacctgaaagacccagtagaaaaccatgggctaa

SEQ ID NO: 35252 - DNA, 201 bp, Homo sapiens
aaaacatgcagaatattctctatgccatttagctgtctgcagaaacccactgttgctgggtacccagccatgtcccctgcccacccccaccctggcgaagstgggagtgagaagccaggggaagcacagtgtatgcacatggccagaaaaagactgacacaattcgtgggcattagagcacggttctctttctggaaattg

SEQ ID NO: 35253 - DNA, 201 bp, Homo sapiens
tatttcaaaagattgacatacagactgtgttctctgaccacagtggaattaattccaaaatcagcagaaaaagataactagaggccaggcgcggtggctcrcgcctgtaatcccagcactttgggaggctgaggcagatggatcacctgagatcatttgagaccaggctggccaacatggagaaaccccatctctactaaa

SEQ ID NO: 35254 - DNA, 201 bp, Homo sapiens
  misc_feature (1)...(201): n = A,T,C or G, or insertion/deletion polymorphism (see Tables 1-2)
tagtgtttggggtggaggactgttcaggtaggcactaatgttgtgtcttagtctgttttcttttaattctggaggctgggaagtccaagttggaggggccncttctggtaagggttttcttgctagtggggaatccgcagtgcaggacatcacctgtcaagggggttcacgagggacagccaaactgacttgtaaaacagc

SEQ ID NO: 35255 - DNA, 201 bp, Homo sapiens
taaaacatgcagaatattctctatgccatttagctgtctgcagaaacccactgttgctgggtacccagccatgtcccctgcccacccccaccctggcgaasctgggagtgagaagccaggggaagcacagtgtatgcacatggccagaaaaagactgacacaattcgtgggcattagagcacggttctctttctggaaatt

SEQ ID NO: 35256 - DNA, 201 bp, Homo sapiens
  misc_feature (1)...(201): n = A,T,C or G, or insertion/deletion polymorphism (see Tables 1-2)
ctagtgtttggggtggaggactgttcaggtaggcactaatgttgtgtcttagtctgttttcttttaattctggaggctgggaagtccaagttggaggggcngcttctggtaagggttttcttgctagtggggaatccgcagtgcaggacatcacctgtcaagggggttcacgagggacagccaaactgacttgtaaaacag

SEQ ID NO: 35257 - DNA, 201 bp, Homo sapiens
tttgttttgtttttgccttgtaatgccagatggtcccaacagtcaacagaagaccagttgacaaagatgtggaccagataagtagatgctagtgtttgggstggaggactgttcaggtaggcactaatgttgtgtcttagtctgttttcttttaattctggaggctgggaagtccaagttggaggggccgcttctggtaag

SEQ ID NO: 35258 - DNA, 201 bp, Homo sapiens
tatctttagtagagacagggtttcaccatgttggacaggctggtctcgaactcctgacctcatgttccgcccacctcagcctcccaaagtgctgggattasaggcatgagccaccgcgcccagccagattattttactttttaaaatattgatgttaagttgtgaagctacatatgctgttacaagtgacaatgtatagca

SEQ ID NO: 35259 - DNA, 201 bp, Homo sapiens
caacaatttcctaagcctacagcaaatctgtatcatgatctggggtgaatttattaaactgaatttctggctcttaaggtggaggtgtacagggaatagtcaataaatatttgttggtgttggtaatggtcaaatctaggctggatacacacattctactagatttgccattattgattatccaggataaatatagttgcc

SEQ ID NO: 35260 - DNA, 201 bp, Homo sapiens
ttgctcttcttgcatggtagcataaaccaagaaaaaagatgcaagatccaggaaacgggggacccaacctgggaatgcagcagagagaatctccaggtgayaggaaaggagatcccaggatcacaaccatgcagaagtccaaccaccaatcccatgtggcctgccgctcagagggctccagttaggcagtctctagaaaga

SEQ ID NO: 35261 - DNA, 201 bp, Homo sapiens
atttcttttgtatgagagaacaatattgagggcgtgagagaagaggggttgccctgttcttaagcaactgaatttaattcctcactggtctctgtactccracaattgattctcactctaaagacttacaagattcataagtgtcttctagcaacaggaaataacctgtgaaaaaggaactttcttaatactaaatttagc

SEQ ID NO: 35262 - DNA, 201 bp, Homo sapiens
cagtattccaggcatacattaccaagcaattaaagttgagatttaagaaaatgtatttgctgctcttaggttagtctacctaggagggctgtgtgtgtgtktttaagcttgatgatgaagcatggggaggccagaactttagcactgctagctttatgtccataaacacccaaacttgatcttctgattggcaagaaagta

SEQ ID NO: 35263 - DNA, 201 bp, Homo sapiens
ttcagagaaataaaaacaagaatgatcaggaaacacaatgatgttggacttttcacaagcaatactggaaactgggagacttacagccagtctatcttcayttcagtttgaaggtacaataaaggtgtttttagacaagcatggtcccagaaaatttacctcatatgcaccctttctcaggaaactaccagaggattgctc

SEQ ID NO: 35264 - DNA, 201 bp, Homo sapiens
gagaacaatattgagggcgtgagagaagaggggttgccctgttcttaagcaactgaatttaattcctcactggtctctgtactccgacaattgattctcamtctaaagacttacaagattcataagtgtcttctagcaacaggaaataacctgtgaaaaaggaactttcttaatactaaatttagccctaataatttcaaa

SEQ ID NO: 35265 - DNA, 201 bp, Homo sapiens
cctggggatgttccaccaagttagtgtctattgtgtgtgtttaccagagtgcctgagctgtgttcaatttctatggacctgtactaaaatgactagctcggaaatgataaatatgcaacttgcatggcgccattatcccatcccacacctgaggcaaacaacactattcagtcatggtactgttcctacacagtattccag

SEQ ID NO: 35266 - DNA, 201 bp, Homo sapiens
  misc_feature (1)...(201): n = A,T,C or G, or insertion/deletion polymorphism (see Tables 1-2)
tcagtaatgacagaaccggggcgggaccacactgctggctgatagcctctctcagaatggcttcaaaaggtgttcaagattatgtttctttgaaattgatntaaagagtgatttctaaagttgtaggatcctagtttaatttggagagatttatctgttagcagatggaaaatgtgtcagttggcccattcaatttagtag

SEQ ID NO: 35267 - DNA, 201 bp, Homo sapiens
tgcatgtaggaaatgagtccagtcacaccgtggaggtccagaaaattaagccacttgcctgaggtcacaaagtcagtaatgacagaaccggggcgggaccmcactgctggctgatagcctctctcagaatggcttcaaaaggtgttcaagattatgtttctttgaaattgatttaaagagtgatttctaaagttgtaggat

SEQ ID NO: 35268 - DNA, 201 bp, Homo sapiens
  misc_feature (1)...(201): n = A,T,C or G, or insertion/deletion polymorphism (see Tables 1-2)
tgatggaagtttattataatttgcaattgacaaggaatttggttatttctgtagcatataagattttaacataataaccaaaattatgactgataccatantagacttctatgaatttacatactttttaacatttgtatatataacatacccataaatgtaatttaaggaaggtctagcatcacttatcatttgacaatg

SEQ ID NO: 35269 - DNA, 201 bp, Homo sapiens
ggagactggggcccaagaacttgattaaacaacctggttccttgtcactcaagtgagctgtgcagaacagcagcatcagcgacacttggcagactcttggrccccatccaaacctactgcatcataatctgcattttaaagacaccccctacccccgtgattttaggcacattgaagtttgagcagcatggctcttgtctg

SEQ ID NO: 35270 - DNA, 201 bp, Homo sapiens
tcctgctactatcgtttactaccatcccaagagatccagggtatttagcctcactgtggatatagctagattgagcaacttcgaacatctgaaaaatcatstatgaacccacaaataaaaaatattctatccttgaatgcaaaaggaaacagttatcacgaagatcatacccttttctgcatgggagatgtggagccagat

SEQ ID NO: 35271 - DNA, 201 bp, Homo sapiens
ctctgatttttaccaaaagtcctatccaactccattttacagatcaggaaactgaagcactgagaggttgtgtaacttgcccaccatgctacagttaataraaggcagagcccaggttcagtctcagctcccgggcctttggatttaagcccacatgcaggaccgccgcatgctgctacccaagccttgctgctgctgctt

SEQ ID NO: 35272 - DNA, 201 bp, Homo sapiens
ccaggtattttctacttaatgtgaaaagaaacaaaggaatttggccccaaatgccaactgttgctgtgcagactcctgtgataggccctttaggaataaawttaaccaatacacagttcttgagcttgagaaacttgcagtaaaaacaagccaaaaagaatgttaggtaacaaaaatacaaggtaagctgagggctctgaa

SEQ ID NO: 35273 - DNA, 201 bp, Homo sapiens
gatccaaagtaatggaaattcctatattactgccatatcatttcaggagaagtaaaaaacaaacattaaagatctcccagctgtcagttatgcagattatractgatgccagtccgaacatccctggccagactctggggttccacacgggaatcctcgtggtgtggcatggcataacatcagcatagggtcacttctcag

SEQ ID NO: 35274 - DNA, 201 bp, Homo sapiens
taatatagaaataattacagccacattaaatgagacagctcctgtcctttccaggttaatgccagataacagtgagtgttcaatgacaggtagttacagtsattttggttcaattagtttcatcatcagggtgggttttgatgcagcagtgatcttaggggtgttcctgcatgacatagacatgcagatggctgaacaggg

SEQ ID NO: 35275 - DNA, 201 bp, Homo sapiens
ctcaaaaaaaaaaaagaaagaaaataaaatacgtatgtttcaattgcagattaaaatgcctttttaagtagactgttatacagttatatattaatcacagwcacgttttaatttcgagttagggtttacaagtaattgtggttagaaacaggtgcccccaattaaaatatttaaaacaggtttgacttaaaaggctggtaa

SEQ ID NO: 35276 - DNA, 201 bp, Homo sapiens
tacctaatagttgcttagtggattttgttctttgggagttgtgaagctgaattgtcaggaagtgagccttcctgaatgtggctgcttttaatcatttagtytagccctagcatagcagatttgaggcataaccaaaaatatgtttgaggattatgaccagcatagtctttgctgctttcctgatctatgaatacaaagaag

SEQ ID NO: 35277 - DNA, 201 bp, Homo sapiens
acatgtagagaaatagaagttctttggagatggggggaaattactaagatttgggagaagtcacactatatatgtatatatatatacatatatatatatawcttagtgcgtagtggtgatgactgcataacaacatgagtgttcttttttgcctttttttcttttagattcaggagaggcgtgcagattggctacatgcat

SEQ ID NO: 35278 - DNA, 201 bp, Homo sapiens
  misc_feature (1)...(201): n = A,T,C or G, or insertion/deletion polymorphism (see Tables 1-2)
taccctcagactgcaattaggataattgttgagttccctcagggtgtttccttagacatcctgctactatcgtttactaccatcccaagagatccagggtntttagcctcactgtggatatagctagattgagcaacttcgaacatctgaaaaatcatgtatgaacccacaaataaaaaatattctatccttgaatgcaaa

SEQ ID NO: 35279 - DNA, 201 bp, Homo sapiens
tagatttctcataatacctaatacaatataaatgctatataaattgttgttatactgtatttttacttgcattattttttattgttgtattgtgttggatwttttcccctaatattgtcttccgtggttggttgtatcctggatgctgagtgtgcaatagggaagcctaactattagaaaccagctgctatgtaacattgg

SEQ ID NO: 35280 - DNA, 201 bp, Homo sapiens
  misc_feature (1)...(201): n = A,T,C or G, or insertion/deletion polymorphism (see Tables 1-2)
aaattgctgtggttgtgatggggagttgagtagaatataatgcatctcactactagagagtccatcagatgtccctggtcctcctggggttgtctgttatnatatttaagagttcacttcccatccattgtgtccatttgtaagaaaggctctccaaaagaacataatagcaagtttacacatactgttgagcctatttac

SEQ ID NO: 35281 - DNA, 201 bp, Homo sapiens
  misc_feature (1)...(201): n = A,T,C or G, or insertion/deletion polymorphism (see Tables 1-2)
ccttagagctcttcatcttgtaaccttgagactccaaactcgttaaacaacttcccctttccctctcttcccagcccctggctaccaccaattctactttntgctctatgaatttgactactctagcttcctcatataggtggaatcatacaatatttgtccttttgtgactggcttagactaatttttgaagatactttg

SEQ ID NO: 35282 - DNA, 201 bp, Homo sapiens
tagtttttaaaattgcggtaaatatatgtaatataaaatttaccattttagccattattaagtgcacagctcacattgtcatgcagccatctgcactatcrgaccttagagctcttcatcttgtaaccttgagactccaaactcgttaaacaacttcccctttccctctcttcccagcccctggctaccaccaattctact

SEQ ID NO: 35283 - DNA, 201 bp, Homo sapiens
tgcctggcatcaaatggctttcccttaatagtcagcagctcaaagggcacaggtgaatctaattataaatgatgccttacagccaagaccaaatgacaacrtaagctaacatttgtgacaataaaagctgcacgtagagtttgaatagaagagagtggctggagcattgagtcatcacacgatatgccatagactagggag

SEQ ID NO: 35284 - DNA, 201 bp, Homo sapiens
aactaaattagcccagcagaggacagtgatttaaactaattgagtctgtgagtggcatatctctaagcctaattaatgcttgaaccctaagatttcttcaagattgaacattaatcaggcaacctcagtgttctccatattcaccgagccagcaaatctttttgggcctcctatgtgctaggaacagttctagggacaagg

SEQ ID NO: 35285 - DNA, 201 bp, Homo sapiens
ttcccccgttggcttttatatcatcctttaaaagtactaacagttcctaatgtacatttgtggggaaaaaaaagccaaaaacaaacaaacaaacaaacaamaataacaacaacaagacagtttatttccatgcaatagaaagacccctgtggccaaaatctgaggcactgctgtttactttttggtccatgcttgtggctg

SEQ ID NO: 35286 - DNA, 201 bp, Homo sapiens
ctacatgttagacctaaaaccataaaaaccctaggcaataccattcaggacataggcatgggcaagtacttcatgtctaaaacaccaaaagcaatggcaamaaaagccataattgacaaatgggatctaattaaactcaagagcttctgcacagcaaaagaaactaccatcggagtgaacaggcaacctacagaaagggag

SEQ ID NO: 35287 - DNA, 201 bp, Homo sapiens
tggcacagtaaatggagtttgcagcgattttgattgcactcttactctgcagctggctggctggggcctgcagaagcctcttaacctcattgtgctgattyctcctgcaaggaaaacgagaactggttcacttgccctctcttctctccccagtagtcttcagaagattaattgctatttgtgattcattttgatttggtt

SEQ ID NO: 35288 - DNA, 201 bp, Homo sapiens
tggatacatgtcattatatatttgttcaaacccatagagtgtacatcatgcgcgaactcccaagtaaacgatggactttgttttataacgatgtgccagtcttggttcattgactgcaacaaatgcaccactctggtgggagatgttaatggtgggggaggcaagtgtatgcagggtagggaagaggagatgtatatggga

SEQ ID NO: 35289 - DNA, 201 bp, Homo sapiens
tttgaagcctttcatttaaaaatggatcttggagtaagataagggtcaagagcttatattcaatttcatttaattctgcattttatgattgcaccaggccrtttctcaatatatatctttggagtgagaaaccattattgtaaggtatttgttcattttacttacacataaagagctacgcaggtcagagtggtagcattc

SEQ ID NO: 35290 - DNA, 201 bp, Homo sapiens
acaagtcctggcaaggatgtggagaaattggaacccctgtatactattggtgggaatgtgaaatggttcggccgatatagaaaacagaatgggggggggggtccctaaaacaattaaaaatagaactgccttatgatccagcaatctcagtcaaactcaccaaaagaattgaaatcaagatctcaaagaaatatttgcaaa

SEQ ID NO: 35291 - DNA, 201 bp, Homo sapiens
attcccccgttggcttttatatcatcctttaaaagtactaacagttcctaatgtacatttgtggggaaaaaaaagccaaaaacaaacaaacaaacaaacaacaataacaacaacaagacagtttatttccatgcaatagaaagacccctgtggccaaaatctgaggcactgctgtttactttttggtccatgcttgtggct

SEQ ID NO: 35292 - DNA, 201 bp, Homo sapiens
ctgtccttgagatagtttgctgagaatgatggtttccagcttcatccatgttcctacaaaggacatgaactcatccttttttatggctgcatagtattccrtggtgcatatgtgtcacattttcttaatccagtctatcattgatggacatttggattggttccaagtctttgctattgtgaatagtgccgcaataaacat

SEQ ID NO: 35293 - DNA, 201 bp, Homo sapiens
  misc_feature (1)...(201): n = A,T,C or G, or insertion/deletion polymorphism (see Tables 1-2)
attagggctcaaagttgggaaagtgtacttgataggaatgtgaccaaaaccaacttctcagtatgggtgccctttaattcagtttgctttagataattgcntataattaccctctaagactttatcaccacttcgagggagaaggggactcaaaggggggcctcttaaaggcaacagtatttacagatgttcctttgtgcc

SEQ ID NO: 35294 - DNA, 201 bp, Homo sapiens
gtgtatgcagggtagggaagaggagatgtatatgggaactccatacattttgttcagttttgttgagaacgtaaaactgctctgaacatagtcattaattyttagaaattatataattttggacatgtttattagtttccttataaatagatatatttttaaactattttcaaaaaattatttttataaaagtaaaatttt

SEQ ID NO: 35295 - DNA, 201 bp, Homo sapiens
atttaatttagttcttttaaaatagagatttcttcattcattcactcaaaagtatttactgacctacaactccacagcaagaaaccaaaaaaaaaaaaaaatgcaaaaaagagagcaaataacttgaatagacatttcttttaagaggacatacagatggtcaatgggtatatgaaaagatgcttaacatcactaatcatt

SEQ ID NO: 35296 - DNA, 201 bp, Homo sapiens
gatgatgagcattttttcatgtgttttttggctgcataaatgtcttcttttgagaagtgtctattcatgtcctttgcccactttttgatgaggttgtttgttttttttcttgtaaatttgtttgagttcattgtagattctgaatattagccctttgtcagatgagtaggttgcaaaaattttctcccatttttgtaggtt

SEQ ID NO: 35297 - DNA, 201 bp, Homo sapiens
ggcatttgcacatgaaaaccctcccttcatgtcctcccctggctctatttgtcaggttcttaaacataagtgactccattttgatcctgaaaactttcacwatcttatgattcttttatttagcatcttctccccaccccattcccaagtacaatgcccagaaggaatcagtgtgagcatttaaaaatcgtgttaatgaat

SEQ ID NO: 35298 - DNA, 201 bp, Homo sapiens
aatttaatttagttcttttaaaatagagatttcttcattcattcactcaaaagtatttactgacctacaactccacagcaagaaaccaaaaaaaaaaaaaaatgcaaaaaagagagcaaataacttgaatagacatttcttttaagaggacatacagatggtcaatgggtatatgaaaagatgcttaacatcactaatcat

SEQ ID NO: 35299 - DNA, 201 bp, Homo sapiens
accactcagaatgatagaagccatgataaattttatatatatacacacacacatatatatatataaaatttatatatgtgtgtgtgtgtgtgtgtgtgtgtataaaatggtgtgagtatgtgtgagacggagagagaaagggaaagggagagagagaaaaagcacagcgggcacaaagggaggcttagttgggccttatca

SEQ ID NO: 35300 - DNA, 201 bp, Homo sapiens
tccttccttccttccttccttccttctttccttccttctttctttctctctccctccctccctccctccctccctctctctctctctctctctctctctcttctttttttgagacaggctctcactctgtcacccaggcttgggtgcagtggtgccatcatggctcattgcagcctcaacttctccaggctcaggtgatcc

SEQ ID NO: 35301 - DNA, 201 bp, Homo sapiens
tttattaggcatttgcacatgaaaaccctcccttcatgtcctcccctggctctatttgtcaggttcttaaacataagtgactccattttgatcctgaaaastttcactatcttatgattcttttatttagcatcttctccccaccccattcccaagtacaatgcccagaaggaatcagtgtgagcatttaaaaatcgtgtt

SEQ ID NO: 35302 - DNA, 201 bp, Homo sapiens
taccactcagaatgatagaagccatgataaattttatatatatacacacacacatatatatatataaaatttatatatgtgtgtgtgtgtgtgtgtgtgtgtataaaatggtgtgagtatgtgtgagacggagagagaaagggaaagggagagagagaaaaagcacagcgggcacaaagggaggcttagttgggccttatc

SEQ ID NO: 35303 - DNA, 201 bp, Homo sapiens
ttccttccttccttccttccttccttctttccttccttctttctttctctctccctccctccctccctccctccctctctctctctctctctctctctctcttctttttttgagacaggctctcactctgtcacccaggcttgggtgcagtggtgccatcatggctcattgcagcctcaacttctccaggctcaggtgatc

SEQ ID NO: 35304 - DNA, 201 bp, Homo sapiens
tctttttcttaaggacttgatacttacaaagaattaccactcagaatgatagaagccatgataaattttatatatatacacacacacatatatatatatawaatttatatatgtgtgtgtgtgtgtgtgtgtgtgtataaaatggtgtgagtatgtgtgagacggagagagaaagggaaagggagagagagaaaaagcaca

SEQ ID NO: 35305 - DNA, 201 bp, Homo sapiens
tgaggaatcgccacactgacttccacaagggttgaactagtttacagtcccaccaacagtgtaaaagtgttcctgtttctccacatcctctccagcacccrttgtttcctgactttttaatgattgccattctaactggtgtgagatggtatctcattgtggttttgatttgcatttctctgatggccagtgatgatgagc

SEQ ID NO: 35306 - DNA, 201 bp, Homo sapiens
tctagttccttgaggtggcttgcttatttgagatctttctacttttttgatatagacatttattactataaacttccctctttttttttttttttttttttgagatggagtttcgctctcgttgccgaggctggagtgcaatggtgtgatctcggctcaccgcaactgcctcccagattccagcatttctcctgcctcagc

SEQ ID NO: 35307 - DNA, 201 bp, Homo sapiens
cgggaagcggagcttgcagtgagccaagactgcgccactgcagtccgcagtccggcctgggcgacagagcgagactccgtctcaaaaaaaaaaaaaaaaaagatctcccggttattcttaagtggtgaaaagtttgactactagtcacataatacatccaatgtgataataaataactcaaattctcatctaatatttgat

SEQ ID NO: 35308 - DNA, 201 bp, Homo sapiens
cttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggtggc

SEQ ID NO: 35309 - DNA, 201 bp, Homo sapiens
gcttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggtgg

SEQ ID NO: 35310 - DNA, 201 bp, Homo sapiens
taatttaatttagttcttttaaaatagagatttcttcattcattcactcaaaagtatttactgacctacaactccacagcaagaaaccaaaaaaaaaaaaaaatgcaaaaaagagagcaaataacttgaatagacatttcttttaagaggacatacagatggtcaatgggtatatgaaaagatgcttaacatcactaatca

SEQ ID NO: 35311 - DNA, 201 bp, Homo sapiens
ttaatttaatttagttcttttaaaatagagatttcttcattcattcactcaaaagtatttactgacctacaactccacagcaagaaaccaaaaaaaaaaaaaaatgcaaaaaagagagcaaataacttgaatagacatttcttttaagaggacatacagatggtcaatgggtatatgaaaagatgcttaacatcactaatc

SEQ ID NO: 35312 - DNA, 201 bp, Homo sapiens
tccatcagtgaactgatagtattgaatttctggagcacagatgtgaatgaccacagcctggactagaagttccaacaaaagtataacaactcttagagtcstttttaccactcccacccctgcaatttgtgaacagagacatcactcttgaatagcaaggcttaaagtaaacagaagttgagtaccaacatggcagcaaga

SEQ ID NO: 35313 - DNA, 201 bp, Homo sapiens
  misc_feature (1)...(201): n = A,T,C or G, or insertion/deletion polymorphism (see Tables 1-2)
aactcttagagtcctttttaccactcccacccctgcaatttgtgaacagagacatcactcttgaatagcaaggcttaaagtaaacagaagttgagtaccancatggcagcaagaaacctgaaatgtggtgagaaaattccttcagcagctgaacagaaaggttttgcagggattcagctcatcagcccttcctcaaagccc

SEQ ID NO: 35314 - DNA, 201 bp, Homo sapiens
cccagctccacttgtcagggtcttaaacatcttaaaatgtgactccattttgattctgataactttcacattccccgcttttgaccaagatctttctccaraagcattgctgatcagtcatccttgggttttgattttccctcagtgctgcaatggacctgtcctggtgtggtctaatctggtcccacatcagagggaagt

SEQ ID NO: 35315 - DNA, 201 bp, Homo sapiens
cagtgtttttggaggctgaggcaggaggattgcttgagcccaggagttcaagacctgcctgggcaacatagtgagaccctgtctctacaaaaaaaaaaaaagtttttcagtttaaaaaaactgcatgttgaatattctacacacaacactagagggatgctgtgtcagaaaagggcctaccattgaccactgaaaaatgaa

SEQ ID NO: 35316 - DNA, 201 bp, Homo sapiens
catgtccctcccttcatggccttccccagctccacttgtcagggtcttaaacatcttaaaatgtgactccattttgattctgataactttcacattccccscttttgaccaagatctttctccaaaagcattgctgatcagtcatccttgggttttgattttccctcagtgctgcaatggacctgtcctggtgtggtctaa

SEQ ID NO: 35317 - DNA, 201 bp, Homo sapiens
aagctacagaaaacttgagagaatagagacaggcaagttaactgacttttaatgagccaaataatctgtaaacataacaatagcagtaaatttgaagtgaygtggtctcaaaaaaaaagactacattttaatgaattactgttcaattcgttatttgcctgatatcactgttttcatctcctttggcagtgtgaattaatg

SEQ ID NO: 35318 - DNA, 201 bp, Homo sapiens
agcttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggtg

SEQ ID NO: 35319 - DNA, 201 bp, Homo sapiens
gattcttttgtgatagttcttgttatcaggcatttgtgcatgtccctcccttcatggccttccccagctccacttgtcagggtcttaaacatcttaaaatrtgactccattttgattctgataactttcacattccccgcttttgaccaagatctttctccaaaagcattgctgatcagtcatccttgggttttgattttc

SEQ ID NO: 35320 - DNA, 201 bp, Homo sapiens
tagcttcccatccccactgccccatcttgactctcttgtttatgatgccttcatcctacttgggatgtctgtgtgtgtgtgtgtgtgtgtgtgtgtgtgtgtgttactgtttgtcttagtccattcagtgttgctataacagagtacctgaggctgggtaacttacaaagaaaagaagtttatttggctcacaattctggt

SEQ ID NO: 35321 - DNA, 201 bp, Homo sapiens
tcttaatccagtatatcatttgttggacatttgggttggttccaagtctttgctattgcgactaatgccgcaataaacatacgtgtgcatgtgtctttatrgcagcatgatttatagtcctttgggtatatacccagtaatgggatggctgggtcaaatggtatttctagttctagatccctgaggaatcgccacactgac

SEQ ID NO: 35322 - DNA, 201 bp, Homo sapiens
gtagaattggtaccagctctttgcatatctggtagaattcagctgtgaatccatctgttacagggttttttttttcagttggtaggtttttgtttttttttgtattactgattcagttttggaacttggtttgttcaaggtttcaatttctttctgattcaatttttggagagtgtgtgtttccaggaatttatccatttc

SEQ ID NO: 35323 - DNA, 201 bp, Homo sapiens
tccatgtctgtgctatggtgaatagtgctgtgatgaacatacaagtgcatgtgcctttttggtagaacaatattctaccgagaacaattgacttttggatrtatacccagcagtgggattgctgggtcgaattgtagttctctgagaaatctccaaactgctttccacagtggctaacctaatttacattccacccaacag

SEQ ID NO: 35324 - DNA, 201 bp, Homo sapiens
ccgagctggtttttatatgcattaaaattgagaacaattggtgtaaagaacaattagatctagtcagggccagctcttgcaaaattgtgaggttggggagsattttctttgacccatccacttcctgctttaaatcgtcttcttccctctgtgacttcaagcttgtccccagctgtcttctatcaaaccctctttgagaag

SEQ ID NO: 35325 - DNA, 201 bp, Homo sapiens
  misc_feature (1)...(201): n = A,T,C or G, or insertion/deletion polymorphism (see Tables 1-2)
caatacacattctttatctcacagtttccatggggcaagagtctgggcacaggtcagggtcacaatcaaggtgtctgccctgggctgcattctcatcttgnggcttggctggggaagaagctacttgcatgctcattagtttgttggtagaaattatattttttgtggctgtatgactgaggacttagctttctgctaact

SEQ ID NO: 35326 - DNA, 201 bp, Homo sapiens
agtgcaggccttgagacaggctggcatctcagtgcttggtttctcccttgggtgaggcatgtggatcctcctcttcatgcttccatctcaaccgcctttgrgctgctgggggagttttccatcgcaggtgttatccattattgatgagtcatggagaagatggtggtgaataattaagtaggtttcaggtgcagaatgaac

SEQ ID NO: 35327 - DNA, 201 bp, Homo sapiens
cctcctgcctcaacctacctactagctagggctacaggtgcataccatcatgcccagctagtgtgtgtgtgtgtgtgtgtgtgtgtgtgtgtgtgtgttttgtagagacagagtcttgttatgttgcccaggctggtctcaaactcctggcctcaagcattggcctctcaaagtgtcatattacaggcatgagccaccatg

SEQ ID NO: 35328 - DNA, 201 bp, Homo sapiens
tctttagacatgaagcattcatgtggagttttttgagcacattgggacttgctgaatgcatggccagtgtgaccaggatgttcctcctccatgatggcatytgtagaccccagtagctctgcaccaagtgctgcggtactgtagctagactgagattccacagcgttttttggggtcctgtaggggtttcctgaaagactt

SEQ ID NO: 35329 - DNA, 201 bp, Homo sapiens
tgaacctgggaggcggaggttgaagtgagccgagattgcatcgctgcactcctgcttggatgacagagtgagactccttccccaaaaaaaaaaaaaaaaaagtaatctagacttgttggtaagacatttgcatgtcaaggttagaaataaatatgagtaaaattcagagttctttatcagcgaaatttctgggagtccagt

SEQ ID NO: 35330 - DNA, 201 bp, Homo sapiens
ttattctgattggaactcgtgagcaagaagtattggtagcaataagtaatctaggtcgggcatggtggctcacacctataatcccagtactttgggaggcygaggcctgaggtcaggaatttgagaccagcctggccaacatggtgaaaccctgtctctactaaaaatacaaaaattagcagggcatggtggcttgtgcct

SEQ ID NO: 35331 - DNA, 201 bp, Homo sapiens
gactacaggagcccgccaccacacccggctaatattttgtagttttagtagggatagggtttcaccgtgttagccaggatggtctcgatctcctgacctcrtgatccgcccaccttggcctcccaaagtgttgagattacaggcgtgagccacagcgcccggcctccttaggccatctcttagtatcaccatggcctgtgg

SEQ ID NO: 35332 - DNA, 201 bp, Homo sapiens
ccacatcccctttcaaccctcctatttgtcctgtgcagaaaacagatggatcttggagaatgacagtggattatgatacatttaaccaggtggtaactccattgtagctgctgtaccagcccgacctgatgacattattctgattggaactcgtgagcaagaagtattggtagcaataagtaatctaggtcgggcatggtg

SEQ ID NO: 35333 - DNA, 201 bp, Homo sapiens
tggtgcgatctcggctcactgcaagctccgcctcccgggttcacgccattctcctgcctcagcctcccgagtagctgggactacaggagcccgccaccacrcccggctaatattttgtagttttagtagggatagggtttcaccgtgttagccaggatggtctcgatctcctgacctcatgatccgcccaccttggcctcc

SEQ ID NO: 35334 - DNA, 201 bp, Homo sapiens
tgacccacgagttttcactcaggtccttctcacagtgtgtccagtgggtccttgagcccatcctgcggctattttcccagctccaggtgcataattggaasagacatatgagcagctgacagaatcccacattgatttcctgatggtgggaaaagtcgagcagaagccattagaactgcctctacctaggaaatcaaaagc

SEQ ID NO: 35335 - DNA, 201 bp, Homo sapiens
aaattagccgggcgtggtggcgggctcctgtagtcccagctactcaggaggctgaggcaggagaattgcttgaacctgggaggcggaggttgaagtgagcygagattgcatcgctgcactcctgcttggatgacagagtgagactccttccccaaaaaaaaaaaaaaaaaagtaatctagacttgttggtaagacatttgc

SEQ ID NO: 35336 - DNA, 201 bp, Homo sapiens
gtgggcaggaggcagcgataatcaccacgtgcagaggtcctgccaggtgcccagcctcatcattccctagaaggcaggcaccaccacatgctcccacactrtagataaggaaacagctttgaaacagatttgaaagtgtttgaggatttgcctggaaggagggctccagagccagggactgggtccgggacacccggagac

SEQ ID NO: 35337 - DNA, 201 bp, Homo sapiens
gatcacgccattgcactccagcctggtgacagagcgagactctgtctcaaaaaaaaaaaaaaccaacaaacaaaaacaaaacaaaacaaattagccgggcrtggtggcgggctcctgtagtcccagctactcaggaggctgaggcaggagaattgcttgaacctgggaggcggaggttgaagtgagccgagattgcatcgc

SEQ ID NO: 35338 - DNA, 201 bp, Homo sapiens
agcccacatcctgtcttggaggcgggggtttctgttttgttttttttttctgctgtccaggctggagtgcagcggcatgatctctgcttactgcaacctcyacctcctgggttcaagcaattctactgcctcagcctccccggtagctggcattacagacacacaccaccatgccctgctaatttttgtatttttagtaga

SEQ ID NO: 35339 - DNA, 201 bp, Homo sapiens; identical to SEQ ID NO: 9001

SEQ ID NO: 35340 - DNA, 201 bp, Homo sapiens
tagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgaggtagc

SEQ ID NO: 35341 - DNA, 201 bp, Homo sapiens
ggtagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgaggta

SEQ ID NO: 35342 - DNA, 201 bp, Homo sapiens
aggtagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgaggt

SEQ ID NO: 35343 - DNA, 201 bp, Homo sapiens
gtaggtagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgag

SEQ ID NO: 35344 - DNA, 201 bp, Homo sapiens; identical to SEQ ID NO: 9004

SEQ ID NO: 35345 - DNA, 201 bp, Homo sapiens
gtcagttctctgaagagtctttttcatatatatcacatagatagagagataggcaggttggtaggtaggtagataggtcaataggtaggtaggtaggtagttagacataggtatctatctatctatctatctatctatctatctatctatctatctatctatctatctatcttactgtagtttagcacagacattggttaa

SEQ ID NO: 35346 - DNA, 201 bp, Homo sapiens
gagtcagaagcacaggatttgccgtcagctgaacaatttagaaaacctgctcctgagattcaggctctgctgtgggcctggtggggtctgactgtctggaygccagcagggaacagtggagcaagagtcatgggcctctgatgatctcagtgtgactttatgtctctgctttccaatgagagaaagtgacaattcactgag

SEQ ID NO: 35347 - DNA, 201 bp, Homo sapiens
aggacaaccactaacccaggactcgggctccatatctctaaaacgggcctcctagacatacctccctgaaatctgatgacctctgtgattagcccagtgtygagtgagaggacaatgcccagtgaccccgcggccatcacccatctgactgctgtccttaagcagggtggcatcatccctgaaagccctcttggctatctc

SEQ ID NO: 35348 - DNA, 201 bp, Homo sapiens
actgtagtttagcacagacattggttaagtcatgtcactcctctgaacctcaattttctcatctctaaaatggggatattaggccgggcgaggtagctcaygcctgtaatcccagcactttgggaggccaaggcaggtggatcacctgaggtcaggagttcaaaaccagcctggcaaacatggtgaaaccctgtctctact

SEQ ID NO: 35349 - DNA, 201 bp, Homo sapiens
agtcagttctctgaagagtctttttcatatatatcacatagatagagagataggcaggttggtaggtaggtagataggtcaataggtaggtaggtaggtagttagacataggtatctatctatctatctatctatctatctatctatctatctatctatctatctatctatcttactgtagtttagcacagacattggtta

SEQ ID NO: 35350 - DNA, 201 bp, Homo sapiens
cgagtagctgggattacaggcacctgtgaccacgccagctaatttttgtattttttttttagtagagacagagtttcaccatgttggccaggctggtctcraactcctgacctcaggtgatccacctgcctcgggcttccaaagtgctgggattacaggcgtgagccattgcgcccagcccaaaataacccctcatctaca

SEQ ID NO: 35351 - DNA, 201 bp, Homo sapiens
cagaaccctctgggagtaagattacccagccctgtgctcgggctgagcaatcaactatagcgcacacgctcctttactgtggttccgagatagttaattgraatctggatactctgggtaaagtcagaacatccagctgggcccagcatgggagatcagcttgatgagtctcccgcaccctattctgggcatcagcagagt

SEQ ID NO: 35352 - DNA, 201 bp, Homo sapiens; identical to SEQ ID NO: 9017

SEQ ID NO: 35353 - DNA, 201 bp, Homo sapiens
tctcaacacattcccctgcatcacaggcggaaatgggtgggacactgtcatttaaataatacaaatttctttcacttgaaagaaagtctgtgggtttttttcttatgtttttcttggccattgacaataatatgtccacttgtggttttaaaaaaattacagacctgtgtcatgtaggaagtgaaattccttgctatttta

SEQ ID NO: 35354 - DNA, 201 bp, Homo sapiens
ccctgcgatgggcatttgggctccttctgtgttatgaacagaaggcctcaatacctctttttttttttttttttttttttttttgagacagagtctcactytgttgcccaggctggagtgcagtggtgccaccttggctcactgcaacctccgccacccgagttcaagcgattctcctgcctcagcctcccaagtagctgg

SEQ ID NO: 35355 - DNA, 201 bp, Homo sapiens
gagtacagtggtgcagtcctggctcactgcaacctccgcctcccaggttcaagtgattttcctgcatcagcctcctgagtagctggaattacaggcacacrccaccacgcccagctgatttttgtatttttagtagagacggggtttcactgtgttggccaggctgttcttgaactcctgacctcaagtgatccccctgcc

SEQ ID NO: 35356 - DNA, 201 bp, Homo sapiens
cagcaacaagggcagggatttctatgagtctccctcctgacaaccctactaggtagggatcattattccctttgagcaggaggaaacggaagctcagaggmtgatactgaacggagtgcctacttgttccaggggcttcataattatttagctcccacaactgcgctggggagtgacttagggtcagctgcattttacagc

SEQ ID NO: 35357 - DNA, 201 bp, Homo sapiens
catttacaaacatgtgtgccacgcttttcccgttctgccccatagaatcaccctttatcctctggtctgtactatgcttttttttttttttttttttttttaatatggcaacagagtttgttccatatcggctcacagaggagttgcattcactgtattggtgctccagtatttatgttgccactctgttgaatgtacagc

SEQ ID NO: 35358 - DNA, 201 bp, Homo sapiens
aagcacctggtcaagcccaagagtgaagtaggcatgggagactggtttctccctttcccctttgccccacttccccagggcacctctcagcaaagccaaayatgttggcgaaaataaatgagcaagaaccgtgtacaagatccctgcccttggccaggtgcggtggctcatgcctgtaatcccagcactttgggaggccga

SEQ ID NO: 35359 - DNA, 201 bp, Homo sapiens
gcatttacaaacatgtgtgccacgcttttcccgttctgccccatagaatcaccctttatcctctggtctgtactatgcttttttttttttttttttttttttaatatggcaacagagtttgttccatatcggctcacagaggagttgcattcactgtattggtgctccagtatttatgttgccactctgttgaatgtacag

SEQ ID NO: 35360 - DNA, 201 bp, Homo sapiens
atgtctttaggggtggagggcgtccttcagcctgccacagatggcaaagtcatgccattgtggctgcagctccattgtccaggctgagtgtgggggcgcayggcgtggttctcatgcccaccacctaccctgaccctgcggaggtgggcaggaggcagcgataatcaccacgtgcagaggtcctgccaggtgcccagcctc

SEQ ID NO: 35361 - DNA, 201 bp, Homo sapiens
agcctcccaaagtgttggaattacaggcgtgagccaccgcacctggctgaggcctgggttcttaccagcaggccagcgattccttttttttttttttttttaattattatttatttattttagagacagggtcttgctctgtggcccaggctggagtgcaattgtgcgatcatagctcactgtagcctcgacttcctgggc

SEQ ID NO: 35362 - DNA, 201 bp, Homo sapiens
agattcctatcttgagatcatgtccatcagttatacgaattcccctacacagtctctcccctattttcggctcagggtagcgggaggtgatcgtctgctcyttgccccaagctggttttcccagcctctgctttctatcttgttatttcagaagaccagtcagggaagagccactctccctagtccaaggaggacaaccaa

SEQ ID NO: 35363 - DNA, 201 bp, Homo sapiens
gccgagatcacgccactgcactccaacctgggcaacaagagcgaaactctgtcttaaaaacaaacaaacaaacaaaaatcactgtgcatttatttccccaycactggctacagaaagcctagcaatactcccaaaggtcaggaaccagcagcagaggtggggccacttcctcctctctaagcctcctctgatgttagggac

SEQ ID NO: 35364 - DNA, 201 bp, Homo sapiens
ggtggaacacctgaggtcaggagttcaacaccagcctggccaacatggtgaaaccctgtctctactaaagatacaaaaactagctgggcgtggtggcacaygcctgtaatcccagctactctggaggctgaggcaggagactcgcttgaacccgggaggcggaggttgcagtgagccgagatcacgccactgcactccaac

SEQ ID NO: 35365 - DNA, 201 bp, Homo sapiens
ggctcggctgagtcagaggcaggtggaacacctgaggtcaggagttcaacaccagcctggccaacatggtgaaaccctgtctctactaaagatacaaaaaytagctgggcgtggtggcacatgcctgtaatcccagctactctggaggctgaggcaggagactcgcttgaacccgggaggcggaggttgcagtgagccgag

SEQ ID NO: 35366 - DNA, 201 bp, Homo sapiens
acctgtcactgtggccctctagtcaaagcaggggcttatgaaggtcacgtgacccacgagttttcactcaggtccttctcacagtgtgtccagtgggtccytgagcccatcctgcggctattttcccagctccaggtgcataattggaacagacatatgagcagctgacagaatcccacattgatttcctgatggtgggaa

SEQ ID NO: 35367 - DNA, 201 bp, Homo sapiens
ccagggtaactgcgctgggaaaggaaataatcagatatcccagggactactggacactggctctgaactgatactgacaccaggagacctcacctgtcacwgtggccctctagtcaaagcaggggcttatgaaggtcacgtgacccacgagttttcactcaggtccttctcacagtgtgtccagtgggtccttgagcccat

SEQ ID NO: 35368 - DNA, 201 bp, Homo sapiens
tggtctcgaactcctgacctcaagtgatctgcctgcctcagcctcccaaagtgctgggattacaggagtgagccaccgtgcctggccacagcagcgtgcgyttttatatttatattttccttcctggggaaagaggggctctgtgggcaaaataacctgctgggaacccaccggacccaggtgagcaggggcatcggatgc

SEQ ID NO: 35369 - DNA, 201 bp, Homo sapiens
ccagctaatttttgtattttttttttagtagagacagagtttcaccatgttggccaggctggtctcaaactcctgacctcaggtgatccacctgcctcggscttccaaagtgctgggattacaggcgtgagccattgcgcccagcccaaaataacccctcatctacagtactggggtttaaatggtagaaattcatttcag

SEQ ID NO: 35370 - DNA, 201 bp, Homo sapiens
gagtcagttctctgaagagtctttttcatatatatcacatagatagagagataggcaggttggtaggtaggtagataggtcaataggtaggtaggtaggtagttagacataggtatctatctatctatctatctatctatctatctatctatctatctatctatctatctatcttactgtagtttagcacagacattggtt

SEQ ID NO: 35371 - DNA, 201 bp, Homo sapiens
cagagtcagttctctgaagagtctttttcatatatatcacatagatagagagataggcaggttggtaggtaggtagataggtcaataggtaggtaggtaggtagttagacataggtatctatctatctatctatctatctatctatctatctatctatctatctatctatctatcttactgtagtttagcacagacattgg

SEQ ID NO: 35372 - DNA, 201 bp, Homo sapiens
ctacagtactggggtttaaatggtagaaattcatttcagcactttctgagtgcgtcttatctaataatactttatagccatttggtgaggacttactggargccgactgtatactgggcccaagtcagacctggggagtgcctgggtcccctgggcccctcctctgccacctgatttcacagaacctcatggaaacttgag

SEQ ID NO: 35373 - DNA, 201 bp, Homo sapiens
tgggaggtagaggttgcagtgagctgagattgcaccagggcactccagcctgggagatagagtgagattctgtctcaaaataagaataataataataatawggcagaggaaggaggaatttgcacctttttccttgcctgcctgcttgagctgagacatctcctctcatcttctgctcttgcactgaaatttataccattg

SEQ ID NO: 35374 - DNA, 201 bp, Homo sapiens
gtgaggacttactggaagccgactgtatactgggcccaagtcagacctggggagtgcctgggtcccctgggcccctcctctgccacctgatttcacagaayctcatggaaacttgagtgtgcagaactaagagaattctatatcctgccgtctgctaccggagaactggctggaacccgaagggggagaccacctggaagc

SEQ ID NO: 35375 - DNA, 201 bp, Homo sapiens
tgcaggaggcaatacaagtccagtctagtaggaatttgctttgggtggcttttaccttaaaaaaatggttattatttgaatgatgcatttcacccgagcaygtctgtggtacgtgcctgcctccatgtctctcggtttggagcctggaggtgggaggagggaggtgagctttcttccatcattccttggtgtctccattgc

SEQ ID NO: 35376 - DNA, 201 bp, Homo sapiens; identical to SEQ ID NO: 9022

SEQ ID NO: 35377 - DNA, 201 bp, Homo sapiens
gtgcttattgtgacctcaggacctttgcacacactggtcttccttcctggaatgcttttcccctgcagggccagcttctcatcattcaggcttctgcacakatgtctccttccctgcccacccccaccccaggcacgctgcagagcttcctacagtgtggggtggccaagcactccaggccccctctttccttttggtcag

SEQ ID NO: 35378 - DNA, 201 bp, Homo sapiens; identical to SEQ ID NO: 9023

SEQ ID NO: 35379 - DNA, 201 bp, Homo sapiens
caggctgctcctctgtcgagctgatcacacccacagttgagctgcgctggccagagatgcctgcccacagcctggtgatgagcagcccggccctcccggcyttcctgctctgcagcacgctgctggtcatcaagatgtacgtggtggccatcatcacgggccaagtgaggctgcggaagaaggtatgtgcctccctggggg

SEQ ID NO: 35380 - DNA, 201 bp, Homo sapiens
ttctccctgccttggctggtcctgggatatgggatccgggcatcaagtagaacagctgcattcactcattgaatccttcccagaggaccgaatgtggcccrgagctgagcatgagatccccgccacagccctgagggcaggggaggcgccatagtcatcctgttttctaggtgaggaacctgggctcagagaggagacatc

SEQ ID NO: 35381 - DNA, 201 bp, Homo sapiens
cggtttgaactccagtgtccagcttcagagcccacatcctgtcttggaggcgggggtttctgttttgttttttttttctgctgtccaggctggagtgcagyggcatgatctctgcttactgcaacctccacctcctgggttcaagcaattctactgcctcagcctccccggtagctggcattacagacacacaccaccatg

SEQ ID NO: 35382 - DNA, 201 bp, Homo sapiens
gctggagtgcagcggcatgatctctgcttactgcaacctccacctcctgggttcaagcaattctactgcctcagcctccccggtagctggcattacagacrcacaccaccatgccctgctaatttttgtatttttagtagagatggggtttcaccatgttggccaggctggtcttgaacccctgacctcaggtgatccacc

SEQ ID NO: 35383 - DNA, 201 bp, Homo sapiens
tgcaacctccacctcctgggttcaagcaattctactgcctcagcctccccggtagctggcattacagacacacaccaccatgccctgctaatttttgtatktttagtagagatggggtttcaccatgttggccaggctggtcttgaacccctgacctcaggtgatccacccgcctcagcctcccaaagtgttggaattaca

SEQ ID NO: 35384 - DNA, 201 bp, Homo sapiens
ggtgccaccacacccagctaattttttgtatttttagtagagagggagtttcaccatgttagctaggatggtctcaatctcttgacctcatgatcctcctrcctcagcctcccaaagtgctgggattacaggagtgagccacggcgcccggcccagacggctttactctgagtgagattgggagccactgcggtctttgct

SEQ ID NO: 35385 - DNA, 201 bp, Homo sapiens
ccggtagctggcattacagacacacaccaccatgccctgctaatttttgtatttttagtagagatggggtttcaccatgttggccaggctggtcttgaacycctgacctcaggtgatccacccgcctcagcctcccaaagtgttggaattacaggcgtgagccaccgcacctggctgaggcctgggttcttaccagcaggc

SEQ ID NO: 35386 - DNA, 201 bp, Homo sapiens
caacatggcaaaaccccgtctctactaaaaaatacaaaaagtagctgggcatggccaggcacagtggctcacacctgtaatcccagcattttgggaggccraggtgggaggatcacctgaggtcaggaattcaagaccagcctggccaatatggtgaaactttgtttctactaaaaatacaaaaattagctgggcgtggtg

SEQ ID NO: 35387 - DNA, 201 bp, Homo sapiens
cttaccagcaggccagcgattccttttttttttttttttttaattattatttatttattttagagacagggtcttgctctgtggcccaggctggagtgcarttgtgcgatcatagctcactgtagcctcgacttcctgggctcaggtgatcctcccacttcagcctcccaagtagctgggactataggtgtgcgtcactgc

SEQ ID NO: 35388 - DNA, 201 bp, Homo sapiens
cagcatggctcactgcagccttgaacacctggggtcaagtgtagctgggactacaggtgcgcaccatcatggccggctaatttttttttttttttttttttggtagagacagggtctcactgtgttacccaggctggtctcacacttctgcagtcaagggaccctcccgccctggcctcccaaagtgttggaatgacaggt

SEQ ID NO: 35389 - DNA, 201 bp, Homo sapiens
tcctagcggcttctccaggtctccctctcactcgtcacacagcacatgagctgtgatttctcctgagttttcagagttcaggatcctgtggttaatcagcrcggagctgggttttcagcctggggctctcaagaccttctcatggcttttagtgcaaagtccaaattcttcaggtgctgccaggacccctgatgacccctg

SEQ ID NO: 35390 - DNA, 201 bp, Homo sapiens
gtttcattcttgtcactcaggctggagtacaatggtgtgatctcggctcactgtaacctccacctcctgggttcaagtgattctcctgcctcagcctcccragtagctggaattacaggcacccaccaccatgcccggctaatttttttgtatttttagtagagatggggtttcaccatgttggccaggctggtttcgaac

SEQ ID NO: 35391 - DNA, 201 bp, Homo sapiens
aatgcatctttcaagcctcagattgtttgttttattttttttggagacagagtctggctctgttgcccaggctggagtgcagtggcaagatcacggctcaytgtagcctcgacctcccaggctcaagcaatcctcctgcctcagccctcctgccaagtagctgggaccacaggtgtgtatcaccacacacagctaattttt

SEQ ID NO: 35392 - DNA, 201 bp, Homo sapiens
caggagaattacttgaacctgagccaagatcatgacactgcactccagcctgcagcctgggcaacagagcaagactcaaaaaacaacaacaaaaaaaaaaacaaaaaaaaaaaaacacaaacaagtcataaagtgctgtccgagtgacaaaggccctcagggaaaggggtggtgcttcttgtggaatggaggttgttttgg

SEQ ID NO: 35393 - DNA, 201 bp, Homo sapiens
acagggtgatgatgctggtataaaatataaagcacctaaagggtgtctggccattaggaggtgcctaacaaatgacaccattgtttgctgttttttttgtkttttttttgacagagtttcactcttgttacccaggctggagtgctatgacgaaatctcggctcactgcaacctccgcctcccaggttcaagcgattcttc

SEQ ID NO: 35394 - DNA, 201 bp, Homo sapiens
gaggctgcggaagaaggtatgtgcctccctgggggtccccggcctgggtcatacttgcttctctccacgtcctgtcaggaaagccccgggatagggaaacrtggccaaggtgtgtgcagggctgggaggtgagcacctcttccagccccgccggggggcttcctgccagtcccacgtgtcagcaaggcctgcaccttctcc

SEQ ID NO: 35395 - DNA, 201 bp, Homo sapiens
gaactcaaacctcagctctctcagctctgcctgggggtcaagagcatgggctctggctggagccaactacatctctgtccagatctgttattcttaggtahggtcattcactggcttgatcctttatctccctctgtaacatgggcctgataatgctccacagtacagggtgatgatgctggtataaaatataaagcacct

SEQ ID NO: 35396 - DNA, 201 bp, Homo sapiens
tgctttaattttttctgtccctgtcttgaaattctcttttttttttttttttttttgagacggagtctcgctctgtcgcccaggctggagtgcagtggcaygatctcggctcactgcaagctccgcctcccaggttcacgccattctcctgcctcagcctcccgagtagctggaactacgggtccccgctatcacgcccgg

SEQ ID NO: 35397 - DNA, 201 bp, Homo sapiens
gcacgaagaaggaacccctaggcttgctttaattttttctgtccctgtcttgaaattctcttttttttttttttttttttgagacggagtctcgctctgtygcccaggctggagtgcagtggcacgatctcggctcactgcaagctccgcctcccaggttcacgccattctcctgcctcagcctcccgagtagctggaact

SEQ ID NO: 35398 - DNA, 201 bp, Homo sapiens
gtagataggtcaataggtaggtaggtaggtagttagacataggtatctatctatctatctatctatctatctatctatctatctatctatctatctatctatcttactgtagtttagcacagacattggttaagtcatgtcactcctctgaacctcaattttctcatctctaaaatggggatattaggccgggcgaggtag

SEQ ID NO: 35399 - DNA, 201 bp, Homo sapiens
caccattgcactccagcctgggtgacagagcaagactctgcctctaaaaaatataaaataaaataaaataaaatagagataataatagacccacctcctakgattgctacatgagggcaatgaactgatctacataaagcaccaagcatagtgtctggcaggtaaagttggccagtaatgtcatcaacattgttatataat

SEQ ID NO: 35400 - DNA, 201 bp, Homo sapiens
ggtttcgccatgttggccaggctggtctccaactcctgacttcaggtaatccacgtgcctaggcctcccaaagtgctgggattacaggcgtgagccaccaygcccaacctgttttgttttttaaattcaagatctaatcaaggattaaaccttgcatttcgttgtcttgggaagccagaacccagactgaattgaatccag

SEQ ID NO: 35401 - DNA, 201 bp, Homo sapiens
ggtgattagggtttgataaggtcatgagggtggggccctcaagattggatcagtacccttataaaaagagacaccagggaacttccttctactctctctcrccatgtaaggacacagtgagaaggcacctggatcttggacttcccagtctccacaaacataagaaataaattcctgttgtttaagcacccaatctgtggc

SEQ ID NO: 35402 - DNA, 201 bp, Homo sapiens
tggctcacaggcgtgagccaccacacctggcttgttttagagatggggtcttgctatgttgcccaggctggttttgaactcctgggctcaagcaatccccytgccttggccttccgaagtgctgggattactggtgtgagccacctcatccagccctaagcctcagctttcatgtcactgcctcagagaaactttctcaga

SEQ ID NO: 35403 - DNA, 201 bp, Homo sapiens
ccgctgccgtggggcggggcgtgggcggtgctggctgcaggaaggctctcccctcccactttgtgctttccctgcaggctgctcctctgtcgagctgatcrcacccacagttgagctgcgctggccagagatgcctgcccacagcctggtgatgagcagcccggccctcccggccttcctgctctgcagcacgctgctggt

SEQ ID NO: 35404 - DNA, 201 bp, Homo sapiens
cttccacgcctccgtgaatgaatgaatgaatgaacacatgttctactaccagactttgtttttcagaaatatagcaaccctttggaaaaatcataggtccygtcactaacaagttgaatttagttatcaagtcactttcttggttagagaagaggaaaggggaggaggagatgggaagaggaggagggaggagggaggatg

SEQ ID NO: 35405 - DNA, 201 bp, Homo sapiens
catagctcactgcagcctcgagcttctgggttggagcaatcctcctgcttcagcctcccgagtagctgggactataggcctgtgccaccatggccggctarctttttgtttctttgtagagatggggtctcgaactcctggtctcaaacagtctttctgccttggcctcccaaagtgctgggattacaggtgtgagccact

SEQ ID NO: 35406 - DNA, 201 bp, Homo sapiens
cagaggttgcagtgagccaagatcacaccattgcactccagcctgggtgacagagcaagactctgcctctaaaaaatataaaataaaataaaataaaatasagataataatagacccacctcctaggattgctacatgagggcaatgaactgatctacataaagcaccaagcatagtgtctggcaggtaaagttggccagt

SEQ ID NO: 35407 - DNA, 201 bp, Homo sapiens
gccgtgccttcttcttaacaggtgagacaccctggccttccctggttcataggcaactcccccatcggactgtgagcttcataaaagcagagacagggggrccttttcatggtgagctaccagcccctggcacagggtaggaatcgtggatgatggttggatgggtgtgtgtgcaactgcacctctgtcctgccactgtga

SEQ ID NO: 35408 - DNA, 201 bp, Homo sapiens
ggctcacagaggagttgcattcactgtattggtgctccagtatttatgttgccactctgttgaatgtacagcccataacttccctaaccaattcccctgcratgggcatttgggctccttctgtgttatgaacagaaggcctcaatacctctttttttttttttttttttttttttttgagacagagtctcactctgttgc

SEQ ID NO: 35409 - DNA, 201 bp, Homo sapiens
tttgggctccttctgtgttatgaacagaaggcctcaatacctctttttttttttttttttttttttttttgagacagagtctcactctgttgcccaggctrgagtgcagtggtgccaccttggctcactgcaacctccgccacccgagttcaagcgattctcctgcctcagcctcccaagtagctggggctacaggcgtgc

SEQ ID NO: 35410 - DNA, 201 bp, Homo sapiens
agttgaacatcttttcatatgcttaacatccccctggtcaattaaaatgaatttcctcattataaaaatcagaactcattacagacgatttgggtaatacygaaaaaacacagagacagaaaggaaaaccactcacagttctaatcacagttcacacttgcatctctctcctctttgtcttctatagctaaatattttcca

SEQ ID NO: 35411 - DNA, 201 bp, Homo sapiens
tcttctatagctaaatattttccataaaattaggcatgcattaggtacacccaatttggagttctgattttcttttattaacattattttgcgaacacttyccatgttggtaaatgttactaaaaaaattattcttgaccagatgtggtggctcatgcctataatcccaacattttcgagggccggcagatcacttgaggt

SEQ ID NO: 35412 - DNA, 201 bp, Homo sapiens
gtttctgctctgccatcttttaccagttagctggagagtgaggcgatggcactccaggggttggggtcatcggaagagcttgaaggggaagtggggaggayggagagctggacaggctgaggccggagacaaactgtctcatgggtctcaacacattcccctgcatcacaggcggaaatgggtgggacactgtcatttaaa

SEQ ID NO: 35413 - DNA, 201 bp, Homo sapiens
atcacagtcagctccaggaattcccctgcatttaacgcacacgttcaggccgtctgtctttccacaaatatttaccaagcacagctctgggcgcacaccaygctaggcactgtaaattcagccataaacaagacagaagctcagtttcagttttctcttaccataaaactaaccatcttcaagtgtgcaattccatgtcat

SEQ ID NO: 35414 - DNA, 201 bp, Homo sapiens
gcttcctacagtgtggggtggccaagcactccaggccccctctttccttttggtcaggcccacacaccatcgcactggcccaagaatcgtcttgccagtgrgagggaagaggaggaccctgcagcgggtccccactcagtgctgctagtctgggcctggcccgaggagacggtgttattggtggaatgtatgtcagcagga

SEQ ID NO: 35415 - DNA, 201 bp, Homo sapiens
cgcactggcccaagaatcgtcttgccagtgagagggaagaggaggaccctgcagcgggtccccactcagtgctgctagtctgggcctggcccgaggagackgtgttattggtggaatgtatgtcagcaggaaggcccggagaacatgcttctgttcctgcacctcacacgcgtggcctgtccttgggggaggtcatgccct

SEQ ID NO: 35416 - DNA, 201 bp, Homo sapiens
tccgcccccaccacacatatgcacatgcttgattcctttcaacagaaaaagaggcaggaaaggatgtgtaaaatgaagagcttcaccgggggctggccatyggttggctccagtgagtgggagcggatcttgttatgattgtccctgaaaggacaggtggtagttagatttagggggaaaaggagacagagcccggcattc

SEQ ID NO: 35417 - DNA, 201 bp, Homo sapiens; identical to SEQ ID NO: 9016

SEQ ID NO: 35418 - DNA, 201 bp, Homo sapiens
cataaataaaatacaaaaattagccaggcgtggtgaaatgcgcctgtaatcccagctactcaggaggctgaggcaggagaatcgcttgaacctgggaggtrgaggttgcagtgagctgagattgcaccagggcactccagcctgggagatagagtgagattctgtctcaaaataagaataataataataataaggcagagg

SEQ ID NO: 35419 - DNA, 201 bp, Homo sapiens
agcagtgtggggtcacgagcctctggcccttatcagggagtctggggctgtgggtcacgccgggatgggcttggcatggctggctttgtttcctaagaggrcctctggctctgccgtgggagggcagggggtgtggacagccaggcagtggacacagtgggcagtggcatggctcttgcttccccagtggcttggacagtc

SEQ ID NO: 35420 - DNA, 201 bp, Homo sapiens
aagaaaaaagtataaaaattaaaaaacaggccaggcccggtgactcacgcctgtaatcccagcactttgggaggccgaggcaggcggatcacgaggtcagragttcgagaccagcctggccaacatggtgaaacctgtctctaaaaaaaatacaaaaattagctgggcatggtggcgcatacctgcagtcccagatacttg

SEQ ID NO: 35421 - DNA, 201 bp, Homo sapiens
tgtggaaaatgacaataacccaatctagatcggactatgaatggcccagacccttcaggaatgaaggtttgggtgtcactccacccagataaagaatcacractggctgggtgtggtggctcacacctgtaatcccagcaatttgggaggctgaggcgggagcatcacatgaggtcaggagtttgagaccagcctggccaa

SEQ ID NO: 35422 - DNA, 201 bp, Homo sapiens
atggtacttctcagctgccgtaatcacatgagccaattatatggcatagtaaatctatctatctatctatctatctatctatctatctatctatctatcthtttatctctctatctctctatctatctgcatttccttgacacagggtcttactctgtcatccaggaagctggagtgcagcagtgcaatcactgctcactg

SEQ ID NO: 35423 - DNA, 201 bp, Homo sapiens
catcttccgaactgaccagaggcagagtgggaattggtaccgagtgcaagatgacctcaggcactggcggggttcttcctgacctcatcccccacgcctgyggccccccacgcctgcagcccatcttcctcccaactccccccagatttagctcaactcctgggggctgtctcctccttcctgaccctggagttgggggca

SEQ ID NO: 35424 - DNA, 201 bp, Homo sapiens
caaaaggcaggttgggcacagtggctcacgcctgtaaccccagcactttgggaagctgaggcaggtggatcacttgaggtcagaagttcaagaccagcctrgccaacatggtgaaaccccgcctctactaaaaatacaaaaatttggctgggtgcagtggctcacgtctgtaatcccagcactttgggaggctgaggcggg

SEQ ID NO: 35425 - DNA, 201 bp, Homo sapiens
gaactgaccagaggcagagtgggaattggtaccgagtgcaagatgacctcaggcactggcggggttcttcctgacctcatcccccacgcctgtggcccccsacgcctgcagcccatcttcctcccaactccccccagatttagctcaactcctgggggctgtctcctccttcctgaccctggagttgggggcactgggaag

SEQ ID NO: 35426 - DNA, 201 bp, Homo sapiens
cagattacacattgtctctgggtatgtctgtgaggctgtgattggcatttgaatccacagacacaatacagtgccctccccagtggcagtgggcatcgtcyaatctgttatgggcttgaataaaacaaaaggcaggttgggcacagtggctcacgcctgtaaccccagcactttgggaagctgaggcaggtggatcacttg

SEQ ID NO: 35427 - DNA, 201 bp, Homo sapiens
tgttaggtggaattatgactttgctttgtctttacttggagattaagtacggtttaggaaatgtctacagggtacctagttgacaaggggtggacttgtgrtggttagtcttttgggtcagtttcattggccaaaggtgcccagattacacattgtctctgggtatgtctgtgaggctgtgattggcatttgaatccacag

SEQ ID NO: 35428 - DNA, 201 bp, Homo sapiens
agactgtgattgtcatcagtttttcctctttatttttctctgcatgtgtgtctgtgtgtgtgtgtatatatatatatatatatatatatatctttgtttcytttcctctcttactctcttatcatgtaacataagatgtattgattttatatcatagtatttaagctatgggatatcaaggagaagcgtaaacatcactct

SEQ ID NO: 35429 - DNA, 201 bp, Homo sapiens
accagctataaccatgtggtcagccacagaaacagagactgtgattgtcatcagtttttcctctttatttttctctgcatgtgtgtctgtgtgtgtgtgtrtatatatatatatatatatatatatctttgtttcttttcctctcttactctcttatcatgtaacataagatgtattgattttatatcatagtatttaagc

SEQ ID NO: 35430 - DNA, 201 bp, Homo sapiens
taccagctataaccatgtggtcagccacagaaacagagactgtgattgtcatcagtttttcctctttatttttctctgcatgtgtgtctgtgtgtgtgtgkatatatatatatatatatatatatatctttgtttcttttcctctcttactctcttatcatgtaacataagatgtattgattttatatcatagtatttaag

SEQ ID NO: 35431 - DNA, 201 bp, Homo sapiens
ctacttgggagactgaggtgggaggatcgcttgagcccgggaggtcgaggctgcattgagccaaaatcgtaccactgcactccagcctgggtgacaaaaaraaaaaaaaaaaaaaaaaaacatgaccagctgaggtgcttgctgaaggcaaaggttgtacagaaccagtagtggaagaaggtggttttaaataccagctat

SEQ ID NO: 35432 - DNA, 201 bp, Homo sapiens
cccctcccactttgtgctttccctgcaggctgctcctctgtcgagctgatcacacccacagttgagctgcgctggccagagatgcctgcccacagcctggwgatgagcagcccggccctcccggccttcctgctctgcagcacgctgctggtcatcaagatgtacgtggtggccatcatcacgggccaagtgaggctgcgg

SEQ ID NO: 35433 - DNA, 201 bp, Homo sapiens
agaatcacgactggctgggtgtggtggctcacacctgtaatcccagcaatttgggaggctgaggcgggagcatcacatgaggtcaggagtttgagaccagyctggccaacatggagagaccccacctctaccaaaaatacagaaactgcgtgcctgtggtcccagctacttgggagactgaggtgggaggatcgcttgagc

SEQ ID NO: 35434 - DNA, 201 bp, Homo sapiens
cattgcactccagcctggtgacagagcgagactctgtctcaaaaaaaaaaaaaaccaacaaacaaaaacaaaacaaaacaaattagccgggcgtggtggcrggctcctgtagtcccagctactcaggaggctgaggcaggagaattgcttgaacctgggaggcggaggttgaagtgagccgagattgcatcgctgcactcc

SEQ ID NO: 35435 - DNA, 201 bp, Homo sapiens
ttgccaaccccgaggatgccctgagacacggaggcccccagtattgcaggagcgaccccgacgtggaacgctgcctcaggcaagtacttcgggcccctggyctggccacacctggccatggcctgccctttcagaacttcttctgcacacaggggacttggaggactcccaggggctgaggttttctgtgttcctgatctt

SEQ ID NO: 35436 - DNA, 201 bp, Homo sapiens
gccgtttgtctcacgaggagtgactctcaactggtatatttcaggcctttgccaaccccgaggatgccctgagacacggaggcccccagtattgcaggagygaccccgacgtggaacgctgcctcaggcaagtacttcgggcccctggcctggccacacctggccatggcctgccctttcagaacttcttctgcacacagg

SEQ ID NO: 35437 - DNA, 201 bp, Homo sapiens
gctgaggcaggagaattgcttgaacctgggaggcggaggttgaagtgagccgagattgcatcgctgcactcctgcttggatgacagagtgagactccttcyccaaaaaaaaaaaaaaaaaagtaatctagacttgttggtaagacatttgcatgtcaaggttagaaataaatatgagtaaaattcagagttctttatcagc

SEQ ID NO: 35438 - DNA, 201 bp, Homo sapiens
catggagctaataagcaccacagcagaactggaggtttccagcctaatactcccttccggctgcaccacgaagtactcaaaaaaaattttttttttttttkagatggactttcactcttgttgcccaggctggagtgcaatagcgtggtttcggcttgctgcaacctccgcctcccgggttcaagtgattcttctgcttca

SEQ ID NO: 35439 - DNA, 201 bp, Homo sapiens
ggcgggcagagagcctaagctcaggagttcgagaccatcctgggcaacatggtaaaaccgtgtctctactaaaatacaaaaaattaaccagatgtgacggygcacgcttgtagtgccagctactcaggaggctgaggcacaagaattgcttgagccggggaggcagagctttcagtgagcagagatcgcgccactgtactc

SEQ ID NO: 35440 - DNA, 201 bp, Homo sapiens
gtagatgcaggatttcaccatgttggctaggctggtcttgaactcctgacctcaagtgatccgcctgcctcggcctccccaaagtgttgggattacaggcrtgagccacctcgcccggtcttttttttttttttttttttttgtgacagggtcttgctctgtcgcccaggctggagtgcagtggaatcccggctcactgat

SEQ ID NO: 35441 - DNA, 201 bp, Homo sapiens
cagcagctgtccctgtcctggccatctggggatcactgtcctcaccgctgtcacctatgcaggaaaatgcagctggtgtggaaaagtctgtggagggtgarggcaggcctgatgctgcaggaggcaatacaagtccagtctagtaggaatttgctttgggtggcttttaccttaaaaaaatggttattatttgaatgatgc

SEQ ID NO: 35442 - DNA, 201 bp, Homo sapiens; identical to SEQ ID NO: 9018

SEQ ID NO: 35443 - DNA, 201 bp, Homo sapiens; identical to SEQ ID NO: 9019

SEQ ID NO: 35444 - DNA, 201 bp, Homo sapiens
gttgcccaggctggagtgcagtggcgcgatgttggctcactgcaacctctgtctcccgggttcaagagattcccctgcctcagcctcccgagtagctgggmctacaggcgcctgccaccacgcctgactgatttttgtatttttagtagagatggggtttcaccatatcagccaggatggtctcgatctcctgacctcgtg

SEQ ID NO: 35445 - DNA, 201 bp, Homo sapiens
gatttgcctgaggccatggagctaataagcaccacagcagaactggaggtttccagcctaatactcccttccggctgcaccacgaagtactcaaaaaaaawtttttttttttttgagatggactttcactcttgttgcccaggctggagtgcaatagcgtggtttcggcttgctgcaacctccgcctcccgggttcaagtg

SEQ ID NO: 35446 - DNA, 201 bp, Homo sapiens
ttggtgccttacacttgtaatcccaggactttaggaggctgaggcgggtggatcacttgagaccaggagttcaagaccagcctggccaacatggaaaaacyctgtctttactaaaaaataaaaaattagccacgtgttatggcacatgcctgtaatcccatctagtcgagaggctgaggcacaagaatcgcttgagcctga

SEQ ID NO: 35447 - DNA, 201 bp, Homo sapiens; identical to SEQ ID NO: 9066

SEQ ID NO: 35448 - DNA, 201 bp, Homo sapiens
aattatagcatatcatccttataatattgccatacacatatacaaagttttattataaatcagttgttgaaaatatttttgaaagtcaaatatattacagmtgcacactcaatagtgaaactaagataatcatttgagggcatatatcctttacagtgatttcttaaaactgtattcaaatgtaggtctaatgagtttttt

SEQ ID NO: 35449 - DNA, 201 bp, Homo sapiens
tctgctattttgtcttcaaatattttttttcttctgcacccacttccccagtgcacgcacgtgcacacccacacacacacacacacactctctctctctcactcactcactcgcttactcactatgtctcttcgtggaactccagttattcaccttttatggtgcttaaaaagtcacttacactctacgtttgtttttaag

SEQ ID NO: 35450 - DNA, 201 bp, Homo sapiens; identical to SEQ ID NO: 9068

SEQ ID NO: 35451 - DNA, 201 bp, Homo sapiens
ctctgctattttgtcttcaaatattttttttcttctgcacccacttccccagtgcacgcacgtgcacacccacacacacacacacacactctctctctctcactcactcactcgcttactcactatgtctcttcgtggaactccagttattcaccttttatggtgcttaaaaagtcacttacactctacgtttgtttttaa

SEQ ID NO: 35452 - DNA, 201 bp, Homo sapiens; identical to SEQ ID NO: 9069

SEQ ID NO: 35453 - DNA, 201 bp, Homo sapiens
ctgggttcatgccattctcctgcctcagcctcccgagtagctgggactacaggtgcccgccaccacacctggctaatttttttgtatttttagtagagacrgggtttcaccgtgttagccaggatgatcgcgatctcctgacctcgtgatctgcctgcctcggcctcccaaagtgctgggattacaggtgtgagccactgc

SEQ ID NO: 35454 - DNA, 201 bp, Homo sapiens
agtcaggatttggcaatttactaggcgaggtagtctgtaggaattgaggggaagaccagtttccagcttggcctactggttgggtttggtttaatggctcytactgagatagagaatacaggaggagatcgtttagggagaaagttttatttaccttttgaacatacaaattttggagtaactgggatatttagttggaag

SEQ ID NO: 35455 - DNA, 201 bp, Homo sapiens
tattggggtgtgccaatagttgatttgaaaaatattgcatacatttaattttatgccttttaagcttctcccaaactttttatgaacttctgaggaaaaattttttttttcactttaaaaagggtacttttttttctttaaagaacaagaaaaaggacaggtatctgtaaaaggcatcaaagtagccctgtacttttcctg

SEQ ID NO: 35456 - DNA, 201 bp, Homo sapiens
atacattctcagcctcagacctggaaccagccatttccccagggaaatctagttctttttattggtgatagatatttacagaccaaaagctgggtgctgastatgctcattgccactgaaggtcattgtttctaagacttttcagtggaaaaaaggtagtacatgtattcaaagaattacgaatttgtaatgacaggtcag

SEQ ID NO: 35457 - DNA, 201 bp, Homo sapiens
tcgtgtaagattcagatttccatctggtattgttttactttgcctgaagaatttctttccatagttactctagtggtggtcaactggtggtgaattttcayggcccttattcatgtgaataaatttattttgccttaatttttgaaatacattttcattgagtatatctgggttgatgcttttttttttttcttcttctta

SEQ ID NO: 35458 - DNA, 201 bp, Homo sapiens
gaagttcagtggagggcaacaactaaaaaacacactaatttcagattttcaaaagtgtttaggaggattatataattatttgatcagaaaagaactggtcbctgtgactgtcttaaatatttaggtagtttgttattctcttaggaattatgaattagattaggttaagggatggggccagatttgcagaatgtttcagat

SEQ ID NO: 35459 - DNA, 201 bp, Homo sapiens; identical to SEQ ID NO: 9072

SEQ ID NO: 35460 - DNA, 201 bp, Homo sapiens
cagctctgttcttttcttcctctggcagtaatggtaacagcagtagctggagcagtcttggtttagaaggagatttgtatgaggacaatttatcctttccracatcagacaggttggtccagtctagaaacttaaaaactgatgagtctgtcaccactaatgcatgatgtcatattcttcaaagaatgtgggttacagtgc

SEQ ID NO: 35461 - DNA, 201 bp, Homo sapiens; identical to SEQ ID NO: 9074

SEQ ID NO: 35462 - DNA, 201 bp, Homo sapiens
ttttgtatttgaaattaaaattgtttttattatcttttatctttcccaagagtcatccttctggaatgctttgtgtcatgagagtgtcacctacatcaccragacttaggattgattttatctttagtctcctaagtaaatatgctactggtataaggtacaccttggacacattcttgcatcagaagcaccaacttgaga

SEQ ID NO: 35463 - DNA, 201 bp, Homo sapiens
tactgtcttccagttaccttctaatttgcaaagccttctgatttaccttctgatttgcaaagaaaaaaattttctttcagcatcccaggcttaaaaccttraagttatttttcacattcttctttttttatgctgtaatataccctgttagttaataggttctgtgtgggcttttgggtgcttcctatgactggcccatct

SEQ ID NO: 35464 - DNA, 201 bp, Homo sapiens
gcgttgaagaaaaagtagggagtcctaagtaaaggggatttacttagtctggggagttaggacgaaagttcctgaggaagtgacagtagagttgaaaggtkaaggattcttgggcattcagctgttaacagggatggacagagaaagaatattggatcctgaagaaacagcctgtggaaggtgatgaggcaggcagggtct

SEQ ID NO: 35465 - DNA, 201 bp, Homo sapiens
gtttgatttaggcagttattgacagagggactgatgtttgagattgggatcagcaaaggaaagcttcacagttacataaacagtggttgaagttcctgtasatatgataggcatacttttctttttccctcgtgctgcttcttaaaaatttgtgattcctacatatttccttttgtggcagtaaagtgtctcctcatagag

SEQ ID NO: 35466 - DNA, 201 bp, Homo sapiens; identical to SEQ ID NO: 9079

SEQ ID NO: 35467 - DNA, 201 bp, Homo sapiens
tgtataggtttgactgctaagtctaagaggatggcttccaaatctacaggatgcctgcaaaatagaaagtaaacttatccttaaacagtatgttaattacwtttttttttttgggacacagtttcgctctgttgcccaggctggagtgcagtggcgtgatcttggcttactgcaagctctgactcctgggttcatgccatt

SEQ ID NO: 35468 - DNA, 201 bp, Homo sapiens
gaaattattggaaacacaaatgtattttcacaaactcattaaatgtagacatactcatttaaatatttgaaggcatactttgctctttattctgttttatrtttttcagcctacatcatgctttgaactttgttctttaaatatgttactttttatttattagttcagcagatgtttgaatgcctactatgtaaaaataca

SEQ ID NO: 35469 - DNA, 201 bp, Homo sapiens
ctgaaatgcttgatgactcagttttcctatgcgtagaatgggcataatagcaccttctgtggtgagaattatgaattcatgtatgtaaagcaattaaacartgtctggcatatggcaggcacaatgcaagggtacggtattagtatttgttgagagcataccgtgtggcaggtactgtgatacaggcttctggtcgtgttc

SEQ ID NO: 35470 - DNA, 201 bp, Homo sapiens
tttgcatgagactttggtttgccatgatgccaacatcagactcactgactatgcaacatggttctcagcaaacatctccaagtctcagttatgtttctagrgagagaatccaattggtcaggtttctgcttctagcacagttggctggagagtgaggaaagataggaatgggaaaaatggatgaggaagagacttagattt

SEQ ID NO: 35471 - DNA, 201 bp, Homo sapiens; identical to SEQ ID NO: 9080

SEQ ID NO: 35472 - DNA, 201 bp, Homo sapiens
aatcccatctagtcgagaggctgaggcacaagaatcgcttgagcctgagagatgggagattgcagtgagccgagatcgtgccactgcactccaccctgggmgactgagtgagactctgcctcaaaaaacaacaacaaaaaacttctggagtaaaggcatttgaaatttgtagattagagactggacatggtaaaaggagaa

SEQ ID NO: 35473 - DNA, 201 bp, Homo sapiens; identical to SEQ ID NO: 9081

SEQ ID NO: 35474 - DNA, 201 bp, Homo sapiens
tttaattttcatctctaaaagttcaattttggtgtcttttgtatcttctccttctctccttatggtgatgttttcctctcacttcttgagtatatggaacrtatttgtactatagttttacaatccttttctgttcctgccatcatcactgtcatttctaggtcttcatttattgcctttttttctcttggttatggttca

SEQ ID NO: 35475 - DNA, 201 bp, Homo sapiens
gagttccgcattcagtatcaaaaggtgccagtgaatattagttagagaatgagtgactatctaaaacatctccaggatctcttacccttgtcttagaattraataaatttgaaatatctttgctttctttcccctgcagagcttcagtgaagatgtgttccagtctgtaaagtctttattgcagagtcagaaggaactatg

SEQ ID NO: 35476 - DNA, 201 bp, Homo sapiens; identical to SEQ ID NO: 9082

SEQ ID NO: 35477 - DNA, 201 bp, Homo sapiens
tgatagtcttgtaagttcagaatctgggatgctttcaatttgattttttttctttttttcttctttttagttcaaaagaaatagaagactttcagtcaacygagtctgtcagtagccagcagatgaacctcagtattggtgatgacagcactggtagctggtccaatttaagttttgaagatgaacaccaagatgaaagca

SEQ ID NO: 35478 - DNA, 201 bp, Homo sapiens
taagagtaagtgaacctggtatgagatctcacgtgatcttctagtgagttgaatgcccaggctccagtagtatgtgttttgggcatgtgaaactctgcctraaccttttcagctgaatggagcttttcttctcagtggaattgagttccgcattcagtatcaaaaggtgccagtgaatattagttagagaatgagtgacta

SEQ ID NO: 35479 - DNA, 201 bp, Homo sapiens; identical to SEQ ID NO: 9067

SEQ ID NO: 35480 - DNA, 201 bp, Homo sapiens
acagagtgtgaggatacatttaacagtatatgatgttcttgtcatgtgattggtctaacaagatgcctggtgatggttaaattcttaggctgtagtgtccwacagtttgggttcagacatcagctctgccactttctagcagtataaccagaggcaggttcaccagtctgtctcattgcccctaactgcactatgcaaatg

SEQ ID NO: 35481 - DNA, 201 bp, Homo sapiens; identical to SEQ ID NO: 9070

SEQ ID NO: 35482 - DNA, 201 bp, Homo sapiens
gttaagtactggtaatcatttgacttggatgtcttctgaaattttgtcaatggtatgctcttaagcttcctatacaaagaatgtatctaatttgatatgtrcagatttctcattcgtctattatcaaacccttctgcccaagaaataagaatgtcaagagcattcactgttgccatagagataagagtgtcttgggaggca

SEQ ID NO: 35483 - DNA, 201 bp, Homo sapiens; identical to SEQ ID NO: 9071

SEQ ID NO: 35484 - DNA, 201 bp, Homo sapiens
atcctgctctagtagctgttatcctttcttcccccatcaatctttgcatcatttccaaagatgatttttttctttgctttacaaaagtatgtcatatcatytcatattggattcacttttatgttgcacagatattctctaatagatttctttcttcctgagacagtattttatttatgtttaaatgaaaaagtggtggag

SEQ ID NO: 35485 - DNA, 201 bp, Homo sapiens
ggagattgcagtgagccgagatcgtgccactgcactccaccctgggcgactgagtgagactctgcctcaaaaaacaacaacaaaaaacttctggagtaaargcatttgaaatttgtagattagagactggacatggtaaaaggagaaaagttatcatttttagaataatctgagaatgtttcttgggaaataaatggggta

SEQ ID NO: 35486 - DNA, 201 bp, Homo sapiens
ggatgcatgaatttcttgtttgtttttttctctgagattgtcttatatctaggctttacttcatgttgttttgtatttgaaattaaaattgtttttattaycttttatctttcccaagagtcatccttctggaatgctttgtgtcatgagagtgtcacctacatcaccaagacttaggattgattttatctttagtctcct

SEQ ID NO: 35487 - DNA, 201 bp, Homo sapiens
tgacagcactggtagctggtccaatttaagttttgaagatgaacaccaagatgaaagcagcagttttcatcatctaagtgaaaggtaactacacttttgcrtataattgtgtagtttaggtcctcagatcttagaagtgagctataaatttacattattatttaaaaattctaaatttgaaaatatgctattactttcaaa

SEQ ID NO: 35488 - DNA, 201 bp, Homo sapiens
acagtaggagttcagatggatgttataagaggggacaggcagtatgttttaaggatttgggctcttcggcttggtgggaagccattggaaggttttgatcmgaagactgacattttttctttttatggaaacatcactttgaactactttgttgaacataaaatgtagtgggacaattaaaatagttgagcagtgaatgga

SEQ ID NO: 35489 - DNA, 201 bp, Homo sapiens; identical to SEQ ID NO: 9076

SEQ ID NO: 35490 - DNA, 201 bp, Homo sapiens; identical to SEQ ID NO: 9077

SEQ ID NO: 35491 - DNA, 201 bp, Homo sapiens
gcataacactaagctctcaaaggtagatgctattaataagcattgtgtgtgttcctatgaaaaaattgaattattctctgtatttaattgatttgtaattrtacctaatgattaatatatctgtttctctgataatccagtttcatttgtatgagcagctgtcataattaaaagccgataaaagtttaaacaagatgctta

SEQ ID NO: 35492 - DNA, 201 bp, Homo sapiens; identical to SEQ ID NO: 9078

SEQ ID NO: 35493 - DNA, 201 bp, Homo sapiens
agctcattgcaacctccacctccagggttcaagtgattctcctgtctcagcctcccgagtagctgggactataggcatgcaccaccatgcctggctaattktttgtatttttagtagagacgaggtttcaccatgttggccaggctggtcttgaactggcctcaagtgatccatccacctcagcctcccaaagtgctggga

SEQ ID NO: 35494 - DNA, 201 bp, Homo sapiens
ctgaactcctcaggattgcagaaaggcccagagaccatgccttgtaccatggtatgccaaacctatttttgattgagagtgttggagagaggggagggaaragacaatacatttatttttagagagtaatgtggaccaaatctttttaattaaaaattagggaccaacacaactcctaaaaataattaatagtggtctaga

SEQ ID NO: 35495 - DNA, 201 bp, Homo sapiens
tttgggaagttctctgctattttgtcttcaaatattttttttcttctgcacccacttccccagtgcacgcacgtgcacacccacacacacacacacacacwctctctctctcactcactcactcgcttactcactatgtctcttcgtggaactccagttattcaccttttatggtgcttaaaaagtcacttacactctacg

SEQ ID NO: 35496 - DNA, 201 bp, Homo sapiens
gatgttttaaaaattgcttctctagaagcaggcaaacagaaaatagctaaaaagaatttctcgaaatttactttatgacacctgaattttcagttagtttmacaccttgtttagggaagtcacatcccagtttttaagctgtaatcttcagacttaagattattattttttagttttaatgcctctgtaagtagacattct

SEQ ID NO: 35497 - DNA, 201 bp, Homo sapiens
ggcctcccaaagtgctgggattacaggtgtgagccactgcgtctggccaattacattttaaagtaatatgctccatatgttttgaggtaaattacctttamatttaataggtccactttttaatttgaaaaaagtacaataaaaactattttctgtttctactctttgtaaactatagtgtatttattatactttttcaga

SEQ ID NO: 35498 - DNA, 201 bp, Homo sapiens
atctagattgcttcgtatttctattgtgagttgtaatgaaccagactataaaacctttatgcactgtagaggagtggtgaagagccccagtgctggagttrgaaaatttggacttgaatcccacctgtgccatttatttactctgtgggcctgggcaaattgctaagcttcctcttgcctcagtttttctcatcgtcaaac

SEQ ID NO: 35499 - DNA, 201 bp, Homo sapiens
cctggaaatattaatatttttgtaaagtatattttgtcatagtttattatggtgctatataaaccaccaatatttcttaaaatctaggtccaaaaagacartgtttaaaactggtagaagcaagtgggggcaatgtcacaaatcatgatttggcccttttctataactttatctagaaaaggatactaacatttagtttct

SEQ ID NO: 35500 - DNA, 201 bp, Homo sapiens
gacaccattgaccaatccttacacattaagacaatatttgattttcattataggtttttcttggtttccttctcttttatggtaactcttgtctcctttgytaatctttccaaattctaattatcagtgttcctatgagcttctgggcctgccattcatttatgtagagagctaaaagatgtataggtttgactgctaagt

SEQ ID NO: 35501 - DNA, 201 bp, Homo sapiens
atcttcctgccttggcctcccaaagtgctgggagccactgtgctaggccagtcttttttttttttttttttttttaaattacaagtgagagcatcctattwacaccattctgcaacttgctctttcacgccagtatggatcactctaactcattatttccaatagctgagtaataatcatgtgaatttatttgaattgatg

SEQ ID NO: 35502 - DNA, 201 bp, Homo sapiens
ttaaataaatagctagagaattttatatagtagtccccccttattctcaattttgctttcctcaatctgaaaatgttaaatggaaaattccagaaataagygattcgtaagttttaagttgcatgttctgagtagcatgatgaagtctcacaccatctcactcaggatgtgaattacccctttatccagtttatccatact

SEQ ID NO: 35503 - DNA, 201 bp, Homo sapiens
tttgctttatttgctaggatataagaggtgataagctattatatttgatttctagttttttgaataaataatttcatcagtatttacttgaaaaaagtagyatgagggggaaaatctggttacttgtatttttaaagctataaacattgtaagttgtaatgctagggaaatttaagtaaaaggagtagacttttaacaatt

SEQ ID NO: 35504 - DNA, 201 bp, Homo sapiens
gtgatccgcctggcagccattgcagagtcaggggtagagcggcaagtacttttgggagaccagatacccaaattcgccgttgccactttaccacccgcctkaatcctgggattctagtatgcaataagagatgccctgtactgatgcaaaatttaataaagtttgtcacagagaatctttgtactttggggttcttttttt

SEQ ID NO: 35505 - DNA, 201 bp, Homo sapiens
tggccatttgtatgtcttttttgatgcaatgttttttcaagttctttgcacattctaaaattgggatatgtcttttgtttaatatatttttggggtttaattttttttttttgagacgagggtggggtgtgtgtgtggggtgggtttgtcttgcggtgtttcccaggctggagtgcagatgggatcatggtgcactatatc

SEQ ID NO: 35506 - DNA, 201 bp, Homo sapiens
cgcctgtaatcccagtactttgggaggccgaggcgggtggatcacctgaggtcaggagttcgagaccagcctggccaacatggcgaaaccccgtctctacyaaaaaatacaaaaattagccgtgcgtggcggtgcgtgcctgcagtcccagctacttgggaggctagggctagagaatcgcttggacccaggaggtggatg

SEQ ID NO: 35507 - DNA, 201 bp, Homo sapiens
ttacgacagttgctttgaggcagtaccggaggagaaagatggcggctaccttactagctgctcggggagccgggccagcaccggcttgggggccggaggcrttcactccagactgggaaagccgagaagtttccactggggtgaggaaggaatcggggttcataggacgtgcacaaggcctgacgcgatgggaagataaag

SEQ ID NO: 35508 - DNA, 201 bp, Homo sapiens
tcggtttccacaggtgcttgtgggcaggggaggggcaagtatctgaagggagttggaagctgaggagctaaatagcctgacttctaggtcttgaaactttmtctgtgacttccctgaccctctagcattgaactgaatgagcctccactggtccacacagcagccagcctctttaaggagatgtgttaccgataccgggaa

SEQ ID NO: 35509 - DNA, 201 bp, Homo sapiens
gctcagctgctgatacccaggcagtagctgatgctgtcacctaccagctcggtttccacaggtgcttgtgggcaggggaggggcaagtatctgaagggagytggaagctgaggagctaaatagcctgacttctaggtcttgaaactttctctgtgacttccctgaccctctagcattgaactgaatgagcctccactggtc

SEQ ID NO: 35510 - DNA, 201 bp, Homo sapiens
agcagagatcgcgtcactgtactccagcctgggcaacagagcgagactccatctcaaagaaaaaggaaaaaaaggcaatactggacatcctatccctgagycctaagagagtgggtagtgatgggatggaggtggaagacaggtgggctcctttcctcactattctgccatcctgcaggtcctacatcgccaatcgagtga

SEQ ID NO: 35511 - DNA, 201 bp, Homo sapiens
cagccattgcagagtcaggggtagagcggcaagtacttttgggagaccagatacccaaattcgccgttgccactttaccacccgcctgaatcctgggattytagtatgcaataagagatgccctgtactgatgcaaaatttaataaagtttgtcacagagaatctttgtactttggggttcttttttttttgacttcaagt

SEQ ID NO: 35512 - DNA, 201 bp, Homo sapiens
gtggtgcggtagcttcgtagtgggaggtggagggtgggctgaagtttgaaattctgaaatcctgcgaggctagtgaggatcttgggcttaagtacgggatkagtcttttgagatttgagggttggcattctggtattctgcggggtgctgaggcccctataagatttgaaaatggttcagcgacggacagattttgtattt

SEQ ID NO: 35513 - DNA, 201 bp, Homo sapiens
agaatgtagacttactcctttttcccttttcccagaccactatcatggccgtgcagtttgacgggggcgtggttctgggggcggactccagaacaaccacygggtgagctcaggacagatttgtgaaaggtcttcccatcttccttttcctttcctgcctgccagcccaccctgcctgcctccacagaccactgtgggaag

SEQ ID NO: 35514 - DNA, 201 bp, Homo sapiens
ggcgggaatcatcatcgcaggctgggaccctcaagaaggagggcaggtcagatccccacccgaccagagcacacttgagccaggacttttatcctctcccmagccattttctttttctttccagtctctacctcacttattcttactattaacgtgcctcagaccaatagcagaatggacaggtgaatgtacgtgtgttgg

SEQ ID NO: 35515 - DNA, 201 bp, Homo sapiens
aaaagaaaagtacagtactgcatggggacggttcttttgcgacagtgagcacttgatggcagcgtggcaagcaacaaacaaaacaagaaagtcagcaaaamcccccccccaaaaaaccaaaaaaaacccaaaaaccgttcggcactttgggaggctgaggcgggcggatcatgaggttaggagttcaagaccagcctggcc

SEQ ID NO: 35516 - DNA, 201 bp, Homo sapiens
gtggggatctgacctgccctccttcttgagggtcccagcctgcgatgatgattcccgccatcaggtcttcccggtatcggtaacacatctccttaaagagyctggctgctgtgtggaccagtggaggctcattcagttcaatgctagagggtcagggaagtcacagagaaagtttcaagacctagaagtcaggctatttag

SEQ ID NO: 35517 - DNA, 201 bp, Homo sapiens
aaagaaaagtacagtactgcatggggacggttcttttgcgacagtgagcacttgatggcagcgtggcaagcaacaaacaaaacaagaaagtcagcaaaacmccccccccaaaaaaccaaaaaaaacccaaaaaccgttcggcactttgggaggctgaggcgggcggatcatgaggttaggagttcaagaccagcctggcca

SEQ ID NO: 35518 - DNA, 201 bp, Homo sapiens
  misc_feature (1)...(201): n = A,T,C or G, or insertion/deletion polymorphism (see Tables 1-2)
aggtgtactcagtgcctatggggggtatgatggtaaggcagtcctttgccattggaggctccgggagctcctacatctatggctatgttgatgctacctancgggaaggcatgaccaaggaagagtgtctgcaattcactgccaatggtgagagcttaggcttctgggcctatgagcttcaaccccaactacccaagccag

SEQ ID NO: 35519 - DNA, 201 bp, Homo sapiens
tctgaagggagttggaagctgaggagctaaatagcctgacttctaggtcttgaaactttctctgtgacttccctgaccctctagcattgaactgaatgagsctccactggtccacacagcagccagcctctttaaggagatgtgttaccgataccgggaagacctgatggcgggaatcatcatcgcaggctgggaccctca

SEQ ID NO: 35520 - DNA, 201 bp, Homo sapiens
  misc_feature (1)...(201): n = A,T,C or G, or insertion/deletion polymorphism (see Tables 1-2)
gtcttttgagatttgagggttggcattctggtattctgcggggtgctgaggcccctataagatttgaaaatggttcagcgacggacagattttgtattttnggaactaggtagagagatcattgaggtttgtgtctgctggagaatgtagacttactcctttttcccttttcccagaccactatcatggccgtgcagtttg

SEQ ID NO: 35521 - DNA, 201 bp, Homo sapiens
ctaaaattgttgcaggccactttgagaacattttagctgacaacagtgtgaacgaccagaccaaaatccttgtggttaatgctgcctactttgttggcaartggatgaagaaattttctgaatcagaaacaaaagaatgtcctttcagagtcaacaaggtatgtggggcagcatgtagcagtaaaaggagcccaattatag

SEQ ID NO: 35522 - DNA, 201 bp, Homo sapiens
gagtcttgctctgtcccccaggctggagtgcagtggcatgatctcagctcactgcaagctccgcctcctgggttcatgccattctccttcctcagcctccygagtagctgggactacaggtgcctgccacgacgcttggctaattttttgtatttttagtagagacgggctttcactgtgttagccaggatggtctcgatc

SEQ ID NO: 35523 - DNA, 201 bp, Homo sapiens
ttggaaatgattttttttttttttttgagatggagtcttgctctgtcccccaggctggagtgcagtggcatgatctcagctcactgcaagctccgcctccygggttcatgccattctccttcctcagcctcccgagtagctgggactacaggtgcctgccacgacgcttggctaattttttgtatttttagtagagacggg

SEQ ID NO: 35524 - DNA, 201 bp, Homo sapiens
gataactgtgactccaggtaagcaaggtggggtagcagggctggtgacttccttttttcagggaaattcataaatatcgttatttgagctgatttgagatygtgaacaaaatggacttaggtccattttggggctgttttcaaagacgggctgttgggttgagtactgtcgcctctcatcccccatgttggcagtatttcc

SEQ ID NO: 35525 - DNA, 201 bp, Homo sapiens
gttcacatcctttgcccacttgttgatggggttgtttgattttttcttgtaaatttgtttgagttctttgtagattctggatattagccctttgtcagatragtagattgcaaaaattttctcccattctgtaggttgcctgttcactctgatggtagtttcttttgctgtgcagaagctctttagtttaattagatccca

SEQ ID NO: 35526 - DNA, 201 bp, Homo sapiens
tccatggtgtatatgggccacgttttcttaatccagtctatcattattggacatttgggttggttccaagtctttgctattgtgaatagtgttccaataarcatacgtgtgcatgtgtctttatagcagcatgatttataatcctttgagtatacacccactaatgggatggctgggttaaatggtatttctagttctaga

SEQ ID NO: 35527 - DNA, 201 bp, Homo sapiens
catccagtctccagcttgctcctttggttgccattatgttttagccaccactttattaactgaattataattcctgtccttcttcttctttggtgcattaytctctctgttttttttctttccattttatgctttgatctttcagccattatccagctgtcttggattttacctttcgttcttaaaacgccctccaataaa

SEQ ID NO: 35528 - DNA, 201 bp, Homo sapiens
tttttttgtaaaggtgggatctcactgtgttgtccaggctggtcttgaaatcctggcctcaagcaatcctcagcctcagcctcctgaagtgctaggattayaggcatgagccaccacacctggccttcacaatttacgttacggttcactctttgtgttgtacatttatgagattttaatacgtacacatatatgcttcaa

SEQ ID NO: 35529 - DNA, 201 bp, Homo sapiens
acgtagacaaatctctgaatctttctacagtaagttgtttaaagcaagtagcaagacttaactttttacaaggagtggcattttcatgctgttagacctayaactttttttcagtgaaattcctttctaggatgttcacttgtgatttgaggctttaaataaataaatcctagtggagaggttgagtatagtgggaatcaa

SEQ ID NO: 35530 - DNA, 201 bp, Homo sapiens
ggacccatggttctttctggggcctttcctccttaatattaacaacagccaaaatttatttggcacttacagtgttctagggactgtgctaagttgcctaygtgcattatctcatttaattcttacagcaggctgatgagttagagactgttaccacactcttgtttaccagtgagggagctgaggcacagaggggtgggt

SEQ ID NO: 35531 - DNA, 201 bp, Homo sapiens
  misc_feature (1)...(201): n = A,T,C or G, or insertion/deletion polymorphism (see Tables 1-2)
gttcatctacttgcaactgcattcttctaagcggaaattattctcccttcagttttctgggtttcagcataactttaaacaagttacacatttcagatgcntattcttggacttataaattgtaatagctgcttgtagtttcttactcatatgctgtacactttttcttatggcttcatttaagcatatcatactaaaaac

SEQ ID NO: 35532 - DNA, 201 bp, Homo sapiens
aatgaaacattcaatacaaagaaattcactgacttctacatgaggtttcaattcatatagtgttaccaattttgaaagtgtacatatagcagttgatattyaataatccttttgttagaagagaataacaatgcaatagcttgactacagactctgattttatgaactgcatgtttttcaggagttcatcagctctacgaa

SEQ ID NO: 35533 - DNA, 201 bp, Homo sapiens
  misc_feature (1)...(201): n = A,T,C or G, or insertion/deletion polymorphism (see Tables 1-2)
ggttctgttaccatctttttcatcccctacatctcccgggaggttttcgataatgggttccaaacctcagtccctgtcagttagtgtaagtgttcgatganttccttcatgggtggagatgaagcctgtctgaggaaaggagtctccaaaggaaatgagtcagcaggtttatatctttgcttcctaacgccttgaattgtg

SEQ ID NO: 35534 - DNA, 201 bp, Homo sapiens
  misc_feature (1)...(201): n = A,T,C or G, or insertion/deletion polymorphism (see Tables 1-2)
gcctgtctgaggaaaggagtctccaaaggaaatgagtcagcaggtttatatctttgcttcctaacgccttgaattgtgccacttcaatccctctgggttgnggattgactttggggctatgcagtctcagcgatttgggccattctggtgtggctgagtctggctgtaagtttactgcttggcaacagtgggctgggtcag

SEQ ID NO: 35535 - DNA, 201 bp, Homo sapiens
tgataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcag

SEQ ID NO: 35536 - DNA, 201 bp, Homo sapiens
gataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcaga

SEQ ID NO: 35537 - DNA, 201 bp, Homo sapiens
ataaagatatctatccatatatatctatattagtatatatgttgtattatattttctggggtagatagtctttatttggtcctcttttcagaagatatgtcgtctcaacatgtgtttcagaaaataaagtacctgtagtcagtgccgataagtgaaattgatgacagtttttggaggccacaactatgtgcacattcagaa

SEQ ID NO: 35538 - DNA, 201 bp, Homo sapiens
taataatctgacactgtgtcaagagcaaatttgtgtatatatatatatgtacatatatatttatgtgtttgcctatatatgtgtatatatgtgcatgtgtrtatatatgtatggggtatatatatatagtatgtatatataagtgtgtatatataggtgtgtgtatatgtatatgtatgtatatgtatgtatgcatatata

SEQ ID NO: 35539 - DNA, 201 bp, Homo sapiens
acctaggttcaaatccagacactggtacttactaactgatatttggacacaaagcttcaatttactgaactgtaaaatgaggcacatgttacctgatttartttttaaaattgtattatattgtgttttatttcaataggttttggggaacaggtggtttttggttacatggataagctctttagtggttacttctgagat

SEQ ID NO: 35540 - DNA, 201 bp, Homo sapiens
ccatgctggtcgttcctctgatagccccggggtccaagaagctcctaggttctttctccggctcagtgcttcccccaggcgtctccctcgtcggactcctsgtccctcccttaaaattgccggtgagtcgtcttccttgctggaaaagaattagggttatgatgattttgagggcaaatcagtgactttgtccccctcccc

SEQ ID NO: 35541 - DNA, 201 bp, Homo sapiens
cattgctctaaggaatcatacaaacaccactacggtacccattgttgtaatatttaaaaatctgtatttgaaacacacagacaatattctagactacatgmagtttccctctgtacttcagtaacacagagttgatttagttcctgtttggatggtcagaatttcaaggtttccaaatcgaaaagctagactaccagcttt

SEQ ID NO: 35542 - DNA, 201 bp, Homo sapiens
cactggcatctagtaggtcagcgatgctgctaagcatcctgcagtgcccaggacagccccacaaagactcatccagcctgaatgtcaatagtgctgaggtygaggagccttactttacgggaactaggcaggaggagtctgtatgcccaaggacgttggtcattatcacgtgtccacttcagtacagcactactcagaggc

SEQ ID NO: 35543 - DNA, 201 bp, Homo sapiens
cattctaggttcaatagaatttcttttctattagctcataagcatttaaaaaggcaacaccttcttgtattcatatgtgtccagaaagtatggcccataaragttatttaggtaaggatgaagaatttacacttgggacttgaagcagcttcactcctgtgaagaggagatgtatcttgacatcaagccacatctctgaac

SEQ ID NO: 35544 - DNA, 201 bp, Homo sapiens
tatgtgggtttgcagtagaatttactttcaagtcagctccaccaggaatagtttaaagatctcataggcatctgtaaagaataacaaacgttgcctatatktacagccatacagtcttatttttaaggtttgatctatgcaaatacagtattatatatacttcatgtaatgtgtaacatgtagattataaagtatatgaat

SEQ ID NO: 35545 - DNA, 201 bp, Homo sapiens
ccgtgcccagccagtttttgaaattaggcattttattaggaaaagccgtataaatggttatgtgggtttgcagtagaatttactttcaagtcagctccacyaggaatagtttaaagatctcataggcatctgtaaagaataacaaacgttgcctatatttacagccatacagtcttatttttaaggtttgatctatgcaaa

SEQ ID NO: 35546 - DNA, 201 bp, Homo sapiens; identical to SEQ ID NO: 9148

SEQ ID NO: 35547 - DNA, 201 bp, Homo sapiens
caacagttgcattgctttgtatgtatcccttcactgctcactccactgtcctgttcctctttcttcctccccagtggtaaccattattctgaatttacaakttcttcattctactgacaagaatactgaggcctggagagattgagtgatttgctcaaggccacagaatctgtttatgtcacatttgggactaaaaaccaa

SEQ ID NO: 35548 - DNA, 201 bp, Homo sapiens
atcctgaatccacccttgtttatatatcatccttgaaagtgacttatcatcgctgagtctcagcttcctcattcataaagtaggaagaaatatatataatrtgtatcaaatagcttgtatactgcctgacacagaataggcattcagaatggtagctgtgctttccttcttatttctcttcctttcttccctgctccttca

SEQ ID NO: 35549 - DNA, 201 bp, Homo sapiens
  misc_feature (1)...(201): n = A,T,C or G, or insertion/deletion polymorphism (see Tables 1-2)
aacactgaaaattttggtcatcttatctgggacagtcttaattcagtgatttttcaaccaggggaaattctgccccctaggggacattttcattgtcacanctggggtactgtcatctagtggatagtctggggggttttgtctaggatgaggaggaagatgaaagagggtcggtttggaaaggaagaattcagtgcattc

SEQ ID NO: 35550 - DNA, 201 bp, Homo sapiens
aagactgagataatatatgtgaaattctgccataaagaaagtgattacgtattttcattcaagagcacaggctttggagtcagaaagagctggctttgaaycctgaatccacccttgtttatatatcatccttgaaagtgacttatcatcgctgagtctcagcttcctcattcataaagtaggaagaaatatatataatgt

SEQ ID NO: 35551 - DNA, 201 bp, Homo sapiens
gttgagaagacgttaaagatgctttagaaactaactgctcccttgtccttgcttccaggcccgcaatggatgccctgcaactagcaaattcggcttttgcygttgatctgttcaaacaactatgtgaaaaggagccactgggcaatgtcctcttctctccaatctgtctctccacctctctgtcacttgctcaagtgggtg

SEQ ID NO: 35552 - DNA, 201 bp, Homo sapiens; identical to SEQ ID NO: 9099

SEQ ID NO: 35553 - DNA, 201 bp, Homo sapiens
atcattggttattccaggaacccatctctcaagcagcagctcttctcctatgcgattctgggctttgccctgtctgaggccatggggctcttctgtttgayggtcgccttccttatcctcttcgccatgtgaagctctgtgggggtcacctgcctgtccctgctgctgcggctgcacaccattcttggtgctgggctgtgc

SEQ ID NO: 35554 - DNA, 201 bp, Homo sapiens; identical to SEQ ID NO: 9101

SEQ ID NO: 35555 - DNA, 201 bp, Homo sapiens
aattaattttccttcaggaaatcagtcatctctggagcagagacaggaggccaggtgttaataggagcaaagagaagaaaaggcctgggcagtgcttggasataaaagacctgaacgatcagacccttccatgggctccctttaagaagagcagggagagaccaagggctaaagttgggagactgagaaaatgcagcccac

SEQ ID NO: 35556 - DNA, 201 bp, Homo sapiens
ttgtttaaatagaattcttatagtgttggcagaatgcagttgagaagacgttaaagatgctttagaaactaactgctcccttgtccttgcttccaggccckcaatggatgccctgcaactagcaaattcggcttttgccgttgatctgttcaaacaactatgtgaaaaggagccactgggcaatgtcctcttctctccaat

SEQ ID NO: 35557 - DNA, 201 bp, Homo sapiens
ctaggcagagctggacacacagaggacctcacatgccttcagacatttgcctggaagtttcttcacaactgatcttacttttgaatttacagaaagttccytgtttcttctgagatcaattactttgtttaaatagaattcttatagtgttggcagaatgcagttgagaagacgttaaagatgctttagaaactaactgct

SEQ ID NO: 35558 - DNA, 201 bp, Homo sapiens
agctctgctggagagaggtattggggaaggttcagcttagtatttgaagataccagatgcaagtttactggagtattatccttgcaggcttgatatgaagyttgaaatttctccccaaagagatttagttaacaggcaaatatcccatgggaggtatatgtcaataggttatacaacattactgtcagtcttttacaactt

SEQ ID NO: 35559 - DNA, 201 bp, Homo sapiens
aggttcttcattttgaaaatgtcaaagatgtaccctttggatttcaaacagtaacatcggatgtaaacaaacttagttccttttactcactgaaactaatmaagcggctctacgtagacaaatctctgaatctttctacagtaagttgtttaaagcaagtagcaagacttaactttttacaaggagtggcattttcatgct

SEQ ID NO: 35560 - DNA, 201 bp, Homo sapiens
tatctgttaacctccaaagtagtatgttttcctataattctgtttttggttacacatagagttgaagtcttccattatttatcagccaaatattcagtgasaaactacaagctggggtagaaaatgagacttagtttctgccttgactgtattctagttggggtgggaagtggaaagacaatcactagataatatttctaa

SEQ ID NO: 35561 - DNA, 201 bp, Homo sapiens
gccactgcactccagcctgggtgacaaagtgagactccatctcaaaaaaaaaaaaaaaaaaaaaaaagaaatgggtaaagtacctcttttgtaaatgagaycaaggaactgagactggaaatttgacccattttattggaaaacccagacatctatatgatgatgtgatgtggtctccgtgggtgggatctgacttgtgtt

SEQ ID NO: 35562 - DNA, 201 bp, Homo sapiens
gtgtatatataggtgtatgtatatatgtatgtgtatctgtatatatataggtgtaggtatatatgtatgtgtgtctgtatatatacatgtgggtatatatrtgtgtgtgtgtgcgcgcgtgtgtgtatatatatatatatatatatttatgcatgtgtaaattgaaaagtaagcagtccaaattttcccttttacagacag

SEQ ID NO: 35563 - DNA, 201 bp, Homo sapiens
gtgtatgtatatatgtatgtgtatctgtatatatataggtgtaggtatatatgtatgtgtgtctgtatatatacatgtgggtatatatgtgtgtgtgtgtgcgcgcgtgtgtgtatatatatatatatatatatttatgcatgtgtaaattgaaaagtaagcagtccaaattttcccttttacagacagacaccaaaccag

SEQ ID NO: 35564 - DNA, 201 bp, Homo sapiens
tttagggtttctttctggctatggttgattatctagctttgtaaagttcttagaccttcaaatgagacaattttcctgattgttccgttttaagtcctcakgtacttttacataataggtgaatgttcttctaattctatttcattattactcttatgctaatcattctaggttcaatagaatttcttttctattagctca

SEQ ID NO: 35565 - DNA, 201 bp, Homo sapiens
tgtatgtatatatgtatgtgtatctgtatatatataggtgtaggtatatatgtatgtgtgtctgtatatatacatgtgggtatatatgtgtgtgtgtgtgcgcgcgtgtgtgtatatatatatatatatatatttatgcatgtgtaaattgaaaagtaagcagtccaaattttcccttttacagacagacaccaaaccagt

SEQ ID NO: 35566 - DNA, 201 bp, Homo sapiens
ttcaaatgagacaattttcctgattgttccgttttaagtcctcatgtacttttacataataggtgaatgttcttctaattctatttcattattactcttaygctaatcattctaggttcaatagaatttcttttctattagctcataagcatttaaaaaggcaacaccttcttgtattcatatgtgtccagaaagtatggc

SEQ ID NO: 35567 - DNA, 201 bp, Homo sapiens
tataaattgtaatagctgcttgtagtttcttactcatatgctgtacactttttcttatggcttcatttaagcatatcatactaaaaaccaacatgccaggytattccagagacttgtaaccagatcctcagagctgggggctcttagacatatttcagcccagccccctcattctgtagatgaggagcagaactcacagag

SEQ ID NO: 35568 - DNA, 201 bp, Homo sapiens
tatgtatatatgtatgtgtatctgtatatatataggtgtaggtatatatgtatgtgtgtctgtatatatacatgtgggtatatatgtgtgtgtgtgtgcgygcgtgtgtgtatatatatatatatatatatttatgcatgtgtaaattgaaaagtaagcagtccaaattttcccttttacagacagacaccaaaccagtgc

SEQ ID NO: 35569 - DNA, 201 bp, Homo sapiens
ccttcttgtattcatatgtgtccagaaagtatggcccataagagttatttaggtaaggatgaagaatttacacttgggacttgaagcagcttcactcctgygaagaggagatgtatcttgacatcaagccacatctctgaactgcgcaactccactatccctacccaatctcccattcctcatttctcatctaccattaga

SEQ ID NO: 35570 - DNA, 201 bp, Homo sapiens
tgtatatatgtatgtgtatctgtatatatataggtgtaggtatatatgtatgtgtgtctgtatatatacatgtgggtatatatgtgtgtgtgtgtgcgcgygtgtgtgtatatatatatatatatatatttatgcatgtgtaaattgaaaagtaagcagtccaaattttcccttttacagacagacaccaaaccagtgcag

SEQ ID NO: 35571 - DNA, 201 bp, Homo sapiens
cacagcatggccattatgagttatggagcgaggagggtgtcatcttatgctgacattacatgttgtggtgttgcaaggcagaaaagatgctggactattgsttggaacaataaaaaaaaaaaaggaaaaaaatacaatgatttaagccctccaaatgatagtatcctggttttaaatggcttacaatattattacaagaat

SEQ ID NO: 35572 - DNA, 201 bp, Homo sapiens
gtatgtgtatctgtatatatataggtgtaggtatatatgtatgtgtgtctgtatatatacatgtgggtatatatgtgtgtgtgtgtgcgcgcgtgtgtgtrtatatatatatatatatatttatgcatgtgtaaattgaaaagtaagcagtccaaattttcccttttacagacagacaccaaaccagtgcagatgatgaac

SEQ ID NO: 35573 - DNA, 201 bp, Homo sapiens
gcgaggagggtgtcatcttatgctgacattacatgttgtggtgttgcaaggcagaaaagatgctggactattggttggaacaataaaaaaaaaaaaggaamaaaatacaatgatttaagccctccaaatgatagtatcctggttttaaatggcttacaatattattacaagaataattaacagtttgaatccatataatat

SEQ ID NO: 35574 - DNA, 201 bp, Homo sapiens
cctcctaggcagttaaggcactacgttgctacgcactgccaggtccactatcatgtgacctgatgtcaagcatcctctctcttgctctttctttttttttwaaattagtagatgttatttttagagtagatctatgcctacagaaaaataagcagaaagtacaaggagttcccatatactccccttcccgtcccaggccta

SEQ ID NO: 35575 - DNA, 201 bp, Homo sapiens
tttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttac

SEQ ID NO: 35576 - DNA, 201 bp, Homo sapiens
ttttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttaca

SEQ ID NO: 35577 - DNA, 201 bp, Homo sapiens; identical to SEQ ID NO: 9149

SEQ ID NO: 35578 - DNA, 201 bp, Homo sapiens
tttctttccattttatgctttgatctttcagccattatccagctgtcttggattttacctttcgttcttaaaacgccctccaataaacatcaattattttcttcttcttcttctttttttatttcaataatttatttttcttttttttaattatacattaagttttagggtacatgtgcacaatgtgcaggtttgttacat

SEQ ID NO: 35579 - DNA, 201 bp, Homo sapiens; identical to SEQ ID NO: 9151

SEQ ID NO: 35580 - DNA, 201 bp, Homo sapiens
ggcattccctaaggactggttataccaaatacttgagagatgtttttcaccatgtctttccatctttaaaatgaggcaggccaggctaaatgatatctacratactctgacacagtaaaaacgtagttttttttttttttttcttgagatggagtcttgctttgtcacccaggatggagtgcagtggcacgatcttggctc

SEQ ID NO: 35581 - DNA, 201 bp, Homo sapiens
  misc_feature (1)...(201): n = A,T,C or G, or insertion/deletion polymorphism (see Tables 1-2)
ggctgagtctggctgtaagtttactgcttggcaacagtgggctgggtcagtggtcaagatcaggcttctaaagagacaggagcagctatgatgcttcagancaaagcagacgcccccctgccatgggaaattaaagcaattactaatagctgtattgtactttcttgcccacaaagcacttttcatatacattgattcact

SEQ ID NO: 35582 - DNA, 201 bp, Homo sapiens
  misc_feature (1)...(201): n = A,T,C or G, or insertion/deletion polymorphism (see Tables 1-2)
agttccttttactcactgaaactaatcaagcggctctacgtagacaaatctctgaatctttctacagtaagttgtttaaagcaagtagcaagacttaactntttacaaggagtggcattttcatgctgttagacctacaactttttttcagtgaaattcctttctaggatgttcacttgtgatttgaggctttaaataaat

SEQ ID NO: 35583 - DNA, 201 bp, Homo sapiens
catagagtgacccttctggctcctttgattagtgattggctctcctccatagcaagggctggcaaagggttcctaactctgtttaagtgaaatctgaaacrggttgccaatggtgcctctcttcaagaccccagagccagcctggaaggaacaccatgaaaatgttgcaatagtcaatgagtagaatgtggacttttgtgt

SEQ ID NO: 35584 - DNA, 201 bp, Homo sapiens
tgctttccttcttatttctcttcctttcttccctgctccttcattctcctctgctgacctctttggtagatctggttgtgtcaaggtagaaggagagaaargagtccttctgaaatttgatggttggaaccatcaggccttacatggtgtgactccatgaagtggtaaatactcagtgaatatgcatgtgaatttcagatg

SEQ ID NO: 35585 - DNA, 201 bp, Homo sapiens
tatcacgtgtccacttcagtacagcactactcagaggcaatgctttttgggtaacggatttttctcttaacaggttcttcattttgaaaatgtcaaagatrtaccctttggatttcaaacagtaacatcggatgtaaacaaacttagttccttttactcactgaaactaatcaagcggctctacgtagacaaatctctgaa

SEQ ID NO: 35586 - DNA, 201 bp, Homo sapiens
ttgcaggttcatggattacttctctataaaaaatatgtatttaccaaaaattttgtgacattccttctcccatctcttccttgacctgcattgtaaatagsttcttcttgttctgagattcaatattgaatttttcctatgctattgacaataaaatattattgaactacatgtcttgttttttttttcctattaagttag

SEQ ID NO: 35587 - DNA, 201 bp, Homo sapiens
  misc_feature (1)...(201): n = A,T,C or G, or insertion/deletion polymorphism (see Tables 1-2)
agccttactttacgggaactaggcaggaggagtctgtatgcccaaggacgttggtcattatcacgtgtccacttcagtacagcactactcagaggcaatgntttttgggtaacggatttttctcttaacaggttcttcattttgaaaatgtcaaagatgtaccctttggatttcaaacagtaacatcggatgtaaacaaac

SEQ ID NO: 35588 - DNA, 201 bp, Homo sapiens; identical to SEQ ID NO: 9106
  misc_feature (1)...(201): n = A,T,C or G, or insertion/deletion polymorphism (see Tables 1-2)

SEQ ID NO: 35589 - DNA, 201 bp, Homo sapiens
tttctgaatcagaaacaaaagaatgtcctttcagagtcaacaaggtatgtggggcagcatgtagcagtaaaaggagcccaattatagatgtgaaaaatgayagggacagagtggggcataaatccattccaatgaggaacctgagggcacggccggcaaagtgcctttcctgagatgaacagctggaaggtaagtggtaca

SEQ ID NO: 35590 - DNA, 201 bp, Homo sapiens
aattaaatactaatatgaataatatatatattaaaaaacattttctaaagtgaaaaaatgtaatgagaagagtgatattgtttttcatttttgcaaatctccttaatatttggcttaatagaagggatgtcatatagcctctggaaaactccgctgtctattagagattgagaatgataatgtcttagtattatcatgaga

SEQ ID NO: 35591 - DNA, 201 bp, Homo sapiens
tgcacacattcttctgatgtttctcaaaatcagtaagaaaaataataactatgaattcacaattttcatcagtcacaaattagttttgttggctgggctgrtcagatggggatctccacaggcagctctggttatataagtttagccattgctctaaggaatcatacaaacaccactacggtacccattgttgtaatattt

SEQ ID NO: 35592 - DNA, 201 bp, Homo sapiens
atgtgtctttatagcagcatgatttataatcctttgagtatacacccactaatgggatggctgggttaaatggtatttctagttctagatccttgaggaaytgccacactgacttccacagtggttgaacttgtttacggtcccaccaacagtgtaaaagtgttcctatttctccatatcctttccagcacctcttgtttc

SEQ ID NO: 35593 - DNA, 201 bp, Homo sapiens
ctttagtttaattagatcccatttgtcaattttggctttcaattattttcttcttaaagtatagaactaaagaaaatgaccttttgagttttggaaatgattttttttttttttttgagatggagtcttgctctgtcccccaggctggagtgcagtggcatgatctcagctcactgcaagctccgcctcctgggttcatgc

SEQ ID NO: 35594 - DNA, 201 bp, Homo sapiens
gataagctatccgtgttgcaggttcatggattacttctctataaaaaatatgtatttaccaaaaattttgtgacattccttctcccatctcttccttgacmtgcattgtaaataggttcttcttgttctgagattcaatattgaatttttcctatgctattgacaataaaatattattgaactacatgtcttgtttttttt

SEQ ID NO: 35595 - DNA, 201 bp, Homo sapiens
cgcccagccgcatctctctcattttttaaaacagctaaaatggatgcattcactacctatgaccctagggcatggctcagagttagttcaaattcccattaaaaaaaaaaagtaactttagctttaatttaattttctaaatctgatgccattcctagtacatgaatattctggatttcctcgtagagaaattacaataag

SEQ ID NO: 35596 - DNA, 201 bp, Homo sapiens; identical to SEQ ID NO: 9094

SEQ ID NO: 35597 - DNA, 201 bp, Homo sapiens; identical to SEQ ID NO: 9095

SEQ ID NO: 35598 - DNA, 201 bp, Homo sapiens; identical to SEQ ID NO: 9096

SEQ ID NO: 35599 - DNA, 201 bp, Homo sapiens; identical to SEQ ID NO: 9097

SEQ ID NO: 35600 - DNA, 201 bp, Homo sapiens; identical to SEQ ID NO: 9098

SEQ ID NO: 35601 - DNA, 201 bp, Homo sapiens
  misc_feature (1)...(201): n = A,T,C or G, or insertion/deletion polymorphism (see Tables 1-2)
gggtctcctgagtcacataccaaaaacttctgggccatctttgatgttccacccagactgctttgaagctgggcttatcataacaccttatgttttcaatngagccaggtcttttacagttggaaataaataaaaataatttcttttcatttttgtccttcagattgaaaaacaactcaactcagagtcactgtcacagtg

SEQ ID NO: 35602 - DNA, 201 bp, Homo sapiens
tggggaggaggaggacacagctgggtggctgctgggtctcctgagtcacataccaaaaacttctgggccatctttgatgttccacccagactgctttgaarctgggcttatcataacaccttatgttttcaattgagccaggtcttttacagttggaaataaataaaaataatttcttttcatttttgtccttcagattga

SEQ ID NO: 35603 - DNA, 201 bp, Homo sapiens
agatcctggaaactcagcctttatgaacagaattaataaaagtttgaaatgtcattgatctctcagtgtttcacttgataaagcaataaaatgctattcayagctgcatgaggctacacccttcttttgaatgcagatgctattacttctcctttgttttctttgaattgctttgtccaccctagaactttttgagtgaca

SEQ ID NO: 35604 - DNA, 201 bp, Homo sapiens
ttagtagagacgggctttcactgtgttagccaggatggtctcgatctcctgacctcgtgatccacccacctcggcttcccaaagtgctgggattgcaggcrtgagccactgcgcccagccgcatctctctcattttttaaaacagctaaaatggatgcattcactacctatgaccctagggcatggctcagagttagttca

SEQ ID NO: 35605 - DNA, 201 bp, Homo sapiens
tttcactgggagaagacaatgatgactgttactgctccttaccaactcaaaatatccatgggagctgagggatgggtaggaggtcctcctaacttcctgartttagcttcccaactgcagtggtcttctcaaagctgactgcagagacaggattgaccctgcacacaagaggtctgtctgagattctagagacatagctta

SEQ ID NO: 35606 - DNA, 201 bp, Homo sapiens
ccgaatctagtcatgaaagaatgaagcctaggcagtcgctgctgtctagggagggatacacttccggggcaagggagacccacttcctgcgagaatgactygcgcccccagctactctgtctctgtactgactgaggaagttctaacaggacagtaactgcaggatgagaacatgggaagaacagggtctctggagtcatt

SEQ ID NO: 35607 - DNA, 201 bp, Homo sapiens
ccttttgttagaagagaataacaatgcaatagcttgactacagactctgattttatgaactgcatgtttttcaggagttcatcagctctacgaagagaccstatgcaaaggaattggaaactgttgacttcaaagataaattggaagaaacgaaaggtcagatcaacaactcaattaaggatctcacagatggcaagtacc

SEQ ID NO: 35608 - DNA, 201 bp, Homo sapiens
ctgacaaattttacaaatttgttaaggaaaaagggacataggcaacatatgtaaaagaaaaaccggctggacgcggtggctcacgcctgtaatcccagcartttgggaggccaaggcgggcggatcacgaggtcaggagatcgagaccatcctggctaacacggtgaaaccctgtctctactaaaaatacaaaaaattagc

SEQ ID NO: 35609 - DNA, 201 bp, Homo sapiens
ctgggactacaggcacgcaccaccagggccagctaatttttgtatttttagtatagacggggttttacagtgttggccaggatgctctcaatctcttgacstcatgatccgcccgccttggcttcccaaagtgctgggattacaggcgtgagccaccggtgcctggccacgcccggctaattttttttagtagagaccgga

SEQ ID NO: 35610 - DNA, 201 bp, Homo sapiens
ttgttacttttgaatccagttgtgctttcaactgttaacgtatttttttttttttcttgagacagttttgcttttgttgcccaggctggagtgcagtggcrcaatctctgctcactgcaacctccgcctcctgggttcaagcatttctcctgtctcagcctcccgagtagctgggattacaggcgtgtgccaccatgccca

SEQ ID NO: 35611 - DNA, 201 bp, Homo sapiens
ccaggcatggtggcacacacctgtaatcccagctactcggggggctgaggcacaagaatcgcttgaaccagggaggcggaggttgcactgagccaagatcktacccactgcactccagcctgggtgacagagcgagactttgtcttaaaaaaaaaaacattgtagggaagtgataagtttccttgaaggcatgagatggca

SEQ ID NO: 35612 - DNA, 201 bp, Homo sapiens
acctccgcctcctgggctcaagcaattctctttccccaggctcctgagcaacagggattacaggcacccaccaccacgcccagccaattttctttttttttcttttttcttatccagacgaagtctcgcactgtcgcccgggccggagtgcagtgtcgcgatctcggctcactgcaacctccgcctcccgggttcaagcga

SEQ ID NO: 35613 - DNA, 201 bp, Homo sapiens
tttgttacttttgaatccagttgtgctttcaactgttaacgtatttttttttttttcttgagacagttttgcttttgttgcccaggctggagtgcagtggyacaatctctgctcactgcaacctccgcctcctgggttcaagcatttctcctgtctcagcctcccgagtagctgggattacaggcgtgtgccaccatgccc

SEQ ID NO: 35614 - DNA, 201 bp, Homo sapiens
ggaagttaccttaggtagcgtagtttcctcttgctgaaaacagggtccggttttcacaaatgtgggaaatttggcttcttttgctaattgctccctcttgsccgctcgcgtgctagcatgttaacccctctttctttcaccaggagcagttggttctggtggaattatcaggaattattgattcagacttcctctcaaaat

SEQ ID NO: 35615 - DNA, 201 bp, Homo sapiens
tctattgaaatacaaaaattagccaggcatggtggcacacacctgtaatcccagctactcggggggctgaggcacaagaatcgcttgaaccagggaggcgraggttgcactgagccaagatcgtacccactgcactccagcctgggtgacagagcgagactttgtcttaaaaaaaaaaacattgtagggaagtgataagtt

SEQ ID NO: 35616 - DNA, 201 bp, Homo sapiens
ctcactgccacctccgcctcctgggctcaagcaattctctttccccaggctcctgagcaacagggattacaggcacccaccaccacgcccagccaattttytttttttttcttttttcttatccagacgaagtctcgcactgtcgcccgggccggagtgcagtgtcgcgatctcggctcactgcaacctccgcctcccggg

SEQ ID NO: 35617 - DNA, 201 bp, Homo sapiens
tgaataccaggaaggtgaagatcattggggaccatcttgcagtctggctaccaaacacggctacatgctggaggcaaaacaggacagaggaagtgtgaccsttaccttctaggaacttgcattctaaagtaaattacattgaaacagacatggatgaataagagtgaacatcaaattcattctattttaagtactgtgcta

SEQ ID NO: 35618 - DNA, 201 bp, Homo sapiens
cactcataactctgtgtttctgtcccttgaagatgtttgttacttttgaatccagttgtgctttcaactgttaacgtatttttttttttttcttgagacarttttgcttttgttgcccaggctggagtgcagtggcacaatctctgctcactgcaacctccgcctcctgggttcaagcatttctcctgtctcagcctcccg

SEQ ID NO: 35619 - DNA, 201 bp, Homo sapiens
atgaagcctgttagacctatgggtttaatctcactcataactctgtgtttctgtcccttgaagatgtttgttacttttgaatccagttgtgctttcaactrttaacgtatttttttttttttcttgagacagttttgcttttgttgcccaggctggagtgcagtggcacaatctctgctcactgcaacctccgcctcctgg

SEQ ID NO: 35620 - DNA, 201 bp, Homo sapiens
caagaccagcctggccaatatggtgagaccccccatttccactaaagatacaaaaaattagccaggtatggtggcatgcacctgtaatcccagctactcgsgaggctgaggtgggagaattgcttgaacccaggaggcggaggttgcagtgagccgagatcatgctactgcactccagcctgggtgacaaagtgagactcc

SEQ ID NO: 35621 - DNA, 201 bp, Homo sapiens
ggtttaatctcactcataactctgtgtttctgtcccttgaagatgtttgttacttttgaatccagttgtgctttcaactgttaacgtatttttttttttttcttgagacagttttgcttttgttgcccaggctggagtgcagtggcacaatctctgctcactgcaacctccgcctcctgggttcaagcatttctcctgtct

SEQ ID NO: 35622 - DNA, 201 bp, Homo sapiens
atttgattggtagaattttagatcccaatacgctgtagggtaaaattcctggccccaatttccatttcaaggatgaagcctgttagacctatgggtttaayctcactcataactctgtgtttctgtcccttgaagatgtttgttacttttgaatccagttgtgctttcaactgttaacgtatttttttttttttcttgaga

SEQ ID NO: 35623 - DNA, 201 bp, Homo sapiens
attttgtatttttagtagagagatggggtttctccatgttggtcaggctggtctcgaactcccgacctcaagtgatccgcccacctcagcctcccaaagtkttgggattacaggtgtgcaccaccgcacccaaccttttttttttttttttttttttaaatagagacaggatcttactatgttacccagctggtctcaaac

SEQ ID NO: 35624 - DNA, 201 bp, Homo sapiens
gggtttaatctcactcataactctgtgtttctgtcccttgaagatgtttgttacttttgaatccagttgtgctttcaactgttaacgtatttttttttttttcttgagacagttttgcttttgttgcccaggctggagtgcagtggcacaatctctgctcactgcaacctccgcctcctgggttcaagcatttctcctgtc

SEQ ID NO: 35625 - DNA, 201 bp, Homo sapiens
tgggtttaatctcactcataactctgtgtttctgtcccttgaagatgtttgttacttttgaatccagttgtgctttcaactgttaacgtatttttttttttttcttgagacagttttgcttttgttgcccaggctggagtgcagtggcacaatctctgctcactgcaacctccgcctcctgggttcaagcatttctcctgt

SEQ ID NO: 35626 - DNA, 201 bp, Homo sapiens
gaagtgtctgtgcttcatatccttggctcaagggccttatcctccgtcctgcctaggcatacagttttctgaaagtttcaactccaggcagcaggttggcrgcaatttttttcctcaggctttcatgattgagaatgtccctactccatactttggcttcaggtagtaagtctgactttggtccttaatttgattggtaga

SEQ ID NO: 35627 - DNA, 201 bp, Homo sapiens
gacctcaagtgatctgcctgcctcggcctctcaaagtgctgggattacaggtgtgagccaccactcctggccaaggaataaaagaagggctacttcatagrcagagcagcctactttctaaagtatggtatcaatttatactcacagtagcaatgtatggaagtgtctgtgcttcatatccttggctcaagggccttatcc

SEQ ID NO: 35628 - DNA, 201 bp, Homo sapiens
tgacctcaagtgatctgcctgcctcggcctctcaaagtgctgggattacaggtgtgagccaccactcctggccaaggaataaaagaagggctacttcatakgcagagcagcctactttctaaagtatggtatcaatttatactcacagtagcaatgtatggaagtgtctgtgcttcatatccttggctcaagggccttatc

SEQ ID NO: 35629 - DNA, 201 bp, Homo sapiens
gaagtagtttaatctgactccctacactggaattactaaggcttcatctttgttttatttgatggcataagaagtataataatgttgttcatttctgttcyagctgatacagaaggcaataataaaacagtgctaaaatataaatgccatacaatgaagaagctcagcatgacaagaactctcctgacagagaagaaggaa

SEQ ID NO: 35630 - DNA, 201 bp, Homo sapiens
ctgggattacaggtgtgagccaccactcctggccaaggaataaaagaagggctacttcataggcagagcagcctactttctaaagtatggtatcaatttayactcacagtagcaatgtatggaagtgtctgtgcttcatatccttggctcaagggccttatcctccgtcctgcctaggcatacagttttctgaaagtttca

SEQ ID NO: 35631 - DNA, 201 bp, Homo sapiens
ttcaagcagttctcctgcctcagcctcccgagtagctgggattacaggcgcctgccaccacgcctaggtaatttttctatttttggtagagacagggtttygccatgttggccaggctgatctcaaactcctgacctcaagtgatctgcctgcctcggcctctcaaagtgctgggattacaggtgtgagccaccactcctg

SEQ ID NO: 35632 - DNA, 201 bp, Homo sapiens
tcaccggcttcttgctcctgggcgcgaggagccgggcagcttgggaccttagccctaatcgtcaccccgtacttgggatgggaagtaccgggaagttaccktaggtagcgtagtttcctcttgctgaaaacagggtccggttttcacaaatgtgggaaatttggcttcttttgctaattgctccctcttggccgctcgcgt

SEQ ID NO: 35633 - DNA, 201 bp, Homo sapiens
ccggctaatttttagtagagacggagttttttttcttttttttttttttggagacgaatttcgctcttgttgcccaggctggagtacagtagtgcgatctyggctcactgcaacctccgcctcctgggttgaagtaattctcctgcctcagcctcctgagtagctgggattacaggcacgcaccagcacgcccagctaatt

SEQ ID NO: 35634 - DNA, 201 bp, Homo sapiens
ggtaggacaagatgctctagaggttccccagttttggagattagtttccttggtagcaaggttacaatgttgaagcctttttctaattatgttttttttttatgatcctttattctgttgtagggcattgacactgagaggcccattctgcaagtggacagctgtgtctttgctggggagtatgaaggtaggaggatgtca

SEQ ID NO: 35635 - DNA, 201 bp, Homo sapiens
gcttgcctagaactcctgaagagaccactgtgcccagcctttcttttccttttgacgtttttctttttttctttcctggagacagagtcttactccatccsccaggctggagtgcagtggcgtgatctcagctcactgcaacctctgcctcccaggttcaagtgattctcattcctcagcctcctgagtagctgggattac

SEQ ID NO: 35636 - DNA, 201 bp, Homo sapiens
ttatcctgtacttggtaggacaagatgctctagaggttccccagttttggagattagtttccttggtagcaaggttacaatgttgaagcctttttctaatkatgttttttttttatgatcctttattctgttgtagggcattgacactgagaggcccattctgcaagtggacagctgtgtctttgctggggagtatgaagg

SEQ ID NO: 35637 - DNA, 201 bp, Homo sapiens
atgatctgcttgcctcagcctcccaaagtgctgggattacaggcatgagatgctgcacccagcctttgtatttttagtagagacggagtctcaccctgttrcctgggcttgcctagaactcctgaagagaccactgtgcccagcctttcttttccttttgacgtttttctttttttctttcctggagacagagtcttactc

SEQ ID NO: 35638 - DNA, 201 bp, Homo sapiens
gcgtgatccctggaggcagaggttgcagtgagccgagatcgcgccactgtactccagcctgggcaacaaagggcaaaactccatctcaattaaaaaataawaataataataataataaattagctggggatggtggcatgcgcctgtggtccctgctgctcaggaggctgaggtgggaggattgcctgaacatgatcatgc

SEQ ID NO: 35639 - DNA, 201 bp, Homo sapiens
tcccaggttcaagcagttctcctgcctcagcctcccgagtagctgggattacaggcgcctgccaccacgcctaggtaatttttctatttttggtagagacrgggtttcgccatgttggccaggctgatctcaaactcctgacctcaagtgatctgcctgcctcggcctctcaaagtgctgggattacaggtgtgagccacc

SEQ ID NO: 35640 - DNA, 201 bp, Homo sapiens
ggtttcaccatgttggtcaggctggtctggaactgacttcatgatctgcttgcctcagcctcccaaagtgctgggattacaggcatgagatgctgcacccrgcctttgtatttttagtagagacggagtctcaccctgttgcctgggcttgcctagaactcctgaagagaccactgtgcccagcctttcttttccttttga

SEQ ID NO: 35641 - DNA, 201 bp, Homo sapiens
atcgcgtgatccctggaggcagaggttgcagtgagccgagatcgcgccactgtactccagcctgggcaacaaagggcaaaactccatctcaattaaaaaawaataataataataataataaattagctggggatggtggcatgcgcctgtggtccctgctgctcaggaggctgaggtgggaggattgcctgaacatgatca

SEQ ID NO: 35642 - DNA, 201 bp, Homo sapiens
accatgcccagctaatttttgtatttttagtagagacagggtttcaccatgttggtcaggctggtctggaactgacttcatgatctgcttgcctcagcctyccaaagtgctgggattacaggcatgagatgctgcacccagcctttgtatttttagtagagacggagtctcaccctgttgcctgggcttgcctagaactcc

SEQ ID NO: 35643 - DNA, 201 bp, Homo sapiens
caggagaatcgcgtgatccctggaggcagaggttgcagtgagccgagatcgcgccactgtactccagcctgggcaacaaagggcaaaactccatctcaattaaaaaataataataataataataataaattagctggggatggtggcatgcgcctgtggtccctgctgctcaggaggctgaggtgggaggattgcctgaac

SEQ ID NO: 35644 - DNA, 201 bp, Homo sapiens
aaaaccagtatcttacagtttccgtgaatcaggaatttgggagcagtttaggtaggtggttctggctccaggtctctgataaggttgcagtcaaaatgttrtctaggctgcagtcatctgaaggcttgactaatgctggaagtaaaatggcttattcatatggcttgtaaatttgttttggttgttggcaggaggcctcag

SEQ ID NO: 35645 - DNA, 201 bp, Homo sapiens
tctcagcactttgggaggcagaggtgggaggatcacttgagcccaggaattggagaccatcctaggcaacataacgagaccccttctctaaaataataatwaaaaaaaatggccaggcgcggtggctcacgcctgtaatcccaatactgggaggccgaggcgggtagatcacgagcccaggagttcgagaccagcctggcc

SEQ ID NO: 35646 - DNA, 201 bp, Homo sapiens
ctcattcctcagcctcctgagtagctgggattacaggtgcccaccaccacgcccggctaatttttagtagagacggagttttttttcttttttttttttttggagacgaatttcgctcttgttgcccaggctggagtacagtagtgcgatctcggctcactgcaacctccgcctcctgggttgaagtaattctcctgcctc

SEQ ID NO: 35647 - DNA, 201 bp, Homo sapiens
ggagcagataggagaaaatggctaactttgcttgcctgtttgaatgtgtggctgaagagaaagttacagatttggaggaagtaacattgtgatatggaacmgtacatatattcctgtattctcagcactttgggaggcagaggtgggaggatcacttgagcccaggaattggagaccatcctaggcaacataacgagaccc

SEQ ID NO: 35648 - DNA, 201 bp, Homo sapiens
tgccaccatgcccagcgaattttttgtatctttagtagagacgggatttcatcatgttggccaggctggtctcaaactcccgacctcaggtgaaccactcrcctcggcctcccaaagtgcagggattacaggtgtgagccaccgtgcccagcctgttaatgtattttatctatcatttttctatgcttggagcaggaggga

SEQ ID NO: 35649 - DNA, 201 bp, Homo sapiens
agaccagcctggccaacatggtgtaaccccgtctctactgaaatacaaaaattagccaggcatggtggtgggcgcctgtaatcccagctactcgggaggcygagacaggagaatcgcgtgatccctggaggcagaggttgcagtgagccgagatcgcgccactgtactccagcctgggcaacaaagggcaaaactccatct

SEQ ID NO: 35650 - DNA, 201 bp, Homo sapiens
agaccccttctctaaaataataataaaaaaaaatggccaggcgcggtggctcacgcctgtaatcccaatactgggaggccgaggcgggtagatcacgagcycaggagttcgagaccagcctggccaacatggtgtaaccccgtctctactgaaatacaaaaattagccaggcatggtggtgggcgcctgtaatcccagcta

SEQ ID NO: 35651 - DNA, 201 bp, Homo sapiens
gagaccccttctctaaaataataataaaaaaaaatggccaggcgcggtggctcacgcctgtaatcccaatactgggaggccgaggcgggtagatcacgagsccaggagttcgagaccagcctggccaacatggtgtaaccccgtctctactgaaatacaaaaattagccaggcatggtggtgggcgcctgtaatcccagct

SEQ ID NO: 35652 - DNA, 201 bp, Homo sapiens
aggaggcccgtggcgagtctccacgtgggtaccggcgctctcggcgcccgtagccacccgcccgccggaagccgacatctcgagttctggcagaagcaatytgcgcggcgaggagcggagcggcaggaacccaataagctgcttcgcctcggagctgaagcccgtactcaagatggcggctccgggcgggcgtggccagtg

SEQ ID NO: 35653 - DNA, 201 bp, Homo sapiens; identical to SEQ ID NO: 9172

SEQ ID NO: 35654 - DNA, 201 bp, Homo sapiens
acagtgctaaaatataaatgccatacaatgaagaagctcagcatgacaagaactctcctgacagagaagaaggaaggagaagaaaacataggttagttccmttattctctgaaaacaggtgatccagtactggctttgacaatgatacattgatgccaggatagtccttgtactttttagtaataactatacatgattttt

SEQ ID NO: 35655 - DNA, 201 bp, Homo sapiens
tggccaatatggtgaaactctgtctctactaaaaacacaaaaattagctgggcatagtggcaggcgcctgtagtcccagctacttgggaggctgaggcaaragaactgcttgaacccaggaggcagaggttgcagggagctgagacggtgccactgcactccagcctgggcgacagaatgagactgtctcaaaaaaaaaat

SEQ ID NO: 35656 - DNA, 201 bp, Homo sapiens
tgttggctcactgtgacctctgccccccatccccctacctcagcctccccagtagttgggaccacaggcgtgttccaccatgcctggctatttctttttttgtttttgttttctttttttttgagatggagtttcactccgtcgcccaggctggagtgcagtggcgcgatctctgcttactgcaacctccacctcccaggt

SEQ ID NO: 35657 - DNA, 201 bp, Homo sapiens
tcatgtgtaagatgtgcctccctcaaaccttgttatgatgtcagcatattacctgtctgatgtgtggggggaaaaaacttccttgtgagcaaagtggataygatcacaatagttctgaattcccaaggtgaaatcccctggaaacttctggcagctgcagcagccttcaacaggctcacatctggaaaaagctggcttttt

SEQ ID NO: 35658 - DNA, 201 bp, Homo sapiens; identical to SEQ ID NO: 9174
  misc_feature (1)...(201): n = A,T,C or G, or insertion/deletion polymorphism (see Tables 1-2)

SEQ ID NO: 35659 - DNA, 201 bp, Homo sapiens; identical to SEQ ID NO: 9175

SEQ ID NO: 35660 - DNA, 201 bp, Homo sapiens; identical to SEQ ID NO: 9176

SEQ ID NO: 35661 - DNA, 201 bp, Homo sapiens; identical to SEQ ID NO: 9177

SEQ ID NO: 35662 - DNA, 201 bp, Homo sapiens; identical to SEQ ID NO: 9178

SEQ ID NO: 35663 - DNA, 201 bp, Homo sapiens
gaatgggccatgcttactagagttgagcactgatggacaaaggggccaatatattttttaataaacagattttttatgacatgtgggatcttctaaaatggagcggggcccctcctgcccaggtctatgggtgggactctacactggcatgaccgcactggttgttaagatattgaattctgttcatacagttggtaatag

SEQ ID NO: 35664 - DNA, 201 bp, Homo sapiens; identical to SEQ ID NO: 9179

SEQ ID NO: 35665 - DNA, 201 bp, Homo sapiens; identical to SEQ ID NO: 9180

SEQ ID NO: 35666 - DNA, 201 bp, Homo sapiens; identical to SEQ ID NO: 9181

SEQ ID NO: 35667 - DNA, 201 bp, Homo sapiens
  misc_feature (1)...(201): n = A,T,C or G, or insertion/deletion polymorphism (see Tables 1-2)
aagagtggaacaaattttcctttgggcttgccatagaaaccaatcctgccaacaccttgatttcagattttcatcctctggaactgtaagagaataaattnccgttgtttcaagccacccagtcgttgtcatttgttatggcagccctgggaaacagagagagtttctttggcccaactgggtccaatgtccaccttgtgc

SEQ ID NO: 35668 - DNA, 201 bp, Homo sapiens; identical to SEQ ID NO: 9182

SEQ ID NO: 35669 - DNA, 201 bp, Homo sapiens; identical to SEQ ID NO: 9183

SEQ ID NO: 35670 - DNA, 201 bp, Homo sapiens
  misc_feature (1)...(201): n = A,T,C or G, or insertion/deletion polymorphism (see Tables 1-2)
tttcaaataaaactccccctcacaccacccaactggaagtcattcctgatgtgctgtgagcagaatgggcctgcgattttgcaagtaaggaatatcctgtnggtttgggagctgtcctaccgtgcatcccgtgacactctctttgacacctaaattaagcagacgcgttgcctgacagaaacccgacttttgcgggactga

SEQ ID NO: 35671 - DNA, 201 bp, Homo sapiens
  misc_feature (1)...(201): n = A,T,C or G, or insertion/deletion polymorphism (see Tables 1-2)
ggaaagggtatgtttgccaagacaagaatgagtatttgtgtggcaaagacatggtcattgaattagtgaattcctgcatcacatttttgtctgtgctcacntctgagcaagaatttggtgggctagttggtttaagggaatggcccactgagtttctgtctgcctgcacttcaaaactgtttaagtctttaggatcatatc

SEQ ID NO: 35672 - DNA, 201 bp, Homo sapiens
  misc_feature (1)...(201): n = A,T,C or G, or insertion/deletion polymorphism (see Tables 1-2)
tttacagagacactgtagcaaagtgttaagagcaaaggcaatggggccttctcacctgggtgcggatccaggctccaatagacagtctggggacactgggnaatttagtcaatccctttgtgctttaatttcttcaaatgtgaaatagaaataatatttttagtagccgtcttacaaaaaacaggttgttataaaaaaatg

SEQ ID NO: 35673 - DNA, 201 bp, Homo sapiens
  misc_feature (1)...(201): n = A,T,C or G, or insertion/deletion polymorphism (see Tables 1-2)
caaggtgaggtagaagcaggtaacccttgtctgcagctatgctgaggctgaattgcacaaattaagaattaggcctaggtctgcagcttaatctagccctnacacatacatacagagccacaagctaagaaagagttcatgttgtaacctagtcaccaaaactggacagatctccaaaagcaaactaaatactagcagaca

SEQ ID NO: 35674 - DNA, 201 bp, Homo sapiens
gtacaaatactgttaaatttatttgacataaaactgataataaacataggtttgggtataaacactgttagtttgtgtaagtgaaaggacaagagactatsaactttatgaatatataaccaagtaatctacaactgcttaggggcttttatgaaaatctctaaatcttttgatcaagacctttacagagacactgtagca

SEQ ID NO: 35675 - DNA, 201 bp, Homo sapiens
gaagtcatcctaaagagtgacagggaagctgctagctcttgtgtgctgccaccacacctggccccctaacttgttttttgaagcaaaaatattgacaccarcacgtgacaagaccatgtggggaaacaaaaatttcaggacaatttcagaaatgatcatagatgcaaaattccaaagtatcaacaaatccaacctagcaat

SEQ ID NO: 35676 - DNA, 201 bp, Homo sapiens
aataaggagagttaagagggctcaatgcagatgctgagcaggtttagccattgtgaaaaagcaacaggaataaaagctaaggaggcagcagctagagcaayaagtccaaggtcttagagatagagcagttttgaaggaagacaaattaaaggtgtttctgtataagtgggtgaatgaagcagagcagagatgaaggcaata

SEQ ID NO: 35677 - DNA, 201 bp, Homo sapiens
tgactcatgcatttatttattccacaaacaggtatcccatcccattgtgttataataatctattaattgtttttcccagtagatactgagattcttaaaartaggaactgtcacctgggtagccctagtgcctagcacagtgctgagcacacgtatggttttattcctaatatgaattcaaggaaggaaggtacaagtgaa

SEQ ID NO: 35678 - DNA, 201 bp, Homo sapiens
gcctgagatatgattttattaagtgaattataaaacctgtctcagctgggctcagtggctcatgcctgtaatcccagcacttgggaggctgaggtgggcaratcacttgaggtcaggagtttgagaccagcctggccaacatggtgaaaccccatctctactaaaaatacaaaaattagccaggtatggtggtgggtgcct

SEQ ID NO: 35679 - DNA, 201 bp, Homo sapiens
tttgattaaatttattcctaagtattttattctttttgatgctattgtaaatggaattgtttgtaaattttatttaaaaattaacggctagcgtatagaayattgctgattttcaaaataccttgtatcctttgaaggttttaatagtttcatttgtagatatcttagggtgtcctatatacaagattgtgtcatctgtga

SEQ ID NO: 35680 - DNA, 201 bp, Homo sapiens
tagtttctttctattttccataagtgtcggctggctgagaaataaagggagacagtacaaagagaagaattttacagctgggccgccaggggtgacatcaygtatcagtaggaccatgatgcccgcctgagtctcagaccagcaagtttttattaagggtttcaaaaggggagggggtgtaagaacagagagtaggtacac

SEQ ID NO: 35681 - DNA, 201 bp, Homo sapiens
agacggggtttcaccatgttggccaggcgggtctcaagctcctgacctcaggtgatctacccacctgggcttcccaaagtgctgggattacaggtgtgagmcactgcacccagccaacacttttagtttcttaagccaattaattagagctctttcatacattttcagtagtgaaacagtgtgtacacaacatgtaaatac

SEQ ID NO: 35682 - DNA, 201 bp, Homo sapiens
agccaatgttttaaacatgaaatagaatagaataaaatggaataggatagaaaatacctgagtacattgcatgtaacaagggtattatttcatgaaacttrcgtttcataggtacccttggtagggggactccagggtcctaatgtaaaatgtagtctttactgggatgataggcaaaatgtttgaaagcccctgctcttc

SEQ ID NO: 35683 - DNA, 201 bp, Homo sapiens
  misc_feature (1)...(201): n = A,T,C or G, or insertion/deletion polymorphism (see Tables 1-2)
cggcagccaggctcggagaaaggccccagaagccagtgcagggaatttgtcctgtgagtgaggggagctgcagaaagttataaagcaaagaagggacattnctgagtttttatttagaaaaaccatttcagctttgcagagaatggactggggaacaggtagaaccactggagtaagggagagtggttgggagggtgtggc

SEQ ID NO: 35684 - DNA, 201 bp, Homo sapiens
  misc_feature (1)...(201): n = A,T,C or G, or insertion/deletion polymorphism (see Tables 1-2)
aactccttctgtgtgcaagtcatcatcccagatacagaggatacagctgtgaagaggcttttgccctcatgaagccatctgtcttcctaagtagagggctngtgagtgaaagcagaggaaaagggtgagataggcggcagccaggctcggagaaaggccccagaagccagtgcagggaatttgtcctgtgagtgaggggag

SEQ ID NO: 35685 - DNA, 201 bp, Homo sapiens
tggaataagtggaggaagattggaaagtgaaaatgtggagaaaataaaacaaaaatctgtactcatcagaccatgcacctgagaataaactttcttacatrggaatgcttttatttctcaggtacatcaaggaaacaaacaccaaaaatgacccaaatgaactcaacaatcttatcaagaaaaactctgatgtgataacat

SEQ ID NO: 35686 - DNA, 201 bp, Homo sapiens
agaggctgaggcaggagaattgcttgaacaagggaggcagaggttgtagtgagccgagattatgccattgcactccagcctgggagacgagcaaaagtccrtctccccacccccaccatcagaaaaaaaagtaaatcagtagtgcatccagtccagagtccatagaacctttggcctggttgaggtaaacatacagccaat

SEQ ID NO: 35687 - DNA, 201 bp, Homo sapiens
aaaccacgtctctactaaaaatacaaaaattagccaggcatggtggtgcttgcctataatcacagctactcaagaggctgaggcaggagaattgcttgaayaagggaggcagaggttgtagtgagccgagattatgccattgcactccagcctgggagacgagcaaaagtccatctccccacccccaccatcagaaaaaaa

SEQ ID NO: 35688 - DNA, 201 bp, Homo sapiens
  misc_feature (1)...(201): n = A,T,C or G, or insertion/deletion polymorphism (see Tables 1-2)
gttgtatataggattccaaacacggctccagcgggatcctgacatataccatcacctgtaagtctggaagcacctggcgcccccaggccattgctgaggangctgtggatatgcataagcagtcagtgactgccgaagcccccagattctgactaatgtgtgagattccaccattagagcttcattcctttgttagtttgt

SEQ ID NO: 35689 - DNA, 201 bp, Homo sapiens
  misc_feature (1)...(201): n = A,T,C or G, or insertion/deletion polymorphism (see Tables 1-2)
tatctctcttacaggttttggaatcattttcaaataaaactccccctcacaccacccaactggaagtcattcctgatgtgctgtgagcagaatgggcctgngattttgcaagtaaggaatatcctgtaggtttgggagctgtcctaccgtgcatcccgtgacactctctttgacacctaaattaagcagacgcgttgcctg

SEQ ID NO: 35690 - DNA, 201 bp, Homo sapiens
cctctgccatcatgggcagctgctcctcccagggacaggagggatccatactctgcttcctgggttgcccctgctagtggttccatgtctatttcagatcyatagccgggtggatgtcatcagacacgtggtgaagaatggtctactctgggatgagttgtatataggattccaaacacggctccagcgggatcctgacat

SEQ ID NO: 35691 - DNA, 201 bp, Homo sapiens
atacatacttttctacctgtgtgtttatcaacgcgattttccacagtattgtattttcctacatcatttttaatgcctgcttacctgataccacatacctrtattagcactttatttaacctctttgacctgtaagtcatttctaacttttcactatttgaaacaatggcaaataatcatgtggatgtgtcttgcacacat

SEQ ID NO: 35692 - DNA, 201 bp, Homo sapiens
gaggcttagcaagcttaaggtcacataattagtaagtgcagggctgagactcaagaccatctctgcttgtctcctaatcctgtgctgctttggctcttcarcagtttaaaagttgggattctttaaggataaggatcttgaccacttgatttaaagtaatcctgttctatgacaggccagaaactatagactgttgtgagc

SEQ ID NO: 35693 - DNA, 201 bp, Homo sapiens
ctcccaggcctgtttctggacatagcaacatttctctacatatatttgttttcaataagatgtcccacatagttggtagtgagggagtgttattgttgccrttgtttttatttttttttaattttggcaaagcacacaccacctttgggatgttgctattgtttttaaatgaaatcctagtacagatattctgcaacttgc

SEQ ID NO: 35694 - DNA, 201 bp, Homo sapiens
  misc_feature (1)...(201): n = A,T,C or G, or insertion/deletion polymorphism (see Tables 1-2)
tggtcattgaattagtgaattcctgcatcacatttttgtctgtgctcacctctgagcaagaatttggtgggctagttggtttaagggaatggcccactgantttctgtctgcctgcacttcaaaactgtttaagtctttaggatcatatctagaatatttgcactgaaattcagaaagggcaatttgccatttttatattt

SEQ ID NO: 35695 - DNA, 201 bp, Homo sapiens
aaccctttccacttgatgtcctaaacgaatgaatgaatgaatgaatgagttcatcatatgtgccttctttaatatgtatagcattaccatccattctttgrcactgacaaatttttgctcccactgactggtttatgagcgtgccttttctccccataccttaccagctcagaacattcttagtctttcagactgttctca

SEQ ID NO: 35696 - DNA, 201 bp, Homo sapiens
  misc_feature (1)...(201): n = A,T,C or G, or insertion/deletion polymorphism (see Tables 1-2)
ttgacacattagtcctcccctcttagctctcctgcccatgaggaagcaggttctgccagctttattcccagatgcagctcaccaagcatttgcacgttganactgcatttctgtgttaacttatgctctgtattctcccatccacttctctgagttcagtaaattatagttggattctcttcgtagctatttatctgaaga

SEQ ID NO: 35697 - DNA, 201 bp, Homo sapiens
ttaaaacctttaaaggctcctccagtgtcagattcgaatccaacatttctgcgctttgctttctttatggctctattcttcaagacttcctcactggccayggagaatgttcccacctcttaagcttcatcttcttgatcccaattcctatctgtcagttccttctcggcatttcttttggccgtgttttcgaacctcctc

SEQ ID NO: 35698 - DNA, 201 bp, Homo sapiens
aagccactgtgcccggcccggaaaaaggcaatttaatggagaaagggtagtcttttcaacaaatgttactggagaaattgcacacccatacacacacacamaaaaaaacctacctcgatctgaaccaaaaaaaaaacctacctcgatctgaaccttatgtcacatgcaaaaagtaagtaaaaatggattatagatataaat

SEQ ID NO: 35699 - DNA, 201 bp, Homo sapiens
  misc_feature (1)...(201): n = A,T,C or G, or insertion/deletion polymorphism (see Tables 1-2)
tcccagcctctggttgcctcagacactccttggcttgtagatgaccatctttactctgtctcttcacatggcattttccctgtgtgcctatctgtgtccanattttcctttttttataaagacatcagtcagattgttttagagcccacctacatgacctcattttcacttgattacctccataaggaccctgtctccaaa

SEQ ID NO: 35700 - DNA, 201 bp, Homo sapiens
  misc_feature (1)...(201): n = A,T,C or G, or insertion/deletion polymorphism (see Tables 1-2)
ctgtctaacagtgtggcagaaaatgccctgctttgcaatatgaagataacctttgtcccgttctttgctttcttctctaagtctatattcattgcctcccngagtgtgtaaccacatgagaaatagagggaaggttctgtccttaagaagttaaaagtgtgactgggaaggtaaaacatacttattaagggttaactagca

SEQ ID NO: 35701 - DNA, 201 bp, Homo sapiens
  misc_feature (1)...(201): n = A,T,C or G, or insertion/deletion polymorphism (see Tables 1-2)
tctagctcaaaacatgatggagcatgaaggaaatgttgagatctgagagcacctcaggaggagccaagaaagagaatcatctggattcaccatgtagaccntagagcagaacaggaaaggcctgaagtgggtcatccaggcttaggtgctcttggaatatggttcctaatggggtgtgtgcagcctcaatgtagacacatc

SEQ ID NO: 35702 - DNA, 201 bp, Homo sapiens
taacatatgtaagatgaacattggttcggtttggaaaagcaggacaacttgaagcagggagggggcttccaggtcataggtagataagagataattggttgcattcttttgagtttctaattagcctttccaagggaggcaatcagatatgcatttatctcagtgtgagcagaggggtgactttgaatagaatgtgaggca

SEQ ID NO: 35703 - DNA, 201 bp, Homo sapiens
gaatatggcagcaggtcagaaatctgctttctttccatgctttccagttatgctttctgtgatgaatgttaggtgagatagtcaccgtaagattaaggaaraaatgggtcaatgtggtatgtccctgatactgcataaacacaacctctatttgtgattcaaatgttaggcagactgtcctgggcaaagatgattttcttt

SEQ ID NO: 35704 - DNA, 201 bp, Homo sapiens
gatcttcatttctttcctctacagcatgactttttctcgtctgtgcctactgttagaactacccctccttcaagcagcatcactgtggaaaatggaacttycctacctggttgatgtccacaccatgagcatttgatatgttctaacaacaaagatgaatcccctcagaatctcccgtcactttcacagtcatccttgaac

SEQ ID NO: 35705 - DNA, 201 bp, Homo sapiens
  misc_feature (1)...(201): n = A,T,C or G, or insertion/deletion polymorphism (see Tables 1-2)
ttttcatgtattacaaaatatcattgtccttttgattttctttacaaccatttaaaaaggtaaaaaccatctcctcagctgtgggcaagcttcaaaagaanaaagaagccactcttagcttgcaaggttgtacataaacaagtagcagcaggttggattcggcccacacatggtttgccaagccctgatttatagtatcct

SEQ ID NO: 35706 - DNA, 201 bp, Homo sapiens
cacttcccaccctaaggcagaacacattttctataaagggccagagtgtaaatattttaggctttgcaagccatacagtgagagttgcaaccactcaaccrtgctgttgtaacccaaaggcagccatagatggtcctgaataagactgactgtgttccaatcaaattttatttatggataatgacatgtgaatatcatata

SEQ ID NO: 35707 - DNA, 201 bp, Homo sapiens
  misc_feature (1)...(201): n = A,T,C or G, or insertion/deletion polymorphism (see Tables 1-2)
caatcaaaaatttatttttctgtgtatttaggaagtttatgtatatttgggcagctaattttaaggaaacaaatgagaacctgcccggaatagacataatnaaaactaatctatgccttgacctttcctcacccactttgttgccttttcacatgacgttcccgctatctcatctctgcttctcaatacattccttttcca

SEQ ID NO: 35708 - DNA, 201 bp, Homo sapiens
gagtgcccctgcccccaaagatatgttcacccggaacctctgaatgtgaccttatttgggaaaagggactttgcagatataattaggctaggaatctcagratgaaatcaccctggagtatctgggtgggccctaaatccaatgacaagtgtgcatccttatataagaggagaagagacagacaggaaagaaaaaaaaaca

SEQ ID NO: 35709 - DNA, 201 bp, Homo sapiens
ccaaattatttttgatattggagaaagattgaagaaagaaggaaaatcatttatataatactttaaatttacataatatttcatcatagaagtatctttttcacattataaagctaatatacacttataataaaagcatttaaatgatacaaaaatgtaaaaagtagaaagtgtaattcctccagaattttacatcctccc

SEQ ID NO: 35710 - DNA, 201 bp, Homo sapiens
cctctacctcccgggttcaagcaattcttctgcctcagcctccctagtagctgggactatgggcacgtgctgccacgcctgtctaatttttttgtatttttagtagagacagggtttcaccatgttggccaagatggtcttgatcttctgaccttgtgatctgcccaccttggcctcccaaagtgctgggattacaggagt

SEQ ID NO: 35711 - DNA, 201 bp, Homo sapiens
ttaatactagatggtaacagtaagtaaagaaagaattgtagttttacagtttttttgtttatttgtttgtttgttttttgaggcagagtctcactctgtcrccaggctagagtgcagtggcatgatcttggctcactgcagcctctacctcccgggttcaagcaattcttctgcctcagcctccctagtagctgggactat

SEQ ID NO: 35712 - DNA, 201 bp, Homo sapiens
cctcaggaagaatgcttttggtggaatgacgagggtgaaatccatagtgtgtggcttaaggagtgaatggaaagaagaggaggagagagaggtggagagamtacacctctttccagaagtttggctctgaaagtaaagagaaagggttaatactagatggtaacagtaagtaaagaaagaattgtagttttacagtttttt

SEQ ID NO: 35713 - DNA, 201 bp, Homo sapiens
  misc_feature (1)...(201): n = A,T,C or G, or insertion/deletion polymorphism (see Tables 1-2)
caaacttttccacttcctaattttgtctaagataagaagattctaaaaacaaacttttccactttctcattttgtctaagtccagccctgcttgcatccantggaagataaaagattaaaactagagattattttcaacaagcatgaattgaggacctactataattggtttattgagcaatcttgcttcactggacaatg

SEQ ID NO: 35714 - DNA, 201 bp, Homo sapiens
  misc_feature (1)...(201): n = A,T,C or G, or insertion/deletion polymorphism (see Tables 1-2)
aagttatatgaaccatattatctggctatattgtaataatcatataagaaataagagacttaacttacctatactgttataggttaaaaaaaattgtgagncatttacattaacagtgaagaagggaaacattgatattttcttttcataaaaacaccacactacttcttttagcatctgagatagaaacagaagctaata

SEQ ID NO: 35715 - DNA, 201 bp, Homo sapiens
  misc_feature (1)...(201): n = A,T,C or G, or insertion/deletion polymorphism (see Tables 1-2)
agtttctgtatatgaggcctagcattaaactcagatttgtagggaaagtctgattcatggcatggaaattggaaaagaccttatactgttgtaggtcttgntgggaatatctgcaaggcatggcctgattagaactccaatctgtaagctgccatttacttgctatgcctcattttatgacccagttgctgctacttcatc

SEQ ID NO: 35716 - DNA, 201 bp, Homo sapiens
  misc_feature (1)...(201): n = A,T,C or G, or insertion/deletion polymorphism (see Tables 1-2)
ttgtaggtcttgctgggaatatctgcaaggcatggcctgattagaactccaatctgtaagctgccatttacttgctatgcctcattttatgacccagttgntgctacttcatctcatgaatttgttggtgctaaagctattggggtggttataactaccctgtagcttgagttgagaaccaaggaatgttactgcttatga

SEQ ID NO: 35717 - DNA, 201 bp, Homo sapiens
tcttcaaaatcaatgtttaagtttttcctagtcttgtattaggtcattattattattatatggaaggaaacttgcaggatctccacaaagtgtcaggttcwtttgctgagatggatcaatagattcatgtttgaagacattgcctttttgcatttggcacaatattatcttgctgattactggcttcactcatagatgcat

SEQ ID NO: 35718 - DNA, 201 bp, Homo sapiens
cttgtattaggtcattattattattatatggaaggaaacttgcaggatctccacaaagtgtcaggttcatttgctgagatggatcaatagattcatgtttkaagacattgcctttttgcatttggcacaatattatcttgctgattactggcttcactcatagatgcatttaaaaagctctttcaaagggtgcagtatttg

SEQ ID NO: 35719 - DNA, 201 bp, Homo sapiens
  misc_feature (1)...(201): n = A,T,C or G, or insertion/deletion polymorphism (see Tables 1-2)
ggcgcggttcagttcatacatctctgatgttgacatcagaagcagaaacgccggagaatattgtatagtagaaacacaaaagatttatagggataactaanaccaagccattcggagcctgatatgtgaagtttccttccgtgttcaggctttctgagttttgctctatggtattctggcctctatttctgttagctggga

SEQ ID NO: 35720 - DNA, 201 bp, Homo sapiens
  misc_feature (1)...(201): n = A,T,C or G, or insertion/deletion polymorphism (see Tables 1-2)
gatgttgacatcagaagcagaaacgccggagaatattgtatagtagaaacacaaaagatttatagggataactaacaccaagccattcggagcctgatatntgaagtttccttccgtgttcaggctttctgagttttgctctatggtattctggcctctatttctgttagctgggaaggattttaatgtaacgttaagaaa

SEQ ID NO: 35721 - DNA, 201 bp, Homo sapiens
  misc_feature (1)...(201): n = A,T,C or G, or insertion/deletion polymorphism (see Tables 1-2)
ggtgttcatcttaagtcatagtctctgcagatattgcttgatctaagggagtggcaccctttgttttgattttcctttgatctttggaagaccatgcattnctatttcagtgatgcttttaaaaagccatttttgtcattaatccagatttgttctcatttgattctagttgttgaaatggatgaaaacaacggacttttg

SEQ ID NO: 35722 - DNA, 201 bp, Homo sapiens
tggtttctactgaatgtgtgtcatttttgcagatcagatgcccctccctgtgcattcccatagcgcctcgaagtcatctctatcaatcattcatttagtcktaaggaagtcttgtttgtatatgtgtatccctgacatgactgagacctcataagttctctaagtgccatatgaataaagaaatgaattggtgttcatctt

SEQ ID NO: 35723 - DNA, 201 bp, Homo sapiens
gccaggagaaaagccaaaccaggttctctcccagagcctctggaaggagccaaccctactgccaccttgatttcatattcaggcctcttgaactgtgagaraataaatttctgttgttttctaaaggcactccatttgcggtcatctgctatggcagcttcaggaaatgaatctacaaatttataaattttctttgcccca

SEQ ID NO: 35724 - DNA, 201 bp, Homo sapiens
  misc_feature (1)...(201): n = A,T,C or G, or insertion/deletion polymorphism (see Tables 1-2)
tttaaaagtcctctcatatttgatattctattttatacattttcatggcttggtcgttttgtgtccttaatcaactagaatacttagagaactaattgccncagcaccatgttagatggtccacatatttatgataccttctttagaataaacagttaacataattaggatccactttttggctgacctaatgtcaataat

SEQ ID NO: 35725 - DNA, 201 bp, Homo sapiens
  misc_feature (1)...(201): n = A,T,C or G, or insertion/deletion polymorphism (see Tables 1-2)
gagaaagacagtaagaccatttgtttttgcctatcctttctctgcttcttaacaagaaccagattcccctccaccaccttaccccaattcctgccaaaganctctgttgctcttcttcagatcctacccctcccactcaaagctgcaaactgtccagggccaatcagtagcttcacaggcgcattctatccctgtacttcc

SEQ ID NO: 35726 - DNA, 201 bp, Homo sapiens
tttctaaaggcactccatttgcggtcatctgctatggcagcttcaggaaatgaatctacaaatttataaattttctttgccccaggaatttttaaaagttkgcaatctagttttccatcaagcatgaccaaagaatgacaggtagatgagagaactggattagaacgtctctggaggttggatttcaagagtttcctggtt

SEQ ID NO: 35727 - DNA, 201 bp, Homo sapiens
  misc_feature (1)...(201): n = A,T,C or G, or insertion/deletion polymorphism (see Tables 1-2)
caaaccagaagtggcttaggagctccatggagggaacacaagagggcagcttttataggatgaacatagaagtaaagcaaagaaaatatttgatgggttanaattatacagttgccttgtttggtctatccctttggaaagtccctagttacataagtttattggctacttctgattggttgagcttaagttctgttttta

SEQ ID NO: 35728 - DNA, 201 bp, Homo sapiens
  misc_feature (1)...(201): n = A,T,C or G, or insertion/deletion polymorphism (see Tables 1-2)
atgtgccactgtacctggcttctgatgaggtttatgaacatactaggatccataaatcctgctcttgtttatacctcaaagaaattctgttgtgacagaanctaggagtctacccctgggagagtgaatttgtaaaatgtggtagacatgaaccgtggaatactcaactgcagttagatgtgggctagatgtacacatggc

SEQ ID NO: 35729 - DNA, 201 bp, Homo sapiens
  misc_feature (1)...(201): n = A,T,C or G, or insertion/deletion polymorphism (see Tables 1-2)
gcaaggttatgatgaggcataaccaattttgtctgctcaagaattcttcaggcctggttttcattttgttttctttaacattttagtacctataaatttanttctttaactgctgcatagtattccacagaagaatgtaccataatgtatttgctcattcctctgttgatgttaccaatattttgttgcaatggacaactt

SEQ ID NO: 35730 - DNA, 201 bp, Homo sapiens
acaggcatgtgccactgtacctggcttctgatgaggtttatgaacatactaggatccataaatcctgctcttgtttatacctcaaagaaattctgttgtgrcagaacctaggagtctacccctgggagagtgaatttgtaaaatgtggtagacatgaaccgtggaatactcaactgcagttagatgtgggctagatgtaca

SEQ ID NO: 35731 - DNA, 201 bp, Homo sapiens
tcattagaaaaattatactagaatagaagtagaattggtgaatcaaaggatattcacatttaaaagttattatatagattacagatggtcctgacttacartggttcaacttatggtttttcaactttatacaatgatgtgaaagtgatgcacatttaatagaaactgctttgaatttgaattttggtctttttccagagc

SEQ ID NO: 35732 - DNA, 201 bp, Homo sapiens
gtagtaatcagaaaactgcaagtgaagcaagcaagtttcactttacatcatttagagtagtaaaaagctagaagctaagatgatgccaaacgtcagagacrtagaagtcctcatccatgtgatgggagtgtggctgttgcagccattctgaagagtaatctggcagtaactagccagatgagttttttgtttgttgttctt

SEQ ID NO: 35733 - DNA, 201 bp, Homo sapiens
  misc_feature (1)...(201): n = A,T,C or G, or insertion/deletion polymorphism (see Tables 1-2)
attactaagaatacagatgaagaaacacatagggagagacataggggaagggatgcagagttccatgccctccctgggctccaccctccaggagcctccangtgttcagctatctagaagctccctgaacccagtcctcttggatttttatggaaacttcgtgacatcagcattccttcccccagggtatgaggcgaggcc

SEQ ID NO: 35734 - DNA, 201 bp, Homo sapiens
taatatatttagccatttttctgttagaatttaagatcatcatagttttatttaaaattaaaactggtatttttgcgtttaagagcttctctgtatttggwgttgtttcataaggtagttgaattactggtaaaatagtatggcaattaaagcattcaccaccaaccttcatatacttcagcctgaaggtgggcttcacat

SEQ ID NO: 35735 - DNA, 201 bp, Homo sapiens
catgatgcagaagatatatatatctatatatctatatagatagatgaaaacaaatatgtatattttctataatgttctataacacaagaagtttcccaaayatttatttacattgtttgtttattcccaaatatttatatttcccaaatacgacagcagggagactgagaaatcacaaaggacagatgagagcgatgttac

SEQ ID NO: 35736 - DNA, 201 bp, Homo sapiens
atcttgtgaatattatgatattagacataatgtcagattctatgcacatataattttatgttcacattaaatattaactaatatatttagccatttttctmttagaatttaagatcatcatagttttatttaaaattaaaactggtatttttgcgtttaagagcttctctgtatttggagttgtttcataaggtagttgaa

SEQ ID NO: 35737 - DNA, 201 bp, Homo sapiens
tggcccaaggtaaagtgttctctgtatgtctattaggtacagtcagtttatggtgttgttcaagtcttctattccctgttaatcttccatctaactgttcygttctctagttttcttgttagacttaatttttcaaacagttattttatgtaaaccatttttgcatcttgtgaatattatgatattagacataatgtcaga

SEQ ID NO: 35738 - DNA, 201 bp, Homo sapiens
gagcccaagctggggctgaggacagtagagctgaacgaagacgcacctgagacggtctacaccagcggtgtcgctgcccgaaagtgagagaaggctgataytgctagctggaatccaggcctgggtgctgcatggtggcgcccctccccgtgaccaccgctgcgttttctcggggtgagaaaggcgcccccaccatgcccc

SEQ ID NO: 35739 - DNA, 201 bp, Homo sapiens
tggccgttcaggttagttcttcttccctcctctcccacaccatggagacacaggaagagaaggaagatacgtgtttttctctagtgctgacattagagccygagactccggccttgcatgaggccagatgggctaaggtttctatgctgggtttttcgagatctccccagacccttccagcaaattcctctttttactcga

SEQ ID NO: 35740 - DNA, 201 bp, Homo sapiens
  misc_feature (1)...(201): n = A,T,C or G, or insertion/deletion polymorphism (see Tables 1-2)
gcctagcacagtgctgagcacacgtatggttttattcctaatatgaattcaaggaaggaaggtacaagtgaatttctctttcccattgtcagcatgagtcncctcttaaaataggcttcaatgtctttagcagtaaaattaaggtttgaattagaatatcttttacatactttccagttgtaaagttacttgttccatatt

SEQ ID NO: 35741 - DNA, 201 bp, Homo sapiens
tctaagaaatattttttaaattgcctaatccaaggtgatgaaaatttattcctattgttttaagagttttatagttccagctcttatatttaggtctttgrttcattttgcgttaatttttgtacattgtgtgatgtaggggcccaaattcattcttttgcatgtggatgaattgcagcaccattttctgacagactattc

SEQ ID NO: 35742 - DNA, 201 bp, Homo sapiens
  misc_feature (1)...(201): n = A,T,C or G, or insertion/deletion polymorphism (see Tables 1-2)
tctaaatcttttgatcaagacctttacagagacactgtagcaaagtgttaagagcaaaggcaatggggccttctcacctgggtgcggatccaggctccaanagacagtctggggacactgggcaatttagtcaatccctttgtgctttaatttcttcaaatgtgaaatagaaataatatttttagtagccgtcttacaaaa

SEQ ID NO: 35743 - DNA, 201 bp, Homo sapiens
gtattttatctcacatatatgctgtaaaatcttaaactataagatcttttctctttgaaatatgtaacctttggttgactattctaggggtcaaggatttyagagtgatgtaaattatagatatatatttactactacagtttttccttgtattggccccagttggatcttatccagcttggcttttataaaagaggtgtt

SEQ ID NO: 35744 - DNA, 201 bp, Homo sapiens
acttttgctcaaaaaaaaaaaaaaaaaaagacaaggtcccaggagaaaaacaaaaacatgaagtccttttaaatacaaacacacacatatgcgtgcgcgcrtgcgcacacacacacacgcacgcatcttggatgttaggttttaattaagctgacttttaaccattgagctccttaaaaaaaaacttttaaaatctcatta

SEQ ID NO: 35745 - DNA, 201 bp, Homo sapiens
atttaaaatgtataagcaaaagtttgtactctgagcttgcaagcagaggcatttattaaaatttcttttttacttatttccttttgaatgtttttaaatgwtatgaaaaagcttaagaatgtggagctatgtaaaataaaaaggaagtaaccccaccaagcacctctcaggaaaccctgtttcctgcccttccctccaccc

SEQ ID NO: 35746 - DNA, 201 bp, Homo sapiens
cactggagtgcagtggtgtgatctcagctcactgcaacctctacctcccgggttcaagtgattctcctgcctcagcctcccgagtagctgggactacaggygtgcaccaccacgcctggctaatttcttgtatttttagtagagatggggttttgtcatgttggccagcctggtctcgaactcctggactcaagtgatccg

SEQ ID NO: 35747 - DNA, 201 bp, Homo sapiens
tcatcgactgtgccagatggagctgagatgtccaggaaggggctgactacactagaatgcattatttgaatatcatgatgtggaagattttttgggggggkgggcagactcttgctctgtcacccacactggagtgcagtggtgtgatctcagctcactgcaacctctacctcccgggttcaagtgattctcctgcctcag

SEQ ID NO: 35748 - DNA, 201 bp, Homo sapiens
tgtaacctcagttcacgatggatataattgttttatacaaatggtgcaaaaaagagaaatagatctaaaaatgccaaacttccaatcattctgtgtcattyaatagcctgtcacttatggaaagtttgcctctactgatattagcatgatatttaccgggagaaaatttgttgcagacactgaaagggctcctctaaactc

SEQ ID NO: 35749 - DNA, 201 bp, Homo sapiens
aaaaaggacccccacacagaaacccaatccaaaggtcatcagcctcaaagatcaaaggtagataaatccacgaagatgaggaaaaaccagcacaaaaacamtgaaaattcccaaaaccagaatgcctcgtctcctccaaatgatcgcaactcctccagaaagggcacaaagctggatagagaatgagtttgatgaactgac

SEQ ID NO: 35750 - DNA, 201 bp, Homo sapiens
ccagtgtcagattcgaatccaacatttctgcgctttgctttctttatggctctattcttcaagacttcctcactggccatggagaatgttcccacctcttmagcttcatcttcttgatcccaattcctatctgtcagttccttctcggcatttcttttggccgtgttttcgaacctcctcggcggccgccgctgcactcgc

SEQ ID NO: 35751 - DNA, 201 bp, Homo sapiens
ggtaagaaatccaacatgtctctcactggactaaaatcaaggtgttggcaaggctgtattactttctagagatcctaagggaataattcatttccttgccwttctagcgtctagagactgcccatactccttggatcacggcccttcctctattatcatagccagcaatgaagggtcaaatccatctcacatggcatcatt

SEQ ID NO: 35752 - DNA, 201 bp, Homo sapiens
tgtttaaaatgaaggacaaaagtgattggcgtaggtagttgcagtgactttcctcagtggtctgtagatctgtttccataacagcaagaagagagctgttmcattgtgggttggtgagccggtgggttgggcatgctcatacacaaactgctcggtagggaaaggagaaggcacatgagcaagggatggccctggtggcca

SEQ ID NO: 35753 - DNA, 201 bp, Homo sapiens
cacttgagtcaccatttggctgtagaattctccctcagaattctgtaaacatcactccattgggtctcctggcattttatttccaaataagagagcaatgwccactggtttctttgcacttggcagacacctgattttggtgaaggtgttggagtgtcttttgttgggagaagtgagtgtgaggagggtgggggagtgttc

SEQ ID NO: 35754 - DNA, 201 bp, Homo sapiens
ttaaaatgaaggacaaaagtgattggcgtaggtagttgcagtgactttcctcagtggtctgtagatctgtttccataacagcaagaagagagctgttacawtgtgggttggtgagccggtgggttgggcatgctcatacacaaactgctcggtagggaaaggagaaggcacatgagcaagggatggccctggtggccaggg

SEQ ID NO: 35755 - DNA, 201 bp, Homo sapiens
ttatgaaaactttcaaatacataccaagcttcaacttttgtcaactgatggtctaccttgttttagctctacctgtactcgttccttcattttccctaccyccactgttttgaggaaaatctcaaacattaaatatttttgttcataaatgttaacatgcatctctaaaacgtgaagattgcttatgaatttttgattgtg

SEQ ID NO: 35756 - DNA, 201 bp, Homo sapiens
ccactttgcatttgggaaagaggctgactgaaggaatgtgatttttgttttttctttgagacagagtttcactcttgctgcccaggctggagtgcaatggkatgatctcggctcactgcaacctctgcctactgggttcaagcaattctcctgcctcagcctcccgagtagctgggattacagacgtgtgccaccataccc

SEQ ID NO: 35757 - DNA, 201 bp, Homo sapiens
tcttgtatttttagtggagacaagatttcgctattttgcccaggctggtcttgaactcctgggctcaagcaattcttctgcctcagctccctaaagtgctyggattgctggtgtgagccaccatacccagcttgtttcttttattctcagaatattcttaatattctcaagaacattcttggcctcccttccctgccattt

SEQ ID NO: 35758 - DNA, 201 bp, Homo sapiens
tacagtgttataatgttctacagaagagggatgtacaccaagaatgccagcctggacctctggtgtgtcttggaagacttaaccaggaaggggacgattcrtttctatttgacccaagactgatgctgcgtggtgaaggagaggaactgcgttccaggcagaggaagtccagatgcgcaagagcagagatgggagggacag

SEQ ID NO: 35759 - DNA, 201 bp, Homo sapiens
tctaaaaaaaaaaactgtctcctcatgcttctgattgaagggaccacataatatgactgcaaagacagtaaactccttgactcatgcatttatttattccwcaaacaggtatcccatcccattgtgttataataatctattaattgtttttcccagtagatactgagattcttaaaaataggaactgtcacctgggtagcc

SEQ ID NO: 35760 - DNA, 201 bp, Homo sapiens
acaagattttgctctcctttttctcatataatatctaagtaactgtctttcttgctattgtgtgtgtgtatatatatatatatagctactatatatatatacagctactatatatatgtgtatatatatatatagctactatatatatgtgtgtgtgtgtgtgtgtatatatatatatatatatatatatatatatataca

SEQ ID NO: 35761 - DNA, 201 bp, Homo sapiens
  misc_feature (1)...(201): n = A,T,C or G, or insertion/deletion polymorphism (see Tables 1-2)
agaacatgtacattagcctgcagttgggcacaatcacctggcaacatggtccactgtagagtatctggtgtttacccttgtgattgcacatggctgactgngagctgcacccgctaccgctgcccagcatcttactgtgtatcactagcccagaaaagataaaaattcagagtatggtttctactgaatgtgtgtcatttt

SEQ ID NO: 35762 - DNA, 201 bp, Homo sapiens
ttggctcttcaacagtttaaaagttgggattctttaaggataaggatcttgaccacttgatttaaagtaatcctgttctatgacaggccagaaactatagwctgttgtgagcttccaggctctgctttgcctctgaatgttcaggtggagacttgaacactcggcttttagaatgacgataacagcaaagatttcttgagt

SEQ ID NO: 35763 - DNA, 201 bp, Homo sapiens
cacaagattttgctctcctttttctcatataatatctaagtaactgtctttcttgctattgtgtgtgtgtatatatatatatatagctactatatatatatacagctactatatatatgtgtatatatatatatagctactatatatatgtgtgtgtgtgtgtgtgtatatatatatatatatatatatatatatatatac

SEQ ID NO: 35764 - DNA, 201 bp, Homo sapiens
aaacaatacacagaaaagcatgtatataggtgcacatatttttttcttttgccttctgctccaatgtgactttcacgtggaactgaggacaaaagtgtggytgagtgaacctgttctacatggttgtgatataagttgaaatctaacagagaactttggctatatgaattcattcaatggaacaacaaaaatctagagagg

SEQ ID NO: 35765 - DNA, 201 bp, Homo sapiens
  misc_feature (1)...(201): n = A,T,C or G, or insertion/deletion polymorphism (see Tables 1-2)
tttttggaggtattaattgcctttcaaactcatcatttctatcacactaactctccattcttaaatgcatggctcctgtagctctccatcctcctgctccnacctggaagggctcctctctagctctgctgcaaatctgctacctttcactgcctccagaccccacccatgcctttcccttccttgcttcacttctatgtg

SEQ ID NO: 35766 - DNA, 201 bp, Homo sapiens
  misc_feature (1)...(201): n = A,T,C or G, or insertion/deletion polymorphism (see Tables 1-2)
gtacttgctattgaagaaatcctatatggaaacttcagtaaaagtaataatctgctacctgatttataggtaataataataaaaaaactggcactgggcanggtggctcacacctgtaatcccagcactttgggaggccaaggcaggtggatcccctgaggtcgggagtttgagaccagcctggccaacatggtgagaccc

SEQ ID NO: 35767 - DNA, 201 bp, Homo sapiens
gcatggcaggaacagctatttaaactgtggggctagaaggtaggatccacccaaagaggtaatcgcccggagcaaggtgaggtagaagcaggtaacccttrtctgcagctatgctgaggctgaattgcacaaattaagaattaggcctaggtctgcagcttaatctagccctaacacatacatacagagccacaagctaag

SEQ ID NO: 35768 - DNA, 201 bp, Homo sapiens
gttttttgttgtttgtgtttgtgagtgtttttggcatggcaggaacagctatttaaactgtggggctagaaggtaggatccacccaaagaggtaatcgccyggagcaaggtgaggtagaagcaggtaacccttgtctgcagctatgctgaggctgaattgcacaaattaagaattaggcctaggtctgcagcttaatctag

SEQ ID NO: 35769 - DNA, 201 bp, Homo sapiens
  misc_feature (1)...(201): n = A,T,C or G, or insertion/deletion polymorphism (see Tables 1-2)
ttagtagagacggggtttcaccatgttggttaggctggtcttgaactcctgacctcatgatctgcccacctccacctcccaaaggactgagattacaggcntgagccactgcgcctggcctacctcactttttaaaaatggaagtcttcccatttaaataaaatgaactatccaataagtatgtcacaaatctaggggaaa

SEQ ID NO: 35770 - DNA, 201 bp, Homo sapiens
aaatcctgctcttgtttatacctcaaagaaattctgttgtgacagaacctaggagtctacccctgggagagtgaatttgtaaaatgtggtagacatgaacygtggaatactcaactgcagttagatgtgggctagatgtacacatggcaacatcatgggtgtcaaaatcatagtgttgagtgaaaaacagtaagaaacaga

SEQ ID NO: 35771 - DNA, 201 bp, Homo sapiens
  misc_feature (1)...(201): n = A,T,C or G, or insertion/deletion polymorphism (see Tables 1-2)
ttggctactttttgtttggagtcaaatataaaactaaacaacatgtgcccagatttcctaccatggatttgcaaaagctattttgaaacctttcttggcanaaatcatattctgttatgattcagtgttgcactgtaaacagagtgtttagaaattggggtttgagaagtgtaacggctagtttccttaaaagaaaaaaaa

SEQ ID NO: 35772 - DNA, 201 bp, Homo sapiens
  misc_feature (1)...(201): n = A,T,C or G, or insertion/deletion polymorphism (see Tables 1-2)
taagttaacatgcaaagagaattttggctactttttgtttggagtcaaatataaaactaaacaacatgtgcccagatttcctaccatggatttgcaaaagntattttgaaacctttcttggcagaaatcatattctgttatgattcagtgttgcactgtaaacagagtgtttagaaattggggtttgagaagtgtaacggc

SEQ ID NO: 35773 - DNA, 201 bp, Homo sapiens
gcattgctgtatcaggttgtatgtacagggcagggtgaggtgtatactcatagaaggcactaaaatggaaatcaaaagaacttgctcctttttttttttttgagactgggccttgctctgtcacccaggccagagtgcagtggtactatcatgactcactgcagccttgaattcctgggctcaaggtacctcccacttcag

SEQ ID NO: 35774 - DNA, 201 bp, Homo sapiens
agagggtcctaggaaaccaactccttattttgaaaaataattaaagaaaaatattatgtattcttttctttgcaaactgtacaactgggtaagcaagttgyaggtaaagggaaatttatcttaccaaaggattatagttaatgtatgaaaaagaagtgatggagttttgcccttttgcaagcccctgatgaaatgataaat

SEQ ID NO: 35775 - DNA, 201 bp, Homo sapiens
tgcactcgctgggtcttgggtgcggcgaaacccagggcgcagcggcgcaggggtctggagcccgcaggggtcgccgggctgagcgcgctcggccgcttccrgtgctgcgctgcggaactcagaggacttggtgttcggcaagcccagagactcaaacaccatgtccatggagggggggtcctcacgctgtgttcagcaggg

SEQ ID NO: 35776 - DNA, 201 bp, Homo sapiens
  misc_feature (1)...(201): n = A,T,C or G, or insertion/deletion polymorphism (see Tables 1-2)
atagcgcctcgaagtcatctctatcaatcattcatttagtcgtaaggaagtcttgtttgtatatgtgtatccctgacatgactgagacctcataagttctntaagtgccatatgaataaagaaatgaattggtgttcatcttaagtcatagtctctgcagatattgcttgatctaagggagtggcaccctttgttttgatt

SEQ ID NO: 35777 - DNA, 201 bp, Homo sapiens
agaaatggaggttttagccaaggaaactgcttgtctggttcctgcttttagggggaaaacagctgtcaggttttcttagatgcctttttttttttttttttgacggagtctggctctgttgcccaggcagaagtgcagtggcgcaatatctgctcactgcaacctccgcctcccaggttcaagagattctcctgcctcagc

SEQ ID NO: 35778 - DNA, 201 bp, Homo sapiens
gaaccatgtagagactaaaggctggaagaagatgagacaaggtggtgactgtaacagtgggaggatattaatgtgtgtaaaaagagaaaagctactgacgrctttggtgcagtgacagcgttctcacctgtgtctacaaaattgattccaagatcataaatgtgtcaccttggtgctatagaaatacaaatgattatgtac

SEQ ID NO: 35779 - DNA, 201 bp, Homo sapiens
gaggaagtgcgtaggggtcattacatatgcttcacctcctaggctatgttaggaattttgctgtttctcctaggaacaatgacaggagactgacgtggaawaaaaggttgatagggtggaattattttaaatttccatttaatctatgttattctgcctcattcttcatgacattattatgcgttgcgtgcttgtgtcaaa

SEQ ID NO: 35780 - DNA, 201 bp, Homo sapiens
tgctgtgactggaccacttccacctcttggtagccgttgctttaattgtgctttgtcttcaggatcatactggtaaggccatgtttaatcttctgttacartgcttcgaagaaatgcttcaagatcttgatcccactcgtttaaaatttccactgagagctctgctcttgtctgcagctgatctggatggttttggcagcc

SEQ ID NO: 35781 - DNA, 201 bp, Homo sapiens
  misc_feature (1)...(201): n = A,T,C or G, or insertion/deletion polymorphism (see Tables 1-2)
cattgaggaaatgaaagaagaccagctatcattaggaggaagaacatagtacaaaataagctggaggaagtgcgtaggggtcattacatatgcttcacctnctaggctatgttaggaattttgctgtttctcctaggaacaatgacaggagactgacgtggaaaaaaaggttgatagggtggaattattttaaatttccat

SEQ ID NO: 35782 - DNA, 201 bp, Homo sapiens
tgtgcgtgagtgtgtgtgtgtgtgtgtgtgtgtgtgtgagagaatttagccacttcagaggccttgttccccataatttggaatttcctttggatttgatsaagttggatagagttgatcaaacccaatgggaaaaagtccaaaacaacagtgaaaacaggaatgaacaacaacaacaacaaaaacagttaagcaaaacaa

SEQ ID NO: 35783 - DNA, 201 bp, Homo sapiens
aaaaaaattaaagacatttctaagtgtctaagccacattcttccttaaaaacccaagagtaacctctgttgcaataactattttagtcaaaaaaaaaaaaagtaacacaatacaaaagtaagctgttcgagaactgagacaaacttgtctgtttacattcttgaaaaaatttgttttccctggaaagggagtctggtgcct

SEQ ID NO: 35784 - DNA, 201 bp, Homo sapiens
  misc_feature (1)...(201): n = A,T,C or G, or insertion/deletion polymorphism (see Tables 1-2)
gtgttacaaaagcaaactagttaatacttccaagaaatgaatatgctaagatattgtttgctgatcaacatttattaaacatttactgtgtaccactgatntaggctcttggccagatatgagcaacaaaaagaagatagtgtagtgcttgccttccaaaatctagcacagtcctagaaagaattcaggtttcactaaggc

SEQ ID NO: 35785 - DNA, 201 bp, Homo sapiens
tgggcagagcccatactgaatcctgggtctccaaaaagggagaattaatatgagattaggctacgtggtgcttttacagtgcactcagaaaaaaaaaaaaattaaagacatttctaagtgtctaagccacattcttccttaaaaacccaagagtaacctctgttgcaataactattttagtcaaaaaaaaaaaaagtaaca

SEQ ID NO: 35786 - DNA, 201 bp, Homo sapiens
taggcagttcttaagaagggagagtgcggttttttgacacttaacatttaaaggttttattggccacattaatctttctcacaaaagttttaggttatctrtaagttcttagaatgtcaaagaagagaagaaaaactgactaactttaaggggcggtggaagaagcagcaacttggcaataattccgcagccaacttcgcg

SEQ ID NO: 35787 - DNA, 201 bp, Homo sapiens
gttacatcataaggtacagagaggaaaaagtctggtggtgttagagggagattaaaaatggatgccaaattaaacataaaattatagaagtctagcatagrattctataaggagactaattttatttaggtagggaatgactacctatcttttaactggatctctgagctctgggcagagcccatactgaatcctgggtct

SEQ ID NO: 35788 - DNA, 201 bp, Homo sapiens
ttcaagatgttgctattttaattaaactaatatcagtgtcttatttatgaaagattacacaagtaaagatcattctgtcttgggctgaatttatagttttrtaacccctgtgccaaagtttgacaccttatagtatttggcagggataataactatgaaactgcttgattaataaatgtaaacaaaaaatgtatgctggca

SEQ ID NO: 35789 - DNA, 201 bp, Homo sapiens
aggctggagtgcaatggcacgatctcagctcactgcaacctccgcctcccgggttcaagtgattctcctacctcagcctcctgagtagctgggattacagrtgcacaccaccatgcctggctaatttttgtacttttagtagaagcagggtttcgccatgttggccaaactagtcgcgaactcctgacctcaggggatcca

SEQ ID NO: 35790 - DNA, 201 bp, Homo sapiens
ttgggacatgagaatcacttgaactcagaggctgtgcactccagcgcaactgcactccagcctgggtgatagaggaagatgctatctcaaaaaaaaaaaaatggaaagaaaaagctgtgttcaaacttcaaactgagactataaaagtttgggcagttactgtaatctccttaaaaatttggccagaatgtacagaccaca

SEQ ID NO: 35791 - DNA, 201 bp, Homo sapiens
cggtcctgcttttgcccgtggatggtggttgctccatgagcctccatctgattggctggagaggctgtgccaggcagacctcatttacatcagtcatctgmactcagaccacctgaggtaatgaagtcctgagcacacaactcctaagctcatgctgcaggaaaggcatcaaatgttctccgattcttttgcaatcactgc

SEQ ID NO: 35792 - DNA, 201 bp, Homo sapiens; identical to SEQ ID NO: 9192
  misc_feature (1)...(201): n = A,T,C or G, or insertion/deletion polymorphism (see Tables 1-2)

SEQ ID NO: 35793 - DNA, 201 bp, Homo sapiens
gatctcactctcttttaacagataacatatctcactcatgcctgcatggacctcaagttaggagacaagagaatggtgtttgacccttggttaatcggtcytgcttttgcccgtggatggtggttgctccatgagcctccatctgattggctggagaggctgtgccaggcagacctcatttacatcagtcatctgcactca

SEQ ID NO: 35794 - DNA, 201 bp, Homo sapiens
ctgggtcttgggtgcggcgaaacccagggcgcagcggcgcaggggtctggagcccgcaggggtcgccgggctgagcgcgctcggccgcttccggtgctgcsctgcggaactcagaggacttggtgttcggcaagcccagagactcaaacaccatgtccatggagggggggtcctcacgctgtgttcagcagggaggcgaga

SEQ ID NO: 35795 - DNA, 201 bp, Homo sapiens
ggaatgtatttgagtccaagattttgcctgatcatgcttagaagcaaagtactccagcctgtgtactatgtcagccacccaaaccaaacatttcagttcaytgttgctgaccagtaatgaacgattcagtaatagggatctcactctcttttaacagataacatatctcactcatgcctgcatggacctcaagttaggaga

SEQ ID NO: 35796 - DNA, 201 bp, Homo sapiens
ccaaatgaactcaacaatcttatcaagaaaaactctgatgtgataacatggacccctcgaccgggagccacccttgatctgggaagaatgctgaaggatcsaacagacaggtttggcttaaatatttttagaggataaaaatgttttataattttttttcaatactattagaaaataaatggctcacctctggcctcttga

SEQ ID NO: 35797 - DNA, 201 bp, Homo sapiens
atagatgttgaccatatcagccccatgaaataaacaggaataccatgtggcccacagtcagttggtaaatccttaagacttgggaggagggtcatattccmgttcacattccagttttagattctcgcttatcttaaagcattatagaccttgaactaaataagaataaaaatttgccccagtgcagtaagaaaatgaaaa

SEQ ID NO: 35798 - DNA, 201 bp, Homo sapiens
ttagtctagctagcagtccatctattttgttaatcttctcaaaaaaaaaaaaaaacagctcttggattcaatgatttttttaagggttttttatgtctctmtctctctcagttctgttctgatcttagttatttcttgtctcctgctagcttttgaatttgtttgctcttgcttctctagttcttttaattatgatgttag

SEQ ID NO: 35799 - DNA, 201 bp, Homo sapiens
ttggcctcccaaagtgctgggattacaggcatgagccactacgcctggcctattagttttctgagtgtgttttatgacaacaggatgttggatttttttcraatgccctttctgtgtcaattgagatgatgatgtggtttccttctttgttctgttaatgcagtgtgttacattgaatgattttcaaatgttgaatcagcc

SEQ ID NO: 35800 - DNA, 201 bp, Homo sapiens
tttattaaatagggactcctttccccactgcttgtttttgtcaggtttgtcaaagatcagatggttgtagttgtgtggtgttatttctgaggtctctgttmtgttccattggtctatatatatgttttgataccagtaccatgctgttttggttactgtagtcttgtagtatagtttgaagtcaggtagtgtgatgcctcc

SEQ ID NO: 35801 - DNA, 201 bp, Homo sapiens
ggctgtggccacactgcttctctagattcctcttcactgggcagggcatctctaaaaggcagaagccccagtcagggacttatagataaagctcccatctyccctgcgacagagcacctgggagaaggggtggctgtgggcacagcttcagcagacttaattcctacctgccggctctgaacagagcagcgaatctcccag

SEQ ID NO: 35802 - DNA, 201 bp, Homo sapiens
  misc_feature (1)...(201): n = A,T,C or G, or insertion/deletion polymorphism (see Tables 1-2)
ttgcctgttcactctgatgatagtttcttttgctgagaagaagctccttagtttaattagatcccatttgtcaattttggcttttgtcacagttgcctttngcatttgagtcaggaagtctttgcccatgcctatgtcctgaagggtattgcctaggttttcttctattgtttttatggttttgggttttacatgtaaatc

SEQ ID NO: 35803 - DNA, 201 bp, Homo sapiens
cactggccatatgtatatcttttatgatgaaatgtctattcaaatctttggcctgttttttaaaaacttgtgttgcttatatttttattcttgagttgtargaattctttgtatatctcccgccttttaaaatatgtaatcagtttagtaatcaatttattatacagattagctccagggagcaattagatttttaaatct

SEQ ID NO: 35804 - DNA, 201 bp, Homo sapiens
  misc_feature (1)...(201): n = A,T,C or G, or insertion/deletion polymorphism (see Tables 1-2)
ccatagatcctgctgtattttatagcacttcagaataacaatcattcttttaaaacccttctacacacctttgctgtttctgtaaatacacctgtcctttncaagcatctggctctttctatgcattcttcctccagaaatcatagtattatagatttggaaaatgcttggccttcattttcctgttacagactggtttag

SEQ ID NO: 35805 - DNA, 201 bp, Homo sapiens
tgactaatgatgttggatacttttttatatgtgcccactggccatatgtatatcttttatgatgaaatgtctattcaaatctttggcctgttttttaaaamcttgtgttgcttatatttttattcttgagttgtaggaattctttgtatatctcccgccttttaaaatatgtaatcagtttagtaatcaatttattataca

SEQ ID NO: 35806 - DNA, 201 bp, Homo sapiens
tcccctgaccttgggcattctcccacacacatgcactgatcagcacttagctgaatgtttgagggggaccttctgtaggtcttcaagttttcccagggcarctctcatgtctttggtgctctgccctaggcactctagccaccttactctccagactctcagctgtctcctcagttccaggatacctccacaaaggtgcct

SEQ ID NO: 35807 - DNA, 201 bp, Homo sapiens
gagttctctttggagctttggtgggaggcaagtggtgctccctccaacccctggggccaggacgaggacagggaaggggtgggcgagggagcctgaggccrcctcatgatcacccaccagcgggagaaaatgcggcgttggggtgagcgggtctggggagacaggatgagcgctggggctgcctgctgagtggccgccgtg

SEQ ID NO: 35808 - DNA, 201 bp, Homo sapiens
  misc_feature (1)...(201): n = A,T,C or G, or insertion/deletion polymorphism (see Tables 1-2)
tgcaacataaattcatctactataacatatgttctctcagaacatgctactggccagagttattagattttgttcacaccatagatcctgctgtattttanagcacttcagaataacaatcattcttttaaaacccttctacacacctttgctgtttctgtaaatacacctgtcctttacaagcatctggctctttctatg

SEQ ID NO: 35809 - DNA, 201 bp, Homo sapiens
cctgggttcaagtgattcttctgcctcagcctcccaagtagctgggactacaggcgcaccccaccacacctgcctaatttttgtattttcagtagagatgsgtttccacacattggccaggctggtctcaaactcctgacctcgtgatctgcccgccttggactcacaagtactaggattacaggcatgagccactgtgcc

SEQ ID NO: 35810 - DNA, 201 bp, Homo sapiens
tattgaagtttacagaatcaaaagttacagataattaggaggcattgaaatacagacctgttttcttttttctttctttcttttttttttttttttttgakacggagtctcactctgttacccaagctggagtgcagtggtgagatctcggctcactgcaacctctgcctcctgggttcaagtgattcttctgcctcagcc

SEQ ID NO: 35811 - DNA, 201 bp, Homo sapiens
tcgctgctattttcttctgaagctcaagttgtttagcttcatttcacagggctttatgaaagcacatcttagtttccagtgactccaaatttggaaaaatkgaggaaaaaaagaaggaaaaaaattgaaaacattattttgaagacatgtagctaagaaaaattagaattcagtccaaactgtagaaaataataaaaattg

SEQ ID NO: 35812 - DNA, 201 bp, Homo sapiens
tgagaaatcacaaaggacagatgagagcgatgttacttaatgccacagaacaggacatcatttaaaggagttactcaaagtgtttcagttactgccattakgaactcctaagcccctcggcagtgtgggtggtacggggtaggtgttgaggttagcagcacccacaggcttctcttcacgcaggatatgctatatagtgaa

SEQ ID NO: 35813 - DNA, 201 bp, Homo sapiens
ttttaaaaatctgttggagaacgcattttagaagaaaatgagtctctggcctcaggtttcgtctgatctctcatggctaggatggtttattcctagatagytaggtcctgagttattaggaaagctcctttttagaaggttgtgaagtctcatgtcctgtgaagagaaaatagggggaggacaacaacaaacaaaagaaca

SEQ ID NO: 35814 - DNA, 201 bp, Homo sapiens
agtgctgagttgtttcattaagaatggaagacagggagggaaggaagacaaagtaggaaaagcagaaggaagacagaaataaagaagggggaaaaggacawgagaaaaaagatgaagaaaaaaaatcattagtatcatgcttagtagctgctcgacatatacagtgttctgaaccaccagcccatttctccatcccatctt

SEQ ID NO: 35815 - DNA, 201 bp, Homo sapiens
  misc_feature (1)...(201): n = A,T,C or G, or insertion/deletion polymorphism (see Tables 1-2)
agacccaaggggagataagatgaaagttatcagtggtgcctaatgaagaagaactgttctgtgagacaaggactgagaatgttcctcatgaggacatcatngatgaccttggtgagaacagtcagcagaagtttgagaaattattgggaggtgctgaagctgccacaagtacagaccaagcttctgagagagttggatgat

SEQ ID NO: 35816 - DNA, 201 bp, Homo sapiens
tgtcagttccttctcggcatttcttttggccgtgttttcgaacctcctcggcggccgccgctgcactcgctgggtcttgggtgcggcgaaacccagggcgmagcggcgcaggggtctggagcccgcaggggtcgccgggctgagcgcgctcggccgcttccggtgctgcgctgcggaactcagaggacttggtgttcggca

SEQ ID NO: 35817 - DNA, 201 bp, Homo sapiens
aaactctagtataatttttaattttttgaattgtagattgtctttttcttttttatcatagacactctgaaagctaattgggatgacagagaagaaaaagrgaaaagaaagaatctcgaataagaggcccagtggcctcactagaaggatgagaagataagacttgctctagaggaggaaaaatggcagcttccttgccca

SEQ ID NO: 35818 - DNA, 201 bp, Homo sapiens
  misc_feature (1)...(201): n = A,T,C or G, or insertion/deletion polymorphism (see Tables 1-2)
aggcttgctccctcatgcttctctttgtgtcccctgccacatctgtacctgtggtttcagatccatcttgtggcaccacagtgcgaatctcagccttctcnccagtttctacacaaacactcatgttaatggtaatctattgagttaacaatttaacaaggaactttaaggtagtttggaggtgctcctggagaggggtta

SEQ ID NO: 35819 - DNA, 201 bp, Homo sapiens
taaaacagtttacactttttggagtaaaaagcatcttcttttacttcggtaactactactttgggcggctcatcattctcttcttcatctccacctttgcrttcaccactgtcaccttccgcttggccctccaatggtttagtgggaaatggtgaagagactggtttactctgggtagtatctttgccaaataaactggag

SEQ ID NO: 35820 - DNA, 201 bp, Homo sapiens
tgagcctgcgagggggaggttgcagtgagctgagatcgcaccagtgcactccaacctgggtgacagagcgagactcagagggtctcaaaaaaaaaaaaaaaggtattaggagacaatgactatgtatgtaggtatagtttttcttgtttacatatgaatttgagaccatgttatatgtatggctaaaatatatttagaatt

SEQ ID NO: 35821 - DNA, 201 bp, Homo sapiens
aaccacatgtagttataacaacagaatattggacaacgtgggggctatagaatgggtgtaacaatgttgtatttcagttcttctaccagttcttcggattygttttcttgaacagagtccaagatggaatattttaccatgaattctgggttggaataggtaggattacagtgaaactctagcatttagtcacatgaataa

SEQ ID NO: 35822 - DNA, 201 bp, Homo sapiens
  misc_feature (1)...(201): n = A,T,C or G, or insertion/deletion polymorphism (see Tables 1-2)
gctacatcaacagctggaacagtacagaaacactatctctcagggaggacagagtaccaggtaccaaatagatcctggcaaaggaacaggcatggaagttnccagagcacattcccatgctttatctctcttacaggttttggaatcattttcaaataaaactccccctcacaccacccaactggaagtcattcctgatgt

SEQ ID NO: 35823 - DNA, 201 bp, Homo sapiens
gtttgtagacagccatcatcttgctgtgttctccaatgggagaagggacaaggcaactctctgggatctcttgtaagaaggatactgattccactcatgakagttctgccctaatgacctaaccatctcccaaaagccccacctcctaatacatcaccctggtagttaggtttcaacgtaagaattttgaggggacattca

SEQ ID NO: 35824 - DNA, 201 bp, Homo sapiens
tggaaatgcacctcctcaatccctaacactgacatttaagcagcagaaagaagaggagcagcccatggtgaaggcaactggaaaggtcagagacccaaggygagataagatgaaagttatcagtggtgcctaatgaagaagaactgttctgtgagacaaggactgagaatgttcctcatgaggacatcatcgatgaccttg

SEQ ID NO: 35825 - DNA, 201 bp, Homo sapiens
tttaatggttattttcaagaatattaatgtatttgaaaaaatattgaaatgttaaaaagtaggtgtattaaaattcattttagttttttttttttttttttccaaaaattgcattcaaatgtattttacactttaggcagttcttaagaagggagagtgcggttttttgacacttaacatttaaaggttttattggccaca

SEQ ID NO: 35826 - DNA, 201 bp, Homo sapiens
aaagcagtggtgagagacgacatccttgccttgtccttatcttagtaagaaagcttctactttctcattttttgtagatgttttaattaattaattaattaatttatttatttatttaagatacagggtcttgctctgtctcccaggctggagtccagtggtgtgatcataggtcaccccagctttgaactgggggctcaa

SEQ ID NO: 35827 - DNA, 201 bp, Homo sapiens
agaaaagcagtggtgagagacgacatccttgccttgtccttatcttagtaagaaagcttctactttctcattttttgtagatgttttaattaattaattawttaatttatttatttatttaagatacagggtcttgctctgtctcccaggctggagtccagtggtgtgatcataggtcaccccagctttgaactgggggct

SEQ ID NO: 35828 - DNA, 201 bp, Homo sapiens
tttattgtggaatataacatacagaacagctcaaaaaccataaatgaagaacacttagaaaatgaacaccagtttaacctaggttaaaaaaaaaaaaaaaagaaaatgtaatattacctgtgagcaccccagaaatctctcatatgctgctttctttctttctttttaaaatagctttatagataatatgatttaaatacc

SEQ ID NO: 35829 - DNA, 201 bp, Homo sapiens
ttttattgtggaatataacatacagaacagctcaaaaaccataaatgaagaacacttagaaaatgaacaccagtttaacctaggttaaaaaaaaaaaaaaaagaaaatgtaatattacctgtgagcaccccagaaatctctcatatgctgctttctttctttctttttaaaatagctttatagataatatgatttaaatac

SEQ ID NO: 35830 - DNA, 201 bp, Homo sapiens
cattattggagtttatacctggacataagagaggcagcacaagagagagagaattccctgactgaagccagtagggctttttttttttttttttttttttttaaattaggcaaagcatgggaattgacttcaggggtagggtatgcaggatgggctgggaaagtgtgaagggtagggtatgccagtcagcatatctggtta

SEQ ID NO: 35831 - DNA, 201 bp, Homo sapiens
gcaatcacagtatgtgtaatatgctggataaataaatgttcagtttttgtgttcatggattctgcatgccacataagctatttccaaataaacaatgggtkaatggtttcaaaagagaagaaaatcaaaaaggaaacatttcattccacttgctcttttaggagctcctgagttctgcatcagaaacaagttgagccttgt

SEQ ID NO: 35832 - DNA, 201 bp, Homo sapiens
aaagttctgagctacatcaacagctggaacagtacagaaacactatctctcagggaggacagagtaccaggtaccaaatagatcctggcaaaggaacaggyatggaagtttccagagcacattcccatgctttatctctcttacaggttttggaatcattttcaaataaaactccccctcacaccacccaactggaagtca

SEQ ID NO: 35833 - DNA, 201 bp, Homo sapiens
cacattcttagaatttttaaagaccttgaccacttgattgatattcttctctttaccatgttgtcatttgcacagatgattgagacagatgaggacttcartccttttcctggaggatatgactatttggttgactttttagatttatccttcccaaaagaaagaccacaacgagaacatccctatgaggaagtaagcagc

SEQ ID NO: 35834 - DNA, 201 bp, Homo sapiens
aggttttattggccacattaatctttctcacaaaagttttaggttatctataagttcttagaatgtcaaagaagagaagaaaaactgactaactttaaggrgcggtggaagaagcagcaacttggcaataattccgcagccaacttcgcgtgttcaggcatcctttttctccagtaaaattttgtgcaactcgtctgcatc

SEQ ID NO: 35835 - DNA, 201 bp, Homo sapiens
cctcacctgcaaatttatggtgggatttgatgtctcattactaatagtacttcagatagcgataaccagctgtatacatttgatgttagtgacatgaagcrgttttgctaatatagactaggatttgaatgttgcagttcaggtgagagaagagactcttaatttcccattcattcctatcatctatcatctaagagcatt

SEQ ID NO: 35836 - DNA, 201 bp, Homo sapiens
tccatatattaacattaaacacaggagtgtgcaattcccacctattttcagtagtcagtcttgctacatctaacttcaattccaatcaccatgcaattatrcttaaaaacaaagtataagtacaaccttctttgactgacacttcttctctaattagggacattagcccaaatatagtctttatttttccatggaataagt

SEQ ID NO: 35837 - DNA, 201 bp, Homo sapiens
cttctcatatttttgaaactcatttctggtcatttcttttagcatctaaagcctgatttttctcattcaatgaatatgttctgagtgtctagcatgttacraactttgggccagggactggtgaagaagaggttatggtttttaaactccgagtctcagaaagggcacagatacaaaagcacttataaaaagcaagagatc

SEQ ID NO: 35838 - DNA, 201 bp, Homo sapiens
  misc_feature (1)...(201): n = A,T,C or G, or insertion/deletion polymorphism (see Tables 1-2)
ttccagcagaggagactccaatctaaatcctgtcatttcagaggaatggaaagcccaattcattaaaacagaaaggaagaagctcctgaactacaaggctnggctggtgaagaacctgcaaccccgaatttattgtccctttgctgggtattttgtggaatctcacccatcagacaagtatggctagacactttgtacatt

SEQ ID NO: 35839 - DNA, 201 bp, Homo sapiens
  misc_feature (1)...(201): n = A,T,C or G, or insertion/deletion polymorphism (see Tables 1-2)
aaaaatcttcgattcatgatcttgatggacggtgttcatcctgagatggacacttgcattattgtggagtacaaaggtatgtttttatccccattgataangaaaaatggaaaacattcttaataggaaggatggtaatatctatatgaaatttcatcacatgttcatcttttagctccattttgaaagaatatagcgtgt

SEQ ID NO: 35840 - DNA, 201 bp, Homo sapiens
cggtgtgaacccgggaagcggaggttgcagtgagctgagaccacgccactgccctccagcctgggtgacagagcaagattccatctcaaaaaaaaaaaaaatcagtttgaaagtgatgagagagaaagtgatgtgaggctgtgtcacggtgggatttgaccttatatggggagtcagggaattcccagtggggctactgat

SEQ ID NO: 35841 - DNA, 201 bp, Homo sapiens
aaatgtgtcccagagattctggtatgttgtgtctttgttttcattggtttcaaagaacatctttatttttgccttcattttgttatgtacccagtagtcaytcaggagcaggttgttcagtttccatgtagttgagtggttttgactgagtttcttaatcctgagttctagtttgattgcactgtggtctgagagacagtt

SEQ ID NO: 35842 - DNA, 201 bp, Homo sapiens
gagattcaacttcttcctggcttattcttgggagggtgtatatgcccaggaacttatccatttcttctagattttctagtttatttgtgtagaggtgtttrtagtattctctgatggtaatttgtgtttctgtgggattggtggtgatatcccctttatcattttttattgtgtctatttgactcttctgtcttttcttct

SEQ ID NO: 35843 - DNA, 201 bp, Homo sapiens
tccttccaaaggcttccctccagcgccactaccaaatccaggaaagcgtcctcctccagaaggtaccaccaaacctttaaaacctttaaaggctcctccastgtcagattcgaatccaacatttctgcgctttgctttctttatggctctattcttcaagacttcctcactggccatggagaatgttcccacctcttaagc

SEQ ID NO: 35844 - DNA, 201 bp, Homo sapiens
tccatgagcatggaatgttcttccatttgtttgtgtcctcttttatttccttgagcagtggtttgtagttctccttgaagaggtccttcacatcccttgtwagttggattcctaggtattttattctctttgaagcaattgtgaatgggagttcactcatgatttggctctttgtctgttattggtgtataagaatgcttg

SEQ ID NO: 35845 - DNA, 201 bp, Homo sapiens
tttttggttccatatgaactttaaagtagttttttccaattctgtgaagaaagtcattggtagcttgatggggatggcattgaatctataaattaccttgrgcataatgcccattttcatgatattgatacttcctatccatgagcatggaatgttcttccatttgtttgtgtcctcttttatttccttgagcagtggttt

SEQ ID NO: 35846 - DNA, 201 bp, Homo sapiens
gggctctgttctgttccattggtctatatctctgttttggtaccagtaccatgctgttttggttactgtagccttgtagtatagtttgaagtcaggtagcrtgatgcctctagctttgttcttttggtttaggattgtcttggcaatgcaggctcttttttggttccatatgaactttaaagtagttttttccaattctgt

SEQ ID NO: 35847 - DNA, 201 bp, Homo sapiens
tcaattttgacttttgttgccattgcttttggtgttttagacatgaagtccttgcccatgcctatgtcctgaatggtattgcctaggttttcttctagggyttttatggttttaggtctaacattgaagtctttaatccatcttgaattaatttttgtataaggtgtaaggaagggatccaatttcagctttcgacatatg

SEQ ID NO: 35848 - DNA, 201 bp, Homo sapiens
  misc_feature (1)...(201): n = A,T,C or G, or insertion/deletion polymorphism (see Tables 1-2)
cagctgccttattactaggagctggttatgtgtgctgtacaaatactgttaaatttatttgacataaaactgataataaacataggtttgggtataaacantgttagtttgtgtaagtgaaaggacaagagactatgaactttatgaatatataaccaagtaatctacaactgcttaggggcttttatgaaaatctctaaa

SEQ ID NO: 35849 - DNA, 201 bp, Homo sapiens
taaaaactccggggaaatcctccactaatgacatggagccttgttctatttctgccttagttacctatcaattttatctcctgaaagagttccaatctgcyagaatatgtgtttttctgtgatttttccagcagaggagactccaatctaaatcctgtcatttcagaggaatggaaagcccaattcattaaaacagaaagg

SEQ ID NO: 35850 - DNA, 201 bp, Homo sapiens
tccgaatgaattgccatatacaaggagaaagctcagtgcctttggctggcttggtaacattttcctagtaaccaattgaaatttccaagataaaaactccrgggaaatcctccactaatgacatggagccttgttctatttctgccttagttacctatcaattttatctcctgaaagagttccaatctgctagaatatgtg

SEQ ID NO: 35851 - DNA, 201 bp, Homo sapiens
cttactgtttgtttttcctttgatataatcaattcttctataatcaaataagttcaattatacagactgtatacagaagtccttgtcttggaattcaaacyatgggtgttcaagatttcaccttgaatatctatacctctttgtttctccacaggtcataaaatactcaatatagtagactgcaccagacccaatggggga

SEQ ID NO: 35852 - DNA, 201 bp, Homo sapiens
tgagatcaaattttaagtgttctcaccacaaaaaaagtatgtgaggtaacatatatgttaattagctctattcagccattccacaatgtatgcatatatcrtaacatcatgtatactctaaatatacacactttatttgccagttaaaaaataggcttctcactgaccaaaatgggatgatatgagcactaatacaagtaa

SEQ ID NO: 35853 - DNA, 201 bp, Homo sapiens; identical to SEQ ID NO: 9201

SEQ ID NO: 35854 - DNA, 201 bp, Homo sapiens
attagatcccatttgtcaattttgacttttgttgccattgcttttggtgttttagacatgaagtccttgcccatgcctatgtcctgaatggtattgcctargttttcttctagggtttttatggttttaggtctaacattgaagtctttaatccatcttgaattaatttttgtataaggtgtaaggaagggatccaatttc

SEQ ID NO: 35855 - DNA, 201 bp, Homo sapiens
gatgagtagattgcaaaagttttctcccattctgtaggttgcctgttcgctctgatggtagtttcttttgctgtgcagaagctctttagtttaattagatmccatttgtcaattttgacttttgttgccattgcttttggtgttttagacatgaagtccttgcccatgcctatgtcctgaatggtattgcctaggttttct

SEQ ID NO: 35856 - DNA, 201 bp, Homo sapiens
tatatacccagtaatgggatggctgggtcaaatggtatttctagttctagatccttgaggaatcgccacactgtcttccacaatggttgagctagtttacrgtcccaccaacgtgtaaaagtgttcctatttctccacatcctctccagcacctgttgtttcctgacattttaatgatcaccattctaacaggtgtgagat

SEQ ID NO: 35857 - DNA, 201 bp, Homo sapiens
tcttaattttctttcataacttctctgttttttaggagattccttaaattggttatctgtttcacagttgccaggtttggtttttggcatattattctgctacttaagatctccactatttttttgttttgttttggcgcccatgattttactggaaaaatccttttgttctctccttttttgttaccccttttcatttat

SEQ ID NO: 35858 - DNA, 201 bp, Homo sapiens
atttgtcattcactgagcagcactgtgctaagtactggagaactagagataaaatgattgtctgttctcagagtgatggtctattagaagagaagaacaartggaatacagaatgatcaatgcaggcaaggggatacagacgcaggagaggagacgaacactggatgagtctatgaatgctgcattttaaagaaggagtag

SEQ ID NO: 35859 - DNA, 201 bp, Homo sapiens
ttcttaattttctttcataacttctctgttttttaggagattccttaaattggttatctgtttcacagttgccaggtttggtttttggcatattattctgctacttaagatctccactatttttttgttttgttttggcgcccatgattttactggaaaaatccttttgttctctccttttttgttaccccttttcattta

SEQ ID NO: 35860 - DNA, 201 bp, Homo sapiens
  misc_feature (1)...(201): n = A,T,C or G, or insertion/deletion polymorphism (see Tables 1-2)
tttcttttcaatgtggcagtttattcctgtataattgctttgcaacattttagttggatctggaaatgcagaggagataggttatgcacgcaatttgtccntcattgtgaaccaatagtcttctccttagcccagtgacagtacctccttgttttcctgaatattcttttgcattcttttggagttcctctttccccagcc

SEQ ID NO: 35861 - DNA, 201 bp, Homo sapiens
tttcttaattttctttcataacttctctgttttttaggagattccttaaattggttatctgtttcacagttgccaggtttggtttttggcatattattctgctacttaagatctccactatttttttgttttgttttggcgcccatgattttactggaaaaatccttttgttctctccttttttgttaccccttttcattt

SEQ ID NO: 35862 - DNA, 201 bp, Homo sapiens
attttcctttgatctttggaagaccatgcattcctatttcagtgatgcttttaaaaagccatttttgtcattaatccagatttgttctcatttgattctarttgttgaaatggatgaaaacaacggacttttgcttttagaactgaatcctcctaacccttgggacttacagcccagatctcctgaagagttggcttttgg

SEQ ID NO: 35863 - DNA, 201 bp, Homo sapiens
  misc_feature (1)...(201): n = A,T,C or G, or insertion/deletion polymorphism (see Tables 1-2)
cttgtttgtatatgtgtatccctgacatgactgagacctcataagttctctaagtgccatatgaataaagaaatgaattggtgttcatcttaagtcatagnctctgcagatattgcttgatctaagggagtggcaccctttgttttgattttcctttgatctttggaagaccatgcattcctatttcagtgatgcttttaa

SEQ ID NO: 35864 - DNA, 201 bp, Homo sapiens
caaacacactacctgcccttgttctccccctaccccaaaattgattctatgtattgagagaactgtagaaatatatttgacctgggagccatatataggggtagagaaggggccagctatctcatggacataacttttgtgcttgccctcctgtcatccgcagtacctacttctcttccctccacatctgaacacccctcc

SEQ ID NO: 35865 - DNA, 201 bp, Homo sapiens
acacctgcctaatttttgtattttcagtagagatgggtttccacacattggccaggctggtctcaaactcctgacctcgtgatctgcccgccttggactcmcaagtactaggattacaggcatgagccactgtgcccagctgacccagtttctacgaccagtttagccacaaagtagacatgtaaccagaggaaagtgact

SEQ ID NO: 35866 - DNA, 201 bp, Homo sapiens
agtccatatttactgataaaaagacttttttcagctgatttggggctcttatgtataggtgtaggatctgtcatccagtaggctctacttacagagggctygcacactggtgcaaggcacatctcataaactggtgaagctggggcagactgcatcaagtagaatgcgggatgagaagggggcaggcctgctgagctccgg

SEQ ID NO: 35867 - DNA, 201 bp, Homo sapiens
tagcttgatcctcctttctttgtgggtgacttttaagaattacaggattagtccatatttactgataaaaagacttttttcagctgatttggggctcttaygtataggtgtaggatctgtcatccagtaggctctacttacagagggctcgcacactggtgcaaggcacatctcataaactggtgaagctggggcagactg

SEQ ID NO: 35868 - DNA, 201 bp, Homo sapiens
  misc_feature (1)...(201): n = A,T,C or G, or insertion/deletion polymorphism (see Tables 1-2)
aatcatgatgcctgctctgcacatggtactgttagactgtggcttgagggcttttatctcccaggattttagggagagttctatatgctgaggtttggttnaagaggttatgcctatgtgtggaagagctccttttcttgctacccggagacttctcatattgcctccctcctgccacctttttggaggtattaattgcct

SEQ ID NO: 35869 - DNA, 201 bp, Homo sapiens
aaaacttaaaagaatgccatatggtggtatatggcaagcacctcaaaaaagtgaattatagttactatttctctgcaatgagcttcttgtgtagcttatayagagggacttttttacaggaactcagattgtttttgtatctaatatgctcatctaagtatagtgattgctttcccacagactagcctttctcttcttcat

SEQ ID NO: 35870 - DNA, 201 bp, Homo sapiens
tgtgggcagagatgaattgttgaagctggctcaaggagtttcattatataatactctcaacatttgtatattgtgaaaattttcataataagttgaaaagsaaggaaaaaaacaacttagtttcaacggctaattgtttctactggggcggagagaagtaatgaaaatgccagagggaaaagggtgtttttttttcagggc

SEQ ID NO: 35871 - DNA, 201 bp, Homo sapiens
  misc_feature (1)...(201): n = A,T,C or G, or insertion/deletion polymorphism (see Tables 1-2)
atatttaaatacaccatggggcaaaatcatgatgcctgctctgcacatggtactgttagactgtggcttgagggcttttatctcccaggattttagggagngttctatatgctgaggtttggttaaagaggttatgcctatgtgtggaagagctccttttcttgctacccggagacttctcatattgcctccctcctgcca

SEQ ID NO: 35872 - DNA, 201 bp, Homo sapiens
cctgggtctccaaaaagggagaattaatatgagattaggctacgtggtgcttttacagtgcactcagaaaaaaaaaaaaattaaagacatttctaagtgtytaagccacattcttccttaaaaacccaagagtaacctctgttgcaataactattttagtcaaaaaaaaaaaaagtaacacaatacaaaagtaagctgttc

SEQ ID NO: 35873 - DNA, 201 bp, Homo sapiens
aagagattcacctttgaaaatttttaaataacttcatttaaaatatttaatttggaaaaaaaatcactttttcacagctttccataatgcatctgctggawaaagcaagcagcagctctgttgcatatttaaatacaccatggggcaaaatcatgatgcctgctctgcacatggtactgttagactgtggcttgagggctt

SEQ ID NO: 35874 - DNA, 201 bp, Homo sapiens
tgctcttagccactgtgtagcctttcaaatctgaatttacaaaacctataaattgaggtttcttagcctcaagagattcacctttgaaaatttttaaatamcttcatttaaaatatttaatttggaaaaaaaatcactttttcacagctttccataatgcatctgctggataaagcaagcagcagctctgttgcatattta

SEQ ID NO: 35875 - DNA, 201 bp, Homo sapiens
tgcagctggccctgatttgcatgtgaccagcaacttttcatctatgtctcaactcaaatgtcacctcttcactgaccatcctgtctaatgattccctccayctcatcccactcaccccagccactctctgttccattgccctgttttattttcttcacggtgcatcattctttgcaatgactttatttacttgttcattat

SEQ ID NO: 35876 - DNA, 201 bp, Homo sapiens
gggctttaactcaagcagtctagctcaaagtctatgctcttagccactgtgtagcctttcaaatctgaatttacaaaacctataaattgaggtttcttagsctcaagagattcacctttgaaaatttttaaataacttcatttaaaatatttaatttggaaaaaaaatcactttttcacagctttccataatgcatctgct

SEQ ID NO: 35877 - DNA, 201 bp, Homo sapiens
  misc_feature (1)...(201): n = A,T,C or G, or insertion/deletion polymorphism (see Tables 1-2)
cagtgttaaacactttggaaatgttaagacatttaatccaacaacaaccctgtgaacagatactactatctgcccccattttgtgggggaagaaactgggnttataagagttagaataacttgcccatggttatacagctaatgaatggtgatgcggggctttaactcaagcagtctagctcaaagtctatgctcttagcc

SEQ ID NO: 35878 - DNA, 201 bp, Homo sapiens
tggaggagcatcaggctttccaatgactttcagtggtggaaaatttacgggtaatattttgtatgaaagtgataccaagtatcacgcatggcacattgctraatgctgtaagagtaaatacaaatgtaattgagacatgatccctccccacaagaagcatgcaatcttattgggaaaccagatttgtaagttgcagattac

SEQ ID NO: 35879 - DNA, 201 bp, Homo sapiens
acagaagtccttgtcttggaattcaaactatgggtgttcaagatttcaccttgaatatctatacctctttgtttctccacaggtcataaaatactcaatayagtagactgcaccagacccaatgggggaaggctgcctatgaaggttgctctaatgatgagtgattttgctggaggagcatcaggctttccaatgactttc

SEQ ID NO: 35880 - DNA, 201 bp, Homo sapiens
tgacttctctgtctgctcacttccaaacacctgctcaacctaagctgttattagacctgtgagcattgatctctaccttcattttcctgtgcccctcccaytgggtgtctctggaaagggagttagatcaacatgaagcaacacatattttattgaattcaagttctgaacaaatccctcgccagtggcagcattatgtaa

SEQ ID NO: 35881 - DNA, 201 bp, Homo sapiens
cctggccttagtccaggggtgcagagctttggattcttaaggtcgctgactcatcagaagaaaataaaacgaggacataagtttttaattttaaaaatttwaaaaaaattgtttttaagacaccgagagcactaactttgaaaatttaagaaattaagagagaaatcacaggatttgaatcactaagtaattgtgataata

SEQ ID NO: 35882 - DNA, 201 bp, Homo sapiens
tccagcgccactaccaaatccaggaaagcgtcctcctccagaaggtaccaccaaacctttaaaacctttaaaggctcctccagtgtcagattcgaatccamcatttctgcgctttgctttctttatggctctattcttcaagacttcctcactggccatggagaatgttcccacctcttaagcttcatcttcttgatccca

SEQ ID NO: 35883 - DNA, 201 bp, Homo sapiens
tcttagatctcacaactagctgagtgccaacgccagatctttccttttttatgttcattactataactttattgacctgcagtagctttttttttttttttaggaaatagaaacaacagtcaattgtaatacttaaatataattatctcacagatcagaagtctcatttcagtcattctccaagatttaatgtatgtatca

SEQ ID NO: 35884 - DNA, 201 bp, Homo sapiens
gatttttcctcttttcacctccctcctttgaatggccaacaacagaatatttccacttcctaagtttggctcttttacttttttctttctttctttctttytttttttttttattttttttttgagactgggtgtcactctgttgcccagactggagtgcagtggcgcaatctcggctcactgcaacctctgcctccgggg

SEQ ID NO: 35885 - DNA, 201 bp, Homo sapiens
  misc_feature (1)...(201): n = A,T,C or G, or insertion/deletion polymorphism (see Tables 1-2)
ttttctagcagttttgttttagaatccaaaagcaatatatacttacagcaggggggaccttcaaccaatttaaaagtgaatcaattaaatataaaagttanttctttctatcccatccatcctcttaaagaaataatcacaatgaacaatttgatgtgtattcctctcactttttaaatacatgcacaaatatatacagtt

SEQ ID NO: 35886 - DNA, 201 bp, Homo sapiens
aaaaaacaaacaaaaaaactggatttttacaggtaagaaaatcctgtgtgaggcaccgtatagatgataaataggcttacatctttttagacaaaataaakctttacatttattgctttatatatcaaatacttaccaagcttgctttatgccaagcacagtgttaaacactttggaaatgttaagacatttaatccaaca

SEQ ID NO: 35887 - DNA, 201 bp, Homo sapiens
ccttcatgtcccttgtaagttatattcttaggtactttattctctttgtagcaattgtgaatgggagttcactcatgatttggctctctgctggtctgttmttggtgtatgcttgtgatttctgcacattaactttgtatcctgagactttgttgaagttgcttatcagcttaaggagattttgggctgagacgatggagt

SEQ ID NO: 35888 - DNA, 201 bp, Homo sapiens
  misc_feature (1)...(201): n = A,T,C or G, or insertion/deletion polymorphism (see Tables 1-2)
ttaaatgacataatatatgtgagcatgcattgtaatttaaaattgtctatgaatgtaagaatcattagttatgaggatatacggtctgcccttaaacttantgtatgtgccatttaaatgtgtgatgtcctaaatgtagaggtttaaatataccttcacctaatagatgtaataaatgtgctcttgaactacattttaata

SEQ ID NO: 35889 - DNA, 201 bp, Homo sapiens
tatatatgttttgataccagtaccatgctgttttggttactgtagtcttgtagtatagtttgaagtcaggtagtgtgatgcctccagctttgttcttttttgcttaggattgtcttggctatatgggctcttttggttccatatgaaattgaatgtagttttttctaattctgcaaaggaagtcaatggtagcttgatgcg

SEQ ID NO: 35890 - DNA, 201 bp, Homo sapiens
gctgatcatgattcctgattaggaggctttgagcagttatttaagctgtctgagctttaggggtttttgtttttgtttgcttgcacagggcttgctccccscttgccagtttgtcgtgatagttaaatgacataatatatgtgagcatgcattgtaatttaaaattgtctatgaatgtaagaatcattagttatgaggata

SEQ ID NO: 35891 - DNA, 201 bp, Homo sapiens
  misc_feature (1)...(201): n = A,T,C or G, or insertion/deletion polymorphism (see Tables 1-2)
aatgggtagattgcaaatttctctcctattctgtaggttgcctgttcactctgatgatagtttcttttgctgagaagaagctccttagtttaattagatcncatttgtcaattttggcttttgtcacagttgcctttggcatttgagtcaggaagtctttgcccatgcctatgtcctgaagggtattgcctaggttttctt

SEQ ID NO: 35892 - DNA, 201 bp, Homo sapiens
actgaaattcagaaagggcaatttgccatttttatatttgcaaaataatcaccaaaggaaagagtactttttctcattaccacagatcctctgaaaaaaaatgcagaaatttaattttaaaattctaattatttaaaatgtataagcaaaagtttgtactctgagcttgcaagcagaggcatttattaaaatttctttttt

SEQ ID NO: 35893 - DNA, 201 bp, Homo sapiens
ttatctttttaatgtccataagttccatagtgttgtcccttctttcatttctgatattgtattttttgtttttgtagacacagggtctgttttttttttttcctttgagagagggactcgctctgtcacccaggctagagtgcagtggcacgatctcagctcactgcaacctctgctttctgggctcaagtgattctccag

SEQ ID NO: 35894 - DNA, 201 bp, Homo sapiens
gacatgaagcggttttgctaatatagactaggatttgaatgttgcagttcaggtgagagaagagactcttaatttcccattcattcctatcatctatcatytaagagcatttgagtcttacacattcttagaatttttaaagaccttgaccacttgattgatattcttctctttaccatgttgtcatttgcacagatgatt

SEQ ID NO: 35895 - DNA, 201 bp, Homo sapiens
tagctgctatatgacaatgagaaacatctcacatttatttcctcacctgcaaatttatggtgggatttgatgtctcattactaatagtacttcagatagcrataaccagctgtatacatttgatgttagtgacatgaagcggttttgctaatatagactaggatttgaatgttgcagttcaggtgagagaagagactctta

SEQ ID NO: 35896 - DNA, 201 bp, Homo sapiens
ttagctgctatatgacaatgagaaacatctcacatttatttcctcacctgcaaatttatggtgggatttgatgtctcattactaatagtacttcagatagygataaccagctgtatacatttgatgttagtgacatgaagcggttttgctaatatagactaggatttgaatgttgcagttcaggtgagagaagagactctt

SEQ ID NO: 35897 - DNA, 201 bp, Homo sapiens
  misc_feature (1)...(201): n = A,T,C or G, or insertion/deletion polymorphism (see Tables 1-2)
attcatagctttttgataagaattgactaacatagtatgtaaaactgccccagcaccaagtttgaaatataatagatgtgtaatcatttgtttgtttattnaactttctaccacaccctacagtggtataataactctgttatataatgaatgctcaataaataaaagccgacttaatatgtctagatagtcaaaaatact

SEQ ID NO: 35898 - DNA, 201 bp, Homo sapiens
ttgatatgcagatttttaaaatacttttcctatgattatatatcttattttacctgatcttatactctgtgtacaagtctgattcttaaaccagataataygttcattaaagttagaaactttcttcttatagaagaagcactaggtttagaatcaaaaacccaaatttgaataccagtttactgtgtgttgtatatttct

SEQ ID NO: 35899 - DNA, 201 bp, Homo sapiens
aagtgattggcgtaggtagttgcagtgactttcctcagtggtctgtagatctgtttccataacagcaagaagagagctgttacattgtgggttggtgagcrggtgggttgggcatgctcatacacaaactgctcggtagggaaaggagaaggcacatgagcaagggatggccctggtggccagggtaaggattttactttg

SEQ ID NO: 35900 - DNA, 201 bp, Homo sapiens
ccttcattccagacatagttatctaatgacttagttatctaatgaccacagggtgtggttttacaatcaagtccagttcttgcatctgtgcctgagtttgrgggcctgtaggacttgcaattttaattggtggcaaggaagtatgcagttcatgcatgtggcttgaataataagattttgctctcctttttctcatataat

SEQ ID NO: 35901 - DNA, 201 bp, Homo sapiens
cttgtgaatgcttcacacagttctcatgctgtgtttttcagctccatcaggtcaatttatgttcttctttagactggttattctagttagcagttcctgtratcttttatcaaggttcttagcttccttgcattgggttagaacatactcctttagctcagaggagtttattacccaccttctgaagcctacttctgtcaa

SEQ ID NO: 35902 - DNA, 201 bp, Homo sapiens
tgttagttttgggtttttcatgggttcccttaattagattgagaaaattactttctactattagtttgtaaagtgtgtcgttgtgagggggtgggagttastcatgaaagggtattttttttcaaaatttttttctgcattataatttcttttgagactattatgtggtttttaccttttattctcttaatgtggtatatt

SEQ ID NO: 35903 - DNA, 201 bp, Homo sapiens
ggaagtggtgagagcagatatccttatcttcttcttgattttagggaaaaagtatccagtcttttgctattgagtataatgttagttttgggtttttcatrggttcccttaattagattgagaaaattactttctactattagtttgtaaagtgtgtcgttgtgagggggtgggagttagtcatgaaagggtatttttttt

SEQ ID NO: 35904 - DNA, 201 bp, Homo sapiens
attttttgagatgcatctatgttgtagcatgtattgtaatttattcctttttattgccaaatagtatttcattatatggatgtatacatttatccactaaytgatagacatttaggttgtttgtactttcgggctgctatgagtagtagcaaagtgaacatttatatacaggtttgtgtgtgtgtgtggacatatgctttc

SEQ ID NO: 35905 - DNA, 201 bp, Homo sapiens
  misc_feature (1)...(201): n = A,T,C or G, or insertion/deletion polymorphism (see Tables 1-2)
ctgtgaggaagggatcaaaaaagaatattctgggtatagggttgtacattgaggaaatgaaagaagaccagctatcattaggaggaagaacatagtacaanataagctggaggaagtgcgtaggggtcattacatatgcttcacctcctaggctatgttaggaattttgctgtttctcctaggaacaatgacaggagactg

SEQ ID NO: 35906 - DNA, 201 bp, Homo sapiens
ctatttcagtgatgcttttaaaaagccatttttgtcattaatccagatttgttctcatttgattctagttgttgaaatggatgaaaacaacggacttttgmttttagaactgaatcctcctaacccttgggacttacagcccagatctcctgaagagttggcttttggagaagtacaggtaaggaaatattaaaaggataa

SEQ ID NO: 35907 - DNA, 201 bp, Homo sapiens
ggacaattggtatgaaaaagagaaaaacttttgacagttttttataaaacattttcagtgaaaccatttctatttagctgctatatgacaatgagaaacakctcacatttatttcctcacctgcaaatttatggtgggatttgatgtctcattactaatagtacttcagatagcgataaccagctgtatacatttgatgtt

SEQ ID NO: 35908 - DNA, 201 bp, Homo sapiens
ttgctattctcaaaagcaatgatccccagaaacctagctggggcccatggccagtctgtgacaaagtttttgctggcaaatagtgaaataagtaagagagyaggtatgtatatcaactctcttttcttgggatgaattgttattattccatgactaagtcctttctatttgggggtattaaaacattatttcttcaatgaa

SEQ ID NO: 35909 - DNA, 201 bp, Homo sapiens
  misc_feature (1)...(201): n = A,T,C or G, or insertion/deletion polymorphism (see Tables 1-2)
agcaggtaacccttgtctgcagctatgctgaggctgaattgcacaaattaagaattaggcctaggtctgcagcttaatctagccctaacacatacatacanagccacaagctaagaaagagttcatgttgtaacctagtcaccaaaactggacagatctccaaaagcaaactaaatactagcagacagagggtgcaagaca

SEQ ID NO: 35910 - DNA, 201 bp, Homo sapiens
caccttaagccttggtagttaaggcaagcatattgggttttttgtttgtttgtttgtggggtttttgtttttttgttttggttttggtagaaacagagtckagctctgtcaacccaggctggagcgcaatggctgaatctcagctcactgcatcctctgcctcccaggttcaagggattctcctgcctcagcctcctgaat

SEQ ID NO: 35911 - DNA, 201 bp, Homo sapiens
cacaccaccacgcccagctaattttttgcattttcagtagagatggggtttcaccatgctagtcaggatggtctcaatctcctgacctcacaatccacctrccttggcctcccaaagtgctgggattacaggcatgagctgcaagccactgtgcccggcccggaaaaaggcaatttaatggagaaagggtagtcttttcaa

SEQ ID NO: 35912 - DNA, 201 bp, Homo sapiens
ggtgaaggaatagacacagacatcaatggaacagaatagagaatccagaaatagatccacacaaatatggccaattgatttttggcaaagatgcaatttgrggaaatgtgaatgaaaaaaaggcttttttttggggggtggggaaggattctcactgtgtcgcccagcctggagtgtggtggcgtgatctcggctcactgc

SEQ ID NO: 35913 - DNA, 201 bp, Homo sapiens
gtcagatctgaagttcctcattctgctgattgtatttgatatcttcaaaatcaatgtttaagtttttcctagtcttgtattaggtcattattattattatytggaaggaaacttgcaggatctccacaaagtgtcaggttcatttgctgagatggatcaatagattcatgtttgaagacattgcctttttgcatttggcac

SEQ ID NO: 35914 - DNA, 201 bp, Homo sapiens
  misc_feature (1)...(201): n = A,T,C or G, or insertion/deletion polymorphism (see Tables 1-2)
gaaggaaagtgattagtaggtgtctggaactttttaacaagctgctggagaacccagagcatgaataaaagttacacttggcagccaggaactctttcagnagataaaataacagatagatattctccgaaaggatcccaggaaagaggatggcaactgccatttattatgtgaagtgaactggggacttttaactaagcc

SEQ ID NO: 35915 - DNA, 201 bp, Homo sapiens
catgaatttgttggtgctaaagctattggggtggttataactaccctgtagcttgagttgagaaccaaggaatgttactgcttatgacctgaatacacgakggtagacttgtaaaataatcttggatataagttaggattttatctgttatgcctagtagataaaatccttaccagaaagtcagatctgaagttcctcatt

SEQ ID NO: 35916 - DNA, 201 bp, Homo sapiens
ctagatagtgacaggagcaaagatttctttcataaggcaatagatattttacattccacctatagtgatttcttcaaaactacatttattaaataaatgtmttttattactttcacctagaaatatcatgtaatataatcatgcactgcttttcatatgaaaagatggccttactgccccaacaatcatttgaatatgagc

SEQ ID NO: 35917 - DNA, 201 bp, Homo sapiens
gctttccagttatgctttctgtgatgaatgttaggtgagatagtcaccgtaagattaaggaaaaaatgggtcaatgtggtatgtccctgatactgcataawcacaacctctatttgtgattcaaatgttaggcagactgtcctgggcaaagatgattttctttctattaacccatactattatagtacaactctacagaac

SEQ ID NO: 35918 - DNA, 201 bp, Homo sapiens
atacacgaagaacatggaatatcttgttatatgagaggcaaggaaatatcaaatactattggggtcatctcaaaatgactcacaagggccagcttgaaaascttcctacttaccacttcgcacctgttagagcagctattatcaacaagatgaaagataataatgttggtgaggatatagaagaaagggaacccttaaatt

SEQ ID NO: 35919 - DNA, 201 bp, Homo sapiens
ggggtcatctcaaaatgactcacaagggccagcttgaaaaccttcctacttaccacttcgcacctgttagagcagctattatcaacaagatgaaagataayaatgttggtgaggatatagaagaaagggaacccttaaattgctggtgaaagtataaaatagcactgctgctatggaaaacactatgaagtttccccccaa

SEQ ID NO: 35920 - DNA, 201 bp, Homo sapiens
gcctcctgagtagctgggattacagatgcacaccaccatgcctggctaatttttgtacttttagtagaagcagggtttcgccatgttggccaaactagtcrcgaactcctgacctcaggggatccacccgccttggcctctcaaagtgctgggattacaggcttgagccactgcacctggctgaacatccttctttcttaa

SEQ ID NO: 35921 - DNA, 201 bp, Homo sapiens
gattcttaaaccagataatacgttcattaaagttagaaactttcttcttatagaagaagcactaggtttagaatcaaaaacccaaatttgaataccagttyactgtgtgttgtatatttctgaatgtttcctcatctacaaaaacaaaaaattcatagctttttgataagaattgactaacatagtatgtaaaactgcccc

SEQ ID NO: 35922 - DNA, 201 bp, Homo sapiens
  misc_feature (1)...(201): n = A,T,C or G, or insertion/deletion polymorphism (see Tables 1-2)
ctgtgaaaggcagtgggctaagtggtagggggagaaggaagatacagagtgctttcaaaagtgcctaaatgtaagtcaacagggcagtgtgccaattacantgttataatgttctacagaagagggatgtacaccaagaatgccagcctggacctctggtgtgtcttggaagacttaaccaggaaggggacgattcgtttc

SEQ ID NO: 35923 - DNA, 201 bp, Homo sapiens
  misc_feature (1)...(201): n = A,T,C or G, or insertion/deletion polymorphism (see Tables 1-2)
gtttgccttttaaactcttagactaattattccaggaattgcctcagtgcttatgttagcttggtgtcagatatctgtactcgtaagaacaaagtcaaaanagaagtcatgaaatttagaatggcttcttcctgtcaaatacatttagaacatatttttggaataatttcaagtccattgggaacacaattactaggaatt

SEQ ID NO: 35924 - DNA, 201 bp, Homo sapiens
  misc_feature (1)...(201): n = A,T,C or G, or insertion/deletion polymorphism (see Tables 1-2)
tttaatgttttatagcaaaacaagaatttgctacagttttatttttctgattttgatagaagcaaattcattgatatctttaaaaatactttggggaaaanctaatcatttaaacaatacacagaaaagcatgtatataggtgcacatatttttttcttttgccttctgctccaatgtgactttcacgtggaactgaggac

SEQ ID NO: 35925 - DNA, 201 bp, Homo sapiens
gacacagcctgaatacaggcactaagtttctgtatatgaggcctagcattaaactcagatttgtagggaaagtctgattcatggcatggaaattggaaaasaccttatactgttgtaggtcttgctgggaatatctgcaaggcatggcctgattagaactccaatctgtaagctgccatttacttgctatgcctcatttta

SEQ ID NO: 35926 - DNA, 201 bp, Homo sapiens
tttcctgactcttctcttctgcattacagctcaggactgccacccagtggcctgttagcatagagctctggaaatgctgatttttttctttaatacagccrcagaataagacaataagaaaatatttgcttccttgttggggaaagtaaaatgcagaacttcctatttaccagccaaacaaaagaagaatgcattctctca

SEQ ID NO: 35927 - DNA, 201 bp, Homo sapiens
ttttacttgcatttttctgtcaaatatgatgctaatatttcactaaatatagtttggcaaaatgtgtttgctaaattgttttggtgttagaagtttttcaytttacatttgtatctattcagattttccactgggattatttccattgctattaaatttaaaagtcctctcatatttgatattctattttatacattttca

SEQ ID NO: 35928 - DNA, 201 bp, Homo sapiens
tgtctgcccgcaccaaaagctgtgtcttctgatttgctgtaggttttaaatgcagagtacctatgcctttctctttaaactcattgtctttcttgtaaaayagtttacactttttggagtaaaaagcatcttcttttacttcggtaactactactttgggcggctcatcattctcttcttcatctccacctttgcattcac

SEQ ID NO: 35929 - DNA, 201 bp, Homo sapiens
gataaatcagctcattctgtcttttgctaacttcccatattaaacgagttatcaaatctggtcaattctccttcataaagcactcacaaatccatcactcytctccagcctcttctgccctggccttaattctgcctctcaaaatttctcacttagactcctgcagtgccccccaacttgtatctgtgcctcccccacaac

SEQ ID NO: 35930 - DNA, 201 bp, Homo sapiens
ttcctattcagccatcttggaaccacctgacacgttttgtcttgataaacatcttaaacaacagaaaacagggttcaagagcaaagaaccggtctgaccaraaatttaccagggtggaattttcccaaccctagtaagcctaagggttctgcaggagaccagggcatatttcagtccttatctcaactgcacaagacagac

SEQ ID NO: 35931 - DNA, 201 bp, Homo sapiens
gtttttctgtgatttttccagcagaggagactccaatctaaatcctgtcatttcagaggaatggaaagcccaattcattaaaacagaaaggaagaagctcytgaactacaaggctcggctggtgaagaacctgcaaccccgaatttattgtccctttgctgggtattttgtggaatctcacccatcagacaagtatggcta

SEQ ID NO: 35932 - DNA, 201 bp, Homo sapiens
ttctatttctgccttagttacctatcaattttatctcctgaaagagttccaatctgctagaatatgtgtttttctgtgatttttccagcagaggagactcyaatctaaatcctgtcatttcagaggaatggaaagcccaattcattaaaacagaaaggaagaagctcctgaactacaaggctcggctggtgaagaacctgc

SEQ ID NO: 35933 - DNA, 201 bp, Homo sapiens
cctcccaaagtgttaggattacaggtgtcagccattatgcccagcctaaaaggactttctctttcagagtgcccctgtctttatttgtagaggttattcartttctttaattacctggcatactttgagtccatccctgagctattctgctatacttttctctatcctttctgtagatctcagcaacctcattcactagaa

SEQ ID NO: 35934 - DNA, 201 bp, Homo sapiens
cagtaacagctctctgaccttctaccctgtatgttctgcgtcctgtctaattcctcaagttccttcactgcctgtcactctgatgcttgctatatatcagrccatcctgctttttgtttcttagacccaaagtgtcaagtgcacacctgccctgggtctttgtgtttgctgtttccatttcctggagtgcagctggccctg

SEQ ID NO: 35935 - DNA, 201 bp, Homo sapiens
agttccacatagtcttttcaggtggaactagttcttgctctactttacttaaggtatattttctttctgtgcaccatttttcttttcttttttttttttttgacagagtcttgccatctcaaaagtgagatggagtgcagtggtgccatctcagctcacagcagcctctgcctcctaggctcaagctatcctcccacctca

SEQ ID NO: 35936 - DNA, 201 bp, Homo sapiens
  misc_feature (1)...(201): n = A,T,C or G, or insertion/deletion polymorphism (see Tables 1-2)
tctcaaatactgaattaaaaaccaaactgaaattcacagttgttggttttgttgttaaattccaggtggacaaaaatcttcgattcatgatcttgatgganggtgttcatcctgagatggacacttgcattattgtggagtacaaaggtatgtttttatccccattgataacgaaaaatggaaaacattcttaataggaag

SEQ ID NO: 35937 - DNA, 201 bp, Homo sapiens
actccggggaaatcctccactaatgacatggagccttgttctatttctgccttagttacctatcaattttatctcctgaaagagttccaatctgctagaayatgtgtttttctgtgatttttccagcagaggagactccaatctaaatcctgtcatttcagaggaatggaaagcccaattcattaaaacagaaaggaagaa

SEQ ID NO: 35938 - DNA, 201 bp, Homo sapiens
ctttaaggggcggtggaagaagcagcaacttggcaataattccgcagccaacttcgcgtgttcaggcatcctttttctccagtaaaattttgtgcaactcrtctgcatcctcgctggtttttacccgaatcaacatggtgactggcatggtggcattcttctcgtcaattggtggatttggaacacagacgataagaacgt

SEQ ID NO: 35939 - DNA, 201 bp, Homo sapiens
tttgaaaattggtataaattcttctttaaaattatagtagaattcaccagtacacccttctgggcctgatgctttctgttttagaaggttcttagttaccrattcaatttatttaatatatatagtactactcagatagtctatttctttttgtacaagttttggcagattgtgtctttgaatggattggtctgtttcacc

SEQ ID NO: 35940 - DNA, 201 bp, Homo sapiens
gtttgacccttggttaatcggtcctgcttttgcccgtggatggtggttgctccatgagcctccatctgattggctggagaggctgtgccaggcagacctcrtttacatcagtcatctgcactcagaccacctgaggtaatgaagtcctgagcacacaactcctaagctcatgctgcaggaaaggcatcaaatgttctccga

SEQ ID NO: 35941 - DNA, 201 bp, Homo sapiens
agaacgttattcttccctgttcgcgtacatggcatattgggtggaatcagaacattcagcaatatgttgcctaaattggtgtctgcccgcaccaaaagctrtgtcttctgatttgctgtaggttttaaatgcagagtacctatgcctttctctttaaactcattgtctttcttgtaaaacagtttacactttttggagtaa

SEQ ID NO: 35942 - DNA, 201 bp, Homo sapiens
tgtttgtttttcctttgatataatcaattcttctataatcaaataagttcaattatacagactgtatacagaagtccttgtcttggaattcaaactatggrtgttcaagatttcaccttgaatatctatacctctttgtttctccacaggtcataaaatactcaatatagtagactgcaccagacccaatgggggaaggct

SEQ ID NO: 35943 - DNA, 201 bp, Homo sapiens
gtgcagtattagggtgggagtgacatgattttccaggtgccatctgtcaccccttcccttggctaggaaagggaattccctgaccccttgtgcttcccagktgaggcgatgcctcgccctgcttcagctcacacttggtgggctgcacccactgtcctgcccccactgtctgatgagccccagtgagatgaacccggtacc

SEQ ID NO: 35944 - DNA, 201 bp, Homo sapiens; identical to SEQ ID NO: 9198

SEQ ID NO: 35945 - DNA, 201 bp, Homo sapiens
  misc_feature (1)...(201): n = A,T,C or G, or insertion/deletion polymorphism (see Tables 1-2)
aaataagaataaaaatttgccccagtgcagtaagaaaatgaaaaggcattgaaatgagattcatactgttgttcattaataatatcttcatttcacaggantgcaaaaccacatgaaaatttcaagaattcactgatctgatgcaaaataaaaatttatcattacatcttgaacccaggaagcttacagcaaagagactat

SEQ ID NO: 35946 - DNA, 201 bp, Homo sapiens
  misc_feature (1)...(201): n = A,T,C or G, or insertion/deletion polymorphism (see Tables 1-2)
gtataagtgggtgaatgaagcagagcagagatgaaggcaatagaaattaagagatcactgtgtgcatttggacattgctgtctcaaggagacttggagtcngaccttttgagttaaaactccagctctgtcacctaccatatgaccttggacaaattattggatctctttgtgttccagatttccatctgtaaaatgaatg

SEQ ID NO: 35947 - DNA, 201 bp, Homo sapiens
tgcacccgctaccgctgcccagcatcttactgtgtatcactagcccagaaaagataaaaattcagagtatggtttctactgaatgtgtgtcatttttgcakatcagatgcccctccctgtgcattcccatagcgcctcgaagtcatctctatcaatcattcatttagtcgtaaggaagtcttgtttgtatatgtgtatccc

SEQ ID NO: 35948 - DNA, 201 bp, Homo sapiens
ttaaattaatcataagcaaaataacacgttgcccactgggaataactcaagcatgtggtattttgtccttaagctaaaaatagctctaggctggattattytgtggaactagaaaacctctaataaccttctacatcttctctccttttaatttctttttctttggcgggtaaggctggagaaacagatcacagatggtgg

SEQ ID NO: 35949 - DNA, 201 bp, Homo sapiens
atggcatgttttatactaatgttatttgattaagtgtccaagggtttctgggcaaaaattaagcttttggtagtatagcagaaagttggagtaagaaacartgagaggtctggcgctgttagttaatggatgtttgccagtgcctgtcagggcaacttggctagtacagtcacccagtacctatgacttctgcatgtgttc

SEQ ID NO: 35950 - DNA, 201 bp, Homo sapiens; identical to SEQ ID NO: 9236
  misc_feature (1)...(201): n = A,T,C or G, or insertion/deletion polymorphism (see Tables 1-2)

SEQ ID NO: 35951 - DNA, 201 bp, Homo sapiens
tgggaccccgacgccgcggtggcctggcgggtggggaaactcggctggaggggacgggcggttcgaggccccggcgccccacgtggagcagacaggagggyctgaggaaaggcccgagtgaggctccgggggagctcaggccgttgggggtggcgacgggaagtgggctgagacaggcccagccttgcggcgcacacgtgt

SEQ ID NO: 35952 - DNA, 201 bp, Homo sapiens
tggctaatttttgtatttttagtagagaaggggtttcgtcatgttgccaggctggtcttgaactcctgacctcaggtgatctggccgcctaggcgtctcaragtgctgggattacaggtgtgagccaccgcgtccagcctatatttttgttattgtgatgaagttgacatgatacagccattttaaagggaataattcagt

SEQ ID NO: 35953 - DNA, 201 bp, Homo sapiens
gagggggcggtggcggcaagatccggacgcggcgttgccaccaggggccaattaagccttaccagcaggggcgacaacagcatcaggtatgggaccccgaygccgcggtggcctggcgggtggggaaactcggctggaggggacgggcggttcgaggccccggcgccccacgtggagcagacaggagggtctgaggaaagg

SEQ ID NO: 35954 - DNA, 201 bp, Homo sapiens
cagtttgggaggctgtggtgggaggattgcttgaggccagaagctcaagacgatcctaggcagcacagtgagactcatccctaccgaaaaaaaaaaaaaaagaaaaagaaataaccaggtggtggtgtgagcctgtagtcccagctacctgggatgctgaagtgggaggattgcttgagcccaggaattcaaggctacagt

SEQ ID NO: 35955 - DNA, 201 bp, Homo sapiens
agtaagatgctttttgggtaggagtgcactcaatgtttcatgtttttacttctcagctaggcgtaacatcttttaatgtgctcctgaatttttttttttttgagatggtgtctcgctgtattgccgaggctagagagcagtggtgcaatcacagctcattgcagcttccatctcctgggctcaagtgatcctcccacctca

SEQ ID NO: 35956 - DNA, 201 bp, Homo sapiens
ggttgaaaccagaaggcagaggttgcagtgagccaagatcgcaccactgcagtccggcccgggcaacaagatcgaaactccgtctcaaaaaaaaaaaaaaattggttcaaggtcagtaatataaggaaccagtgtggacaagtgtgtgccttaaggagttggcatgagagagtagattatatagttgatgtttttagggtt

SEQ ID NO: 35957 - DNA, 201 bp, Homo sapiens
taatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttcac

SEQ ID NO: 35958 - DNA, 201 bp, Homo sapiens
ctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttca

SEQ ID NO: 35959 - DNA, 201 bp, Homo sapiens
gccttagatcacctgaggtcaggagttcgagaccagcctggccaacatggtgaaaccctatctctactaaaaatacaaaaattagccggttgcagttggaygtgcctgtaatcccagctactcgggaggctgaggcaggagaatcatttgaacctgggaggcggaggttgcagtgagccgagattgtgccaccgcactcca

SEQ ID NO: 35960 - DNA, 201 bp, Homo sapiens
agttggacgtgcctgtaatcccagctactcgggaggctgaggcaggagaatcatttgaacctgggaggcggaggttgcagtgagccgagattgtgccaccrcactccagcctgggcaacagactgagactctgtctaaaaaaaaataaaaaataaaaaattaatgggatttaccatgtaaacaatctaaagagtactatat

SEQ ID NO: 35961 - DNA, 201 bp, Homo sapiens
cctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtcttttc

SEQ ID NO: 35962 - DNA, 201 bp, Homo sapiens
ttgacctcgtgatccgcccgcctcggcctcccaaagtgctgggattacaggcgtgagccaccgtgcctggcttggatttttcttttgaaaacatttcttgsaataccaagttcctcaaaagtaattatttaaattataattttatgaattaattgcaatgactaagatattgataaattattatctgtaatgaaattctga

SEQ ID NO: 35963 - DNA, 201 bp, Homo sapiens
ccctaatgcaaatgatgttgcatttttttcaggtgcttattgtccatttaaatatcttagggaggaatgcctttcacgtcctttacccattgaacagtttgtctttttgttactgagttataagagttcttagtctggacactagacccttaccagatacgtgatttgcagatattttttcccatttatagattgtctttt

SEQ ID NO: 35964 - DNA, 201 bp, Homo sapiens
atttcttaacaaatatttttttcccagtgttgcttgcctactcattttcttaatgatatcttttgattggcagatgttctaaattttatgaagactggatwtttttttctaatatttttattcttctttgtgtcctaagaaaattttgcctatccccgggctacaaagatagtttcctgtgcttgcttctagaagcattgt

SEQ ID NO: 35965 - DNA, 201 bp, Homo sapiens
attttgtatgcatgcatgtgtgtgaaaagtcattaagtctggaatgaaatatagagtatccgtgaagccattttagaattatatgtgtgtatatttatgtrcataggtatatgaatacataccttaggttccattattatcagtttttcctcttatttgtttgtatctactgtatatttctctgggaaatactcatggtct

SEQ ID NO: 35966 - DNA, 201 bp, Homo sapiens
cgagactccgtctcaaaaaaaaaaaagaaataaaaaaaaggtttgttaacaattaagacatgcgcacattaacctagccctacataaagtcagtatcagcwatatcatggctttctacccccacatcttgtcgcactggatactcttcaggggcattaacatccatggagctatcatctcctatgataacaatgccttctt

SEQ ID NO: 35967 - DNA, 201 bp, Homo sapiens
tgtgtacctcctcagtttttttatctgtaaaatggaaataagaataaatattgtgttcatgtctgtaagatttctgccacttaatagctgtatggtattatgccatatatctccctgccttactttcttcatatgtaacaatagtatctacctcatatgagataacccatgtaaggatattacaaaggtattagatagtga

SEQ ID NO: 35968 - DNA, 201 bp, Homo sapiens
ttagtaaagacggggtttctccgtgttagccaggatggttttgatctcctgacctcatgatccaccttcctcagcctcccaaagtgttgggattacaggcrtgagccaccgctcccaactagttgactgttcttatgtggcacatgactatatatctgctgttgaagtagtgtcagattctggaaagctaacatatggcag

SEQ ID NO: 35969 - DNA, 201 bp, Homo sapiens
ttgtgtacctcctcagtttttttatctgtaaaatggaaataagaataaatattgtgttcatgtctgtaagatttctgccacttaatagctgtatggtattatgccatatatctccctgccttactttcttcatatgtaacaatagtatctacctcatatgagataacccatgtaaggatattacaaaggtattagatagtg

SEQ ID NO: 35970 - DNA, 201 bp, Homo sapiens
aatttcagcataggatttggagggacaaacatctaaactatcagatgactacactaaacaacatattttcagatgaaacatggcccgccgttggaagaagwtaccatctaggattttgatagccagagaagagacatcaatgcctggcatcaaaggataggctaactctcttattaggggttaatgcaactggtgactgta

SEQ ID NO: 35971 - DNA, 201 bp, Homo sapiens
cttgtgtacctcctcagtttttttatctgtaaaatggaaataagaataaatattgtgttcatgtctgtaagatttctgccacttaatagctgtatggtattatgccatatatctccctgccttactttcttcatatgtaacaatagtatctacctcatatgagataacccatgtaaggatattacaaaggtattagatagt

SEQ ID NO: 35972 - DNA, 201 bp, Homo sapiens
ttgctgacatcacagcccaaatttccacatttcattccagctactccagaatttgcacatgtggcccataaagaggcatgaagagacaactgtgcacgtcsaaggacttttcagacttcctctttccttccccagaatctaccccctaaacctttcctaataaacatactaccttaaggccaatttgcggggagacagatt

SEQ ID NO: 35973 - DNA, 201 bp, Homo sapiens
gttcaagtgattctcatgtctcagcctcccaagtagctgggattacaggcatgcaccaccaaggctagctattttttttttttttatttttttatttttttattttagtagagacggggttttgccatgttgtccaggctggtctcgaactcctggccttaagtgatccccacccgccttgcttcccaaagtgctgggatt

SEQ ID NO: 35974 - DNA, 201 bp, Homo sapiens
acaacacatctatttacagcatggtttactgaacattttaagccagttgttgagacctcttgcttggggacaaaaagattctttgcaaaacaacactgctyattaacaatgcatttggtcacccaagagctctaatgagatgtgcatagagattaatgttgttctgatgcttgataatacaatgtccattctgcagcccat

SEQ ID NO: 35975 - DNA, 201 bp, Homo sapiens
ccgggtgtggtggtgcacacctgtagtcccagctacttgggaggctgaggcaggagaatcacttgaacttgggaggcagaggttgcagtgagtcaagatcrcgccactgcactccagcctgggcgacagagtgagactccatctcaaaaaaaaaaaaaaaggtatttttcataactccccatctattctaatagtgttttt

SEQ ID NO: 35976 - DNA, 201 bp, Homo sapiens
tattagttaatttagtcttaaatattactttattcccaatagagagagaacacagtaagttaatgagaatataatgatttacatccttaaatatctttccrttgtgtggcccttctttccctaaaatacaagcaaacaggcaataaataaataaataaataataaataaacccaatagcttcattttctttatttttttct

SEQ ID NO: 35977 - DNA, 201 bp, Homo sapiens
ttgctattcaactacagtatccagttagatttggattcgaggtgtatttttattaacctgaatgccaaaggccttcctatgaaaggcctaaaatccataasctataaaagaagatgaatgtatttgactttgtcaaaatctaatataaacagatgtccatttgatgaagtaatctatataaaaaatctattttctagcgaa

SEQ ID NO: 35978 - DNA, 201 bp, Homo sapiens
ttaatgaagagactgtccttttcccattgagtggtcttgaaatccttgttgaagatcgtttgatcatatatggtagtttatttctgggccctgtgttcacrtccatggtctgtattgcctgtctttattacagtattacagaccacaggctctttggtttcccatgtaatggaaattaacacggacccaagcagatttccc

SEQ ID NO: 35979 - DNA, 201 bp, Homo sapiens
aggcagcatatctggttgcgatgattaccttgagtagtggtctggccggtggcaacaatgctgtaaatcagttatttcgcattccttcctgaggtggactstctgcaaccttggtttgattttggatctcctaagagcaattcctggaattctttaaaaggtatggttacctattatgagagcaccgaagaatggctgttt

SEQ ID NO: 35980 - DNA, 201 bp, Homo sapiens
cctcctgagttcaagtgattctcatgtctcagcctcccaagtagctgggattacaggcatgcaccaccaaggctagctattttttttttttttatttttttatttttttattttagtagagacggggttttgccatgttgtccaggctggtctcgaactcctggccttaagtgatccccacccgccttgcttcccaaagtg

SEQ ID NO: 35981 - DNA, 201 bp, Homo sapiens
accctccacctcctgagttcaagtgattctcatgtctcagcctcccaagtagctgggattacaggcatgcaccaccaaggctagctattttttttttttttatttttttatttttttattttagtagagacggggttttgccatgttgtccaggctggtctcgaactcctggccttaagtgatccccacccgccttgcttc

SEQ ID NO: 35982 - DNA, 201 bp, Homo sapiens
actgtgatagcaccactgcactctggcttgggtgagagagtaagaccctgactcaaaatatatatatatatatgtgtgtgtgtgtgtgtgtgtgtgtgtgtatttttttctttttagcataatattggacttctacagatttgcaagaaaaatttcatgaacttcacattttactacatttgctctatctttttctctgtg

SEQ ID NO: 35983 - DNA, 201 bp, Homo sapiens
gaaggaatctgaacagccagcaaaagccacttttgcctttggagctcaaactagtactacagctggtaagtattaactttttattattattattattattwtttttttttacaagttgtcgttttacaagttgccttgacagatgcagcaagtcaattaatggtttacactgaacatagttgagaaatacagaactctttg

SEQ ID NO: 35984 - DNA, 201 bp, Homo sapiens
aactgtgatagcaccactgcactctggcttgggtgagagagtaagaccctgactcaaaatatatatatatatatgtgtgtgtgtgtgtgtgtgtgtgtgtgtatttttttctttttagcataatattggacttctacagatttgcaagaaaaatttcatgaacttcacattttactacatttgctctatctttttctctgt

SEQ ID NO: 35985 - DNA, 201 bp, Homo sapiens
tttaatgaaatgtaaacacattatgctaactgatttcagatagtgttgctatttagcaggaatggatgtattctgatccattaaattcaggttaatagaaytctatatgtaaaattacccatttggaatgatcttttacctttcaccttatcctggattctaaaatgtgcaaggattgtagtcattaaatatattggcctt

SEQ ID NO: 35986 - DNA, 201 bp, Homo sapiens
gaactgtgatagcaccactgcactctggcttgggtgagagagtaagaccctgactcaaaatatatatatatatatgtgtgtgtgtgtgtgtgtgtgtgtgkgtatttttttctttttagcataatattggacttctacagatttgcaagaaaaatttcatgaacttcacattttactacatttgctctatctttttctctg

SEQ ID NO: 35987 - DNA, 201 bp, Homo sapiens
ccaggagttcgaggctaaagtgaactgtgatagcaccactgcactctggcttgggtgagagagtaagaccctgactcaaaatatatatatatatatgtgtrtgtgtgtgtgtgtgtgtgtgtgtatttttttctttttagcataatattggacttctacagatttgcaagaaaaatttcatgaacttcacattttactaca

SEQ ID NO: 35988 - DNA, 201 bp, Homo sapiens
gcattaaaatgatgtataatgtaaccacatttaagaatgtattccaattatcaagtggcaaattgttataatgcaaaactgcaattacgtttgcaccaacctaatatctgattcatataccatgagcttattttttttgacaagtttttacatttcctggtaaaatctgtagcatgttttgtgaagtttatctctgtatga

SEQ ID NO: 35989 - DNA, 201 bp, Homo sapiens
gcccaggagttcgaggctaaagtgaactgtgatagcaccactgcactctggcttgggtgagagagtaagaccctgactcaaaatatatatatatatatgtrtgtgtgtgtgtgtgtgtgtgtgtgtatttttttctttttagcataatattggacttctacagatttgcaagaaaaatttcatgaacttcacattttacta

SEQ ID NO: 35990 - DNA, 201 bp, Homo sapiens
tagcagttagattccaacattttgtgttacatttgctttatcaaaaaagaaaaatttacctgtccatctttttttattttttggtgcattttaaagatagwtgaagacattagtacacttcacccccaaatacgtcagcatacatagcgtgaagtagagttaaatatttgttgttctttttataacatagcaaaattgaca

SEQ ID NO: 35991 - DNA, 201 bp, Homo sapiens
gagcccaggagttcgaggctaaagtgaactgtgatagcaccactgcactctggcttgggtgagagagtaagaccctgactcaaaatatatatatatatatrtgtgtgtgtgtgtgtgtgtgtgtgtgtatttttttctttttagcataatattggacttctacagatttgcaagaaaaatttcatgaacttcacattttac

SEQ ID NO: 35992 - DNA, 201 bp, Homo sapiens
cttcttactgagttttaggaggtctttataaattttggacctaggtactttgtcagatacatttcttaacaaatatttttttcccagtgttgcttgcctaytcattttcttaatgatatcttttgattggcagatgttctaaattttatgaagactggatttttttttctaatatttttattcttctttgtgtcctaagaa

SEQ ID NO: 35993 - DNA, 201 bp, Homo sapiens
gagagcccaggagttcgaggctaaagtgaactgtgatagcaccactgcactctggcttgggtgagagagtaagaccctgactcaaaatatatatatatatrtgtgtgtgtgtgtgtgtgtgtgtgtgtgtatttttttctttttagcataatattggacttctacagatttgcaagaaaaatttcatgaacttcacatttt

SEQ ID NO: 35994 - DNA, 201 bp, Homo sapiens
aatgctttgatttataaagcttctctaacgttgcactctctccttcgttcattgtaggtttcgcatcgccgaagatagattctgttgctgctcagcccacygcaacaagcccagtagtttatacaagaccagcaataagtagcttttcttctagtggaattgggtttggggagagtttaaaagctgggtcatcatggcagt

SEQ ID NO: 35995 - DNA, 201 bp, Homo sapiens
ccccaaagccagtttccatagcaacaaatcgaagtgtttattttaaaccatctctgactccttctggtgaattcaggaagactaatcaaagaatagataasaagtgcagtgtgagtatatgtatatttctaccagtctttgaatattgattagaataagtaagactaaataatgtaaaatataactaccattgtattctag

SEQ ID NO: 35996 - DNA, 201 bp, Homo sapiens
atccattaatcacttgaaggacattggggttggttttactttttggctgtaatgaataatgctcctgtcaacatttatgtataagtgtttttttgtgtgtktgtgtgtgtggacatgtttttatttctcttgggtttatacctagaaatagaattgctggatcataggtttttgaagagaccaggccagttgtcttataaa

SEQ ID NO: 35997 - DNA, 201 bp, Homo sapiens
agagcatacactttacatttattctatggctccatagtgatttgtccttttaatattattaagtgtccttttaaaaaaaacttttggaaatattttttgtyttgaaatctactttggtattaatacagccactcttactggaataagccttcttatgcttagtagtttcagggcatatctttttccattcatatactttga

SEQ ID NO: 35998 - DNA, 201 bp, Homo sapiens
tgcttttggttgctcttgtgccttcagatgattgtttctttatacttttttccagagtttatcatatatctaaacgtttatcaggtagaagctactctgcstttagcacaagtggaactcattttgtttgttctttatctagggatcattggagacttagggtgctctttgttcagttgggttaaaaatcaaagtggctct

SEQ ID NO: 35999 - DNA, 201 bp, Homo sapiens
ctggtcttgaactcctgacaaatgatctgcctgcctcagcctcccagagtgctgggattataggcgtgagccatcacgcccagcctcctttgcaaaacttmtttaaccaccactgcactgtatgttcattagcagttctgggccaaatgtgttgttgatgttggcaagttgtctttgctgctttacaacccattttgaact

SEQ ID NO: 36000 - DNA, 201 bp, Homo sapiens
  misc_feature (1)...(201): n = A,T,C or G, or insertion/deletion polymorphism (see Tables 1-2)
ccaggctggagtgcggtggcacaatctcggcccattgaaagctctgcctccgggttcaaacgattctcctgcctcagcctcctgaatagccgggattacangcgcatgccaccacgcctggctaatttttacatttttagtagagacgttttcaccatgttggccaggctggtctcaaactcctgacctcaaatgatccac

SEQ ID NO: 36001 - DNA, 201 bp, Homo sapiens
cccgggaggcggagggtgcagtgagccgaggccgcgccactgcactccagcctgggagacaaagtgagactctatctcaaaaaaaaaaaaaaaaaaaaaaagttcagtaaactaaagtcctcattgcacatcatcatctttgtatactttcctcattaaccaaaattttgtgaaatctattgtgtgtagtagaatttcaat

SEQ ID NO: 36002 - DNA, 201 bp, Homo sapiens
gtttctttgtccattcatttgtggatggatacttaggtcaattccgtatcttggctattgtgaatagtgctgcgagtgcagattatctctttgatatactrgtttcctttaacttggatatatacccagcagtgggattgttggatcatattgtggttctacttttagtttttgtgagaaacctcaatgatgttctccatg

SEQ ID NO: 36003 - DNA, 201 bp, Homo sapiens
tcacaaggtcagtagatcgagaccatcctggctaacacggtgaaaccccatctctactaaaatacaaaaaattagccgggtgtggtggcgagttcctgtaktcccagctgctcgggaggccgaggcaggagaatggcgtgaacccgggaggcggaggttgcagtgagccaggattgcgccactgcactccagcctgggcga

SEQ ID NO: 36004 - DNA, 201 bp, Homo sapiens
gcacatttttaagattacagaataatttagaatattacataaacttagttgataaagcagcagcgaaatttgagaggattgactcccattttgaaaattcygcagttagaatgctatcaaaaacattgcatgccacagagaaatctttcgttaaaggaatagtcagtcgatgaggcaaacttcattgttgtcttattttaa

SEQ ID NO: 36005 - DNA, 201 bp, Homo sapiens
aatctaggctcttgtattggtgttattactatggattatgtaattttgtttcagatataactgtttcaaagaacacttcattgccacctctgtggtccccrgaagctgaacgttctcactcactctcacagcacactgccaccagctcaaaaaaaccagcattcaacttgtctgcctttggaacactttcccctgtgagta

SEQ ID NO: 36006 - DNA, 201 bp, Homo sapiens
atccactatctttgtttagtcaaaacaaggtgacaagttagttataaagcaagtctcattataagaaatttataggttgtctacattatagttgtagtagrttttatttctagtttttacctttcagttcacaagcatttttatgtataaaggttatgcaggcccatgtagattgtgatacataatttctgaaccgaagaa

SEQ ID NO: 36007 - DNA, 201 bp, Homo sapiens
cctcaggtgatctgcccacctcagtcccccaaagtgctaggattacaggcatgaaccacctcgcttggccagattgttttagttcctgtatttttttttttaactcttgtatttctagttgtctgaatttttatttatcttaaagcatgtgcagtaaaataattgcttgagaaagctattgaaagtattgtttatgtttta

SEQ ID NO: 36008 - DNA, 201 bp, Homo sapiens
gcctcccaggttcatgccattctcctcctcaacctcccgagtagctggcaccacaggcgcctgccaccacgcctggctaatttttttgtatttttaatagwgacagggtttcaacatgttagctcggatggtctcgatctcctaacctcgtgatctgcctgcctcggcctcccaaagtgctgggattacaggcgtgaacca

SEQ ID NO: 36009 - DNA, 201 bp, Homo sapiens
caacatttgctgtagtgaaatgtcaacatcagaaaagattttagattgtttcttgagtttatttttgttggattgtttttttttgtttgtttatttgtttygttttgttttttgagatggagttttgcccttgttgcccgggctagagtgccatggtgcagtctgggctccctgtaacctctgtctcctggatataagtga

SEQ ID NO: 36010 - DNA, 201 bp, Homo sapiens
tggagatggggtttcactatgttggccgggatggtctccatctcttgacctcgtgatctgcccgccttggcctcccaaagtccttgggattacaggcacgrgcccccgtgcctggccgcatcttgtttcttattgtttcttttgttccatccctcctctccccatcccacacagaaacttacatgtcaggtcactcttcaa

SEQ ID NO: 36011 - DNA, 201 bp, Homo sapiens
agcataaaaagtaaaagcagtaagtcactcatcttactgctagcagctaccattactctttagatgtaaacattctagacttttcaacctgcttttacccrtaactacacttttaagaatgatttttgtgggccaggcatgatgactcatgccagtaatgccagtgctttgggaggccgatgtgggaggatcacctgaggc

SEQ ID NO: 36012 - DNA, 201 bp, Homo sapiens
aaaaatgggctgagaaaagggcaagtggataccagcacagcatcaaatctgtgattttataagtgtgtgtgtgtgtgtgtgtgtgtgtgtgtgtgtgtgtktaggaaaaagctaaattttaagaaaagtgagtaaagaaaaactttaaatccaagtgagtggattcagagaaaaacagtacaggtgaaaatcatggctaaa

SEQ ID NO: 36013 - DNA, 201 bp, Homo sapiens
ccaagacgggcagatcacttgaggccaggagttgaagaccagcctggccaacatggcgaaaccccatctctattaaaaagagaaaaaattagctgggcgtsctggcatgcacctgtagttccagctactcgggaggctgaggcaggagaattgcttgaacctgggaggtggaggttgcagtgaaccgagatcgaaccactg

SEQ ID NO: 36014 - DNA, 201 bp, Homo sapiens
ttaggtggtcttgatataggtatgtgcagcctctctgctcactggacactcccttgtggatttctgggagaccctctctgcacagttccctactctgcagygtcctaaattctgatttcttcccgctctgttttacttgactctaggtctctgttcaaggtctgaaaatgttcctagacagagagctgggtaatcgtaggg

SEQ ID NO: 36015 - DNA, 201 bp, Homo sapiens
aagctttgaattgcatgatccaaggacacgcctgtatttgggtcttagcacctttttgttcgttcagtccatagtacttcccactctctctttttttttttccttgagacagagtctcgctttgttgctcaggctggagtgcagtggcgtgaactctgctcactgcaacctctgcgtcctgggttcaagcgattctcctac

SEQ ID NO: 36016 - DNA, 201 bp, Homo sapiens
atgtcactacagtgaacagtacaaattgtaagaagacaccacctgaagattgtgagggtccttttagacctgcagaaatcctgaaagaaggaagtgttctwgatattctgaaaagccctggtaagataattaaaagataagccttttgattacaaactcatgatctcaatttaatgtcattttgtattatactttaggctt

SEQ ID NO: 36017 - DNA, 201 bp, Homo sapiens
agctgtaaaatatttgttaagacttatttttttttttttttaaatgagatagtcttgctttgttggtcaggctggagtgcagtggtgccatcatagctcaytgcagccttgaactcctgggctcaagtgatcctcccacctcagcctccttgagtagctgggactacagctgtgtgcaaccacacccagctgactttttaa

SEQ ID NO: 36018 - DNA, 201 bp, Homo sapiens
gaagctttgaattgcatgatccaaggacacgcctgtatttgggtcttagcacctttttgttcgttcagtccatagtacttcccactctctctttttttttttccttgagacagagtctcgctttgttgctcaggctggagtgcagtggcgtgaactctgctcactgcaacctctgcgtcctgggttcaagcgattctccta

SEQ ID NO: 36019 - DNA, 201 bp, Homo sapiens
cgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactcttaag

SEQ ID NO: 36020 - DNA, 201 bp, Homo sapiens
ggtggagcttgcagtgagccgagatcatgccactgcactccagcctgggcgacagagcgagactccgtctcaaaaaaaaaaaaaaaaaaaaaaagataagycaagctgtgcaacctgtgggctgcatgtggcttaggatggctatgaatgaggctcaacacagatttgtgaattttctaaaacattatgagattcttttgc

SEQ ID NO: 36021 - DNA, 201 bp, Homo sapiens; identical to SEQ ID NO: 9246

SEQ ID NO: 36022 - DNA, 201 bp, Homo sapiens; identical to SEQ ID NO: 9251

SEQ ID NO: 36023 - DNA, 201 bp, Homo sapiens
aaaacactcctctctttctccactctaatgatgaccaccgccttgtcttttatggtaatcactgttctttgggttttattactgcatttattggctaatamatgcatccctagaaaatgtagttttgcctgcttttatataaatggaatattactgcatgcagtcttttgatttgtgattgttttgctctaaggcttgtaa

SEQ ID NO: 36024 - DNA, 201 bp, Homo sapiens
ctcatcagctgttgctagtgttagtatattttacttgtggtccaagacaattctttttgtccagtgtggactagggaagccaaaagattggaccacccccrcctcccctgctgatacaggcaatagataatgtactgatcgaactgaataaggaatggaggacataaaattaaagacgttgatttcaagctgctgaagtca

SEQ ID NO: 36025 - DNA, 201 bp, Homo sapiens
ccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactcttaa

SEQ ID NO: 36026 - DNA, 201 bp, Homo sapiens
gtccaagacaattctttttgtccagtgtggactagggaagccaaaagattggaccacccccacctcccctgctgatacaggcaatagataatgtactgatygaactgaataaggaatggaggacataaaattaaagacgttgatttcaagctgctgaagtcaacattcagatgtatgtaatgtgaccaggcatggtggctc

SEQ ID NO: 36027 - DNA, 201 bp, Homo sapiens
cccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactctta

SEQ ID NO: 36028 - DNA, 201 bp, Homo sapiens
tggactagggaagccaaaagattggaccacccccacctcccctgctgatacaggcaatagataatgtactgatcgaactgaataaggaatggaggacatamaattaaagacgttgatttcaagctgctgaagtcaacattcagatgtatgtaatgtgaccaggcatggtggctcacgtctgtaatcccagcacttcgtgag

SEQ ID NO: 36029 - DNA, 201 bp, Homo sapiens
acccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactctt

SEQ ID NO: 36030 - DNA, 201 bp, Homo sapiens
cctgccaccacgcctagctaattttttgtgtttttagtagagacgggggtttcaccatgttagccaggatggtctcaatctcctgacttcgtgatccaccygcctcggcctcccaaagtgctgggattacaggcgtgagccaacacgcctggtctggaggccagatttttcaagtcttctgtaaaagagtaagcccgcaag

SEQ ID NO: 36031 - DNA, 201 bp, Homo sapiens
cacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaataactct

SEQ ID NO: 36032 - DNA, 201 bp, Homo sapiens
tgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaata

SEQ ID NO: 36033 - DNA, 201 bp, Homo sapiens
acatttacaaaagaaaaaatgcattgtaattggatggactttacttattagtgtgtcagttcttagcgaatatcatatagcaggttatcacaaaatggtgrgaatgccttttggtcatctataccagggttgttttaattattcactgtatggaataatgtacactctctgtgttcaactttaacatatttacctcttggg

SEQ ID NO: 36034 - DNA, 201 bp, Homo sapiens
ggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggtaa

SEQ ID NO: 36035 - DNA, 201 bp, Homo sapiens
aaggctgagatgagagcccaggagtttgaggctgcagtgggccatgatcacgtgccattgcactctacctggtatgacacaggtctctggaaaaaaaaaaattcttgctatagtgctttagctagcctgtcacctatatcaagtatgtctttgtttttaagtctttttttgtttttctgagctggagtctcgctgtgtcac

SEQ ID NO: 36036 - DNA, 201 bp, Homo sapiens
aggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggta

SEQ ID NO: 36037 - DNA, 201 bp, Homo sapiens
agtttctttatgcccatccaaggcaaacatacatacccctatatattcttacttccttttaccttgttagaaaagtctgtataccgcactccctttctgcycctttgattttatcagggattatcttggacacatctttgttcttccttcttcgtttatagctgcctggattgcatatggcattttgcatgtctatgagtt

SEQ ID NO: 36038 - DNA, 201 bp, Homo sapiens
caggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataagggt

SEQ ID NO: 36039 - DNA, 201 bp, Homo sapiens
cagtgccattaagatactgacatactgtaaattaaaattttcatgaaatctccccccactccccgtttttttttttttttttttaggaagttcagtacctrcttcaagtagcagcactgtacctgtctctctgccttctggaggctctctaggattggaaaagttcaagaaacccgagggaagctgggactgtgaattgtg

SEQ ID NO: 36040 - DNA, 201 bp, Homo sapiens
tcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataaggg

SEQ ID NO: 36041 - DNA, 201 bp, Homo sapiens
gtatctactacctggaaaataaggattcttagcttatgaagtattttctaccataatctatgggaaggcctttatttacaaatagttacagataaccagtyctcatcaaacattaagaaacatagacaacaaatataattaatcctgagaaaacaagagattttgaaagctgaagtcctggggaaaaaaatgacatagcac

SEQ ID NO: 36042 - DNA, 201 bp, Homo sapiens
cctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataag

SEQ ID NO: 36043 - DNA, 201 bp, Homo sapiens
ttttagatgtgcaaaaaatgcaaaagttgaatatccatgaatacttttgaataataaattggaaacactcaaaattaacctttaaaaagtatggaattcarcaaatagctatgagcagttttttgtctgttatatatttacttagaaatataaagacaaaatcaaaactaaaattacatattatttggaaagcaacaaaaa

SEQ ID NO: 36044 - DNA, 201 bp, Homo sapiens
ttcaacaaatagctatgagcagttttttgtctgttatatatttacttagaaatataaagacaaaatcaaaactaaaattacatattatttggaaagcaacraaaacatgatagggtctaatcagatttgatgatgaaaacaccaggctatggtagacactcttaaccattcttccattagccaggttgaaagtaagccaac

SEQ ID NO: 36045 - DNA, 201 bp, Homo sapiens
ctcctttaatccttgaacttaaatttattatttatgattatgaagtgtggactttgctttagggccacagagtattttttaagattaatttttttttttttgagacggagtcttgctctgtagcccaggctggagtgcagtggtgtgatctgggctcactgcaacctccgtctcccaggttcaagtgattctcctgcctca

SEQ ID NO: 36046 - DNA, 201 bp, Homo sapiens
ctaagcctcccaatgtggtgggccttagcctccaagctctgtctcccctgtggctttttaggagagatctgtagtaggtcttattttagttatatacttaytccttatttttaagggcgaaccttttggtacatcagctgaatgccattagtaatgagatctttaaattctggcagccctaaaacttgagagtcctcagca

SEQ ID NO: 36047 - DNA, 201 bp, Homo sapiens
acctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttataa

SEQ ID NO: 36048 - DNA, 201 bp, Homo sapiens
gacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttata

SEQ ID NO: 36049 - DNA, 201 bp, Homo sapiens
tgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggttat

SEQ ID NO: 36050 - DNA, 201 bp, Homo sapiens
ccgagctcaagcagtccacccacctcagcctcctaaagtgctaggattacaggcgtgagctactgtgcccagccaagatgttagaaaactcttgactctgkgtagcagcataactgtccaaaaaaacacaaaacaaaacaaaagaaaagccatgctacaaagtctagtgaaggtcattcccacagaaaacacaaagcatta

SEQ ID NO: 36051 - DNA, 201 bp, Homo sapiens
ctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggtta

SEQ ID NO: 36052 - DNA, 201 bp, Homo sapiens
tcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagggt

SEQ ID NO: 36053 - DNA, 201 bp, Homo sapiens
ctgagtcagttttcccaaaattgcttttattatttttgtctcagtgtttcttattaaatactgtcctcaaatgcctggtactccttggctacctgtagttkttatgagtgtaggacacgtaaataccacttaaatcctttctacattgatagggcttacagatcttgaatttcattgtagatttatctggtttatctagca

SEQ ID NO: 36054 - DNA, 201 bp, Homo sapiens
ctcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaaggg

SEQ ID NO: 36055 - DNA, 201 bp, Homo sapiens
aattgcttttattatttttgtctcagtgtttcttattaaatactgtcctcaaatgcctggtactccttggctacctgtagttgttatgagtgtaggacacrtaaataccacttaaatcctttctacattgatagggcttacagatcttgaatttcattgtagatttatctggtttatctagcattattttacttgggaaag

SEQ ID NO: 36056 - DNA, 201 bp, Homo sapiens
gcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcaggtattttcagtcgttctctactgatggttagg

SEQ ID NO: 36057 - DNA, 201 bp, Homo sapiens
actcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaataactgaagg

SEQ ID NO: 36058 - DNA, 201 bp, Homo sapiens
tggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaaat

SEQ ID NO: 36059 - DNA, 201 bp, Homo sapiens
taaaattaaatatgttctccaacataaatttaccatactataattctggaggattatattacagtttgagaaaaaaataacagtagcgtgtgtgttaggtrtagcagaaaatgtatataccaatgtgagtctactccccccccacccgaccccccttacccttctgctgctcatggtaaatgttagcatttggaaattttg

SEQ ID NO: 36060 - DNA, 201 bp, Homo sapiens
aggagagctctaatattactgatgggagaatcacacctgagccagcagtcagtaatacagaaggtaagtaaaatgtgaatattttgtcatgaatgataggytttcatgccctaattttgaagacactacctagttatggtaaatctaatcaggcggtacataaaccatatgggaagaggatgataatcaggttcaaattgg

SEQ ID NO: 36061 - DNA, 201 bp, Homo sapiens
gctggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctcaa

SEQ ID NO: 36062 - DNA, 201 bp, Homo sapiens
ggctggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattcattgtcttgctca

SEQ ID NO: 36063 - DNA, 201 bp, Homo sapiens
tccgccatggcctcgggagccggaggagtcggagggggcggtggcggcaagatccggacgcggcgttgccaccaggggccaattaagccttaccagcaggrgcgacaacagcatcaggtatgggaccccgacgccgcggtggcctggcgggtggggaaactcggctggaggggacgggcggttcgaggccccggcgcccca

SEQ ID NO: 36064 - DNA, 201 bp, Homo sapiens
gaaataaaaaaattagccagatgtggtggtgcgtgtctgtaatcctagcaaggcaggaggttgcggtaggaggatcacgtgagagcccaggagttcgaggmtaaagtgaactgtgatagcaccactgcactctggcttgggtgagagagtaagaccctgactcaaaatatatatatatatatgtgtgtgtgtgtgtgtgtg

SEQ ID NO: 36065 - DNA, 201 bp, Homo sapiens
gaactcgggaggtggagcttgcagtgagctgagaccgtgccactgcactccagcctgggcaacagagccagactccatctttaaaaaaaaaaaaaaaaaaagagagattttaacttccactatttctttaatttctaagtattcttttttattttctggatgtttcctttttatgcccctctgggttcccccccacccaac

SEQ ID NO: 36066 - DNA, 201 bp, Homo sapiens
gaaatatgtgccttagattttatgttgcaacaaataatatagggtttactttacaggcaccagttagaagacaaatgaaagctaagcaactcagtgcacartcttacggtgtgaccagttcaacagctcggcgaatattgcagtctttagagaagatgtcaagccctttagcggtaaatttttaaaatcacgattaataca

SEQ ID NO: 36067 - DNA, 201 bp, Homo sapiens
gatatatgtagttaatcaaaatttgctcatattagttaatttagtcttaaatattactttattcccaatagagagagaacacagtaagttaatgagaatayaatgatttacatccttaaatatctttccgttgtgtggcccttctttccctaaaatacaagcaaacaggcaataaataaataaataaataataaataaacc

SEQ ID NO: 36068 - DNA, 201 bp, Homo sapiens
ggtcacaagcctggccatttaacctaatccgtctgtagaatggaagttacacatgcatgctttcttttctcctatgaatgcctttgagtgcttagattttyttgtatgacatgtagaaaaatgacttgttttaaatataggtcattggatggtctgaatagaggttagaagggaattaatattttccagatgtctgaagtt

SEQ ID NO: 36069 - DNA, 201 bp, Homo sapiens
ccatgttggtcaggctggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattca

SEQ ID NO: 36070 - DNA, 201 bp, Homo sapiens
gccatgttggtcaggctggtctcaaactcctgacctcaggtgatccacccgccacagcctcccaaaagtgctggtattacaggcgtgatccacccgccacagcctcccaaaagtgctggtattacaggcgtgagccaccgcgcccggcccaaattctgatctttaaaatgtcatcttgcatgaagttgtgcagacaaattc

SEQ ID NO: 36071 - DNA, 201 bp, Homo sapiens
ttgaacccgggaggcggagcttgccgtgagcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcaggta

SEQ ID NO: 36072 - DNA, 201 bp, Homo sapiens
cttgaacccgggaggcggagcttgccgtgagcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcaggt

SEQ ID NO: 36073 - DNA, 201 bp, Homo sapiens
gcttgaacccgggaggcggagcttgccgtgagcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcagg

SEQ ID NO: 36074 - DNA, 201 bp, Homo sapiens
ggcttgaacccgggaggcggagcttgccgtgagcagagatcttgcccctgcactccagcctgggcgacagagcgagactcttgtctcgaagaaaaaaaaaaaaagtaaagatttgaggaatttttttttttttgtcttctagttttcttaaatgttttttattttgagggaaatgtttgagtagtaaaaattgtggttcag

SEQ ID NO: 36075 - DNA, 201 bp, Homo sapiens
atccaaggacacgcctgtatttgggtcttagcacctttttgttcgttcagtccatagtacttcccactctctctttttttttttccttgagacagagtctygctttgttgctcaggctggagtgcagtggcgtgaactctgctcactgcaacctctgcgtcctgggttcaagcgattctcctacctcagccttccaagtag

SEQ ID NO: 36076 - DNA, 201 bp, Homo sapiens
ccactgataattaccatctttgtgttggtgttgggagggattgattctgggtatctgcttctaaacatactctgccatcctttttttttttttttttttttaattcccactacatcctcacttccataggtatctggaacctaaacattttgggtatgtttggtgtaaatgcaattgcttctgttctttccctactgctcg

SEQ ID NO: 36077 - DNA, 201 bp, Homo sapiens
gagacggggtttcactatgttggccaggctggtcttgaacttctgacctcgtgattctccctcttcagcctcccaaagcgctgggcttataggagtaagcyaccgtggccccagccccatcctttatttctttttcttttcttttcttttttgtgagacggagtcttgctctgtcacccaggctggagtgcaatggcgcga

SEQ ID NO: 36078 - DNA, 201 bp, Homo sapiens
cccactgataattaccatctttgtgttggtgttgggagggattgattctgggtatctgcttctaaacatactctgccatcctttttttttttttttttttttaattcccactacatcctcacttccataggtatctggaacctaaacattttgggtatgtttggtgtaaatgcaattgcttctgttctttccctactgctc

SEQ ID NO: 36079 - DNA, 201 bp, Homo sapiens
atgctgattattgctgagccatatggtatactataactttctatcctatacaaaatttgtttctctgacattattgacttcctctctttattttttttttatgtaaagagcaatcaattttataaactaaatacaaagaaaaagtcaattttaggagatctttcttccagttaaagaattgagaaaaggctacagaggccc

SEQ ID NO: 36080 - DNA, 201 bp, Homo sapiens
aattcatatcctaccaccattgtatgagttcttatatgtgggttctatttgatttctcatgtgtgtaaattgttttaaaaggtttttttttttttttttttggccatttttcagtttggcttttgcgtgtaagtttgtagaggttctttatgtattctggatattggtactttgtcagctaatgtacataccaaaatttct

SEQ ID NO: 36081 - DNA, 201 bp, Homo sapiens
tgaacagccagcaaaagccacttttgcctttggagctcaaactagtactacagctggtaagtattaactttttattattattattattattttttttttttacaagttgtcgttttacaagttgccttgacagatgcagcaagtcaattaatggtttacactgaacatagttgagaaatacagaactctttgggaaggaac

SEQ ID NO: 36082 - DNA, 201 bp, Homo sapiens
tgagaaggaatctgaacagccagcaaaagccacttttgcctttggagctcaaactagtactacagctggtaagtattaactttttattattattattattwttttttttttttacaagttgtcgttttacaagttgccttgacagatgcagcaagtcaattaatggtttacactgaacatagttgagaaatacagaactct

SEQ ID NO: 36083 - DNA, 201 bp, Homo sapiens
ccaaacttcactgccaggcaacatatccatgtaacaaaattgcactggtaatccttaaatttatacaaattaaacaaaaataatagcaagctttatctacyttgtaattagctttcaaactcttgattgcaaaccaaaagtcaggaataaaccttttatattgtgagccatcacctgcacagcgtatatgtctatatgatt

SEQ ID NO: 36084 - DNA, 201 bp, Homo sapiens
atttctaaaactgtcataatatgttttttctctcaacagggcattcttagcagggttacagaatctgttaagaatattgtgccagggtggctacaaagatmcttcaacaagaatgaagatgtatgcagctgttcaacagacacaagcgaggttccacgctggccagaaaataaagaggaccatctggtatatgccgatgag

SEQ ID NO: 36085 - DNA, 201 bp, Homo sapiens
atttgactttgtcaaaatctaatataaacagatgtccatttgatgaagtaatctatataaaaaatctattttctagcgaattctagggtaggaaaattctrgcaattgtagggtaggaaaaagtactttctgagactattcttaaggatttatgtttgtttcttaatttctgtcttacagatcaaggtgcagcaaagccag

SEQ ID NO: 36086 - DNA, 201 bp, Homo sapiens
taacaggatgcaaaaagaattccatccattgtttcttctcctctgaattctgtaagttgagatttaaacctttttacaaaatattgttcatacaaaaattwgccgggtgtggtggtgcacacctgtagtcccagctacttgggaggctgaggcaggagaatcacttgaacttgggaggcagaggttgcagtgagtcaagat

SEQ ID NO: 36087 - DNA, 201 bp, Homo sapiens; identical to SEQ ID NO: 9252

SEQ ID NO: 36088 - DNA, 201 bp, Homo sapiens
tgacctcaagtcatctgcccgccttggcctcccaaagtgctgggattacaggtgtgaaccactgtgcccagcccagaatcatatttaatggtgaaacattrgaagcaatcttattaaagttgggaataaggtagaagtccatcaccaccacttctagatattaagaatgtaattagttatggggatgtggtaatgtgttag

SEQ ID NO: 36089 - DNA, 201 bp, Homo sapiens
ttaaatttaaaaaaattacagctcatcatgtcactacagtgaacagtacaaattgtaagaagacaccacctgaagattgtgagggtccttttagacctgcmgaaatcctgaaagaaggaagtgttctagatattctgaaaagccctggtaagataattaaaagataagccttttgattacaaactcatgatctcaatttaa

SEQ ID NO: 36090 - DNA, 201 bp, Homo sapiens
gtgttatagagtagcctgcccccaccccagctgcctttcattaatccttttttttgagatggagtctcgctcagtcgcccaggctggagtgcagtgatgtratctcggctcactgcaacctctgcctcctgggttcaagcaattctccctccctcagcctctcaagtagctgggattacaggtgcctgccaccacgcctgg

SEQ ID NO: 36091 - DNA, 201 bp, Homo sapiens
ccacggtgcttggacctgaatctagtttcaataatctgaatttaacatccaaatctaagacattattggttgtattttataagcctatgccattcagcagygaagtttaccctatccaatcagtccaagtcctctagccatttaaagtacttttctagctgaagaattaaaaacctgctccctgggagaataagattccag

SEQ ID NO: 36092 - DNA, 201 bp, Homo sapiens
ttttttttttttttttgagacgagtctcgccctgtcacccaggctgaagtgcaatggtgcgatttcggctcactgcaacctccgcctgccaggttcaagcrattctcctgcctcagcctctggagtagcacgcaccattattcctggctaagtttttatatctttagtagggacggggtttcaccatgttggccaggctgg

SEQ ID NO: 36093 - DNA, 201 bp, Homo sapiens
aagatacttcaacaagaatgaagatgtatgcagctgttcaacagacacaagcgaggttccacgctggccagaaaataaagaggaccatctggtatatgccratgaggagagctctaatattactgatgggagaatcacacctgagccagcagtcagtaatacagaaggtaagtaaaatgtgaatattttgtcatgaatgat

SEQ ID NO: 36094 - DNA, 201 bp, Homo sapiens
gtagcagcatgatcttaactcactgcaacctccacctcctgggttcatatggcttataatttatcattctgtttctgtgcagtcacttgggaattcttcartccttaaaaccagtcagcttggagattctcctttttatcctggaaaaacaacatacggtggggcagcagctgctgtaagacagtctaaactacgaaatac

SEQ ID NO: 36095 - DNA, 201 bp, Homo sapiens
ctactttgtaattagctttcaaactcttgattgcaaaccaaaagtcaggaataaaccttttatattgtgagccatcacctgcacagcgtatatgtctatatgattgaaatctgttttgcaaaataatacttgcctctggtaggtgtaaggttccctggtattttctgttttattttattttaaaagagaagtgctggttgc

SEQ ID NO: 36096 - DNA, 201 bp, Homo sapiens
tctactttgtaattagctttcaaactcttgattgcaaaccaaaagtcaggaataaaccttttatattgtgagccatcacctgcacagcgtatatgtctatatgattgaaatctgttttgcaaaataatacttgcctctggtaggtgtaaggttccctggtattttctgttttattttattttaaaagagaagtgctggttg

SEQ ID NO: 36097 - DNA, 201 bp, Homo sapiens
tctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatgagatt

SEQ ID NO: 36098 - DNA, 201 bp, Homo sapiens
atctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatgagat

SEQ ID NO: 36099 - DNA, 201 bp, Homo sapiens
aatctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatgaga

SEQ ID NO: 36100 - DNA, 201 bp, Homo sapiens
gaatctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatgag

SEQ ID NO: 36101 - DNA, 201 bp, Homo sapiens
tgaatctgggaggtggagcttgcagtgagccgagatcatgccactgcactccagcctgggcgacagagcgagactccgtctcaaaaaaaaaaaaaaaaaaaaaaagataagccaagctgtgcaacctgtgggctgcatgtggcttaggatggctatgaatgaggctcaacacagatttgtgaattttctaaaacattatga

SEQ ID NO: 36102 - DNA, 201 bp, Homo sapiens
tggaccagaaaagggtctttatcctggtgaatattttagaatctatactaactcatggaggtaaaggcaaacattactattcttcattcaatcaatacttyctgatcacataccacatgtcaagcattaaatacagaggatacagcagtgaacaagttcctgccttcttggagcttatgttctaagttaggaagacaagga

SEQ ID NO: 36103 - DNA, 201 bp, Homo sapiens
aaaaagataaatttctaaaactgtcataatatgttttttctctcaacagggcattcttagcagggttacagaatctgttaagaatattgtgccagggtggytacaaagatacttcaacaagaatgaagatgtatgcagctgttcaacagacacaagcgaggttccacgctggccagaaaataaagaggaccatctggtata

SEQ ID NO: 36104 - DNA, 201 bp, Homo sapiens
taacaatacaaaaaattagccgggtgtggtggcgggtgcctgtagtcccagctactcgggaggctgaggcaggagaatggtgtgaatctgggaggtggagyttgcagtgagccgagatcatgccactgcactccagcctgggcgacagagcgagactccgtctcaaaaaaaaaaaaaaaaaaaaaaagataagccaagctg

SEQ ID NO: 36105 - DNA, 201 bp, Homo sapiens
tttttttgttttttgagacggagtctcgctctgtggcccaggctggagtgcagggtgtgatctctgctcactgcaagctccgcctcccgaattcatgccaytctcctgcctcagcctcccaagtagctgggactacaggcgcctgccaccacacctagctaattttttttttggtattttttatagagacggggtttcacc

SEQ ID NO: 36106 - DNA, 201 bp, Homo sapiens
gaggcaggagaattgcttgaacctgggaggtggaggttgcagtgaaccgagatcgaaccactgcactccagcctgggcgacagagcaagactctgtctttwaaaaaaaaagaaaggaaaagaaaaaaagaataaaagaatgtaaaactgtgagataatctaatagctcagaaagaatttaaacgtacccaccagatgtgtc

SEQ ID NO: 36107 - DNA, 201 bp, Homo sapiens
tttagtatgtggtaacagtggcttctcaatcattgaggaaaggatggcttatttaagagattaccttaggttataaacaggttaaccatttggaaaacagygaagccgaatcctttctttactcctgcatcataactaatttcagatgggagtcaagattagacatattgaaataaaagcaacagtatcaaaatacgggta

SEQ ID NO: 36108 - DNA, 201 bp, Homo sapiens
ctcagaagtagaattgtagactgaatccccatatactatttagccagcttcaacttttaccattttgacccatcttgtttctttttctttcttttttttttctgagacagagtctcgctctgtctcccaacctggagtgcagttgtgcaagctcgtttcactgcaagctccacctctcaggttcactccattttgcctcag

SEQ ID NO: 36109 - DNA, 201 bp, Homo sapiens
ttatagacacaaacctcaacaaaaatatttgtaaatggaatccaacaaatttaaaaaggaaactgcatcatgatcaagtggggtttatcctgggaaggcarggttgactcaacatatgaaaattaatgggattagaccaggtgtggtggctcatgcctgtaatcccagcactttggaaggccttagatcacctgaggtcag

SEQ ID NO: 36110 - DNA, 201 bp, Homo sapiens
aaattaaaattttcatgaaatctccccccactccccgtttttttttttttttttttaggaagttcagtacctacttcaagtagcagcactgtacctgtctstctgccttctggaggctctctaggattggaaaagttcaagaaacccgagggaagctgggactgtgaattgtgcctagtgcagaataaggcagactctacc

SEQ ID NO: 36111 - DNA, 201 bp, Homo sapiens
ctagtggtgcagctactcaattctttttttaattataatttttattttaagttccagggtacatgtgcaggatgtgcaggttacataggtaaacatgtggycatggtggtttgctgtacctatcaactcatcaggtattaagcccggcatgcgttagctatttttcctaatgctgtcccgcccccccacccaacgggcccc

SEQ ID NO: 36112 - DNA, 201 bp, Homo sapiens
gtttttgttttttgttttgtagttgatattcactgatggactccaaagaatcattaactcctggtagagaagaaaaccccagcagtgtgcttgctcaggaraggggagatgtgatggacttctataaaaccctaagaggaggagctactgtgaaggtttctgcgtcttcaccctcactggctgtcgcttctcaatcagact

SEQ ID NO: 36113 - DNA, 201 bp, Homo sapiens
tgttaaatatttgtcttaatatcaagcttttgcatatcggggccctcttttataagctttataagcaatcttttgttttctctgcttgctcaaagtagctrtgtttgttgtatctgttagtatttgctctataacaaacatactgggtgccttcccacttagatttggcaattatcactcctgtaaatgagatattacata

SEQ ID NO: 36114 - DNA, 201 bp, Homo sapiens
gcctagagtctggcaaggtgatgtgttgaatctagtgtctgcctgcatgccagcatccctttactgatgagatttgtggttttcatcacttcatggtaatyatcccaagttataagatggagtctctagaaaatcagtagagtatgaaggcccaagtaaaatacatgtgagtgcatgtatgtgtgcatacaaattacttct

SEQ ID NO: 36115 - DNA, 201 bp, Homo sapiens
ccccaacttttatgttaaaagttgcaacaaggtttaagggcttatgtttgataggccagatggtgaccagctgtgataaaacacagggaacccttgcaaargatttcaaaatttatgcagtagtccgccttatctgcagttttgctttccaaggtttcagttacccgcagtcaactgtgttctgaaaatattaagtgaaaa

SEQ ID NO: 36116 - DNA, 201 bp, Homo sapiens
tcagatagggattgcattgaacctgtagatcagtttggggaatattgccatcataacaattagtaggtcttccaacccatgaatacaagacttctttccayttctgtagatatttagtttctttcattaatattttgtagttttcaatataaaagtcttgtacttcgattaaatttattcttgaatattttgggttttgat

SEQ ID NO: 36117 - DNA, 201 bp, Homo sapiens; identical to SEQ ID NO: 9293

SEQ ID NO: 36118 - DNA, 201 bp, Homo sapiens; identical to SEQ ID NO: 9294

SEQ ID NO: 36119 - DNA, 201 bp, Homo sapiens
tattctttgaagattgtgggcaccctgaagtctctgtttgttagtttagtggtcacctaataattaacagagatttcattaaatgcctagaagcaaaataycttccagtctttgcccatggcctctgtgtatgcattagggcaggccttgaactcttacccagggagtttacaaccctgccttagcctttactaccagctt

SEQ ID NO: 36120 - DNA, 201 bp, Homo sapiens
caggggttatagaggtagctcagagagttgggtgcaagtagagaaatccacccggcttgcattacacatcttatttctagagaagctttcctttgaagaargagttctaaggtttaaaaaattaccttgaatgccacttatattgcattttaattttattttagagaaatcaatggaaagtagaaaaattaaggcactgat

SEQ ID NO: 36121 - DNA, 201 bp, Homo sapiens
gaattctttttaaatgtttgtagaattatttttcacttattaggtaaaacgtgtattttttgattttctccaatttcagctttctcatgttgctatgctcmattttgtataccatatatagttttgttaaattgacaaagtggtgttttttgttcttctttttcccattggttaaaatttaaagagaaagtggaagctaga

SEQ ID NO: 36122 - DNA, 201 bp, Homo sapiens
cgcaaaacatctgatggtttaaatatggcagtttcccctgtgctttctctctctcctgccaccatgtaagactttccttgcttcctctttgccttctgccrtgattgtatgtttcttgaggcctccccagctatgcagaactatgagtaaattaaacctcccttataaattacccagtctcagatattctttatagtagtg

SEQ ID NO: 36123 - DNA, 201 bp, Homo sapiens
aaaatatttctcccatcttaatagttttagaaagtaaaaatacttcttgaataaactgtgtagcgcagaccttcccattacagttcatttctatgtatttktttaaatacccacagctcgaaaaacaaagaaaaaaataaaaggaattcagcaggccactacaggagtctcacaagaaacctctgaaaatcctggtaacaa

SEQ ID NO: 36124 - DNA, 201 bp, Homo sapiens
cctcacagtgcttgcctttcattcaggtgccaggaaacgtctgcctgaatgaatgggtgtaatttacctgcacattttacatgcttctctaggtgtgtgawtaactcataatccatccatgactttcacccataatcctccttgtagcaattgctttgcttgcaacaaaactaagtagacatatctagctttatgcatggt

SEQ ID NO: 36125 - DNA, 201 bp, Homo sapiens
ttgtttaaatacccacagctcgaaaaacaaagaaaaaaataaaaggaattcagcaggccactacaggagtctcacaagaaacctctgaaaatcctggtaasaaaacaatagttcctgcaacgttaccacaactcacccctaccctggtgtcactgttggaggttattgaacctgaagtgttatatgcaggatatgatagct

SEQ ID NO: 36126 - DNA, 201 bp, Homo sapiens
tacagtaagacctattctctttctatatttatgggaaaattttaagttgtgcccttgtttcatgtgtgtttctatttaaagataccatacttaatatataytgttgattcattaacattgaactcatggctaacagcactataaatcatgtctgatcaaaacttatgatacatgtactttcttcgtaaggtacatcatagt

SEQ ID NO: 36127 - DNA, 201 bp, Homo sapiens
tgaggcaggggaatctcttcaacccaggaggcggaggttgcagtgagccaagattgtgccattggactccagcctgggcgacagagcgagactctgtctcaaaaaaaaaaaaaaaaaaaaaaaatcatctttaaagagataactaacccttccccagaaggcagggccaaagtctaaggttcttccaggtcctttgtattc

SEQ ID NO: 36128 - DNA, 201 bp, Homo sapiens
ctgttgataagaatctgtgtagacttttttctccttccttcctttgatctttgatcatgggaagacatggaaaaagaaagctaactacagtgattttgtcyactacactgttatttggttaaaaattttagtttcctaatgagtattagcatgtatgagaaattatgggagaaaaaggcgcatcctagaaaaggtgtgctt

SEQ ID NO: 36129 - DNA, 201 bp, Homo sapiens
aatagacaaatacagagaaacagccaagatcagcttactgggaaaagatgccactgaagccaggaagactatggcaatttgggaaaagatgccactgaagycaggaagactatggcaattttgatgaattgctggaggctgagtgaggactagcttcagagttaaaaactcccagggacccagtcttagtgggggtttcct

SEQ ID NO: 36130 - DNA, 201 bp, Homo sapiens
acagtgagaccctatctatctcaaaaaaaaaaaaaaaagaaaagaaaagaaaaagaaaatcctttaactgacttcatcttaaccttttagttcctaaggayggtctgaagagccaagagctatttgatgaaattagaatgacctacatcaaagagctaggaaaagccattgtcaagagggaaggaaactccagccagaact

SEQ ID NO: 36131 - DNA, 201 bp, Homo sapiens
tttggaacgtcctagagacttgttttgaatacttttgaccaaaatgctgatagtgacgtggacaatgaagtccaggctgaaatggtcccagagatgaggarcttattgggaactggagcaaaggttatttttgctatgctttagcaaaaagactggcagcattttacccctgccctagagaactgatgaactttgagatga

SEQ ID NO: 36132 - DNA, 201 bp, Homo sapiens
aaaatgcggaagtgactttggaactgggtaacaggcagtggttagaacagtttggagggctcagaagaaaactggaagatataggaaagtttggaacgtcstagagacttgttttgaatacttttgaccaaaatgctgatagtgacgtggacaatgaagtccaggctgaaatggtcccagagatgaggaacttattgggaa

SEQ ID NO: 36133 - DNA, 201 bp, Homo sapiens; identical to SEQ ID NO: 9287

SEQ ID NO: 36134 - DNA, 201 bp, Homo sapiens
aatagtgccaagtaatggtgaggttatacctgtattctgattataatctcataaatatttaccatgttagctgtctcagagttcttttgcaaaacagatamagatagaaagtataaataagaaaaataagtgaacatatactgaactttgtacaagatgctggcgatatggagagacccaagacatgggccctacctaaaa

SEQ ID NO: 36135 - DNA, 201 bp, Homo sapiens
aaatttgctgttctggtattaccaaaccacacatttgtaccgaattggcagtaaatgttagccatttacagcaatgccaaatatggagaaacatcataatwaaaaaatctgctttttcattatgtgactccaacatgcttttgtagaacttgtacagttccgattgtccaatctgatttttgtttactgaaagtagagtta

SEQ ID NO: 36136 - DNA, 201 bp, Homo sapiens; identical to SEQ ID NO: 9290

SEQ ID NO: 36137 - DNA, 201 bp, Homo sapiens
ttttccctgtctcagcaacccgagtagctaggattacaggtatgccaccatacccgctaatttttgtatttaatagaaacagggtttcgccatgttgacargctggacttgaactcctcacttgaactcctcacgtcaagtgatctgcctgctttagcctcccaaagtgctgggattacaggcatgagctaccgcgcctgg

SEQ ID NO: 36138 - DNA, 201 bp, Homo sapiens
tttaaaatgccacctaaaattgtttttatcagaatacttaaaaaaaaatcctcactttattctctgggggtgggaagaggcaattccttccttccaccacracattgaattatcacataaaattgtaaaattatgaatattatgattgagcttagtaaagcattttctaagttcatttatagtaaaacaagagaaacctta

SEQ ID NO: 36139 - DNA, 201 bp, Homo sapiens
gggagctgaaataaaagcatgtgttaaatataccatctttaaccagaactacatttgactggtcattttattttcaagctcacatacacttcaaacagagrtatggctaaaggaattatcatgtgaacaacagccagggctctgaacatcacagattatatcatcatacttgaaatatttgaaattttgattcaaaatgag

SEQ ID NO: 36140 - DNA, 201 bp, Homo sapiens
gagtcatggaaaatatacattgatgattcctgttgcataaagagttttcaagaaaattttgttgaattaagctataactacaaaaaaaaatccattacatrttgacctttagaaaggatttttaaaagcccatgctgtccttatttctgcagcttcagagagccgactgctcttattttcttctggcatattctattaata

SEQ ID NO: 36141 - DNA, 201 bp, Homo sapiens
aaattaatttttgcaatacttttatgaagatacaaactctgacaaagcttttaaaacaagtttgagagaatacagtattgatttcacttgtaaatctgacrattattttagaaaaaaggaaaatattatttactattattttgcttataaatgtttatcaattttaaagcttccacattgcacatctcccactacaacagt

SEQ ID NO: 36142 - DNA, 201 bp, Homo sapiens
tctggcatattctattaatacttgggttttgtatttttcaagtaaataaaatattcctattgagaatttcaattttaaaaaagaaaaggtctactaagtgytcctttccctgttgaattatgtgtgatcatttctatgctaaactagattagggtgtgacttgtgatggtgatttttgttcattttacatattaagaaaga

SEQ ID NO: 36143 - DNA, 201 bp, Homo sapiens
ggctccctgatgaaccacctgccacggcccgtatgaccgcatccaggggtgatgatgtcattttcacagggttattgagagctaaaactacgaagtactayaaactattatttaaaatataaatacatactatatatgcatatgtgtgtatatataattaatggggtaaacattacagaatactgtcctaacctttaaaca

SEQ ID NO: 36144 - DNA, 201 bp, Homo sapiens
ttcacattgacctttccaaggttatcagtgacctgcttgtccttaaattcagtgggcactttccagtaacctactgttggcaccagccctgtgctagacamcaggatcctgtttgtaaaggcatctgccagtggtttctgtgacacaattctgtttctagttttcctccttctacttctctagcctcttggcaagttcttc

SEQ ID NO: 36145 - DNA, 201 bp, Homo sapiens
caattactgatgtttataagtagatttattacaccaaagcacctagcaaattcttgaatggatcaggtcttatttttcagtcttactttgcaaatttaagycaaataattaaggatttgttaaatatttgtcttaatatcaagcttttgcatatcggggccctcttttataagctttataagcaatcttttgttttctctg

SEQ ID NO: 36146 - DNA, 201 bp, Homo sapiens
gagagaaaaattattcagatgttttcctttgtcaataatacaaggagcatttgtagggaaaaatatttacaaatacagtaagacctattctctttctatayttatgggaaaattttaagttgtgcccttgtttcatgtgtgtttctatttaaagataccatacttaatatatattgttgattcattaacattgaactcatg

SEQ ID NO: 36147 - DNA, 201 bp, Homo sapiens
gtcagagatgttgactagagttaatgcctcttttaggagaggtaccaggtaagtgttctcaaagaactggaaactgagaccaccacctctggcattatctrtttgtgaacacaagcaagtctgaatttttccgcaccatagctacctttcatgtaagcttcttttcttagaagaaaagaaggtaacatttgggtgtaattt

SEQ ID NO: 36148 - DNA, 201 bp, Homo sapiens
gtgatgcttagtggttaagttctgatttgtgttttcttgaagttattaaggaactttatgataacagtttatatattccctcttcttggcatagtaatgargtaatagagactattcacctctaagcctgattttttaaataagtgtttattttatgtttaagtaaggtaggtctgcttttggcttggacttgaatttggc

SEQ ID NO: 36149 - DNA, 201 bp, Homo sapiens
ttctaatctttctcgagtgaggaaaatgtcagcagatagtgaatatcactgagagagagatgatagcccaggttatcttccccagatagaaataagccttragactgacaggtgtatatgaatacagagagtatacataaagaagatgtattttcaattgtcagtctctaaatttgctttaagacttcgaaatggattgct

SEQ ID NO: 36150 - DNA, 201 bp, Homo sapiens
tctttctatatttatgggaaaattttaagttgtgcccttgtttcatgtgtgtttctatttaaagataccatacttaatatatattgttgattcattaacaytgaactcatggctaacagcactataaatcatgtctgatcaaaacttatgatacatgtactttcttcgtaaggtacatcatagtcttctcgtacatgggaa

SEQ ID NO: 36151 - DNA, 201 bp, Homo sapiens
tatcgagtattatgtactgtacacagttgtatttgctgtacttttctataactggtagcacggtaggtttgtttataccagcatcaccacaaacataagcatggtgttgtattacaatgcacagctgcagctaagtgataggactttttcagctccattataattttatgggaccatcactataaatgctgtccatcattg

SEQ ID NO: 36152 - DNA, 201 bp, Homo sapiens
cctactgaaaacttttttcagtcttaaattttttatctaactggctgtattgcagatgtctgctatataacttttatataattttaaaaactatttctttyctccttgatcttctaggggtaaggttaccaatgttttcattatttactaaatatagcagcccccaccccttattcatggaggataggttccaaaacccct

SEQ ID NO: 36153 - DNA, 201 bp, Homo sapiens
tcacacaaatgatacttatcccttggtgtttgatctaaatttctacaatgagaatgtgattttatagtctttactggggaaggaagtaggtttttcaggcygaaattcttgtgtagcaaaaattaacacttaagttagcccttggcaatctccagttctataatggtaaaatggatttcccagaaagtcactctctatccc

SEQ ID NO: 36154 - DNA, 201 bp, Homo sapiens
aatagcatggcacaccatagagggcatagggccacaggaacaagaggaaggtcacctaattctgtcttggaagtcaaggaagaagtaacattgaattttamatctataagctgagtaggaattagatagatgaaaaataagggcagagacatgatcagatttgtattttacaaagactaatcttacatggagagaccaatt

SEQ ID NO: 36155 - DNA, 201 bp, Homo sapiens
gggagctggggcgggggcttcccgcacgggcacccctcgccccacggccctctcctttctcaggacggaccacgagttcccttccccttggactgaggggraagctcctaacaggaacatctgtagggagttgaacgctggcattttaaagctgcctgtattttgttttatttgtaggggcaggggtcctatgaacgtgat

SEQ ID NO: 36156 - DNA, 201 bp, Homo sapiens
ccaagctggtctggaactcctgacctcaggtgatccacccgccttggcctcccaaagtgatgggattacaggcgtgagctaccgcgcccagtcagcatcattttttttttctcatcaacgttaaaacaatgttgaacaaaacattattcaaagacctgccgtatggctattttctagttgtgtgactttctttgggaaagt

SEQ ID NO: 36157 - DNA, 201 bp, Homo sapiens; identical to SEQ ID NO: 9296

SEQ ID NO: 36158 - DNA, 201 bp, Homo sapiens
ttctgagcttaaatgtcctcattcataaaatggggctagtaataatgcataaggtttttgtaagaattagaattaataaagtacttagaccataataactmattagtattagttgttgtctttgctattattttgatgtggtggttgtttggtttcacctgtgtactatcaggacatgctgaaataaaatttaagaattgg

SEQ ID NO: 36159 - DNA, 201 bp, Homo sapiens
aagtaaccagaaggaaagaaattttaattcttaaaatgtaatagtttcttggtttttttttttctgtgaaacacctgcatggcacctttttgttattcatmctgttttgactgtggctgtcgtagattcttgttgaaagtctgagagactgagacttgtcattttgaacatggcatcagtggaacagcttatgattcaata

SEQ ID NO: 36160 - DNA, 201 bp, Homo sapiens
ttgcttccaggccacaaacttacagcatgttactgtactgaacactgcaggcacctctaatacatcggtaagtatttatgtatctaaacatagaaaaggtmcaataaaaatacaatataaaagaggaaaaaaatagtacacctgtataggtgcttactgtgaatagggcttccaggattggaagttgctgtgagtcattga

SEQ ID NO: 36161 - DNA, 201 bp, Homo sapiens
ggacatttattatatgaagtctactgtagtgtaaactctgtagacttaggctacactaaatttatagaaaaattttcttcaataataaattaaccttagcstactgtaacttttttactttgtaaacttttaatttttttaacattttgactcctttttagtaacacttagcttaaaacacacacattgtacagctgtaaa

SEQ ID NO: 36162 - DNA, 201 bp, Homo sapiens
cccacccaaatcttatcttgaattgtaatccccatatattgagggagggacctggtgtgaggtgtttggatcatggaagtgatttcctccatgctgttctygtgatagtgtgggagatcgcaaaacatctgatggtttaaatatggcagtttcccctgtgctttctctctctcctgccaccatgtaagactttccttgctt

SEQ ID NO: 36163 - DNA, 201 bp, Homo sapiens
tattatcccagcaatttgggaggccaagatgggaggattgcttgaggcctggagtttgagaccagcctgagcaacataacgagaccccgtctctacaggaaaaaaaaaaaaaaaaaaaacgttatccaggcatcgcacctgtagtctcagctactcaggaagctaaagcaggagattcaggctgcaaagagctatgacaca

SEQ ID NO: 36164 - DNA, 201 bp, Homo sapiens
acttcagttttgtagacatttttcctaaggccaattatgaaatatcctttcacctagtcatgtgtatataaaatcaccatgttattacagaatttagtaayactgtttttaaaaagtatgattaatccattaaattagaataatgcacccttcatatattatggtactacagtgattcatgaaataattctatataattct

SEQ ID NO: 36165 - DNA, 201 bp, Homo sapiens; identical to SEQ ID NO: 9299

SEQ ID NO: 36166 - DNA, 201 bp, Homo sapiens
tctgctttttggacatttgtgtattttctttgaagaaatgtctttaacattctttgcccattttaaaattaggttgtctttttattgttgagttgtcggtktgtgtgtgtgtgtgtgtgtgtgtgtgtgtgtatctagaatatatgtgtatgtatatatgcagatatattctaaacactagacccttatgaaatatataat

SEQ ID NO: 36167 - DNA, 201 bp, Homo sapiens
aatgatgtttcccttgtagaataagttagggatgaggccctctttctagattgcttttttagaatagttttagtaggattagtaccagctcttctttgtayatctggtagaatttggctgtgaatccatctggtcaagggctttttttaattggtaggttttttattattgattcaatttcagaactcgttattggtctgt

SEQ ID NO: 36168 - DNA, 201 bp, Homo sapiens
ttcatggcagcccttcctatcacaggcctggaggtctaggaggaaaaaatggtttcgtgggccaggcccagggttgcgctgctctctgcagcctcaggacrtggtgccctgcatcccagctgctctagctccagctgtggctaaaaggggccaggagataatcttgggctgttgcttcagagggggtaagcctcaaacctt

SEQ ID NO: 36169 - DNA, 201 bp, Homo sapiens
cactaaaataacttcaggagtatgaataagtctactaaaaagtctacaggatccatgttgtagtttgagtagatggttccataccaagtcaaggtaaaagwtaatttatatataatatgaaaatggctgctttaggtttatagagtaatcaatataaatcttccttataaaagggaaatttcccacttataatttatgtaa

SEQ ID NO: 36170 - DNA, 201 bp, Homo sapiens
gcagattaatattataaatttgaatgtacaaaggaagctttagcagtaaaatagcaacttttatctgtcttacgtattggaggttctgcataagatttaattttttttttttttgaaatggagttttgctcttgttcacggggctggagtgcaatggtgtgatctcggctcaccacaacctctgcctcccgggtttaagtg

SEQ ID NO: 36171 - DNA, 201 bp, Homo sapiens
ggaggcggaggttgcagtgagccgagatggcaccattgcactccagcctgggtgacagagcaagactttgtctcaattaaaaaaaaaaaaaaaaaaaaaamcacaagagggtttgtgagtcttaaagtgtcagatgacagaagaaaactgtgtctacctagtatttaatttccattttctgttaggggtgcccttgttttg

SEQ ID NO: 36172 - DNA, 201 bp, Homo sapiens
gaggcaggagaatcacttgaacccgggaggcagaggttgcagtgagccgagatcacaccactgtactccagcttggcgacagagcaagactccgtcttggaaaaaaaaaaaaaaaaagaaacctgaaactagttataagttagagtttcatatccctgtttatataacaagttgtataattaacactgatctcagcattaa

SEQ ID NO: 36173 - DNA, 201 bp, Homo sapiens
cacttggctaattttttgtatttttagtagagacggggttttgccatattggccaggctggtcttgaactcctgacctcaagtgatccacccactttggcmtcccaaagtgctgggattacaggtgtgagccaccgcacccagccctccacccttttttcttagcccactatgtttccatactgctctggtgtctgtgaca

SEQ ID NO: 36174 - DNA, 201 bp, Homo sapiens
ttttgttttttgttttgtagttgatattcactgatggactccaaagaatcattaactcctggtagagaagaaaaccccagcagtgtgcttgctcaggagargggagatgtgatggacttctataaaaccctaagaggaggagctactgtgaaggtttctgcgtcttcaccctcactggctgtcgcttctcaatcagactcc

SEQ ID NO: 36175 - DNA, 201 bp, Homo sapiens
gcctccaagagagcatggtaaactaattagcatggttctatcatgattctgtttctattttgaactattaataaaaatttttgcaattctcagttaccccatttagtatagaacacaataagaatggaaccattctattctaacattgtacattgagatatcgttcccaccaccatatctgtcctccatagactatatggt

SEQ ID NO: 36176 - DNA, 201 bp, Homo sapiens
actaaaataacttcaggagtatgaataagtctactaaaaagtctacaggatccatgttgtagtttgagtagatggttccataccaagtcaaggtaaaagataatttatatataatatgaaaatggctgctttaggtttatagagtaatcaatataaatcttccttataaaagggaaatttcccacttataatttatgtaat

SEQ ID NO: 36177 - DNA, 201 bp, Homo sapiens
attgatctcattgctccttggcaattcccacagagatgatcttctgaagagtgttgcctcatacctttatttctcttaattcaggtttcaggaacttacayctggatgaccaaatgaccctactgcagtactcctggatgtttcttatggcatttgctctggggtggagatcatatagacaatcaagtgcaaacctgctgt

SEQ ID NO: 36178 - DNA, 201 bp, Homo sapiens
gagtacaaaaagaaattgaaacagctggtacagatatttggcattggagagcagctctgaacaaaggtgaattatagtctagtggtcaattttgtggcctrttctttacaaagaattgaacctgatacagttaaccatctaccccaaactattatttgtttaaaacacaatctattggctgggcgtggtggctcatgcctg

SEQ ID NO: 36179 - DNA, 201 bp, Homo sapiens
gcaccaacaaggcagtcactaggtataaaatgaataaaatagtgcctgtattcaagtagtttatctgctagttaggttgcagagtcagtcacaaaatagcrtggcacaccatagagggcatagggccacaggaacaagaggaaggtcacctaattctgtcttggaagtcaaggaagaagtaacattgaattttaaatctat

SEQ ID NO: 36180 - DNA, 201 bp, Homo sapiens
tgtcagatttataaccaaatattactgaaactaatttttttaagttcaaaaacccaatctagtagtttctctcttattttcaacttttattttagattctrggggtacatgtacaggtttgttactaagatacattgtgtgatgccggtgtttggagtatgattgaacctttcatctaggaagtaagcacagtacctaaca

SEQ ID NO: 36181 - DNA, 201 bp, Homo sapiens
ccacaaacttacagcatgttactgtactgaacactgcaggcacctctaatacatcggtaagtatttatgtatctaaacatagaaaaggtacaataaaaatmcaatataaaagaggaaaaaaatagtacacctgtataggtgcttactgtgaatagggcttccaggattggaagttgctgtgagtcattgagtagtgagtga

SEQ ID NO: 36182 - DNA, 201 bp, Homo sapiens
aggttgattctatgtctttgctattgtgagtagtactgcagtgaacatacacatgcatgcgtctttatggtagaatcatttatattcctctgggtatatacccagtgatgggattgctgggtcgaatggtagttctgttttaagttctttgagaaatcatcaaactgctttccacaatggctggattaatttacacttcca

SEQ ID NO: 36183 - DNA, 201 bp, Homo sapiens; identical to SEQ ID NO: 9295

SEQ ID NO: 36184 - DNA, 201 bp, Homo sapiens
gacacttcaaaagaaatgacctcattcttaattttgtttaaagaagaatataacatgatttgaatatatttagctaggatattttagtgcctgctagcacytgaagccagagttcactgtgagcattctgactatgaagtgagaagctaagagaactgtattttgatattcctttgacagttaaatcataacactgttctt

SEQ ID NO: 36185 - DNA, 201 bp, Homo sapiens; identical to SEQ ID NO: 9297

SEQ ID NO: 36186 - DNA, 201 bp, Homo sapiens
tacagggagtaataaataggatgtggaagatgggttagaattggcaaaatctctgcatgtaagtctgggttactaaatatagtgagagaaattcaaatctstctttaagaatcgaataaaatatttagaaataagttactgttgtatttgaggtgaacacaaatggcatttcaaagatgctcgagataccttgttggaaaa

SEQ ID NO: 36187 - DNA, 201 bp, Homo sapiens
atggcagaaacagagaggtatatgagctgcatagggatctctgttgataagaatctgtgtagacttttttctccttccttcctttgatctttgatcatggraagacatggaaaaagaaagctaactacagtgattttgtccactacactgttatttggttaaaaattttagtttcctaatgagtattagcatgtatgagaa

SEQ ID NO: 36188 - DNA, 201 bp, Homo sapiens; identical to SEQ ID NO: 9298

SEQ ID NO: 36189 - DNA, 201 bp, Homo sapiens
gaataatgcacccttcatatattatggtactacagtgattcatgaaataattctatataattctacatacaatcaaagaaatataaaatgtgttttgtacrgaagtgcttatttttcatctggggaattccagtgagattggtatattctaggccagataattttttcaaaatagaggacaacaaacatgagatgttccca

SEQ ID NO: 36190 - DNA, 201 bp, Homo sapiens
gcattgtacttttaaatgtggcatgctgaatgggagcaggggacatggctttttattctggaagatagaaactactcttctggtaacaaagaatttgattyggagttaactaaaaggttcatttaacaagctgcctcttactaatcggatcaggaagataatgtgactttagagcttatgatgttttccccccgtttttgt

SEQ ID NO: 36191 - DNA, 201 bp, Homo sapiens
acacctataatcccagcactttgggaggctgtgggcagatcacttgaggtcaggagttcgagaccagcctgaccaacatggcgaaaccccgactctactamaactataaaaagccgggtgtggtggtgcatgcctgttatcctagctactcgggaggctgaggcacaagaatcatttgaacctgggagatggaggttgcag

SEQ ID NO: 36192 - DNA, 201 bp, Homo sapiens; identical to SEQ ID NO: 9301

SEQ ID NO: 36193 - DNA, 201 bp, Homo sapiens
actatgcgatcaaaaagtttttagtctttcttcttaccatactggttcttggtattctgtttaccattcaatgtactattattgcttctgcttaaaactcrcatcccctaatgcaagcctgagcaaacagaactgataacacacagcctgagaagggagtgcttggggtctcaagacttattctgtttttctccatctttg

SEQ ID NO: 36194 - DNA, 201 bp, Homo sapiens
ttgagttaatgctggaaggagttaagacttccggggactattgagaatgcaagattgtgttttgaaatgtaagaacatgagatttaggaggggccgggggyagaataatatggcttggctgtgtgtccccacccaaatctcaatcacttgtaatccccacatgtcaggggaggggcctagtgggaggtgactgaatcacaa

SEQ ID NO: 36195 - DNA, 201 bp, Homo sapiens
aggtatatgaaaaatctctgtaccttcctcccaattttgctgtgaacttaaaactgctctaaaaaaagtcttttttaaaaaaagctctatgaactagttgstattataaaccttaggccatttcaagtaaaaattacatatcaatgtttattaaatactgagttaatagctgaatacctctttcatatacaaataagtaca

SEQ ID NO: 36196 - DNA, 201 bp, Homo sapiens
aataataattagggcaggcttgctgagcatttttaaactgcactgtttattgtcatgcatttgaatgattatcgcagactttatgaattttcattttatawtaatttgtaggccaggcacagtggctcacgtctgtaatcccggcactttgggaggccaaggcaggcgggtcactggaggtcaggagttcaacaccagcct

SEQ ID NO: 36197 - DNA, 201 bp, Homo sapiens
gtatatgaaaaatctctgtaccttcctcccaattttgctgtgaacttaaaactgctctaaaaaaagtcttttttaaaaaaagctctatgaactagttggtattataaaccttaggccatttcaagtaaaaattacatatcaatgtttattaaatactgagttaatagctgaatacctctttcatatacaaataagtacatt

SEQ ID NO: 36198 - DNA, 201 bp, Homo sapiens
ttgaacattactggtgtatagaaatgctactgatttttgtacattgattttaaatcctgaacctttaccaaagttgtttatcagctccaggagccttttgrcagagtcttcagggttttctaggtatagaatcataagtgaaaagagatcgtttgattatttattttcctatttggaagccttttatctctttctcttacc

SEQ ID NO: 36199 - DNA, 201 bp, Homo sapiens
tgcatagtataacccaagacatggccaactttttctgtaaagggccagatggtaaatgttgttagctttgcacagtctctgtcacagctactaaactctgyccttgtggcaggaacatagtcattgacggtactcaaatagaacaggcatggctgtgttccaataaaactttatttacaaatacaggctgcaagtaggatt

SEQ ID NO: 36200 - DNA, 201 bp, Homo sapiens
atcagaagacttctctgacacctctctatgtctaaaggtcctttgatattctcacatggcggcatgaatcacagtgtattttaactggccttttccttgtrtgtctcctacaatgagctgttgaagcttcatgaaaacacaatctgttttactcagggcagttataattccaattacaaagcacatttcctggctcctggc

SEQ ID NO: 36201 - DNA, 201 bp, Homo sapiens
taatgtgtaaaattaacccattgttaatatagaatgccgttatcactcctgattaagcggtcttcattttcatgttaatactgatgtcttgtaatgctttmtggaatcaaacattttcatacatattcattagtctaattctaatcataatccaatgaaaaagagcaggaaagatgctcaaggaggttatattcaagtcca

SEQ ID NO: 36202 - DNA, 201 bp, Homo sapiens; identical to SEQ ID NO: 9288

SEQ ID NO: 36203 - DNA, 201 bp, Homo sapiens
ttcttctgtcttgctactgccatctttctagtggtgcagctactcaattctttttttaattataatttttattttaagttccagggtacatgtgcaggatktgcaggttacataggtaaacatgtggccatggtggtttgctgtacctatcaactcatcaggtattaagcccggcatgcgttagctatttttcctaatgct

SEQ ID NO: 36204 - DNA, 201 bp, Homo sapiens
tgttgtagtttatagtttcattgggcattttcagtagttttatctgaagtcacatttcaaattttgtaattgaagctccaaagtatgctaccggaaacacragctgatgctgtgagacaaaatcaacaggtaatccaccatcacaactgtgggctagaatgctcaagaaaccttggaggcccagagagctgagatgaatac

SEQ ID NO: 36205 - DNA, 201 bp, Homo sapiens
ggccatagccccccacctcatctgatggtatcctctggcagccacagaccacacagttctttctacctaaattagtcattagcacatagtaggtacccagwaaatgtttgttgaattaatactgtttatatatttctaatttatctccaagtaaatccagtctccttaaggacaaggaacgttttcactataacacctagc

SEQ ID NO: 36206 - DNA, 201 bp, Homo sapiens
cgagcggctcctctgccagaggtaagaagcgaggcgggagggggccggggcgcgctcgctcccccgaggtgccgctgggaccggagacaactcgggggccrccgcgggagcctacaaacttttattagcctcggggagtgggggtggggggctggcaagggccgggcgacggtgacgaaagggcagcgcgcgggtgacagc

SEQ ID NO: 36207 - DNA, 201 bp, Homo sapiens
cagatgtaccactatgacatgaatacagcatccctttctcaacagcaggatcagaagcctatttttaatgtcattccaccaattcccgttggttccgaaarttggaataggtgccaaggatctggagatgacaacttgacttctctggggactctgaacttccctggtcgaacagttttttctaatggctattcaaggtaa

SEQ ID NO: 36208 - DNA, 201 bp, Homo sapiens
taccactatgacatgaatacagcatccctttctcaacagcaggatcagaagcctatttttaatgtcattccaccaattcccgttggttccgaaaattggartaggtgccaaggatctggagatgacaacttgacttctctggggactctgaacttccctggtcgaacagttttttctaatggctattcaaggtaagatcag

SEQ ID NO: 36209 - DNA, 201 bp, Homo sapiens
tcgtctgagacgcaccttgtcacgtttctgccgccaggaatcatgtaggaatgattccagtcgcttaaacctgagcccttttcctttcttctgtcttgctactgccatctttctagtggtgcagctactcaattctttttttaattataatttttattttaagttccagggtacatgtgcaggatgtgcaggttacatagg

SEQ ID NO: 36210 - DNA, 201 bp, Homo sapiens
tgagtaaatgcttataaagcattcagcgcattttctgcctcgtaataagaaggtcacaaatgatagctgcttctgctaccactattaatgctatcattatycttattatctggaggcagattgtggaggacttttggaggccaaacagagacactaagatttgaagaggtaggaagtagggagccaaggaatgttattaag

SEQ ID NO: 36211 - DNA, 201 bp, Homo sapiens
cagaggctggcacacagaaccactatgtatgtgtaagccattactgttaatgcgctgtctctacatcctcagtgctaggctgcctggaaacactatcctgygacttttggttgttgaagcctacaccaaatctaccttcccagtggaatgcatgcttgcccaccttgaaatccctgatgcagatcaccttgtccagggagc

SEQ ID NO: 36212 - DNA, 201 bp, Homo sapiens
gagtccaggagttcgagaccagcctggacaacatggcaagacgtcgtgtctacaaaaagtacaaaaatgagctggatgtggtggcgtgcatctgtggtccyagacacttgggaagctgagatggagggatcacttgagccccaggagttcgaggctgcagtgagctgtaatcacaccactgtacatcagctgggcgacaga

SEQ ID NO: 36213 - DNA, 201 bp, Homo sapiens; identical to SEQ ID NO: 9327

SEQ ID NO: 36214 - DNA, 201 bp, Homo sapiens
gggaggccgaggcaggcggatcacgatgtcaggagatcgagaccatcctggctaacacggtgaaactccatctctactaaaaatacaaaaaaaaatagccrggcgtggtggtgggtgcctgtagtcccagctactcgggaggctgaggcaggagaatggtgtgaacctgggaggcggagcttgcagagagccgagatcgtg

SEQ ID NO: 36215 - DNA, 201 bp, Homo sapiens
gctgagatgagaatcacttgaacccaggaggtggagattgcagtgagctgagattgtgccactacactccaacctgcatgacagagtgagactctgtctcaaaaaaaaaaaaaaagaaaagagaagaaaaagaaagtcatttcaggtgaggatcaggaacctggctggggagacaaggtggggagcaagaggcattattca

SEQ ID NO: 36216 - DNA, 201 bp, Homo sapiens
ggcaggcggatcacgatgtcaggagatcgagaccatcctggctaacacggtgaaactccatctctactaaaaatacaaaaaaaaatagccgggcgtggtgrtgggtgcctgtagtcccagctactcgggaggctgaggcaggagaatggtgtgaacctgggaggcggagcttgcagagagccgagatcgtgccactgcact

SEQ ID NO: 36217 - DNA, 201 bp, Homo sapiens; identical to SEQ ID NO: 9330

SEQ ID NO: 36218 - DNA, 201 bp, Homo sapiens
tactaaaaatacaaaaaaaaatagccgggcgtggtggtgggtgcctgtagtcccagctactcgggaggctgaggcaggagaatggtgtgaacctgggaggyggagcttgcagagagccgagatcgtgccactgcactccagcctgggcgacagagcgagactctgtctcaaaaacaaacaaacaaaaaaaaacaaacccac

SEQ ID NO: 36219 - DNA, 201 bp, Homo sapiens
gccgtggggtttcaaagcatctggggatgcagacacttccatcttcctcctgcttcctgccaggagtgcaaatcagacacatttcccaaatccaaaaacawaccaccgggaaagcagtgaatttacacggtggaatttgtctcacttgagaggggcagaaatagctgccctgcacggtggaaatgtcgaaggtcatataag

SEQ ID NO: 36220 - DNA, 201 bp, Homo sapiens
tgcccctacagtcactttcctgtgggggctgccctgctcacccaggaggggagaatcttcaaaggtaaaggtgggcaccccagggtcccccagcccagcarcctgggtggtgggtcagaggaagatgtacaggaagaggcgcagaggcacaggcagtggcaagagcgcggctctgtcccttcttcccccagtctccgctgg

SEQ ID NO: 36221 - DNA, 201 bp, Homo sapiens
ctgccaccatgccaggctaatttttgtatttttagtagacagggtttcaccatattggccaggctgatctcaaactcctgaccttgtgatccgcccgcttyggcctcccaaagtgctgggattataggcttgagccaccatgcccagcctcatcatgtgtttttataggccaggcttgtggcttctttggcgatccaattc

SEQ ID NO: 36222 - DNA, 201 bp, Homo sapiens
tatgggtatccatggcccatcaggctgactctgaagcccgtgctcctcacggctgcctctctgtctttgtggttctgtaagttggacaaaattattttcarccatggaggaaacataatggtactttggcatgtggatgctgcttgtaccgtgggagtttctgcttttggagttgtgttttgggagaaagggggttgtttt

SEQ ID NO: 36223 - DNA, 201 bp, Homo sapiens
gctgcctgcccggggtaccaacatggcccagaagcgtcctgcctgcaccctgaagcctgagtgtgtccagcagctgctggtttgctcccaggaggccaagmagtcagcctactgcccctacagtcactttcctgtgggggctgccctgctcacccaggaggggagaatcttcaaaggtaaaggtgggcaccccagggtccc

SEQ ID NO: 36224 - DNA, 201 bp, Homo sapiens
tgcccctgttccagcaacacaacgtgatacagactcctgtcctacaagatataacagaaaggcagcattgaaacataaagcggggggaacctgagccaggygcggtggctcacgcctgtaatcccagcactttgggaggccaagatgggcagatcacgaggtcaggagatcgaaaccatcctggctaacacagtgaaaccc

SEQ ID NO: 36225 - DNA, 201 bp, Homo sapiens
atgggcagatcacgaggtcaggagatcgaaaccatcctggctaacacagtgaaaccccgtctctactaaaaatacaaaaaaattagctgagcgtggtggcrgatgcttgtagtcccagctacttgggaggctgaggcaggagaatggtgtgaacctgggaggcagagcttgcagtgagccgagatggcgccactgcactcc

SEQ ID NO: 36226 - DNA, 201 bp, Homo sapiens
atctgtgaaatggaggagactggtctgttacagggtcttaagaaacgatttctgtaaagttcctgacacagggtatgtaatacattcaaactattatatakttttgttttgttttgttttgttttgttttgtttgagaacaagtctctctgtgccgcccaggctggagtgtagtggcaagatttcggctcactgcaacctc

SEQ ID NO: 36227 - DNA, 201 bp, Homo sapiens
ttctgagtaagtaaagcccgaggtgcactcaaggagaagggctccagtatccgatagccttccctgtcaccgaggtgtgtcctggcttccttaaggcttcyggaggaataaatgacggttggcgggcgcctgtagtcccagctacttgggaggctgaggcaggaacatggcgtgaacccgggaggtggagctcgcagtgag

SEQ ID NO: 36228 - DNA, 201 bp, Homo sapiens
gaagggtacattttattccaagaataaaggaaactgaagtgtacacttttttttttttgagacggagtctcactctgtcacccaggctggagtgcagtggyagagtctcagctcactgcaacctccgcctcctgggttcaagcaattctcctgcctcagcctcccgagtagctgggactacaggcgccagctaccatgccc

SEQ ID NO: 36229 - DNA, 201 bp, Homo sapiens
ggtaaggtgccaggtgctggggatatcacagtgaacagggatgacacaatccctgcccccatggcagtcccctcatattgcataggtgatgactgaaggckcgagcctcatccagtggaaggaaggaatggaggagataaacaggactgtggcccatttgcattgcagggaaagacctggtgtcaccagagaaagggttgt

SEQ ID NO: 36230 - DNA, 201 bp, Homo sapiens
atgctttccagcactggaactggtgttctgcttggaacagcaggaggtcagacagcctcatcgtgcctccagagccaggggacccccatgccagaatgctygggtcctttcttgttttaaaacccacaatagtcgggcatggtggctcacgcctgtaaccccagcactttgggaggccgaggcaggcggatcacgatgtca

SEQ ID NO: 36231 - DNA, 201 bp, Homo sapiens
gccatgttggccaggatggtctcgaactcctgacctcaggtgatccatccgcctcagcctcccaaagtgctgggattacaggcatgagccaccacgcccarcctgcacatactatttatttccttcgcctacgacacagagaaacccagggcttccgaatagcatctctgcctcttcatcacactgaacctatctcctcac

SEQ ID NO: 36232 - DNA, 201 bp, Homo sapiens
ctgtcacccagactggagtgcagtggcatgatctcggctcactgcaacctctacctcccaggttcaagcaattctctgcctcagcctcccaagtagcaggkattacaggcatctgccaccacgcccggctaatttttgtattcttagtagagacagggtttcaccatgttggccaggctggtcttgaactcctgactttgt

SEQ ID NO: 36233 - DNA, 201 bp, Homo sapiens
agcaactctcccatggccctaaccatgcctttgttacggcatttgtgtgaaattttatctccccctccagagggtaagctccaggaattgtccgattggtytttgttgctcctttcccatgcctgcctgacatagagaaggattttggtcgacatgtgtggaatgaagtgaaaaataacccccaaaaagcttaagaggccc

SEQ ID NO: 36234 - DNA, 201 bp, Homo sapiens
atttggggttcaaatcctgattctgccacttcactaactctgtggccttgggcaagtcgtttcacctttcatgatctacagcatgcaggtgataagagcgmctgcataccccggccccttacagggttgttgggggattaaatgaactaatccacttaaggtccttagcacagaggctggcacacagaaccactatgtatg

SEQ ID NO: 36235 - DNA, 201 bp, Homo sapiens
taccaaaggcagagtgtgtagatttggggttcaaatcctgattctgccacttcactaactctgtggccttgggcaagtcgtttcacctttcatgatctacmgcatgcaggtgataagagcgcctgcataccccggccccttacagggttgttgggggattaaatgaactaatccacttaaggtccttagcacagaggctgg

SEQ ID NO: 36236 - DNA, 201 bp, Homo sapiens
catttttccagcacccaactgctgtactctaggtattcagctcagtttccctgagcccaagatgcactcattatcgcactcatgatttgttaaattgagarcgtttgtggatttagaggatgaatgagaagtaccagctcccttgttaacatcagatgggtctgagcaacctcagagagaacccctctcaggtctttaagg

SEQ ID NO: 36237 - DNA, 201 bp, Homo sapiens
atcgacttttaaacaaaactaagtatcactagcaatgattagcaaatgtccttatttacacaaaacctgccatttttccagcacccaactgctgtactctrggtattcagctcagtttccctgagcccaagatgcactcattatcgcactcatgatttgttaaattgagagcgtttgtggatttagaggatgaatgagaag

SEQ ID NO: 36238 - DNA, 201 bp, Homo sapiens
aaagcccgaggtgcactcaaggagaagggctccagtatccgatagccttccctgtcaccgaggtgtgtcctggcttccttaaggcttccggaggaataaakgacgctgtgctgagaacattttgtgcagataggccaagatcaggatgtgaattgcactttatgaaaaaaaagagaaaaggagggaaataactcaatttca

SEQ ID NO: 36239 - DNA, 201 bp, Homo sapiens
catgcctgttggtctttagggacatctgggtgcataggtcacattctgtgaggtaattatctcttcactcatagtggagttaattcctgtggtagagctayagcacctttctggctaaaatacagaaagagagctacaccttttagcacctttctggctaaaatgcagaaatgcaggggtttagtgcaaggccagtgggga

SEQ ID NO: 36240 - DNA, 201 bp, Homo sapiens
tcccaggactttgggaggccaaggctgacagatcacatgaggccaggagtttgagaccagcctggccaacacagcaaaaccccatctctagtaaaaatagaaaaaaattacctgggcatggtggcacacacctgtaatcccaggctacttgggaggctgaggcacaagaattgcttgaacccaggaggcggaggttgaagt

SEQ ID NO: 36241 - DNA, 201 bp, Homo sapiens
ccactcaaatctcatcttgaattgtagctcccataattcccacatgtcatgggagggacctggtgggaggcaattgaatcatgggggcgggtctttcccaygctgttctcgtgatagtgaataagtctcatgagatctgatggttttataaatgggggttccctcacacaagtcctctcttgcctgttgccaggtaagaca

SEQ ID NO: 36242 - DNA, 201 bp, Homo sapiens
tggcaagatttcggctcactgcaacctccgcctcccaggttcaagcgattctcatgcttcagcctcctgagtaattgagactacaggtgccggccagcacrcctggctaatttttgaatttttagtagagacagggtttcaccacgttgaccaagctggtctcgaacttctggcctcaagtgatctgcccacctcggcctc

SEQ ID NO: 36243 - DNA, 201 bp, Homo sapiens
ggaatgttcctaccctgccgactgccccagaccgcgctcaaatgtggcttaaatccagggtctttcaatgcttagaggactgggatgaggaaggaagttgratgggaggcaggaaggggaggccataaatcaaaaacatcaacagtcctggggtgcaggcagggagagcgttcgtgctttcccagcctcggatatgtctgg

SEQ ID NO: 36244 - DNA, 201 bp, Homo sapiens
acatccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagag

SEQ ID NO: 36245 - DNA, 201 bp, Homo sapiens
aacctccgcctcccaggttcaagcgattctcatgcttcagcctcctgagtaattgagactacaggtgccggccagcacgcctggctaatttttgaattttyagtagagacagggtttcaccacgttgaccaagctggtctcgaacttctggcctcaagtgatctgcccacctcggcctcccaaagtgctgggattataggc

SEQ ID NO: 36246 - DNA, 201 bp, Homo sapiens
catccctttgctcttccttcctcttccgccatggttgtgaggcttccccagccatgtggaactgtgagtccattaaacctccttttttattttattttatttttttttttttttgagaccgagtctcgctctatggccaaggctggactgcagtggtgtgatcttggctcactgcaacctctgcctcccgggttccagaga

SEQ ID NO: 36247 - DNA, 201 bp, Homo sapiens
tgagaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcat

SEQ ID NO: 36248 - DNA, 201 bp, Homo sapiens
acacgtaggcagtgtcttacaccacacctgctgagtccaaaccatgggaggctcctctcctagaccctgcatcctgaaagctgcgtacctgagagcctgckgtctggctgcagggacacacccaaggggaggagctgcaatcgtgtctggggccccagcccaggctggccggagctcctgtttccgctgctctgctgcctg

SEQ ID NO: 36249 - DNA, 201 bp, Homo sapiens
cttcatcatggaggcattgggtaaattaagacagtgccaggttcttgggaagggccactaccatgggccaaagaatctaccagtgccccaggtcgaattgycctaattgccctgtccttctccccaccttgtttggagtaaccagttccttcctgctttggaatggggcaaacttcttactcaacacacgcaacaggaagt

SEQ ID NO: 36250 - DNA, 201 bp, Homo sapiens
gaccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctc

SEQ ID NO: 36251 - DNA, 201 bp, Homo sapiens
gcattgggtaaattaagacagtgccaggttcttgggaagggccactaccatgggccaaagaatctaccagtgccccaggtcgaattgccctaattgccctktccttctccccaccttgtttggagtaaccagttccttcctgctttggaatggggcaaacttcttactcaacacacgcaacaggaagtgtctctgccagac

SEQ ID NO: 36252 - DNA, 201 bp, Homo sapiens
ccgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcga

SEQ ID NO: 36253 - DNA, 201 bp, Homo sapiens
cgagtctcgctctatggccaaggctggactgcagtggtgtgatcttggctcactgcaacctctgcctcccgggttccagagattctcctgcctcaagccttctgagtagctgggattacatgtgcttgccaccacgcctggctaatttttgtatttttaggagagatgaagtttcaccatgttggccaggctcatctcgaa

SEQ ID NO: 36254 - DNA, 201 bp, Homo sapiens
tcactgctgcactcctagcaccaatgacagtgcccagcactgctcagtaaatatttgttggttgaaatgagacaatgcatataaaatgctttgcagaatgyctggcacattctaggcacacattatcttttttttttttattttattttatttttatttttatttatttatttttatttttttttgagatggagtcttgct

SEQ ID NO: 36255 - DNA, 201 bp, Homo sapiens
gcctgcaaagcaggtaaataagcaaggcaactctcatacaagggccagtatgcccctgttccagcaacacaacgtgatacagactcctgtcctacaagatwtaacagaaaggcagcattgaaacataaagcggggggaacctgagccaggtgcggtggctcacgcctgtaatcccagcactttgggaggccaagatgggca

SEQ ID NO: 36256 - DNA, 201 bp, Homo sapiens
tgctaacagcctgtgaaaggaaggtgattaatgctatccatttaacccctgcaaccctgaaaggcagagaaggaaacaggtttggaaagtttcagagctcraaatcacagagctgggattggaacccagacttcccctgactccaaaagctgttgctctgtggggagtgaaggatctctgagtaccgtgttgaaattcaga

SEQ ID NO: 36257 - DNA, 201 bp, Homo sapiens
tgcttagaggactgggatgaggaaggaagttggatgggaggcaggaaggggaggccataaatcaaaaacatcaacagtcctggggtgcaggcagggagagsgttcgtgctttcccagcctcggatatgtctggcaccttactgaggcttccacaacactaagtccacacctcctgcccactgacctaagtgttaatgctcg

SEQ ID NO: 36258 - DNA, 201 bp, Homo sapiens
cacctgctgagtccaaaccatgggaggctcctctcctagaccctgcatcctgaaagctgcgtacctgagagcctgcggtctggctgcagggacacacccarggggaggagctgcaatcgtgtctggggccccagcccaggctggccggagctcctgtttccgctgctctgctgcctgcccggggtaccaacatggcccaga

SEQ ID NO: 36259 - DNA, 201 bp, Homo sapiens
catcacctccaccttccagtctgtggaaggagaaaagaatggaagtaacaggcaagcaacctccttaccaaaagtatgatccagaaatttcccacatcacyttgggccacatcccattggccagaactgcatcatgtggccacactgtgctgcaagggagtctgggaattacagtccctagctgagcggccatgctggaat

SEQ ID NO: 36260 - DNA, 201 bp, Homo sapiens
accactgtgaccacattcaccctcaccctgacaagggacctgcagctgtggcacccagtagtgtctaatgacatccgtcaactctggacatgaatgcctgygatcctgagaacgagttaaatgactaatcactcctaacatgccaatgtaaataatgaagggaccagaaaatatgtgaggaaaaatatacaagaagataat

SEQ ID NO: 36261 - DNA, 201 bp, Homo sapiens
ttgagtagtggggcatgtgagtgtgccccctgccacaaccatctttctttctcattaactggcctattacatgttttacacaaagtaaaggaagatttctstctctgaggcctttctgaacttccagagcagacacatgtgaccatcctgagagactgggtcttctgcaagtgtggaaatgtgctttaacggcatgtcagc

SEQ ID NO: 36262 - DNA, 201 bp, Homo sapiens
gagatgacattccaccattgtgatttgttccttccccaccccaactaaccaatcgatcttgtgacattccacccccccaccaccgacaatgagtctcacgrtctccccaccctgcaccgtgtgacccccgcccctgcccacaagaaaacaaccccctttaactgtaattttccattacctacccaaatcctataaaactgc

SEQ ID NO: 36263 - DNA, 201 bp, Homo sapiens
gagctccctcatactgtgtgttccttctgcaattttttttttttttgagaaggattttcattcttgttgcccaggctggggtgctatggcacggtcttggstcactgcaacctttgcctcccggattcaagcgattcttctgcctcagcctcctgagtagctgggagctacaggcgcccaccaccaagcctgggtaatttt

SEQ ID NO: 36264 - DNA, 201 bp, Homo sapiens
gctccctcatactgtgtgttccttctgcaattttttttttttttgagaaggattttcattcttgttgcccaggctggggtgctatggcacggtcttggctyactgcaacctttgcctcccggattcaagcgattcttctgcctcagcctcctgagtagctgggagctacaggcgcccaccaccaagcctgggtaatttttg

SEQ ID NO: 36265 - DNA, 201 bp, Homo sapiens
taggctaatgcaggagacagatgataaacaaggagcaaaataaataaacaaacagtggcgtttctgagtcaagagggctatagaggaaaacaaaatgcagaaaaaaaaaaggagtccagtgacaaacgggcaaacaggggacactgcagattggggtcagcaaacaacagcccttgggccaaatccagcctgctgcttgta

SEQ ID NO: 36266 - DNA, 201 bp, Homo sapiens
aacttcttactcaacacacgcaacaggaagtgtctctgccagacataccactggactctgctctcttctcagggtgcaacatagaaaatgcctgctacccrctgggcatctgtgctgaacggaccgctatccagaaggccgtctcagaagggtacaaggatttcagggcaattgctatcgccaggtgagtgggaaagccag

SEQ ID NO: 36267 - DNA, 201 bp, Homo sapiens
ctctccatgtggggcctgcaggcaagtcatgagagaggtaagcagcttctcttgctgtctggaatgcaaatatcttccctgtcgcaggctatgggagccamgccaagttgcaggcatggcaggcatggcaggcgtggagacacagctactgtcctgtttgcttggttggctgacttctaaggcctccctacgcttgcatga

SEQ ID NO: 36268 - DNA, 201 bp, Homo sapiens
ttttataaaagtcctcttgatggaaggctgcaatttcttcaactctaaaaacaaaacggtaagccaggtatggtggctcagcctgtaatcccagcaattarggaggcagaggcaggaggatcgcttgggtccaggagttcgagacctgcctgggcaacatagcgagaccctgttctccacaaaaaaaaaaaaaaaggaata

SEQ ID NO: 36269 - DNA, 201 bp, Homo sapiens
aggagagatgaagtttcaccatgttggccaggctcatctcgaactcctgacctcaggagatccgcctgcctcggcctcccaaaagtgctgggagtacaggygtgcgccacaacacccggcctaaacctcttttctttataaattacccggtctcaagtatgtctttattagcagcttgagaacagactaatacactgagta

SEQ ID NO: 36270 - DNA, 201 bp, Homo sapiens
gaggcttccccagccatgtggaactgtgagtccattaaacctccttttttattttattttatttttttttttttttgagaccgagtctcgctctatggccmaggctggactgcagtggtgtgatcttggctcactgcaacctctgcctcccgggttccagagattctcctgcctcaagccttctgagtagctgggattaca

SEQ ID NO: 36271 - DNA, 201 bp, Homo sapiens
tttgccttttttttttttttgagctagaaaattcaaggaaattacttgaatttgttacaggctccaaatacagttattcctctgcgtcttaagcatctagmactgaagtggaaaattccactctttcaataatggttagccatcttagctcaggccatgctgtggtttgaaggtttgccccctccaaaatgcataagcgta

SEQ ID NO: 36272 - DNA, 201 bp, Homo sapiens
attgcacagcatttcaggatgcagtacgtgggcaaaggcttccttcctttttttttatttgccttttttttttttttgagctagaaaattcaaggaaattrcttgaatttgttacaggctccaaatacagttattcctctgcgtcttaagcatctagcactgaagtggaaaattccactctttcaataatggttagccatc

SEQ ID NO: 36273 - DNA, 201 bp, Homo sapiens
tcgtagtattatttggtcctatcttattattatggatttctaacttagcaccatcccaatctctctcatgtatgttttgaagtaagcaaaggcaatagcaraaacagaattggtttgcctggtcagaagacagcctgctttctgggctgagagaagcaaaacaaaattgcacagcatttcaggatgcagtacgtgggcaaa

SEQ ID NO: 36274 - DNA, 201 bp, Homo sapiens
agaaagaaagataaaagaaaagaaagaaagcaaagaaaatggtccacggaaacggagtcagctccgggccttgcacatggctgaggctcagccggtgttcrtgcagcgccgggtgggtgatgggcagggaagagaaggaccacctgtaaccctaggggcactgcacgaggtgtccctgggctcgtggggagtatgcatctg

SEQ ID NO: 36275 - DNA, 201 bp, Homo sapiens
gctggtctcgaacttctggcctcaagtgatctgcccacctcggcctcccaaagtgctgggattataggcatgagcaaccgcattcagcctcaaactattayattgttttaaagttatcattatttcttctgcaagctgcaaaactaccaaaggcagagtgtgtagatttggggttcaaatcctgattctgccacttcacta

SEQ ID NO: 36276 - DNA, 201 bp, Homo sapiens
gccgaccatttcctctgtgccaggctttgtgttaagtgctttacacgagtgatctcaatttattctcacaacaggactatgagggagattctatcattagygatttacaaatgaagccagtgagcctcaaagaggttcagtccctttccccaattctcagagccagttgggcaaagagtcccagggcagaatgaaacctaa

SEQ ID NO: 36277 - DNA, 201 bp, Homo sapiens
cacgcctgtaatcccagctattcgggaggctgaggcaggagaatcgcttgaacccaggaggtggaggtcgcagtgagccaagatcgtgccactgccctccrgcctggatgacagagcaagactccatctcaaaaaaaaaaaaaaaagactaaaataaaaaagactccttttatcctcttgttatctgggaagcttttccta

SEQ ID NO: 36278 - DNA, 201 bp, Homo sapiens
cgaccatttcctctgtgccaggctttgtgttaagtgctttacacgagtgatctcaatttattctcacaacaggactatgagggagattctatcattagcgwtttacaaatgaagccagtgagcctcaaagaggttcagtccctttccccaattctcagagccagttgggcaaagagtcccagggcagaatgaaacctaatg

SEQ ID NO: 36279 - DNA, 201 bp, Homo sapiens
cttccccttccagtagcgtggcaccaccttctgacccacccctcagtgtgtccaccagtgagagtggttcctaagggagagtgtgaagcacacgtaggcastgtcttacaccacacctgctgagtccaaaccatgggaggctcctctcctagaccctgcatcctgaaagctgcgtacctgagagcctgcggtctggctgca

SEQ ID NO: 36280 - DNA, 201 bp, Homo sapiens
tgctgagtccaaaccatgggaggctcctctcctagaccctgcatcctgaaagctgcgtacctgagagcctgcggtctggctgcagggacacacccaagggraggagctgcaatcgtgtctggggccccagcccaggctggccggagctcctgtttccgctgctctgctgcctgcccggggtaccaacatggcccagaagcg

SEQ ID NO: 36281 - DNA, 201 bp, Homo sapiens
atcatctcacagtctctgtggggcaggattctgggctgagccagcttctatggctcgaggtctcttacaaagtggcaatgaatatgtcaggaagggcttcrgtctcatcggaagatttgactgggggtggatccacttcaaagctcactcagtttctggcaggattcagttcactgtgggctgttgctgttactattcagt

SEQ ID NO: 36282 - DNA, 201 bp, Homo sapiens
aatcagcccttgattctttcgaaagcctccacatcctttccagatggcacagaaagggccctcctacaatcccccggcacccacactgacccctcctgccrtgcttatcacatggtgtcatcactgtccacttatgtatctgcctctcccttgggactttgtgctgcagagggcaggagctgtgtcttgaatctttgtgcc

SEQ ID NO: 36283 - DNA, 201 bp, Homo sapiens
aggatgtatggattcctataactaaaccgtgggaagacctggagtgtagccagacctcaggggcaactggcactggccagactcctttctttccatctctmttctctcatccattcttctgagtgtccatttcagcctctctcattggtctcttccataatgaatggaaacatggcggcccacactcagtgtctcaagaga

SEQ ID NO: 36284 - DNA, 201 bp, Homo sapiens
ccgtgcttatcacatggtgtcatcactgtccacttatgtatctgcctctcccttgggactttgtgctgcagagggcaggagctgtgtcttgaatctttgtrccattgactttctcgtgctgtgacgtagcacctgcctggctcagaacaggcactcaataactgttgagtgactgattggatgaatgaatgagatgagtac

SEQ ID NO: 36285 - DNA, 201 bp, Homo sapiens
tacaaaaagtacaaaaatgagctggatgtggtggcgtgcatctgtggtcccagacacttgggaagctgagatggagggatcacttgagccccaggagttcraggctgcagtgagctgtaatcacaccactgtacatcagctgggcgacagaatgagaccctgtctcaaaaaataaaaaacaaaataagaaataaagtaaag

SEQ ID NO: 36286 - DNA, 201 bp, Homo sapiens
agccaggcgtggtggcacatgcctagagtcccagctactcgggaggctgaggcagaaggatggcctgagccccggtggtggagattgcaatgagccgtgakcacgccactgcactccagcccagcccgggcaacagagcaagactctctcaaaaaaaaaaaaaaaaaaaaggccaggcacggtggctcatacctgtaatct

SEQ ID NO: 36287 - DNA, 201 bp, Homo sapiens
gcaacagagtgagactgtctcaaaaaagaaaaaggaattctagagccaccactggcacccacgctccatacagctgggtttggaatgagcgctgtcctcaygtatgaccacgtgcaggtaaagagctttgaaggtgccaagggccatgagtagcttgggaggtcatctaggttctcccagcactgtggagtcaaggagtcc

SEQ ID NO: 36288 - DNA, 201 bp, Homo sapiens
tgtggggcctgcaggcaagtcatgagagaggtaagcagcttctcttgctgtctggaatgcaaatatcttccctgtcgcaggctatgggagccacgccaagytgcaggcatggcaggcatggcaggcgtggagacacagctactgtcctgtttgcttggttggctgacttctaaggcctccctacgcttgcatgagtcactg

SEQ ID NO: 36289 - DNA, 201 bp, Homo sapiens
taagtccacacctcctgcccactgacctaagtgttaatgctcgtctttagatgaaactacggaggtctcgagaggtgacatgacttgcccaaggtcacacrgggcgctggtggtgaaaccctgggctggaggttccccaaagccctgctctcttccttccacccactgtgctcagtgctggccagggtggtgacgtgtttg

SEQ ID NO: 36290 - DNA, 201 bp, Homo sapiens
ccctttgctcttccttcctcttccgccatggttgtgaggcttccccagccatgtggaactgtgagtccattaaacctccttttttattttattttattttwttttttttttgagaccgagtctcgctctatggccaaggctggactgcagtggtgtgatcttggctcactgcaacctctgcctcccgggttccagagattc

SEQ ID NO: 36291 - DNA, 201 bp, Homo sapiens
ggtggtcggtggagaatcttggaggagaaaagccagctgggctttcggagtccagcagtgagcagcgccctgcggggcgggggcgggtaatggaacctgarcccatctgagtctgctctaatctgttcctaaactcttttctttgatttattgcttttgtagaaaagttcatgtgagcaaaaattcaagcttgtttttgct

SEQ ID NO: 36292 - DNA, 201 bp, Homo sapiens
tggaaagccaccacgtggccttctcagccttcaggacacagtggatctgtgaatcaggaactgcctgatggggtatgacccaaatcaggaacagaccgagwctcagggcctgaatcttagcaattgtcctcagtccttgggagagactaatttgagtttgattctttgcttccccagtgacatgcaagatgattttatctc

SEQ ID NO: 36293 - DNA, 201 bp, Homo sapiens
acagagaaacccagggcttccgaatagcatctctgcctcttcatcacactgaacctatctcctcacccttaaagtggccattctgacatcttgatgtcagscctctgagcccaagctaagcggtcttaacccctgtgacctgcacatatacatccagatggcctggagcaactgaagaaccacaagagatgacattccacc

SEQ ID NO: 36294 - DNA, 201 bp, Homo sapiens
agcccatctgagtctgctctaatctgttcctaaactcttttctttgatttattgcttttgtagaaaagttcatgtgagcaaaaattcaagcttgtttttgmtaagcttagaggcattctccttcagggcagtaggggacatggtgtggaggtaccccttggtattattccctgtctgttgaggttctgtcgggtgtgactt

SEQ ID NO: 36295 - DNA, 201 bp, Homo sapiens
ggtaagctccaggaattgtccgattggtctttgttgctcctttcccatgcctgcctgacatagagaaggattttggtcgacatgtgtggaatgaagtgaaraataacccccaaaaagcttaagaggccctggctgcaacagctgtcacccagtaattccaagagttcactcggcatcctgggcaggagtccccaccctctt

SEQ ID NO: 36296 - DNA, 201 bp, Homo sapiens
tctccccctccagagggtaagctccaggaattgtccgattggtctttgttgctcctttcccatgcctgcctgacatagagaaggattttggtcgacatgtstggaatgaagtgaaaaataacccccaaaaagcttaagaggccctggctgcaacagctgtcacccagtaattccaagagttcactcggcatcctgggcagg

SEQ ID NO: 36297 - DNA, 201 bp, Homo sapiens; identical to SEQ ID NO: 9339

SEQ ID NO: 36298 - DNA, 201 bp, Homo sapiens; identical to SEQ ID NO: 9340
  misc_feature (1)...(201): n = A,T,C or G, or insertion/deletion polymorphism (see Tables 1-2)

SEQ ID NO: 36299 - DNA, 201 bp, Homo sapiens; identical to SEQ ID NO: 9341

SEQ ID NO: 36300 - DNA, 201 bp, Homo sapiens
  misc_feature (1)...(201): n = A,T,C or G, or insertion/deletion polymorphism (see Tables 1-2)
accacaagtggtcacccctcactggcctcgctgtactactggactgctccagcccttcctggcccagagctagagatggcaccacccccgcactgtgcacncaataggtacagacactctcagccccaaacccctccagcctgttactgtgagactcacacatcctgttttcccaagcttgccccacagggtgagcaaact

SEQ ID NO: 36301 - DNA, 201 bp, Homo sapiens; identical to SEQ ID NO: 9342

SEQ ID NO: 36302 - DNA, 201 bp, Homo sapiens; identical to SEQ ID NO: 9343

SEQ ID NO: 36303 - DNA, 201 bp, Homo sapiens; identical to SEQ ID NO: 9344

SEQ ID NO: 36304 - DNA, 201 bp, Homo sapiens; identical to SEQ ID NO: 9345

SEQ ID NO: 36305 - DNA, 201 bp, Homo sapiens; identical to SEQ ID NO: 9346
  misc_feature (1)...(201): n = A,T,C or G, or insertion/deletion polymorphism (see Tables 1-2)

SEQ ID NO: 36306 - DNA, 201 bp, Homo sapiens
gcggtttcaccatgttggccaggctggtctcaaactcctgacctttgatctgtccaccttggccttccaaagtgctgggattacaggcgtgagccaccgcrcctggccaattctcaagaatcccctactaattccttgtaccatcttgtaataaagaagcagatccttggaccctgtgattctaattcagtatgtttgagc

SEQ ID NO: 36307 - DNA, 201 bp, Homo sapiens
gtagtgtgatctcagctcactgcaacctctgcctcctgggttcaagggattctcgtgcctcagcctccccagtagctgggattacaggcacacaccaccamacccagctaatttttgtatttttagtagagacgcggtttcaccatgttggccaggctggtctcaaactcctgacctttgatctgtccaccttggccttcc

SEQ ID NO: 36308 - DNA, 201 bp, Homo sapiens
cttcaaccccaccccatttcactttcccaagagcaagttagtaacagggacagggcttacatccaggccttctgactcagcctagaattccatccattccrtcgatctgctgccaaagaatgttactgattgggcaataattatttacttggtgtgtgggcaccactgttttttaaatgagtgttttcatttgtatcaaac

SEQ ID NO: 36309 - DNA, 201 bp, Homo sapiens
tccaatcagctcattggtatttggggctactcagcatagagggtagagactgcctgccttttctctcctggtcccacctcagctgaccctctgtcagctcraatcagctggaagagccagagttaagaggcctactcaggaagggccctatggacattgtgcccactaggcagcatggggcttactaaggcctggaatgtc

SEQ ID NO: 36310 - DNA, 201 bp, Homo sapiens
ggcgtgagccaccgcgcccagccccacactcttaagtttaactcccagtagtcactgaactaacctctgtctctcctgacattcatcagtcttcctcatcycaccccaacctctacccttggggcaatccaaggcttgatgtttactagataatacttttctcttttggtgtttaccacatcctgtgagtctgttaaggca

SEQ ID NO: 36311 - DNA, 201 bp, Homo sapiens
taacctctgtctctcctgacattcatcagtcttcctcatcccaccccaacctctacccttggggcaatccaaggcttgatgtttactagataatacttttytcttttggtgtttaccacatcctgtgagtctgttaaggcaagaatgactgtcctcatttgtaaaaggagagacttaaggtaaagtgatttgcccaaggtc

SEQ ID NO: 36312 - DNA, 201 bp, Homo sapiens
gggggacatccttctactgggagaagtccaccttggtccttcttcaccaacttgaagcaaagcttcctgctgaatggaacctgtcccctcaagcaaaagtstctatgggaaaccctattggtaccagtggtgtaaaggcaggagcagagctagggtaggaaacccgcagatgtggattgggtctggacatgtaggcaaaag

SEQ ID NO: 36313 - DNA, 201 bp, Homo sapiens
ttcctgctgaatggaacctgtcccctcaagcaaaagtgtctatgggaaaccctattggtaccagtggtgtaaaggcaggagcagagctagggtaggaaacmcgcagatgtggattgggtctggacatgtaggcaaaagtgcttggaccaagatctgttgacttattttactactaacagggtcaggtgcccacctcacctg

SEQ ID NO: 36314 - DNA, 201 bp, Homo sapiens
ctagctgggggatggacaagattatcctgggtgactacctcccaaggctgcttggtctagagggagggggacttatacaatcatctgttttctggagaaasagaagtcctgagggggttgcgtatcctgactaggatggtatcttggcttgtctggccagggagtgaagatatggttggtcagaaagggcaaaatactgaa

SEQ ID NO: 36315 - DNA, 201 bp, Homo sapiens
ctggtcttgggctaggcagggatggtgtcttggggcacttggcctagttagatagtggagaactggactgacatgtgtgaagaatttggggttctggggcyccttgggagttgagtcagagttgcctcattcctcttcttgggttctgtctcccgtttgcttctagactttcccattctttggtgtagctcctgcaatcct

SEQ ID NO: 36316 - DNA, 201 bp, Homo sapiens
ctgggactataggtgcatgacaccacactcagctaaaattttttttttttttttttgagacagagtttcattcttgttgcccaggctggagtacagtggcrcaatcttggcccactgcaacttccgcctcccagattcaagtgattctcctgcctcagcctcccgagtagctggcattacaagcatgcactaccacaccca

SEQ ID NO: 36317 - DNA, 201 bp, Homo sapiens
acaggcatgagccaagagatcttcccatctcatctttctgagtggctgggactataggtgcatgacaccacactcagctaaaattttttttttttttttttgagacagagtttcattcttgttgcccaggctggagtacagtggcacaatcttggcccactgcaacttccgcctcccagattcaagtgattctcctgcctc

SEQ ID NO: 36318 - DNA, 201 bp, Homo sapiens
ccacctaggaggcctgtggtaggagaaacaggctgcccacgtaccacatccagtgagtagaggccagcaaaggtggcgcggaggcgggccacagcctcagrctggccagggagcaacatctccagcatgcccggcctgcttagctcctgctgcaccttcttagtcccagccagctgggtggcaatgtctgggcacttggca

SEQ ID NO: 36319 - DNA, 201 bp, Homo sapiens
ggctgtgaggactgccagcacgctgtcacctctcaacgttatcacatttttttctttctttctttctttccttctttctttctttctttctttctctttcyttccttccttccttccttccttccttccttccttccttcctttctctttcttttctttcttttttgtttttttttgagatggagtcttgctcttgtcgcc

SEQ ID NO: 36320 - DNA, 201 bp, Homo sapiens
gaggttctccacttccccaccagactcaggagcccagctggcttcacccagtggatcccgcactggggctgcaggtggagctgcctgccagtcctgcgccrtgtgcctgcactcctcagcccttgggtggccgatgggactgggtgccgtgagcagggggcggtgctcgtcgggggggctcgggccgcacaggagcccacg

SEQ ID NO: 36321 - DNA, 201 bp, Homo sapiens
gacccaaagagtgagcagcagcaagatttattgcaaagagcaaaagaacaaagcttccacagtgtggaaggggacctgagcgggttaccactgctggctgrggcagcctgcttttattctcttatctggccccacccacatcctgctgattggtagagccaagtggtctgttttgacagggtgccgattggtgcgtttaca

SEQ ID NO: 36322 - DNA, 201 bp, Homo sapiens
ggagtgcaacagcgcaatcttggctcactgcaacttctacctcctgggctcaagtgatcctccctcctcagcctcccaagtagctgggactacaggtgcaygccaacacacccagctaatttttgtattatttgtagagatggggttttgccatgttgcccaggctggtcttgaactcctgagctcatgcaatccacctac

SEQ ID NO: 36323 - DNA, 201 bp, Homo sapiens
ggacccaaagagtgagcagcagcaagatttattgcaaagagcaaaagaacaaagcttccacagtgtggaaggggacctgagcgggttaccactgctggctsgggcagcctgcttttattctcttatctggccccacccacatcctgctgattggtagagccaagtggtctgttttgacagggtgccgattggtgcgtttac

SEQ ID NO: 36324 - DNA, 201 bp, Homo sapiens
gcaacagcgcaatcttggctcactgcaacttctacctcctgggctcaagtgatcctccctcctcagcctcccaagtagctgggactacaggtgcacgccamcacacccagctaatttttgtattatttgtagagatggggttttgccatgttgcccaggctggtcttgaactcctgagctcatgcaatccacctacctagg

SEQ ID NO: 36325 - DNA, 201 bp, Homo sapiens
tgatcaataataatagcagggttgggggtagcaatctatcagatactgttcaggtaaaggctttccaagaaggtgacatttcagctcagaattgaaggatrggaagggaccagccaagggttcctcctcagcctgaggccaggtgagaggagttctggggtagagatgggggtaggatggcagggtggttggagtactcag

SEQ ID NO: 36326 - DNA, 201 bp, Homo sapiens
ttcggatgtgttcggagtttcttccttctggtgggtttgtggtctcgctggctcaggagtgaacctgcagaccttcacagtgagtgttacagctcataaargcagtgtggacccaaagagtgagcagcagcaagatttattgcaaagagcaaaagaacaaagcttccacagtgtggaaggggacctgagcgggttaccact

SEQ ID NO: 36327 - DNA, 201 bp, Homo sapiens
taaaaagatatcctgtctgccattaaggaactcataatccagtgagggaaacagatgtctacataggactctagtgctagaaaaaaataagtgcccaagtkttgtctttagaaataaacaggctgggcgtggtggctcacgcctgcaatcctagcactttgggaggccaaggcgggcggatcacttgaggtcaagagcctg

SEQ ID NO: 36328 - DNA, 201 bp, Homo sapiens
aattgtgtaacctgaaacaaatgacttagcttctatgaattttatttcttatgaaatgaaatgagggggtgataatctgtaaggttacttccattgttacrgttctaattgcttctctttcctccaaattttttttttttttttttttttttttgagatagagtcttgttctgttgcctaggctggagtacagtggtgcaa

SEQ ID NO: 36329 - DNA, 201 bp, Homo sapiens
acccatcaaccctgaggcctggctatggtaccaccgggtggtaggtgcccagcgctgccccatcgtggacaccttctggcaaacagagacagtgagtgaarggtacagaaggctggggcccagggacaatgtgggaagattgactcaaatttctcatctctgacttccccagggtggccacatgttgactccccttcctgg

SEQ ID NO: 36330 - DNA, 201 bp, Homo sapiens
gtgaacctaggaagcacagcttgcagtgagccgagactgcggcactgcactccagcctgggtaacagagcaagactccgtctcaaaaaaaaaaaaaaaaaagagttctgatatcctagagggcttgggattttgcagtaggccaataccctgcccctcacctttcccaaccagccaggggccccagcctggtgtgtatgtc

SEQ ID NO: 36331 - DNA, 201 bp, Homo sapiens
aatactgaacctgagggaatggtagggggatgaatagaaggactattaggaaagactgggaatgaccagccttcatgggtcagtttgaggggattcccacrtatccggacgtgaaccgcctgtggagcattgtggacaaatacaaggtgaccaagttctacacagcacccacagccatccgtctgctcatgaagtttggag

SEQ ID NO: 36332 - DNA, 201 bp, Homo sapiens
ggggcaggcgggggggtggggctctggagaagtaggttgggcctagatgatggagggtcttaaataacaaactaaggagcttagaaggtttgtgtcatagrtccatattagttattcagtttcttctaggaccctggcttagagatcctgaaagttccatgagcaacccctttcttcattcactcaatccctggggctttc

SEQ ID NO: 36333 - DNA, 201 bp, Homo sapiens
cttaaggcacagattggatccctcttgctgcagtctctgacttggtttctcctatcctgtcctctgtggctagagaaagccctcttctgggtgatcacagyggttccttaggatctccccttcaacattccttcatcgttagttggttcttcccagaaggtaagcccaatcccttctactgcagtccctagcatcctctcc

SEQ ID NO: 36334 - DNA, 201 bp, Homo sapiens
  misc_feature (1)...(201): n = A,T,C or G, or insertion/deletion polymorphism (see Tables 1-2)
ggccaatggtgccaccagtgttttggtgagaagggagccacctggcctagctgggggatggacaagattatcctgggtgactacctcccaaggctgcttgntctagagggagggggacttatacaatcatctgttttctggagaaagagaagtcctgagggggttgcgtatcctgactaggatggtatcttggcttgtctg

SEQ ID NO: 36335 - DNA, 201 bp, Homo sapiens
taatggaaattacgcggtataagactgaacgagttactacgatgtcaagttgttttatttatttttttaacttgggctgggattgtattagtaatagttcmgaagttctgatagatggttccatgtctgttaaaatgtatgaggaaaatcggccaggagcagtggctcacgcctgtaatcccagcactttgggaggccgag

SEQ ID NO: 36336 - DNA, 201 bp, Homo sapiens
gttgggatttgaaccaagacagtttgactgcagaatccatatcctaatagcaatgctattcctcttccatgaccccacagaatgcatttcaccaaattccrtcaaatacagaatttctaccagggaagcagcctcctaatttgtcctctcttgcctagtttcgccaacttgagtctttccagtagatttatcaagacacca

SEQ ID NO: 36337 - DNA, 201 bp, Homo sapiens
tatgcctactattatcacttgaaaatatttttgagtatttgtactctcgttattagctgcgtggtccttggcagagtttcctgtgcttcctgagcttcagytttctcatctataaaattaggataattaatgtatactttgtaagaccataatgtcataaagattaaatgagattagtccagtccctgatacatgaatggc

SEQ ID NO: 36338 - DNA, 201 bp, Homo sapiens
atggcacttcctttcccttgacaaggacacctgctgagtacagcagaggtggagtcagcacttgtggaacatgaggctgttgcagaggcagctgtggtggsccaccctcatcctgtgaagggtgaatgcctctactgctttgtcaccttgtgtgatggccacaccttcagccccaagctcaccgaggagctcaagaagcag

SEQ ID NO: 36339 - DNA, 201 bp, Homo sapiens
gcgcctgtagttccagctactggtgggggagggggtacagctgagatggggggatcacttgagccagggagatggaggttacagtgagctgagatcatgcyactgcactccagcctgggtgacaaagagcgagacaccgagctaaaaaaataataataatagaaattaaaaaaaaaaagttttatggctcttgtcatgcat

SEQ ID NO: 36340 - DNA, 201 bp, Homo sapiens
ggttgcagtgagccaagatcacaccactgccctccagcctgggtgacagagcaagactctgtctcaaaaaacaataaaagtaataataataattgcttacygtttttctttttgtactatttaagcctttatcatatatttaatattttccaatctcactatcatatgaaatcctccttttcctcccaaagttctccctct

SEQ ID NO: 36341 - DNA, 201 bp, Homo sapiens
aagctaagtgatttgcctaagggtcatacacctgtttgaagacagaactgagactaatctccagatactctcactcctagtcaactattttttttcactcrtgacactacctcattattctagtagtccagcacttggctgtgacagataaaaagagaaattagccacattagccaaactgatttaaattaactttaaaat

SEQ ID NO: 36342 - DNA, 201 bp, Homo sapiens; identical to SEQ ID NO: 9357

SEQ ID NO: 36343 - DNA, 201 bp, Homo sapiens
ttatgagtgtgctatgagtgctcatgtgtgagtgatgtgggtggctctgaaataccatctgagggtgctggtatgaatgatggcctgatagacatatgtgkcatcaggagtgtgataaaggagatgagatgggagcatggagaaaaggagatggaagggagatggatgctgtgaaaagggtgctggcagggctggaatccc

SEQ ID NO: 36344 - DNA, 201 bp, Homo sapiens
ggaggttatagtccagcttgaggagacagacaataaacatagaaaccagtaagtatatgacaggtagtgatgagtactatagaaaaatatagagcagagtsaggggaaagggaagtgacagtgcagagtgggagctgataaggaaagaaccttttgataaatatgacatttgagcagagatctgaaggaaagtatggagtg

SEQ ID NO: 36345 - DNA, 201 bp, Homo sapiens
tctgcctcccaggttcaagagattctcatgtgcagcctcccaagtagctgcgactacaggtgcgtgccaccatgcccggctaaatttttttttttttttttagtagagatggggtttggccatgttggccaggctggtgtcgaacttctgacctcaggtgatcctcccaccttggcctcccaaaatgttgggattacaggc

SEQ ID NO: 36346 - DNA, 201 bp, Homo sapiens
cagccgggagggggcgcctctcccagccctcggccgtgtcccggtctgactcgcccccgtctgctcagcgctatcagcctgcagctggcacacaggtgcgygtagatggacagccaggaaggcagcgcagggtcgaggggagagcgcggggcaagcgagacttcagtggctctgcactttacgcagctcagggaccaaacc

SEQ ID NO: 36347 - DNA, 201 bp, Homo sapiens
cctcgggcagccgcgggaagctggtgatgctcatgtagtccactggcgagtaggcgcccagggcgctctcctggctggcctcgttctccgccgccatcctygcccgcgccccccagcagcgcagcgcctgccggaagtggctgcggcgggggagtgggagggcggagggcggggcctgatcttcgcgacagccgggagggg

SEQ ID NO: 36348 - DNA, 201 bp, Homo sapiens
  misc_feature (1)...(201): n = A,T,C or G, or insertion/deletion polymorphism (see Tables 1-2)
cagaattctggggagacattgccaaggaattttactggaagactccatgccctggcccattccttcggtacaactttgatgtgactaaagggaaaatcttnattgagtggatgaaaggagcaactaccaacatctgctacaatgtactggatcgaaatgtccatgagaaaaagcttggagataaagttgctttttactggt

SEQ ID NO: 36349 - DNA, 201 bp, Homo sapiens
gaagggaccagccaagggttcctcctcagcctgaggccaggtgagaggagttctggggtagagatgggggtaggatggcagggtggttggagtactcagtwagcttgggttctgctcctgttctttctgttccattccatccttgaagggccttctctcccttcctgtactcctacctgcctgtcccacctcattccctcc

SEQ ID NO: 36350 - DNA, 201 bp, Homo sapiens
gaaggtttggaatgaaggggctgaggaaggagtctgttcctcttgcctgagggttgtttgtggctggtagcataaatactcaaagctaatgggagatacawgggaaatacctgttgttgggaacagtctttctccacttgaatcaggtgagcagattgtggaggtgagctggaggatttcatgtttaaggtggatttctaa

SEQ ID NO: 36351 - DNA, 201 bp, Homo sapiens
tgcctgagggttgtttgtggctggtagcataaatactcaaagctaatgggagatacaagggaaatacctgttgttgggaacagtctttctccacttgaatsaggtgagcagattgtggaggtgagctggaggatttcatgtttaaggtggatttctaacctgcttctctcatttctccctgagttttatgacccttgacac

SEQ ID NO: 36352 - DNA, 201 bp, Homo sapiens
agtattccagctatggtctgacttgaacagggtactattaccattctttcactttacatatctaagattatattagcctcattgacagccacactctccastcagtttataatctctcataatacttaagattttccttttctttctctctttctctctccttttcctttttcctctttctcctttcatttccttcccttt

SEQ ID NO: 36353 - DNA, 201 bp, Homo sapiens
cctcctgggttcaagcaattctcctgcttcagcctcctgagtagctgggattacaggcacacaccaccatgcccagctaatttttttttttttttttttgkatttttagtggagacgtggttttgccatgttggccaggctggtctcaacttcctgacctcaggtgagcttcctgcctcagcctcccaaagtgctgggatc

SEQ ID NO: 36354 - DNA, 201 bp, Homo sapiens
  misc_feature (1)...(201): n = A,T,C or G, or insertion/deletion polymorphism (see Tables 1-2)
gggttcgaatcctagctctgcctcttctgtgacctcagataagttatttaacacctctgaatctacattttctaatttgtaaaatagggttaaagtggtgnctctggccgggcacggtggctcacacctgtaatcctagcactttgggaggctgaggtgggcggatcacctgaggccaggagtgcaagaccagcctggcca

SEQ ID NO: 36355 - DNA, 201 bp, Homo sapiens
ttctgagctgcttttgaggatggttacttgaggtgtcctccaaactgccacatatagtgagttagagaatctgccaggcacagtggctcatgcctgtaatyccagaactttgggagactgaggagggaggatcactgaactcaggagtttgagatcagcctgggcaacacaggtagaccccatctctataaaaaattttaa

SEQ ID NO: 36356 - DNA, 201 bp, Homo sapiens
ctgcaaatttagctcatataatttatagaagacatctaccatacaacctgttttgcatagccagttatcacccaacataatcagccaaatcagatctactktgttagaaattgcctaacttctttcttaagataaatatgttaatatatgactctgtgataactgtttcacttctgagttgtaattctaagagatataagg

SEQ ID NO: 36357 - DNA, 201 bp, Homo sapiens
  misc_feature (1)...(201): n = A,T,C or G, or insertion/deletion polymorphism (see Tables 1-2)
tgcaaaggtgtacaactttcaattttagaaaattttcatcacccccaaaagaagtgcaatactcattagcagtcatttttcattttcccccaacttcttcncctccagctctaggcaaccactaatctactttctgtctctaaggctctgccttattctggatgtttcatataaatggaatcatataacacgtggcccttt

SEQ ID NO: 36358 - DNA, 201 bp, Homo sapiens
gtgtgaagtgggatctgattgttattttgatttgtatctccttgaccatgcctgaccttttttttttttttttttttttgagactgagtctcgctctgtcrcccaggctggagtgcagtggcacaattttggctgattacgacctctgcctcccaggttcaagagattctcatgtgcagcctcccaagtagctgcgactac

SEQ ID NO: 36359 - DNA, 201 bp, Homo sapiens
tttccttatgctaattctgaatttggaaacaataccccccttttggaggccatgtcatttaggaggagaaggccctgaactagacatttagactcaagaaytgtgctatccaacatggaagccactagctacatgtaactattgatatttatagtaattaaaattaagtaaaataaataatccagttcttccgccacattt

SEQ ID NO: 36360 - DNA, 201 bp, Homo sapiens
aagtaggttgggcctagatgatggagggtcttaaataacaaactaaggagcttagaaggtttgtgtcataggtccatattagttattcagtttcttctagraccctggcttagagatcctgaaagttccatgagcaacccctttcttcattcactcaatccctggggctttcttctctccctcagactttcttcccttccc

SEQ ID NO: 36361 - DNA, 201 bp, Homo sapiens
gaggctgaggtgggagaatcatttgagcccgagagtttaagaccagcctgggcaacatagtgagacattgtctcaaaaaaaaaaaaaaaaaaaaaagttgkggggtagcaccagtcttccctgtcattagtcaattaccagtctttcaattattcaaccatgaccctcgaatacctattgtgccaattgtgcttggaggag

SEQ ID NO: 36362 - DNA, 201 bp, Homo sapiens
ctctggaggctgaggtgggagaatcatttgagcccgagagtttaagaccagcctgggcaacatagtgagacattgtctcaaaaaaaaaaaaaaaaaaaaaagttggggggtagcaccagtcttccctgtcattagtcaattaccagtctttcaattattcaaccatgaccctcgaatacctattgtgccaattgtgcttgg

SEQ ID NO: 36363 - DNA, 201 bp, Homo sapiens
gaacccaggagacagaggttgcagtgagccgagatcaagccaatgtactccagcctgggcaacagagcaagactccatcaaaaaaaaaaaaaaaaaaaaaagcctgaaaagaattatgggccaaactgcaaagagctacttacacaaatagttcacagaaaggaaaaagccttatagggaggcaggataatataaagatta

SEQ ID NO: 36364 - DNA, 201 bp, Homo sapiens
ctgttttttaaatgagtgttttcatttgtatcaaactggacctgctttcctcaaggattgcccaaaaggagacacaaatttactaaacacttatcaataayagaacaccgtgctaggcaatttccatatactattaatttaatcctcacaataactttggaagacagaaagtattttctctgatttacagatgaggatcct

SEQ ID NO: 36365 - DNA, 201 bp, Homo sapiens
cagaggcagctgtggtgggccaccctcatcctgtgaagggtgaatgcctctactgctttgtcaccttgtgtgatggccacaccttcagccccaagctcacygaggagctcaagaagcagagtaaggagcctccctgggcagggactatagggtctgtcttggaggcccagttatcactgcaagttgttggggaggggctag

SEQ ID NO: 36366 - DNA, 201 bp, Homo sapiens
ctccaaggcagaaatgcacccccttcctcaccaaataattaacagagacaagggagaagaagggagagatccaagaagatggggatgaattaaggagatgsagctggaggtggatgcttgacacagaagaaggaagaccggggacttcccaaggcagggcagggacggggtcagcgggcctcaccggtgtcggggtctccc

SEQ ID NO: 36367 - DNA, 201 bp, Homo sapiens
gatagagataaatgctgttaagaaaaataaacagggtagcatgatagtgtgtgcagggatggctactgtacacaggatcgtcggagaagacttctctgaaktgacatttgagcagaggcctgaagggtgagaaggaaacaggcatgggaaaatctagagtaagagtgttttgtgcagagggacacagcttgagatgtctga

SEQ ID NO: 36368 - DNA, 201 bp, Homo sapiens
tgtgcagagggacacagcttgagatgtctgaagaatggactgaagcctgtgtggctggagcgtagcaagcaaagggaagaatattacatgacgttggagaygtacataatacagggagggtcttgtgggccatggtgaggagtttgaattttattcaaaggacagtgggaaaccttttttttgttgttgttgttgttgttt

SEQ ID NO: 36369 - DNA, 201 bp, Homo sapiens
acagggagggtcttgtgggccatggtgaggagtttgaattttattcaaaggacagtgggaaaccttttttttgttgttgttgttgttgtttgtttttttttgagacagaatctcactctgtcacccaggctggagtgcggtggcacgacctcagctcactgcaacctccacctcccgggttcaagcaattctcctgcctca

SEQ ID NO: 36370 - DNA, 201 bp, Homo sapiens
cgtagcaagcaaagggaagaatattacatgacgttggagatgtacataatacagggagggtcttgtgggccatggtgaggagtttgaattttattcaaagkacagtgggaaaccttttttttgttgttgttgttgttgtttgtttttttttgagacagaatctcactctgtcacccaggctggagtgcggtggcacgacct

SEQ ID NO: 36371 - DNA, 201 bp, Homo sapiens
tattacatgacgttggagatgtacataatacagggagggtcttgtgggccatggtgaggagtttgaattttattcaaaggacagtgggaaacctttttttkgttgttgttgttgttgtttgtttttttttgagacagaatctcactctgtcacccaggctggagtgcggtggcacgacctcagctcactgcaacctccacc

SEQ ID NO: 36372 - DNA, 201 bp, Homo sapiens
agatgtgaagagaggtagtctaattctaaatggattttgaatcaataatgggttaaagtaaatttcgagagtgtgagaatgaagtagttggagaagactcyttggaggaggttccctaggggaagaagatgagaaggactagtgactgtgtaccatgggttgtcacaccaaccatatggcctccaggtgaaggaaaagtag

SEQ ID NO: 36373 - DNA, 201 bp, Homo sapiens
tgccgaggacccactcttcatcctgtacaccagtggctccacaggcaaacccaaggcaagtgtgtgtgtgtgtgtgtgtgtgtgtgtgtgtgtgtgtgtgkattatgtaggggtaagaagtaagtttctgaggaaacaagtaatgaaattatttttttcctacaaccctgagttttggaaatgtagcattgtcttttctaa

SEQ ID NO: 36374 - DNA, 201 bp, Homo sapiens
gccaagcatagctaatagcctctttggatctcagagttaagagactaaattggatgttcttttaagagttctgatatcctggccgggcgcggtggctcacrcctgtaatcccagcactttgggaggccgaggcgggtggatcacaaggtcaagagattgagaccatcctggctaacacggtgaaaccccgtctctactaaa

SEQ ID NO: 36375 - DNA, 201 bp, Homo sapiens
atgccgaggacccactcttcatcctgtacaccagtggctccacaggcaaacccaaggcaagtgtgtgtgtgtgtgtgtgtgtgtgtgtgtgtgtgtgtgtgtattatgtaggggtaagaagtaagtttctgaggaaacaagtaatgaaattatttttttcctacaaccctgagttttggaaatgtagcattgtcttttcta

SEQ ID NO: 36376 - DNA, 201 bp, Homo sapiens
  misc_feature (1)...(201): n = A,T,C or G, or insertion/deletion polymorphism (see Tables 1-2)
tctccaggggtttcccagtaagatgctgcattgtggtcaagcacctggggcgggcagagctcggcatgggtgactccaccagccagtcccccccaattaanaggtcatgcccagatgtgcaggtgagtctggcactgctatgcctttctccaggctcaaattccttcacttttcctgcctagaaaattcttgatgtccttc

SEQ ID NO: 36377 - DNA, 201 bp, Homo sapiens
  misc_feature (1)...(201): n = A,T,C or G, or insertion/deletion polymorphism (see Tables 1-2)
tcttattgttaccttcatgctaaagatgatgaaactgagactcatggaagttaaatcacttgcccaaggccacactgctagaaaggtggcatttaaactcnagcaggctcattctacagcctgagttccataagataaaatgagagagtaaagagacaagtgtgttgagagcaagagaagcagtgaacctgaggctgtctc

SEQ ID NO: 36378 - DNA, 201 bp, Homo sapiens
aattcaaacttcttactattgcctacaaggctctacgtgatttggctgctgcctacctctcattcttacccaacttcttgctcactgaaatctagccataytgtctttctttctttctttgaaaaggtctcagtgccttttcacttgatgctccttttccccagaatactcttcccaagaattagtatgattgcctacctc

SEQ ID NO: 36379 - DNA, 201 bp, Homo sapiens
tgttccagttctcagagggaatgctttaaaataattttttaatttccatcttgatttcatttttgacccaatgctcattcaggatcagattatttaatttscatgtatttgcatggttttgaaggttccttttggagttgctttccagttttattccactgtggcctgagagagtgtttgatgtaatttcaattttcttaa

SEQ ID NO: 36380 - DNA, 201 bp, Homo sapiens; identical to SEQ ID NO: 9391

SEQ ID NO: 36381 - DNA, 201 bp, Homo sapiens
aaacttgtataattatgaaatttttaaaaggttaaagcctttgttatttattttaattcaaatccagtatattattatacatattcggagcccaaactatkcatcttcatctaaaccttcaattaaattccacaatgcaaacctcttggctctagaatcacgtttcttgtttattcaactgagcctgtgtcttgaaaaagt

SEQ ID NO: 36382 - DNA, 201 bp, Homo sapiens
ggaggctgaagatagggctccaatcccttctagcttgtagggtttctgctgataattctgctgttaatctgataggttttcctttataggttacctggtgmttctgactcacagctcttaacattctttccttcatcttaactttggataacctgatgacaatgtgcttaggtgaagatctttttgcaatgaatttcccag

SEQ ID NO: 36383 - DNA, 201 bp, Homo sapiens
ccttattatttagtttttctttctttttttagctaaactaatgtaaaattatatctaatgacagcaagctttcctttctttcgacatagtgaaaacttgtrtaattatgaaatttttaaaaggttaaagcctttgttatttattttaattcaaatccagtatattattatacatattcggagcccaaactattcatcttca

SEQ ID NO: 36384 - DNA, 201 bp, Homo sapiens; identical to SEQ ID NO: 9393
  misc_feature (1)...(201): n = A,T,C or G, or insertion/deletion polymorphism (see Tables 1-2)

SEQ ID NO: 36385 - DNA, 201 bp, Homo sapiens; identical to SEQ ID NO: 9395

SEQ ID NO: 36386 - DNA, 201 bp, Homo sapiens
ccacgttctgacatcaccttggtcgtgacagtgattggctgttggaaggcaaagaagagtttatagccagcaagagcaagtgaatgagtgagtgagagggmagaggaaatactcaatctgtgccactcactgccttgagcctgcttcctcactccaggactgccagagggtaagatttaatagaacaacttcattatcata

SEQ ID NO: 36387 - DNA, 201 bp, Homo sapiens; identical to SEQ ID NO: 9396

SEQ ID NO: 36388 - DNA, 201 bp, Homo sapiens
tttgggtacagtctagaatgatataataaaaacaaacactgtagcacattgagctctggtatttttgctaactcacagacaaaagtggacagttttatcasttgttgaccaattccatcagtgataaggtcactggctgtcctattacagctgattcaatactgtcagatagctgtttacatgtggcactgcagagtcctt

SEQ ID NO: 36389 - DNA, 201 bp, Homo sapiens
aaaacagacgtactcaggtaaactctcaccatccgtgtatgagggttccggttgctccacattctcaccaacacttgcttctttcagtcttgttagccaawctagtgagttgataatatctttgtaagcgcaaattagtgctatttttctatccaataaaatttgtgaagcctcatacccatcaacagtaacctattttcc

SEQ ID NO: 36390 - DNA, 201 bp, Homo sapiens
aaaagatgggctccttcaggagcaaagcctgtttattcccaaggggccatcaagaacttttactaagataggactgtgagaaactgtctgggcaccaaaayccaaagactcactctgacacacaaaaagagtgtgacttaggacccaagacagtatctccaggacttagtgtcagatactcagtaaggatgcaataaatct

SEQ ID NO: 36391 - DNA, 201 bp, Homo sapiens
acctaaaagtgaaatttcggagtcgaaatctactgaggcatatatattcaaccttagtagatggcaaccagctttccaaaacagacgtactcaggtaaacyctcaccatccgtgtatgagggttccggttgctccacattctcaccaacacttgcttctttcagtcttgttagccaatctagtgagttgataatatctttg

SEQ ID NO: 36392 - DNA, 201 bp, Homo sapiens
  misc_feature (1)...(201): n = A,T,C or G, or insertion/deletion polymorphism (see Tables 1-2)
tcaaagcattatttagaccaccccgatagaaatcagtgctgcttaaaaagatgggctccttcaggagcaaagcctgtttattcccaaggggccatcaagancttttactaagataggactgtgagaaactgtctgggcaccaaaacccaaagactcactctgacacacaaaaagagtgtgacttaggacccaagacagtat

SEQ ID NO: 36393 - DNA, 201 bp, Homo sapiens
ttaatagattgactttggcctgtttttgtatattatgaatgtaggatcatacatgatttactctttgtgtgtcacttcttcactctcaaatttagagattyatccatgttgttctgtagttgtagatcatttattctcattgttagtatttcattacgtgaatgtaccaaaatgtgttattcttctgttgatgggcactta

SEQ ID NO: 36394 - DNA, 201 bp, Homo sapiens
cttggtcgtgacagtgattggctgttggaaggcaaagaagagtttatagccagcaagagcaagtgaatgagtgagtgagagggcagaggaaatactcaatstgtgccactcactgccttgagcctgcttcctcactccaggactgccagagggtaagatttaatagaacaacttcattatcataaaattagacactccata

SEQ ID NO: 36395 - DNA, 201 bp, Homo sapiens
tcgtttgttgttgtggtggttgaggactgaggaagactaggacttctttggggactctgatgaaatcaagtacacacaaaattttgccaaggatctctgamcatttaaggtcttcccagaacgtgtctgcagacacctcatgaccataggttaaaatccctgctttggggaagagccatgctactcagttttatatctctt

SEQ ID NO: 36396 - DNA, 201 bp, Homo sapiens
acttcacatgtataaattaacctcattttaggaactggctttaatcaaatttaaagatactaaaaattatatgcaaattaaatgctattaaattaagtgcyaatttaaattcaacaggagagctcactatgtaagagaatcatctataacaacttttatagtaagctgaatgatttctttcatgttttctaaataaaattt

SEQ ID NO: 36397 - DNA, 201 bp, Homo sapiens
gaaatcgtccaaatataatactctattcaccctctgggctagggaaggcacaaccattaaggtcatggcagtggaagaacaggtttaattattctcttttycacctgaggttattcctggctcgaggtgacaagcattccctttccttgggtggatgatgtggccatctgaagaatgagccagcagggacagtcccacagg

SEQ ID NO: 36398 - DNA, 201 bp, Homo sapiens
ataattatggggaatttgtgtggccacaaaaatatgagcatgaatgaaacaagagttgtgggttttcagaattgtattcccttctttggttcacctcagayccataaataaacagtgctcatttgaaagtttgctttgttctcttttttaaactaaatggaaatgataataaattcaagtctctgactagctcctaaactt

SEQ ID NO: 36399 - DNA, 201 bp, Homo sapiens
agtattgtgttgcatgaaatgatggccttaaattttacatttttcacagctagatttgggttctttcaaacgtttccttacaggctggggatataacaaayaaagctacaaaagagaaggaaagtgatgaagaagaagaggaggaagaggaaggaaatgaaaacgaagaaagcgaagcagaagtggatgaaaacgaacaag

SEQ ID NO: 36400 - DNA, 201 bp, Homo sapiens
gtgagaaaaacaaaccatcccttaaatttgtaaacaaaaaggaaaataactaaaaaaaaaataagagtttccaattttgccgggttacctgtgaagagtgmctttgaaaaccagagggtgtggtgttgattttaaatatacaacaaaccaggattgcactatttttagtaccatacagtttgggttcaggacaccaattat

SEQ ID NO: 36401 - DNA, 201 bp, Homo sapiens
  misc_feature (1)...(201): n = A,T,C or G, or insertion/deletion polymorphism (see Tables 1-2)
tatatacaaaatcttaatttattctcattcaacactgaacttgttagagggatattactctacacaacctcccaaataattaaatgaataagtcataaganttttacttcacatgtataaattaacctcattttaggaactggctttaatcaaatttaaagatactaaaaattatatgcaaattaaatgctattaaattaa

SEQ ID NO: 36402 - DNA, 201 bp, Homo sapiens
actgggctatggagaggacgccacgcctggcacagggtatacagggttagctgcaatccagcttcccaagaaggtaacaatggaattattcctccaaaatraaattattaccattaataataatggtaatgttcaatcttttttaaactttttaactggagtctaagggtatcctaacactacacacatagtattttatac

SEQ ID NO: 36403 - DNA, 201 bp, Homo sapiens
gggaggctgagacaggagaatcgcttgaacccaggaggcagaggttgcagtgagccaagatcacaccactgcactccagcctggcaacagagcatgactctgtgcaaaaacaaaacaaaacaaaaacaaaaaaccttcatgcaataatatatcactaagaatttcttagagtgtttagtttcttctttgtgcagaaaaaaa

SEQ ID NO: 36404 - DNA, 201 bp, Homo sapiens; identical to SEQ ID NO: 9398

SEQ ID NO: 36405 - DNA, 201 bp, Homo sapiens; identical to SEQ ID NO: 9399

SEQ ID NO: 36406 - DNA, 201 bp, Homo sapiens
ggaggctgagacaggagaatcgcttgaacccaggaggcagaggttgcagtgagccaagatcacaccactgcactccagcctggcaacagagcatgactctgtgcaaaaacaaaacaaaacaaaaacaaaaaaccttcatgcaataatatatcactaagaatttcttagagtgtttagtttcttctttgtgcagaaaaaaaa

SEQ ID NO: 36407 - DNA, 201 bp, Homo sapiens; identical to SEQ ID NO: 9401

SEQ ID NO: 36408 - DNA, 201 bp, Homo sapiens; identical to SEQ ID NO: 9400

SEQ ID NO: 36409 - DNA, 201 bp, Homo sapiens
acacccagctaatttttttatttttggtagagacagggttttatcatgctggccatgctggtctcgaactcctgaactcaagcgatccccctgccttggcstcccaaagtgctgggattacaggcatgagccactgtgcctggcttcaatcaatttagaagtttattttgccaaggttaaggacatgctggcgagaaaaaa

SEQ ID NO: 36410 - DNA, 201 bp, Homo sapiens
  misc_feature (1)...(201): n = A,T,C or G, or insertion/deletion polymorphism (see Tables 1-2)
ttccaacctctcctactgcctctcccacatctgccctccaaggtccatccaccttgtgtgggccactagcttcctgacctctgcccctttttttggtgctnccgtcaccacctagaatgcccagtcttttatagctgaaggtcaaagtcttgctcaagcttccagcccagcaaaagctactttctccaagaagctttcctc

SEQ ID NO: 36411 - DNA, 201 bp, Homo sapiens
  misc_feature (1)...(201): n = A,T,C or G, or insertion/deletion polymorphism (see Tables 1-2)
catggaatctttaaggccctccctgatctgattccaacctctcctactgcctctcccacatctgccctccaaggtccatccaccttgtgtgggccactagnttcctgacctctgcccctttttttggtgctaccgtcaccacctagaatgcccagtcttttatagctgaaggtcaaagtcttgctcaagcttccagcccag

SEQ ID NO: 36412 - DNA, 201 bp, Homo sapiens
acaacgttatttaattctagctaagtactctggactggtggaggaagtatggaccctctttggtttattgagaaaagtcataagtgggtgacagagaagarttgaagacagaaatgcgccaagctgaaacattctccttggcataaccagaaacacccagaggacttggcaaggcaggaagcttcccacagtgccattcag

SEQ ID NO: 36413 - DNA, 201 bp, Homo sapiens
gtggaggttgcagtgagctgagatcacgccactgcactccagcctgggtgacagaatgaaactccatctcaaaaaaaaaaagaacaaatgaacaaaagagwaaggattaggcctctaaatgccattttttccaggaggacagagtaccttcctactcacggggctttggcatacagcattcattcattaattcattcactc

SEQ ID NO: 36414 - DNA, 201 bp, Homo sapiens
tggcaggaacagggaggcttccaggaggcagcgagtctgaaggagctataggaattagctggatggatagaaatgacaggacaagcagcatcctttgatcrtggggacagagacaggtcctgccaaggtggcctaggccatccctcaggactactgtagcctccacccctcttgctggttatacccctcctccacctaaac

SEQ ID NO: 36415 - DNA, 201 bp, Homo sapiens
ccagaggctccctacccccagccacaggaggctgtgactctggacagggtttggggctgggcatgagcagagctgaagaggccgtcctctctgcctttctyggggagggtgtgcaggagaggctccagaggcttccagtggaggatgcttcattcagtcaacaagcatttattgagcacccactgtgttccaggcagtgtg

SEQ ID NO: 36416 - DNA, 201 bp, Homo sapiens
tgagttcctcttcacaccagtggtggtcgcctgcatgtccatcatggccttgctgctgctgctgctcctgctgctattgtacaagtataagcaggtgagcyggagcggagtggggctgccaggtgcctgagtgagccagatttggatggtacccccaggctgcatggattcacccttcctcctcctcagtcagtccatcag

SEQ ID NO: 36417 - DNA, 201 bp, Homo sapiens
gccacctgtgtcatgggaagtagccaccacaggttttatggccatctcttgtttctctactccttttccccttcattcaacaaatatttgaacacctaccrtgttctgggagtgtggagggcaaagatgggcagctcataatctggtggagatatgcatcaatgaaatcaccacccagtgtgtgtaaaagatcaaccaaga

SEQ ID NO: 36418 - DNA, 201 bp, Homo sapiens
agagatgggcagatgtggccgggtgcagtggctcatgcctgtaatcccagcactttgggaggctgaggcgggcagatcacctgaggatgggagttcgagamcagccttaccaacaaggtgaaaccccgtctctattaaatatacaaaattagccgggcgtggtggcgcatgcctataatcccagctactcgggaggctgag

SEQ ID NO: 36419 - DNA, 201 bp, Homo sapiens
tcaactttctgcgaaggaaggctgaggccatgctgggacccagcctgagccccggccaggaccccgagggaggcgtcgactataagaacatccacctcgaraagaaatatgtccgcaggtagcccctggcaaaggacaagaaaaaggccaggtctgggaggcaggatccgagtctgtcttcaaagccagctcagggttgga

SEQ ID NO: 36420 - DNA, 201 bp, Homo sapiens
  misc_feature (1)...(201): n = A,T,C or G, or insertion/deletion polymorphism (see Tables 1-2)
ggagcctggactagaatcctgctctcttgacttccagtccaggagtcacccaagccacactgctgtcctggaggtctctgtctcaggggcttgtggggtcnggacaggatcagaacaagaagggtgtacactgcgccctcatcctagatactgtcagctgccacgcctggggaggcaaaagagaaggaggccatctcttca

SEQ ID NO: 36421 - DNA, 201 bp, Homo sapiens
tctcaggggtagattggcattaggaacagtgaagaactttctcacaggcagagctgcccaaaaccagaatgggttgtaagctccctcaccggggacagccragcagagaccaatgctcactcagatggagtgtggcaggagggtttcttatcagaaagggaggttccagttgaccatggggtggtgggtggtcaaggcctg

SEQ ID NO: 36422 - DNA, 201 bp, Homo sapiens
gatgagtgggagaaagctgtgcccagggctggagctctggggctgggcacctgtgtccccagcgtgaagatgaggaagggtaccaggctttcttcattcgwttttactaaatagtgtatgagagacaacagttgtctctgctcataaagcacgtggtctggtggggatgataacggaagcttcctcagaattttggggata

SEQ ID NO: 36423 - DNA, 201 bp, Homo sapiens
tgtccccagcgtgaagatgaggaagggtaccaggctttcttcattcgtttttactaaatagtgtatgagagacaacagttgtctctgctcataaagcacgyggtctggtggggatgataacggaagcttcctcagaattttggggatattagataacgtataaagtgcgctcggcctaggaagaagtgccagggaatggga

SEQ ID NO: 36424 - DNA, 201 bp, Homo sapiens
  misc_feature (1)...(201): n = A,T,C or G, or insertion/deletion polymorphism (see Tables 1-2)
ggtcatgtggccaagattggggacttcgggctggctagggacatcatgaatgactccaactacattgtcaagggcaatgtaagtgctgggagggcttgggncaggctggggagggggtgaagagtcggggcccaaaataactggggactgtcatcccaggcccgcctgcctgtgaagtggatggccccagagagcatcttt

SEQ ID NO: 36425 - DNA, 201 bp, Homo sapiens
cacacaggaagcaccgggtaagagtagctgctgttgcagtgttgtcaagtgggaccctttaaacccagtctaagatgtgtgtgggtgtgcgggaatggggagaagacaatgggcatggcctcttacctgatcttggcctttgcagggctgaatccctaccctggcatcctggtgaacagcaagttctataaactggtgaag

SEQ ID NO: 36426 - DNA, 201 bp, Homo sapiens
gggccaggggcaatagggttgctgggggcaggggacagagtgctagggccctcccacctgggcccagagtcctgtacttggctcacttgaggtggaccagytgtcagcctcagatccatcactgtgtgtccttagcccctcccttgctctctctgagctggggaaacggcatcttcatttgagtgggtgcgggaaggacct

SEQ ID NO: 36427 - DNA, 201 bp, Homo sapiens; identical to SEQ ID NO: 9429

SEQ ID NO: 36428 - DNA, 201 bp, Homo sapiens
tcagccagtgggtcagcgtcagagcccagcctcacagctgccccgcaagtggcactccctctccctgcctggagagaggagagtggctaggaggctggggaagcagaagtgagaacatccctgtagaagggccacaggctgagcggaaaccgggggctgagcctgacgccaacaatgtgtttccgcccacacaggctgggg

SEQ ID NO: 36429 - DNA, 201 bp, Homo sapiens
gtgccctgatgggtggcaggaaggtgatgtccatcagcatccggctgaaagtgcagaaaggtgcgtggggcatggggaccggcagccaggcctgaagagtrgggacagagagccggcggccacatgggtggtgactggggactgggtgtgatggggggcagtgggatgtcctctttctttcacttcttcccctcaatggtt

SEQ ID NO: 36430 - DNA, 201 bp, Homo sapiens
  misc_feature (1)...(201): n = A,T,C or G, or insertion/deletion polymorphism (see Tables 1-2)
gccggcaactactcctgcgtggccagcaacgtgcagggcaagcactccacctccatgttcttccgggtggtaggtaagcatcagggtggtggtggacagtnggtagggatcctgcaggagtgtgagcagaagggttttgaggaggaagctgatgtcagggaaggagacctgctgaggatatctctgctggagtttgtttat

SEQ ID NO: 36431 - DNA, 201 bp, Homo sapiens
  misc_feature (1)...(201): n = A,T,C or G, or insertion/deletion polymorphism (see Tables 1-2)
gataaggatgacctccaggtctctggctatggtgattgggtgcaggcagtggcagtcactggactcagaccctgaagcaaggcagcagctcatcggagtgngagcaggctctgagacatttaggtctggccgtgcctcatgtgttgaatgttatgggagatggaggtggcgaggagcatgagaatcatgagcatcactgcc

SEQ ID NO: 36432 - DNA, 201 bp, Homo sapiens
tgaggccggagaatcgcttgaacctgggaggcggaggttgcagtgagcagagactgtgccactgcactccagcctggatgacagagcaagactctgtttcaaaaaaaaaaaaaaaaaaaactagtcaggactctttcagatacaagtaatagaaaccaactcaaactggcctaattaaaaggatttttttccttatagcta

SEQ ID NO: 36433 - DNA, 201 bp, Homo sapiens
caggactactgtagcctccacccctcttgctggttatacccctcctccacctaaacatgttccaccagagaggggtctctgccagcctgggtcagggactyggtgagaattgcatgaaagctgggcaagatcacacacaaactttgcatccgtgttaggggtgcccaggtttcctcaaggccatccagggactctcaaagg

SEQ ID NO: 36434 - DNA, 201 bp, Homo sapiens
  misc_feature (1)...(201): n = A,T,C or G, or insertion/deletion polymorphism (see Tables 1-2)
acctccggggaccacaagtgctgtctgcatcactggaggcctgtcgagggacagggaacagagctgcctgagggtccagagcaacaggtgggtgtcacagngaggcagatctgggccagatagggaagcatgggctaactgcttcccacaacagatggatgcaggtgacctgtcagaaatgcgccaaggggcacagggaat

SEQ ID NO: 36435 - DNA, 201 bp, Homo sapiens
gagaggctgtgattaggagaataagggtttggggggccttccatttatggggacagtgtatctctttatggatgaatatcttacagtgaccactagtattaaaaaaaaaaaaaaaagaaggcaaggaaagcaagcaaggagtgggaggggattgccagcaccgccactctctgcctgggtcccgtgacggctggtggcaga

SEQ ID NO: 36436 - DNA, 201 bp, Homo sapiens
gaggcaggagaatggcgtgaacccgggaggcggaggttgcagtgagccgagattgggccactgtactccaacctgggtgacagagcaagactccgtctcaraaaaaaaaaaaaaaaaaaaaaaaggttagccaatgatcttaggttcacttaaaactgtctttccctcccccatccccactggttctatcatctgtcaagt

SEQ ID NO: 36437 - DNA, 201 bp, Homo sapiens
ggaggcggaggttgcagtgagccgagattgggccactgtactccaacctgggtgacagagcaagactccgtctcagaaaaaaaaaaaaaaaaaaaaaaagkttagccaatgatcttaggttcacttaaaactgtctttccctcccccatccccactggttctatcatctgtcaagtgtccatatgatccatatctaggaat

SEQ ID NO: 36438 - DNA, 201 bp, Homo sapiens
  misc_feature (1)...(201): n = A,T,C or G, or insertion/deletion polymorphism (see Tables 1-2)
ttctcttctagctgtggcaggagttgaatgaggtgatacccggatctgccttgtaaagaaaataactagcccacattccagacagggattatctttgctgntgcaaaagcctctgtctggaggtcagaagatctcagctccctgtgtctcaggcctgctccttatgggaacttgagtggattacaccacatcaggcctcag

SEQ ID NO: 36439 - DNA, 201 bp, Homo sapiens
ttttaagagatgggctctcactatgttgtccaggctggactcgaacttctgggctcaagggatcctcctgcctcagcctcctggataactggcacgggtgygtcccacagtgcccagatactacgatctttattttgtaccaccagtctatttgtctatctgtgagccaacatcaaactgtcttaactatctttataatat

SEQ ID NO: 36440 - DNA, 201 bp, Homo sapiens
gaactgtgagtcaattaaacctcctttcctttagaaatcacccagtctcgggtatgtctttattagcagtatgagaacagactaatacagtaggtataggaaaaaaacatggcatatacagggtttagtactatctgcagtttcaggcatacaccagggttactggaatgtatcccctgtggagattgctgtaaatgcata

SEQ ID NO: 36441 - DNA, 201 bp, Homo sapiens
gcttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctctttttt

SEQ ID NO: 36442 - DNA, 201 bp, Homo sapiens; identical to SEQ ID NO: 9431

SEQ ID NO: 36443 - DNA, 201 bp, Homo sapiens
cttacctttattccatttccagcactttttattttttaatgtatatccaactttctagctggtatcatactccttttacctaaagaacttcccttaggatttttttttttttttttttttttttggtagtatgggtctgctggcaatgaattctcttagtttttgtttgtcaaagataatctttatcccttctcttttttt

SEQ ID NO: 36444 - DNA, 201 bp, Homo sapiens
ttttattgctagtttgttgggtgggttttgttttgttttgtttttaatgaaagcatgttgggttttacagttacatcaagtgacatgatcatatgaggatwtttttcattctattaatgtgatgtattaccctgattttcatgtgttaaaccactgttgtatttcttggacaaatcccacttcatcatggtatataatcat

SEQ ID NO: 36445 - DNA, 201 bp, Homo sapiens
accagattatcagagatatcagggccctcagaggttgtcttgtccaaggtcttcaatacacaaatagtgaaacaggcttggagaagggaaggtcacacaayaaggcagagtcaagcaggaacatgctctcagtgctatgttcatgagacgacctctctcagcccagagcaggccttgccctgccttctcccactgggcgcc

SEQ ID NO: 36446 - DNA, 201 bp, Homo sapiens
caatggttccacgatcatctatggggcaggactgacaaggtgtcggggcagggagacaaaccacatgtgagcaaataactcagtgggcaaggtcatctcaygtcattggacatgctacaaaaataaacattcaacatggtagctgaataaggagtgtgtagggcggggagcctcactgagaaggaaacactttattagagc

SEQ ID NO: 36447 - DNA, 201 bp, Homo sapiens
ggatggtacccccaggctgcatggattcacccttcctcctcctcagtcagtccatcagctaacagctctttagtgggtgcctactgtatgccaacatgagycagctgctgggtggcctctgaggctctgccctaatagcgtttactgtctagtgcgagagacaggtgctaatcaaatagccattaaagcaagggcacacct

SEQ ID NO: 36448 - DNA, 201 bp, Homo sapiens
tcccagctcaaaaaacaaacaaaaagccgtgaaagcaagagcatggattatagagtgagaggctatgaggagaggaatggcattctgaggcagcgcagccytgggatcctgtctcagcccaggggtgtcctggcacccagcacggggcagaggaaatggatatacaagcgtggtgtcccctgggccaggcctgagccctgc

SEQ ID NO: 36449 - DNA, 201 bp, Homo sapiens
ctaaaaattcccttttaagtacatatagtgccctgggcggctgagaaaatcaaacatacaaacaacagaaacaacgttatttaattctagctaagtactcyggactggtggaggaagtatggaccctctttggtttattgagaaaagtcataagtgggtgacagagaagaattgaagacagaaatgcgccaagctgaaaca

SEQ ID NO: 36450 - DNA, 201 bp, Homo sapiens
  misc_feature (1)...(201): n = A,T,C or G, or insertion/deletion polymorphism (see Tables 1-2)
caatacggtaccaaagatataatcacctaggtttacaaatatttttaggactcacgttaactcacatttatacagcagaaatgctattttgtatgctgttnagtttttctatctgtgtacttttttttaagggaaagattttaatattaaacctggtgcttctcactcacagactttgtggtctctctcgggtttgggttc

SEQ ID NO: 36451 - DNA, 201 bp, Homo sapiens
gcaggttggcaccttacttccctgggatccccagagttggtccaaggagggagagtgggttctcaatacggtaccaaagatataatcacctaggtttacaratatttttaggactcacgttaactcacatttatacagcagaaatgctattttgtatgctgttaagtttttctatctgtgtacttttttttaagggaaaga

SEQ ID NO: 36452 - DNA, 201 bp, Homo sapiens
actgagcatagctcccatagtttttcaaccctcgcccgcttccaccctccctgctctagtagcccccagtgtctgttggtgccatctttatgcccatgcayactcaatatttagctcccacttataagtgagaacatgcggtatgtaggttttctgtttcggtgttaatttgcttaggataatggccttcagctgcaccac

SEQ ID NO: 36453 - DNA, 201 bp, Homo sapiens
ccaagaccccttgaagatggctttagaagggccccaaacttagctagctccccccaagctcaggctggccctgccccagactgcgacccctccctcttggrttcaaggctttgttttcttcttaaagacccaagatttccaaactctgtggttgccttgcctagctaaaaggggaagaagaggatcagcccaaggaggagg

SEQ ID NO: 36454 - DNA, 201 bp, Homo sapiens
ggatggtattggaggaccctagagagagaggggggctctctcttcattactgcgatgagatcctgggctgaagaggggctgtgtccagccttagtgtgcaktgtgtgtgtgtgtgtgtgtgtgtgtgtgtgtgtgtgtgtgtgtgtgtgtgttgggagagaagagtagagattggggcacattctggaagtgatgagggag

SEQ ID NO: 36455 - DNA, 201 bp, Homo sapiens
tgtctcaggcctgctccttatgggaacttgagtggattacaccacatcaggcctcagtttccccagggataaatggagctagatgccacactaagacaaargttgataaaaatctgactaccactatccaacagttactatgccccagggctgtctggttgcttcacacacattagctcattttaccctcccaaaagccca

SEQ ID NO: 36456 - DNA, 201 bp, Homo sapiens
agacatttcccaagcaagaactggccatttgctataatttttaaaattttatttattttgacagtgaactgggggactttttaaaaaatgtatttattacytaaacaacacatgttcattatggacaaattgtaaaatagagattaaagaaagaataaaacaaaaaatttcccagaatcagccaaagatgatttttattgt

SEQ ID NO: 36457 - DNA, 201 bp, Homo sapiens
cacaaggtagaatgtaatttacttaatactactgaaccatacacttaaaaatggttgaaatggtaaatttcatgtatgttttatcacaattaaaatatatrtatatatttggatgggaggttgggtgggtggatggatgggtagatggatggacagatgaacggatggataagatctcaagttccaccctccctcctggct

SEQ ID NO: 36458 - DNA, 201 bp, Homo sapiens
cctcttcacaccagtggtggtcgcctgcatgtccatcatggccttgctgctgctgctgctcctgctgctattgtacaagtataagcaggtgagccggagcrgagtggggctgccaggtgcctgagtgagccagatttggatggtacccccaggctgcatggattcacccttcctcctcctcagtcagtccatcagctaaca

SEQ ID NO: 36459 - DNA, 201 bp, Homo sapiens
cccacatcctcttcactgatagcaggtctgacctacagtgagccgccatagctttcctttgaagaaataattcttgggctacattttttttaaggttgtcttttttttttcattttttgttttttttttcttgagacggagcctcactctgtcacccaggctggagtgcagtggtgcgatctcggctcactgcaacctctg

SEQ ID NO: 36460 - DNA, 201 bp, Homo sapiens; identical to SEQ ID NO: 9427

SEQ ID NO: 36461 - DNA, 201 bp, Homo sapiens
gctcagtgacaggctcatcccttctctctctctctctgccatctgtgtgtctgcatttttccttctccttcttttggcttctggtcactccgggtcttggrgtatgccctgctttctcccctgggtctctgcatttggtccccatgtatctgtgtggtgctctctgtcctgccctctccctgtctttgggactgtggttct

SEQ ID NO: 36462 - DNA, 201 bp, Homo sapiens
cagctccaatgccactgctctggaaggcctcacagactctccatcttctgttccccagcgccatctgattgtgcttatgttacaacacttaggggcttgcytccaaatgtgttggactttaagaagttaatgtcacattgatgaccttgcatgttgttgatctgatgagagtaagggaggccagatgtgcttggagaccat

SEQ ID NO: 36463 - DNA, 201 bp, Homo sapiens; identical to SEQ ID NO: 9425

SEQ ID NO: 36464 - DNA, 201 bp, Homo sapiens
ctccactccattccttcacactctggttggccccagagagtcctgatttttcaccctctctgcccctatgctattccctctcctgggatttcctttctgcytgaagggttgctgctcctccttcaaggcccagctccaatgccactgctctggaaggcctcacagactctccatcttctgttccccagcgccatctgattg

SEQ ID NO: 36465 - DNA, 201 bp, Homo sapiens
agggacttggtgagaattgcatgaaagctgggcaagatcacacacaaactttgcatccgtgttaggggtgcccaggtttcctcaaggccatccagggactytcaaaggcagtggcctcagccagagggagcatgagaatccgctagagagcttgttacctgtgcaggtacccccctcccacccctaagtcagcaggcctgg

SEQ ID NO: 36466 - DNA, 201 bp, Homo sapiens; identical to SEQ ID NO: 9430

SEQ ID NO: 36467 - DNA, 201 bp, Homo sapiens
tgccctgccttctcccactgggcgccttgggactgcccacacccctgctcttgggggtcagaaacaaggtccaggaactgcctgccagccccgactgccaygtgctcccttcctcttctgcagaagcccaagtaccaggtccgctggaagatcatcgagagctatgagggcaacagttatactttcatcgaccccacgcag

SEQ ID NO: 36468 - DNA, 201 bp, Homo sapiens
tgaggccatgctgggacccagcctgagccccggccaggaccccgagggaggcgtcgactataagaacatccacctcgagaagaaatatgtccgcaggtagyccctggcaaaggacaagaaaaaggccaggtctgggaggcaggatccgagtctgtcttcaaagccagctcagggttggatggctcatgaatgggtggctat

SEQ ID NO: 36469 - DNA, 201 bp, Homo sapiens
cccttttaagtacatatagtgccctgggcggctgagaaaatcaaacatacaaacaacagaaacaacgttatttaattctagctaagtactctggactggtygaggaagtatggaccctctttggtttattgagaaaagtcataagtgggtgacagagaagaattgaagacagaaatgcgccaagctgaaacattctccttg

SEQ ID NO: 36470 - DNA, 201 bp, Homo sapiens
ttagtttttgtttgtcaaagataatctttatcccttctctttttttgagataaaattcacataacataaaattaaacattaaccattttaaggtgtacaayggcatttaggacaaatacaatgctgggcagccatcacctttatctagttccaagacatttcatcaccccaaaacaaaaccacctcctcataagcaatcac

SEQ ID NO: 36471 - DNA, 201 bp, Homo sapiens
cacccacagacccaccttccagcagatctgctccttccttcaggagcaggcccaagaggacaggagagagcgggtgagtggggtgaggcttggggtgggtsgccggtaaagcacgttgggctgggcctgatggatctggactgacagtttctggtccctcccaccctcaggactataccaatctgccgagcagcagcagaa

SEQ ID NO: 36472 - DNA, 201 bp, Homo sapiens
agggggcaggggctcgttcaaggtggtcccttgatggcacagcaccatccctgccaagctaccacccatctcagagtcaggacggcccaaggggcgcatcytagacctcacttctgtctgctgtccctctctcccaccaggtcagggaatcccagtgatagagcccagtgtccccgagctggtcgtgaagccaggagcaac

SEQ ID NO: 36473 - DNA, 201 bp, Homo sapiens
gtggtgaggtggggacaggctctgaatgttctaggtatggaaagaggacggaagctcagcctcagacatggatttcccactgggggcctgcctaaggccargtgctgggcatgtgtaggagggatgctgagccaagaggcagggaggagatggtgggtgcgtgtgatggctctcgcggtggccaggtaacagtggaggtgg

SEQ ID NO: 36474 - DNA, 201 bp, Homo sapiens
tatctgtcgctatctgcttaggaataaaaggcaaggcagcttcttgcatgactcagtttccagcttgatttttccttttggcagagtgaattagggtcccragtttttattttcccttcacaggggcatggtgtgtgggaggggggccagatggttttccagggtccagtcccaagagaaagaagagatggggaggctgga

SEQ ID NO: 36475 - DNA, 201 bp, Homo sapiens
  misc_feature (1)...(201): n = A,T,C or G, or insertion/deletion polymorphism (see Tables 1-2)
gatcctacatctctttttttttctttcccatatgaattaagctgaggacttggccgtgaacattccattcatttgtttcttcattcggtggtagaaatacntccactttgtacacagggttaaaagagtccattcctggggagtagaaagatggcatcacagcagggaagactgaggcaggaggctgaggaccccaggggg

SEQ ID NO: 36476 - DNA, 201 bp, Homo sapiens
acctgggcttgagacagcaatcagtccctgtaacaagggccagggtcagagtgaagcagctagcccaatgccactgggatctgaagccactaaacctgccyagggggtcaaaggaccccagctgtgtgggcagaggaggccattagggctctttcctggcatttcatcctgcagagccctgggctggccaagagccaaagg

SEQ ID NO: 36477 - DNA, 201 bp, Homo sapiens
ctgggcttgagacagcaatcagtccctgtaacaagggccagggtcagagtgaagcagctagcccaatgccactgggatctgaagccactaaacctgcccagggggtcaaaggaccccagctgtgtgggcagaggaggccattagggctctttcctggcatttcatcctgcagagccctgggctggccaagagccaaaggtc

SEQ ID NO: 36478 - DNA, 201 bp, Homo sapiens
gtggggacaggctctgaatgttctaggtatggaaagaggacggaagctcagcctcagacatggatttcccactgggggcctgcctaaggccaagtgctggrcatgtgtaggagggatgctgagccaagaggcagggaggagatggtgggtgcgtgtgatggctctcgcggtggccaggtaacagtggaggtggagtctcac

SEQ ID NO: 36479 - DNA, 201 bp, Homo sapiens
  misc_feature (1)...(201): n = A,T,C or G, or insertion/deletion polymorphism (see Tables 1-2)
tgctagaaatgacacttgtccctcttcctggcagttgcactgcataggagggctacaaccccaggtggcaggcttggcagtattcacaattcactcaatcncgtttgctgatcagagtcttggggagaagggatgcacattctgatgaatacaaaatcaaaacgtgaattaagccatcctgaaaggacttgagagaggaaa

SEQ ID NO: 36480 - DNA, 201 bp, Homo sapiens
gggatggcaggcaggattctggtttctgggaggactggtgagagcaagcaggaccccagcctgaggacctgggcttgagacagcaatcagtccctgtaacragggccagggtcagagtgaagcagctagcccaatgccactgggatctgaagccactaaacctgcccagggggtcaaaggaccccagctgtgtgggcagag

SEQ ID NO: 36481 - DNA, 201 bp, Homo sapiens
agtcaggacggcccaaggggcgcatcctagacctcacttctgtctgctgtccctctctcccaccaggtcagggaatcccagtgatagagcccagtgtcccygagctggtcgtgaagccaggagcaacggtgaccttgcgatgtgtgggcaatggcagcgtggaatgggatggccccccatcacctcactggaccctgtact

SEQ ID NO: 36482 - DNA, 201 bp, Homo sapiens
gcagaagtgagaacatccctgtagaagggccacaggctgagcggaaaccgggggctgagcctgacgccaacaatgtgtttccgcccacacaggctgggggkcgcctggcagcccctcggaggcttgaatcagctctcacttccctcctttgcccctattttaggccctggaaaaatgctgacgctgcagaggcaacgggcc

SEQ ID NO: 36483 - DNA, 201 bp, Homo sapiens
tatgaattaagctgaggacttggccgtgaacattccattcatttgtttcttcattcggtggtagaaatacgtccactttgtacacagggttaaaagagtcyattcctggggagtagaaagatggcatcacagcagggaagactgaggcaggaggctgaggaccccagggggacagaggcctgggtgagaggctgagcaagc

SEQ ID NO: 36484 - DNA, 201 bp, Homo sapiens
ccagcagcatcctcagcaccaacaacgctaccttccaaaacacggggacctatcgctgcactgagcctggagaccccctgggaggcagcgccgccatccayctctatgtcaaaggtgaggagtctgagcctcctcccaagaggcctgacccggcaggccccactacaatgggccctaaaattaacaatcgtaacaattcag

SEQ ID NO: 36485 - DNA, 201 bp, Homo sapiens
caaggacctggaagagctgctaatgtaatgcagtcctcacaacaaccctgcaagtcgggtctatgatgatgcattttctagaagtgcagggaggttatccraggtcacacagcctcacatagtgggactagactggagcccaggtgcgcctgactctggagccaccacgctgaagcatccgctgaactgtcctggcgtggt

SEQ ID NO: 36486 - DNA, 201 bp, Homo sapiens
gaagtgcagggaggttatccaaggtcacacagcctcacatagtgggactagactggagcccaggtgcgcctgactctggagccaccacgctgaagcatccrctgaactgtcctggcgtggtgtgacctcagatgaatgatcagcctctctgagcttccttgtcacctatgtccaggtactccttggcccagtggagggagg

SEQ ID NO: 36487 - DNA, 201 bp, Homo sapiens
atgggccctaaaattaacaatcgtaacaattcagctctgcatttactgagtgctggctatgagcaaggacctggaagagctgctaatgtaatgcagtcctyacaacaaccctgcaagtcgggtctatgatgatgcattttctagaagtgcagggaggttatccaaggtcacacagcctcacatagtgggactagactggag

SEQ ID NO: 36488 - DNA, 201 bp, Homo sapiens
  misc_feature (1)...(201): n = A,T,C or G, or insertion/deletion polymorphism (see Tables 1-2)
tgggcagaggaggccattagggctctttcctggcatttcatcctgcagagccctgggctggccaagagccaaaggtcctgggccctagttctgccttgacnccccctcagggaccttgggtgagtcctttcatgtccctgggccttaggaatctggattagattatctttcaacagcagcaatgggcataaatatgaattc

SEQ ID NO: 36489 - DNA, 201 bp, Homo sapiens
  misc_feature (1)...(201): n = A,T,C or G, or insertion/deletion polymorphism (see Tables 1-2)
aaatagaaagtaaatacaaatgtgatgagcaagaaaccaagctggggagtggcgggcatggaggtgctggggaggctaattcatatcagctggtcacagangccttgctgaggaatttttgagctaaagatctgaaggatgagaacagcctcccatttgaagtgtgggaggaaaggcattccaggagggaaaggtgggtgc

SEQ ID NO: 36490 - DNA, 201 bp, Homo sapiens
aagcactccacctccatgttcttccgggtggtaggtaagcatcagggtggtggtggacagtcggtagggatcctgcaggagtgtgagcagaagggttttgwggaggaagctgatgtcagggaaggagacctgctgaggatatctctgctggagtttgtttatccaaggcctggctaaggagccactctccaggagctttcc

SEQ ID NO: 36491 - DNA, 201 bp, Homo sapiens
agcactccacctccatgttcttccgggtggtaggtaagcatcagggtggtggtggacagtcggtagggatcctgcaggagtgtgagcagaagggttttgakgaggaagctgatgtcagggaaggagacctgctgaggatatctctgctggagtttgtttatccaaggcctggctaaggagccactctccaggagctttccc

SEQ ID NO: 36492 - DNA, 201 bp, Homo sapiens
ctctataatgaaaaggaggaggatgggatttctggtagaggaaattgcttgagcaaaacctccaaggttggaatgactatggtgtgttcagggatgttagsagacccagatgggtggagcgttgagtgtgtgtgtgtaggaaggaagaggggaggtggctggatgagcacagtgagacctgatttgattgagagccttgaa

SEQ ID NO: 36493 - DNA, 201 bp, Homo sapiens
ctcctgcctcagcctcccgagtagctgggattacagatgcccaccaccacacccagctaatttttgtatttttagtagagacagagtttcaccatgttggycaggctggtctcgaactcctgacctcaggtgatctgcctgcctcggcctcccaaggtgctaggattacaggtgtgagccatcgtgcctggcctgaaataa

SEQ ID NO: 36494 - DNA, 201 bp, Homo sapiens
tcagcctcccgagtagctgggattacagatgcccaccaccacacccagctaatttttgtatttttagtagagacagagtttcaccatgttggccaggctgrtctcgaactcctgacctcaggtgatctgcctgcctcggcctcccaaggtgctaggattacaggtgtgagccatcgtgcctggcctgaaataatcattcat

SEQ ID NO: 36495 - DNA, 201 bp, Homo sapiens
cctctcagttcccttctggtcctttctggccaggtctctgtcttcctctcatttaaagcagaagttctgaatctggaatgtgtaggccctttggagggggytggtccatggatcggtttaatgggtccataagccacagagacattgaggaaaggaacacgagatcccctaaaacacagtagtctgggcccattcagcaca

SEQ ID NO: 36496 - DNA, 201 bp, Homo sapiens
  misc_feature (1)...(201): n = A,T,C or G, or insertion/deletion polymorphism (see Tables 1-2)
aaggaagatctcactagaaagctgatatttgagcaaaggcttaaattgctgaaggagcaagccatgcggccattttggagaagggagctccatcctgcagngggactgtgcttgccatgttcaggggacaagtgggccagtgtggctgcggggagagagtgagaaaaaaagtggtctcagatgaggtcagagagctaaagt

SEQ ID NO: 36497 - DNA, 201 bp, Homo sapiens
  misc_feature (1)...(201): n = A,T,C or G, or insertion/deletion polymorphism (see Tables 1-2)
ctgaaggagcaagccatgcggccattttggagaagggagctccatcctgcagcgggactgtgcttgccatgttcaggggacaagtgggccagtgtggctgnggggagagagtgagaaaaaaagtggtctcagatgaggtcagagagctaaagtgggaaggtgagatgaaaggaggctaccgcagtggtccaggctggagct

SEQ ID NO: 36498 - DNA, 201 bp, Homo sapiens
gtgtgtaggaaggaagaggggaggtggctggatgagcacagtgagacctgatttgattgagagccttgaacgccacgctgaataatggaggcaatgggackccatagagggcttttgagtagacatatatcagtgtagaagggtgaatttcagatttttagacagaatagagtaaggagaggagctcttagaaatcatcta

SEQ ID NO: 36499 - DNA, 201 bp, Homo sapiens
tggatgagcacagtgagacctgatttgattgagagccttgaacgccacgctgaataatggaggcaatgggacgccatagagggcttttgagtagacatatrtcagtgtagaagggtgaatttcagatttttagacagaatagagtaaggagaggagctcttagaaatcatctagtccagggcttgtggcagagccctgagg

SEQ ID NO: 36500 - DNA, 201 bp, Homo sapiens
tcaatgtcacacagctcccaagtggcacaggtgaaacttgactgcagatctaagttactgatctgagcaaggaagtggaaattatgttctccaaaacatcrctagaactagtagtatagattctgggaagaggagactcaggggccacaagcctggcttgctagaccctcagaagggctgtatgattccaaaggcatgtgg

SEQ ID NO: 36501 - DNA, 201 bp, Homo sapiens
aataaaataaacccctttaaggctgttatctgactgcaatcctggcaggggccatactaggctggggctcaccaacaccacctgattctctcctgcaggcrcaccttcaccctctctctgccccgcctgaagccctctgaggctggccgctactccttcctggccagaaacccaggaggctggagagctctgacgtttgag

SEQ ID NO: 36502 - DNA, 201 bp, Homo sapiens
acatgccaagagcccactggtggtctagtttaagcaccagaaacttggacttcagtgaatctgggtccaaatcctgcctctgccaagctctggctatgggrtgatgagaaagttggtgtgtctgagtctcttctccatttgtaaaatgggatcattaacagcctgttgtgagggattccgtaccacaacgcacatagagga

SEQ ID NO: 36503 - DNA, 201 bp, Homo sapiens
gtgacgatggggaggaggaaacgggagcctgtgagggggtaggggaggagacagagtatgagagagtcatttgggcagcagctgcaaggatgagtgggagmaagctgtgcccagggctggagctctggggctgggcacctgtgtccccagcgtgaagatgaggaagggtaccaggctttcttcattcgtttttactaaata

SEQ ID NO: 36504 - DNA, 201 bp, Homo sapiens
tgaggtcgggcatcatctccttgactacacacccaaagcggttgtttggcccagcccacccacctccagggacaggaccttactcactctcggggccaccrgttccttctctgagcagctccaatgtttgcaaagttcttccttacatggaactgaaaactgcctcgcagtgcccacagagctgccaggacagtcatgcag

SEQ ID NO: 36505 - DNA, 201 bp, Homo sapiens
tggacagatggatgagctcgtctgtgcccaggcaaatgctaggaagagtatacacacactcttacaagcagttgaggcggggagagaggctgtgattaggwgaataagggtttggggggccttccatttatggggacagtgtatctctttatggatgaatatcttacagtgaccactagtattaaaaaaaaaaaaaaaaga

SEQ ID NO: 36506 - DNA, 201 bp, Homo sapiens
cagctccaatgtttgcaaagttcttccttacatggaactgaaaactgcctcgcagtgcccacagagctgccaggacagtcatgcagagattccagagaagrgcctagggccccctgcggccctttctgccttgggctggccagcccccttggctgtggtttaggaactctgtatcccctctccacgggaccatttttggaa

SEQ ID NO: 36507 - DNA, 201 bp, Homo sapiens
tggagaaaaattagaaggaactagagtgtccatttgttagaggaatggtgagataaattatggtacatccatacgatgagatacagtgaagcaattttaaraatatggtaaatctctatgaactaatatggaaagatttctaagatgtgttgaatgattaaatagcataggatactatttttaaaactataaagtagggat

SEQ ID NO: 36508 - DNA, 201 bp, Homo sapiens
  misc_feature (1)...(201): n = A,T,C or G, or insertion/deletion polymorphism (see Tables 1-2)
ttttaaagatcagtgatatcccatgtcagcaagtgtacggtgatgctgcatttctcacacactgttggtgagaatgcacatcctcacggccttcttagggnaacaatttaacaatatctccatgttttaacgtacctaccctttgacccggcgatcccacttctatgaatggatcctgctccaatgagagtgtatttacac

SEQ ID NO: 36509 - DNA, 201 bp, Homo sapiens
ttctgaggctggggtccctgaactgcacttggaggtgcacccctctagaggcctccaggccattaaggacccatggcctataggatcaagccctggcaccstgccaggttgtcaggtactcttagtacttggacctcaccccctttctactcccatctccactccattccttcacactctggttggccccagagagtcctg

SEQ ID NO: 36510 - DNA, 201 bp, Homo sapiens
aggcagatagtaatccttaaaggctgaggattggaacccagatctttctaatccctaaactaccttggtataacatctccattccttctggctgcagctckcaatccctcaacaatctgactttcataataaccgttaccaaaaagtcctgaccctcaacctcgatcaagtagatttccaacatgccggcaactactcctg

SEQ ID NO: 36511 - DNA, 201 bp, Homo sapiens
aacccaaaccaatcaccgggccagaggggacagagtaccctcactggttggcctgggttacacacctactccagagctatatttggaagccgcattgactratttatgaccagaagaaagggaaatggatgaggacacgtgaaattgtgtgtgtatgtgtgtgtgtgttttcttgctgccaaaaatttttcaaaaacttgg

SEQ ID NO: 36512 - DNA, 201 bp, Homo sapiens
ctgtctggaggtcagaagatctcagctccctgtgtctcaggcctgctccttatgggaacttgagtggattacaccacatcaggcctcagtttccccagggrtaaatggagctagatgccacactaagacaaaggttgataaaaatctgactaccactatccaacagttactatgccccagggctgtctggttgcttcacac

SEQ ID NO: 36513 - DNA, 201 bp, Homo sapiens
gaaacattgactcatcttattttaccctcacaagaagctggaggcaggaagtatactagtcagtatcttacccatcaggaagctgaggctcagcaaggttaaaaaaaaaaccccaaggggctgagggatagggttggcactgggccccaggggcttctgtccctagagcccatggcctccactgcctgcctgcccacacaa

SEQ ID NO: 36514 - DNA, 201 bp, Homo sapiens
gcccatggcctccactgcctgcctgcccacacaaagaccatgtgcaatgtgatcagaagctgagaggaccaggccagagggctgtgggagttcagaggtgkacggacttttcaggctggtgggtaagggagactgcctggaggaggtggcttggcattggtgggacgggctttggaggatgaggatgcagcaggggagatg

SEQ ID NO: 36515 - DNA, 201 bp, Homo sapiens
aactagcccacattccagacagggattatctttgctggtgcaaaagcctctgtctggaggtcagaagatctcagctccctgtgtctcaggcctgctccttwtgggaacttgagtggattacaccacatcaggcctcagtttccccagggataaatggagctagatgccacactaagacaaaggttgataaaaatctgacta

SEQ ID NO: 36516 - DNA, 201 bp, Homo sapiens
tgggtaagggagactgcctggaggaggtggcttggcattggtgggacgggctttggaggatgaggatgcagcaggggagatgacactaagggaaagggtayctctgggggagagggcagagtgtgcagaggtgcaggtgagggaaggaccagggtggggttgggggtctgaagggttggaccccaccctgtcggtccaagg

SEQ ID NO: 36517 - DNA, 201 bp, Homo sapiens
atgaggatgcagcaggggagatgacactaagggaaagggtacctctgggggagagggcagagtgtgcagaggtgcaggtgagggaaggaccagggtggggytgggggtctgaagggttggaccccaccctgtcggtccaaggccatcagtgggtttgaacaagggagtggtgtgatcaaggactgaatgacccatcttgtg

SEQ ID NO: 36518 - DNA, 201 bp, Homo sapiens
  misc_feature (1)...(201): n = A,T,C or G, or insertion/deletion polymorphism (see Tables 1-2)
cagagggacagaggaacaagaagtggtaagaaaaaacagtcttagccacagaggctcctagagatggaagtggccaggagaggctgaagaatcccctcctngccttgttgctgtcttttgggctgggaaggcacccacgggcaggatttggatcctcagaggcttgggaagttcttctccctgggtcccgtttcagactct

SEQ ID NO: 36519 - DNA, 201 bp, Homo sapiens
cctcagaggcttgggaagttcttctccctgggtcccgtttcagactctctcccaagctataacgcagaggctctgaagttcacctgcagtccgcccttccraatcagagcctggaagttagttccttctcatttctaattgcagtcttttctctctaactaccagctagaagttcttcctgatggttagctggaagctttc

SEQ ID NO: 36520 - DNA, 201 bp, Homo sapiens
aactccaaactggctgtcttagctgaaggcacagctcagactccagagaggggtgcagactcacccgagatctcactcccagtcagtagctgacacagaaycaggactcatgcttgtgccgctgaactttgtgggggtgggtggggggaggtggttctctgtcaccttgacacatggcctttgccccagcctttagacaaa

SEQ ID NO: 36521 - DNA, 201 bp, Homo sapiens
cggaaagagttgctctgctgacccagggcctcagtgtcctccaccgccccagcccagcttccactttccccctcaacttggtcttccatcagcatttcttrtgggcaacccttagcatggtactccccctcagcagctgacccctgggcaagaaacaggggcagccattcctcctccccacatcccagggcttgcctcccc

SEQ ID NO: 36522 - DNA, 201 bp, Homo sapiens
cctcagtgtcctccaccgccccagcccagcttccactttccccctcaacttggtcttccatcagcatttcttatgggcaacccttagcatggtactccccstcagcagctgacccctgggcaagaaacaggggcagccattcctcctccccacatcccagggcttgcctcccctggctgggtggtaacagcatggagagcc

SEQ ID NO: 36523 - DNA, 201 bp, Homo sapiens
ctgcagagctggtgcggattcgaggggaggctgcccagatcgtgtgctcagccagcagcgttgatgttaactttgatgtcttcctccaacacaacaacacyaaggtcagtccctgcagatcacaaggtgaagtctggccatcctcccagcacaccaggtttcccatggtggagtcctgggcccccaactccaaactggctg

SEQ ID NO: 36524 - DNA, 201 bp, Homo sapiens
ctcactgcccggccaggcatggtagctcatgcctgtaatcccagcactttgagagaccgaggcaggcaaactgcttgagctcacgagttcaagaccagcckaggctgcgacaaagccccgtctctacaaaaattagccaggtgtggtgccacatgcttgtagtcccggctgcttgggagactgaggtgggaggattgcttg

SEQ ID NO: 36525 - DNA, 201 bp, Homo sapiens
gcagggagggtggatggagagagaagaggcagagatcagattgcaaaggcccctgtaagccctgctacagggtatggccttgatctgctctatggagctgsaatagtaatgggagcaaataccccatagtactccaattcagacactagagctcaatcctcaggcctagagataggtgtggtcgaacctttgtggtccagg

SEQ ID NO: 36526 - DNA, 201 bp, Homo sapiens
caaaaagtctgggggtgcagaaaggccacctatggccatggcctggccacagtttggcttcctgtcacctgaagaccagctcagtgacaggctcatccctyctctctctctctctgccatctgtgtgtctgcatttttccttctccttcttttggcttctggtcactccgggtcttggggtatgccctgctttctcccctg

SEQ ID NO: 36527 - DNA, 201 bp, Homo sapiens
ctcagtgacaggctcatcccttctctctctctctctgccatctgtgtgtctgcatttttccttctccttcttttggcttctggtcactccgggtcttgggrtatgccctgctttctcccctgggtctctgcatttggtccccatgtatctgtgtggtgctctctgtcctgccctctccctgtctttgggactgtggttctt

SEQ ID NO: 36528 - DNA, 201 bp, Homo sapiens
tggagtgtggcaggagggtttcttatcagaaagggaggttccagttgaccatggggtggtgggtggtcaaggcctgagctgagcagtgcagtgatgatgastgacctctgccccccaaccctctctcctatgtagggacagtggcttctccagccagggtgtggacacctatgtggagatgaggcctgtctccacttcttc

SEQ ID NO: 36529 - DNA, 201 bp, Homo sapiens
agctctctactactaggctctagtagaaagaactgctatttcccgaggactaggcacaaggacttgtactcagttcttaaatacgctgctcctataccctsataaccacctgactgtccacactttaacgatacacagctgaagctttggtctgattccaaagcctgtgcaagaatgtttggtgtgataaggcctggatag

SEQ ID NO: 36530 - DNA, 201 bp, Homo sapiens; identical to SEQ ID NO: 9419

SEQ ID NO: 36531 - DNA, 201 bp, Homo sapiens
ttttaccaaaaataaaataaacccctttaaggctgttatctgactgcaatcctggcaggggccatactaggctggggctcaccaacaccacctgattctcycctgcaggcacaccttcaccctctctctgccccgcctgaagccctctgaggctggccgctactccttcctggccagaaacccaggaggctggagagctct

SEQ ID NO: 36532 - DNA, 201 bp, Homo sapiens
  misc_feature (1)...(201): n = A,T,C or G, or insertion/deletion polymorphism (see Tables 1-2)
tctccggtgatcccaggacatcttgcaactcccccagtggcctggttcctctcctggctctgacaataggctgtgagttgcagaagggagggaccacagcngacctgttcaccaccatgtccccagggccagggacagtgattgagaaatatctgttgcatgcccttcacctgcattattgtctcactggatctgagtcaa

SEQ ID NO: 36533 - DNA, 201 bp, Homo sapiens
ttacccaaggccgttgggccctgaatattttaccaaaaataaaataaacccctttaaggctgttatctgactgcaatcctggcaggggccatactaggctrgggctcaccaacaccacctgattctctcctgcaggcacaccttcaccctctctctgccccgcctgaagccctctgaggctggccgctactccttcctggc

SEQ ID NO: 36534 - DNA, 201 bp, Homo sapiens
attctgggctagaaggcaggggaccttggcatgtggctggccacaccaagcaggaagcacaaactcccccaagctgactcatcctaactaacagtcacgcmgtgggatgtctctgtccacattaaactaacagcattaatgcagtcagcctctggttctttgtgccacatgagtacctgcaaattccctggaacgtctttc

SEQ ID NO: 36535 - DNA, 201 bp, Homo sapiens
agcccagcaaaagctactttctccaagaagctttcctcattcttcagctgaaaatgatttctcttcgcattcctttgtctgtgcctcttatgggccctcayatctgttcagcattcttagcctcccataccctgtgcactcttacgcctccaggcctttactgtgctgtttctccttcttggaacattccttcctcctccc

SEQ ID NO: 36536 - DNA, 201 bp, Homo sapiens
  misc_feature (1)...(201): n = A,T,C or G, or insertion/deletion polymorphism (see Tables 1-2)
gtatatgacagtgatttgaggggcatttttctatagcatgttacctacatcatctcatttaatgccctcagcaaccactgtatgcagctagcattagtctnttttacagagttgtaaactgaggttctgagaggttgggacagttgcccttgtctacagctggtcaaaggcagagtctggtttttaaccctgaaggaggac

SEQ ID NO: 36537 - DNA, 201 bp, Homo sapiens
agactgcccccactgcatgccagtctgggggacagagatcctgtcttggaaaaaaaaaaatcccaaaagggaacccactcaccttatcatagccctcaagrccttcctgtttctggaatctgccccccacttccctcaagccatgatggctgccttcctatagctcaaacttgccaggatcattcccatgtcaagcataca

SEQ ID NO: 36538 - DNA, 201 bp, Homo sapiens
gtatgtggatgggctactattattcagccttaaaaaggaagggaattctgacctgtgctgcagcatgaatgaaccttgaagacattatgctgggtgaaatraggcaatctcaatagacacatgctgtgtgagtccactgaggtgcagtgcctagagcagtgcaattcacagagacagcagaatcatggttgccaggggctg

SEQ ID NO: 36539 - DNA, 201 bp, Homo sapiens
ctcttgttgcccaggctaaagtgcaatggcttgatcttgggtcactgcaacctctgcctcccaggtttaagcacttctcctgcctcagcctcccaagtagmtgggattacaggcacctgccaccacacccagctaattttatacttttagtaaagacagggttttgccatgttggtcaggctagtctcgaactcctgacct

SEQ ID NO: 36540 - DNA, 201 bp, Homo sapiens
tgggttttacaacttacatcgtaaattaatcaaagtctacctttaaatgataaaatgttactttaaatatagcatgagggccggtgctgtggctcacacckgtaatcccagcactttgggaggccgaagcaggcagatgacctgaagtcaggaattcgagaccagcttagccaacatggtgaaaccctgtctctactaaaa

SEQ ID NO: 36541 - DNA, 201 bp, Homo sapiens
acccatggaggtaagggccttggggttcctggggccaaggtcttggggcctctggggaatctcagggccccagggctaccttgttccgtcttctccttctyaggatcctactgctccaagtgtcagggggatcccggtcacagcatcccttaaactcctgggcccatctcctggaatagtcaggagctgcacgggcagctt

SEQ ID NO: 36542 - DNA, 201 bp, Homo sapiens
atagggagcatcggagcccttggaggaggagatgaatgtgcaagctcctaggccctgcttccagggagccggatcctctgggtctggagtgaagccccccrcctacctcttatgaagcttccattcaaggatgcttggacactctccccagggcccccaaaggtgccccgggctttgctgggactccaagtgccccacatc

SEQ ID NO: 36543 - DNA, 201 bp, Homo sapiens
cggatcctctgggtctggagtgaagccccccgcctacctcttatgaagcttccattcaaggatgcttggacactctccccagggcccccaaaggtgccccrggctttgctgggactccaagtgccccacatcctcttcactgatagcaggtctgacctacagtgagccgccatagctttcctttgaagaaataattcttgg

SEQ ID NO: 36544 - DNA, 201 bp, Homo sapiens
ttccattcaaggatgcttggacactctccccagggcccccaaaggtgccccgggctttgctgggactccaagtgccccacatcctcttcactgatagcagstctgacctacagtgagccgccatagctttcctttgaagaaataattcttgggctacattttttttaaggttgtcttttttttttcattttttgttttttt

SEQ ID NO: 36545 - DNA, 201 bp, Homo sapiens
gtggagaagctgcaggggaaatgcaggagaggaaggttgcagtgtgacctccagaaggcctttctgaacgagcttcctggaggtgtagtgcatgcaagccrtggctgggcaccaggccaggccgctgcagagaggtttcttgcactggcagagggtgagactgcatgaccccagaggctccctacccccagccacaggagg

SEQ ID NO: 36546 - DNA, 201 bp, Homo sapiens
tcgatctcctgacctcgtgatccacccaccttggcctcccaaagtgctgagattacaggcatgagccaccgtgccccgccaaagccatctgttttaaacaratggaactactgaggcacaaggaaacttgctcacagagccgaggttagaactcagctatgctgagtccaagtccagtggcctcactgcccccagtctcat

SEQ ID NO: 36547 - DNA, 201 bp, Homo sapiens
ctcacagagccgaggttagaactcagctatgctgagtccaagtccagtggcctcactgcccccagtctcatgctcctgttcatggaggggagcactcagcmcctccctcaccccacacccttggctgctctaggccctgtactggtcatcacggagtactgttgctatggcgacctgctcaactttctgcgaaggaaggct

SEQ ID NO: 36548 - DNA, 201 bp, Homo sapiens
taaaggttcaaaacacttttctgaaaaagaaagtacatatatacactcataaatatacatacaaacacacacatacacaccacacacacacctgagtacaygggaatgatcattttcctggatcaatgttatatcaggatttttcaatttcaagaaggaactttaggctgggtatagtggctcatacctataatcccagta

SEQ ID NO: 36549 - DNA, 201 bp, Homo sapiens
agagaacagcggtgagtcaggagcaggagcgggcaggagcgggcggaccgcagctccgcaccacctatgaccgtgtcttcctcaaagagcaaaacattatwtttttttgtgtgtgattattttatttttatttttttaggctcatcagctattgttagtgttagtgtattttatgtgtgactcaagacagttcttccaatg

SEQ ID NO: 36550 - DNA, 201 bp, Homo sapiens
aaggagatgcttaatgcttctactctgggcagatcagagcctgctcagggaattgtgttcatgcgacaggggatcatctcatgagaagcagctgacagcayggggagagctgtagatcttgggggctgtgatgggagtggcatcacttggaggtgacagccaagtgggtgtacccagagttgtggaatggtgcttgggggg

SEQ ID NO: 36551 - DNA, 201 bp, Homo sapiens
taccatccaaagaaaagccattattaacattttggtgtacttctttccagtctttttttctgtgaataagttctgtatctgtttttttcttcttctttccyttcttttttttttccagtagagatggggtcttcctttgttgctctggcctcaaacagtctcctgtctcggcctcccaaagtgctgggattacagcactgt

SEQ ID NO: 36552 - DNA, 201 bp, Homo sapiens
gatcacatagagctctctaggccagagtaacagttcgtattttattctgactgatgagggaccttttggatggttttgaatgggaaatctgtggaagggtrtggacaaggtggcactgggttagctccaggacaggttatgtactagatgacagagtgggcccaggtagatcttggaacggaaaccccccccccttaacag

SEQ ID NO: 36553 - DNA, 201 bp, Homo sapiens
gccctggtagttctcatttgttctttttctagtttcttaaggtagaagctgatgtcattgattcaaaacctttcttttcttttcttttctttttttggtarataaggtttcactctgttgcccatgttagagtgcagtggcacaatcatggctcactgcatccttgacttcctgggatccacctacctgccccagtctctc

SEQ ID NO: 36554 - DNA, 201 bp, Homo sapiens
agttttggggggctagacttaggtcactgggcaacctccggcatagctgcccacgggtcaggtgctaccccgtgggctagggagggaggctgggtcttctstcagtattttttaagcaccctaccacatcctgggcatcagctgttgagggtataagggcgagcttgtataaagaatgacaaagatgtcgttcctccctag

SEQ ID NO: 36555 - DNA, 201 bp, Homo sapiens
aacttcccatacagggactgatccagctcagttttggggggctagacttaggtcactgggcaacctccggcatagctgcccacgggtcaggtgctaccccstgggctagggagggaggctgggtcttctctcagtattttttaagcaccctaccacatcctgggcatcagctgttgagggtataagggcgagcttgtataa

SEQ ID NO: 36556 - DNA, 201 bp, Homo sapiens; identical to SEQ ID NO: 9449

SEQ ID NO: 36557 - DNA, 201 bp, Homo sapiens
aggtgggggaacatatttcccagggattaaaactacctggtcttcccaaacactggagcaattttcggagcttctggaaccaatgtttcttcagcaccttygctatcttcctgatggagatcatatgaaatgttcccatattctcttaaaaatgggaaaatttcaagcagaaactggcagaagtctctgcgaataccaaac

SEQ ID NO: 36558 - DNA, 201 bp, Homo sapiens
tacctgattgttggccacttctggttaaggccactctctccagctttccagtgacaggtaatgctttacattacaaccaactaatattctaagattcttaraaatggacaaaccacttgttgcttattttgattgtttctggacagttactacctgtgtggaaaaattcagggtgctaaacaacagtgtcactttatggcc

SEQ ID NO: 36559 - DNA, 201 bp, Homo sapiens
accttagaagactggattaaaagctgacttattttagggtttttttcagtggcggtgtgcaggatatctcactcagatgttccagggcagaaagccagttstaatagacttcaaatatctgcagaaagcgtggacctgacttgagttccacctctgccagcactgggggagggcttggtgcagagctggcttccactgttt

SEQ ID NO: 36560 - DNA, 201 bp, Homo sapiens
  misc_feature (1)...(201): n = A,T,C or G, or insertion/deletion polymorphism (see Tables 1-2)
agaattttccggaagttggttaaggtggtgaatttcactattactcaaattttaaaccacccttgtattcctgggacaaaccccatttgacagtgatgtantatccctctcatagattgttggatttcatttgctaaaaagtttgctcagaatttggctcagaatttccttatacagtctctgtccacttttcatatcagg

SEQ ID NO: 36561 - DNA, 201 bp, Homo sapiens
cattaaattaatgttatgacccctcattggattgtgacctgtagtttgaaaactgtgtcatggaccaggttggaataggaaaacgggtctgccatctcccrtgtcatgtgttctttgtcagttaacttcctttctttaacagttttacatttgccctgacaggaatatcaactggcttttactttgagaactgttttgttt

SEQ ID NO: 36562 - DNA, 201 bp, Homo sapiens
  misc_feature (1)...(201): n = A,T,C or G, or insertion/deletion polymorphism (see Tables 1-2)
atcagggagaagctccattgaagagagacctgcttgagaaagacctatttttaatgagtatttcagaacattgttcctggaagcctctgactggtatacanaattaccttgtacccagaagccaccgagaattaaagacagataactttaagcagtgcagatacttgtttatgtatcaaaactatcattcatagagccttc

SEQ ID NO: 36563 - DNA, 201 bp, Homo sapiens
ataatcaggaataaggtttgcatgtttagaggtagatagagctgcttgtgtaatacagtaccacattattttgttagcactggtggttggaaactatgctraaagcaaaaatgcaagtaaagccaaagatggtggaggagaccaaggctttgggtgcttgggttaaaggactaacaaggaagcatttagaattatgtctgt

SEQ ID NO: 36564 - DNA, 201 bp, Homo sapiens
  misc_feature (1)...(201): n = A,T,C or G, or insertion/deletion polymorphism (see Tables 1-2)
cagtatcttatgtgtgtctcaggcatcatgctggttgggaatcagtaaataagcagaatcctacccttactgaagcggggagggtggtggtttagcagctntcagatgatgaattctgcagtcaaggggtgcactcagagaacacaaagcggggagtgatttatgctgccttggcaaaaaggatcagggagaagctccatt

SEQ ID NO: 36565 - DNA, 201 bp, Homo sapiens
aaccatagtaccaacatcttttttggtgagggcctcagactgcctccactcatggtggaaggcaaggggagccagcatgcatagagatcacatacagaaaraggaagcgaaactcattcaccacctcccttgctcctgccccacgataatctactcatgagggatctgcccccctgacccaagtacctccctttaggacct

SEQ ID NO: 36566 - DNA, 201 bp, Homo sapiens
acaaagtgtgtctatctgtaattaggagatagaattgagttctgtgtaggtagaagctctgagcattcctttctccttccagttcattttagctatttgcrcggtttgcagtggaagtgggtgttactctctagatctaggatgatgaaggaacttaacttctcaggtgacataggaaattatctagggacctcttgccaa

SEQ ID NO: 36567 - DNA, 201 bp, Homo sapiens
tagtttctccattggtaaagtaaggtgggcaaggtagattagatctgggcagtttactcttaagagacaggagccttagagaagactgataattgagtttyaaggagtttataaatccctgaaattgcatgcaaaatgggtccgtagctttcatcagattctcttgctccactggatgcctgctgctggaagtaagctttc

SEQ ID NO: 36568 - DNA, 201 bp, Homo sapiens
agtttttccagtcccttttgcaggaaaaaaaaagaacttacacatatatatatatctttctctctccatgtggtcttagtccatttatctctgcttgtctyccccttcctggcttcctcatcctcagaactctaagctctctgcactgactgctgtggttccggacatcccaggtttccgcaagatcctcccacgctcaga

SEQ ID NO: 36569 - DNA, 201 bp, Homo sapiens
ttattcttttcagagctgacctgcttacccctgggtccagagctccagagcttaaaggcagagcacggggcaagccctcattactggctgcagcaagaccyatgagagcaattttgccagccccagttaacgtggggcgaggcagcagcatgggactgcccagggccaggcaggccttttccctgagtggtaagggctggg

SEQ ID NO: 36570 - DNA, 201 bp, Homo sapiens
  misc_feature (1)...(201): n = A,T,C or G, or insertion/deletion polymorphism (see Tables 1-2)
actggggctgggagtgaccctgagttggaagcttccctctcccgagctttagtttctccattggtaaagtaaggtgggcaaggtagattagatctgggcantttactcttaagagacaggagccttagagaagactgataattgagttttaaggagtttataaatccctgaaattgcatgcaaaatgggtccgtagctttc

SEQ ID NO: 36571 - DNA, 201 bp, Homo sapiens
aagcttagaggtttatttgtatatggagagaggcctttttgatgatgaatctcaccctggtctccagagtctgtttccgtgcttgaggtgatgttctgagkttattgtccttgtgagaaaggaaagtggaaccaaagtatgtgggcactaatggcttggtgggaaaaacactggggctgggagtgaccctgagttggaagc

SEQ ID NO: 36572 - DNA, 201 bp, Homo sapiens
aagagtgttccatttggctggaggagatggcgtgggggcatggggtgggagaaggggtgttacggaaaataagacgtgaaaagcatcttggaaccatgtcrtggaaggtcttgtcagtttgttctttagtcagtggggtcctactgaatgtccttgagccggggagaggcctagaggaaagttatttcaagaggggaattt

SEQ ID NO: 36573 - DNA, 201 bp, Homo sapiens
  misc_feature (1)...(201): n = A,T,C or G, or insertion/deletion polymorphism (see Tables 1-2)
acattccacttggctccttagggctgctattattattattactattaccaggaaaaatgggcattttcagaggtccccagaatttccatatgagttttttnaagtgaacagaaaatggtggcacttgaggcagcaaatggaaggactaaaataaggatgagaagagaaatgtcactggtctgccttggggaaagaggggat

SEQ ID NO: 36574 - DNA, 201 bp, Homo sapiens
agtgaggagacagtcaccatcgagcaaacctcttggtcgaattattatgagtctccgtccacgcagtgccttctctgtagcagcccattattcaaaggggracaaaagtaagcaccccttaactctgcccctagctaccccatcccatttggctcatactgctcttttcttcagaaaacattaaaactataactgtgaaga

SEQ ID NO: 36575 - DNA, 201 bp, Homo sapiens
agcagctaaaagacctgaccaaaattgcacaagctggcagagtataaagaaatcttttacatacaggcccttactacatgtttgagtgaatcaatgaaggsatttgcttaagttgatgaaacataggaggaatgggccagaacttctgattcctggccaagcatttttttttaacctgtttccatatagaattgttataat

SEQ ID NO: 36576 - DNA, 201 bp, Homo sapiens
tagagaagtactttagtaaagcagcttattttgtttagcctagtgtttcccacagggttttccctttatttttaacataacacatattaacgtcctaatgsacaaatgtgtgacattgggatcacccttttgtagggcaggcagcatagagcagggaaataaatgctagacagctgagagacctggtccaaaaggagttct

SEQ ID NO: 36577 - DNA, 201 bp, Homo sapiens; identical to SEQ ID NO: 9458

SEQ ID NO: 36578 - DNA, 201 bp, Homo sapiens; identical to SEQ ID NO: 9459

SEQ ID NO: 36579 - DNA, 201 bp, Homo sapiens
tctctgttttttagcccagcaccagagagctgatgttggttggtcagatgactgtttagatctgtgctgtctctagctcctagcatatgttgctatttcasttaattacaattggccaggtgtggtggtggctcatgcctgtaatcccagcactttgggaggccaaggcaggaggattgcttgagcctaggagtttgagac

SEQ ID NO: 36580 - DNA, 201 bp, Homo sapiens
caggccttgaccacccaccaccccatggtcaactggaacctccctttctgataagaaaccctcctgccacactccatctgagtgagcattggtctctgctyggctgtccccggtgagggagcttacaacccattctggttttgggcagctctgcctgtgagaaagttcttcactgttcctaatgccaatctacccctgaga

SEQ ID NO: 36581 - DNA, 201 bp, Homo sapiens
tcccattccctggcacttcttcctaggccgagcgcactttatacgttatctaatatccccaaaattctgaggaagcttccgttatcatccccaccagaccrcgtgctttatgagcagagacaactgttgtctctcatacactatttagtaaaaacgaatgaagaaagcctggtacccttcctcatcttcacgctggggaca

SEQ ID NO: 36582 - DNA, 201 bp, Homo sapiens
acttcctagatcactgaagataaagtgagctaatgcggttagagtgatagccgccttttttaactgtaacccatagtgagaaatacattttgtgtcatgaygcagaatgatattcgtacatatgcaagtgtgtataactgaaacaacattcccaaaacagtatttttctttattttctatcttatttcatttttgaatttt

SEQ ID NO: 36583 - DNA, 201 bp, Homo sapiens
gggtacagagctgtcaaattcaaggccctgtggcagtgcctggctgtctgacttcccttcaccaagccttggcttccctgtgtgtataatgacggggtagrctgttgtgttgctgatgttctgtgactcccacagtttgaccttctttatcctgaccttctagttcacctggcctgaattcctgggctctaatgaggtaaa

SEQ ID NO: 36584 - DNA, 201 bp, Homo sapiens
  misc_feature (1)...(201): n = A,T,C or G, or insertion/deletion polymorphism (see Tables 1-2)
tataggatgtataggtttatagtctttctttgaacaaaagtacggttgtgctagatgttgttttggaatgtgctttttaaacttaggggtacattgtgggnatcttcctgtgccagcaagtagagaagtacatgaccatttttatagggatgtatggtgctccagtttacacttttgtgattcagtctttgtgtacagccc

SEQ ID NO: 36585 - DNA, 201 bp, Homo sapiens
gaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatcaaga

SEQ ID NO: 36586 - DNA, 201 bp, Homo sapiens
tggaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatcaa

SEQ ID NO: 36587 - DNA, 201 bp, Homo sapiens
cccccaacttttagctgccacttggctcattacagcagtaccagtatgggggtgggaggggtgaggctgtggagtgaaggcggcgtatagggcagagactragaggtcctgtgagattcttagaggagccatcctgctccaaggggcctgagctgagtgtggtctgtgagcatctgctgctcctctcagagagggagatct

SEQ ID NO: 36588 - DNA, 201 bp, Homo sapiens
agtggaggttgcagtgagccgtgattgtgccactgcactctagcctgggcaacagagtgagactctgtttcacacacacacacacacacacacacacacacacacacacacaaatcagcaatctttttgtgcatgataaaatcctacgtaatcctggagtgatttgatttttaaaactacacactaatgtagatcattatc

SEQ ID NO: 36589 - DNA, 201 bp, Homo sapiens
tgatgtgggaggatcacttgagccggggaagtggaggttgcagtgagccgtgattgtgccactgcactctagcctgggcaacagagtgagactctgtttcwcacacacacacacacacacacacacacacacacacacacaaatcagcaatctttttgtgcatgataaaatcctacgtaatcctggagtgatttgattttt

SEQ ID NO: 36590 - DNA, 201 bp, Homo sapiens
cttgaggcagcaaatggaaggactaaaataaggatgagaagagaaatgtcactggtctgccttggggaaagaggggatggcacacagaacaggtcaggacytgagatggagcctggtcactccagatcaaggctggaccttgaaaggcaggcaggttttgaatggaaggggaaggcatgccatacttaagtctctcccact

SEQ ID NO: 36591 - DNA, 201 bp, Homo sapiens
tttacaaatgccaaactaattttggaaagcatgaatctttttgtgcatccagggacccttagcaagagattacgagtgacttgtagaagtaccttctttgmtcatagggagacttggccccattgcatgttagactcattctgaccacacagctcctggatatctgcttccagtcccaaggctcatgccaagacctaagag

SEQ ID NO: 36592 - DNA, 201 bp, Homo sapiens
cagctgggccagcccattcaacagccatctggccctggtgaggtgaaggtaaggcccattttccagagtgggagctgtttgagggtctggctgcttccatktaatgtatcaaagctataggtaaaggcacatcccatttcttacacgttggcagacctctgggtggaggttaacatgaatgatttatctgttttttaagta

SEQ ID NO: 36593 - DNA, 201 bp, Homo sapiens
agaccagcctggacaacatagcgagatttcatctctattattattttttaaattatataaaattaaaaaaaaaacttaatgaactcttccattttttttttctgccaattacctgactttaggaatgaacccagctgggcacagtgtaatcccactcatgcctgtaataccaacagtttgagaggccaaggtgggcagatc

SEQ ID NO: 36594 - DNA, 201 bp, Homo sapiens
aaattttctgtgtgtccaaattccatggattagtggggttggttggttggttttttggctatatgtagctagaatagttatcaagttttttttttttttttcatgtcaaatgggtaatgtgctgacgttataatgaggtttgagggaggcacatctcacccatgtgcatgaataccagattgtcatacttgtgagctataa

SEQ ID NO: 36595 - DNA, 201 bp, Homo sapiens
gtaatccaacatctgttctggaaggtggccactgttactgtccctgttctcacatgaggaaatggaggcactggcgggcaggggttggcctaggagacacrgtacatggtgatgttaggattcaaagagggctggctgagcctagagtgttctcatcaccagatgggttccaccttagtcattccttcttgtcaaaatgca

SEQ ID NO: 36596 - DNA, 201 bp, Homo sapiens
  misc_feature (1)...(201): n = A,T,C or G, or insertion/deletion polymorphism (see Tables 1-2)
gtggtggtgggttgacatggaggttgttttgattttgtggttgaaggtcagtaggaggctgggggagagggtggtggtagctgggagggagaacagggtcnggtatagattgttaatgatgaagatcccatccctgatgcaaataatagctactggatgaatctgctgggttgttttggtctctttccaggtgagatttat

SEQ ID NO: 36597 - DNA, 201 bp, Homo sapiens
aaatctgattcatggtgtttctaatacatggtattagaaactgcacagaagcatgtggcaaggcctggacttgaacatgacactcagcctttggtgggctkgtgactgccaactggcagtccagagggctcatttggagaatagctctacaaattccccgggaaagcattccctcaagtcgtttcaggacatgggagctca

SEQ ID NO: 36598 - DNA, 201 bp, Homo sapiens; identical to SEQ ID NO: 9452

SEQ ID NO: 36599 - DNA, 201 bp, Homo sapiens
attgatgcagtcatggtaagcatctgaggtcttggttctgaaaaaccttagaagactggattaaaagctgacttattttagggtttttttcagtggcggtytgcaggatatctcactcagatgttccagggcagaaagccagttctaatagacttcaaatatctgcagaaagcgtggacctgacttgagttccacctctgc

SEQ ID NO: 36600 - DNA, 201 bp, Homo sapiens
agtttgtatgttctccccgtgtcgccccatccatggaggagttgaagtttggaggaggggagagtggtactccctgtcgtcaactcctcagcagaactgayagttgttgggctgcagcaagggctgggcgatatccccttgctcgcagcaggtcaggtgctcactagagctctcctcctccagctcactgctgctgctgcc

SEQ ID NO: 36601 - DNA, 201 bp, Homo sapiens
tggcttcggccctgaagctgattgctcatcttcctgggaagaagcgagtgagaactgtacactctctgcagactggcttcctaattaaccctgcgcccccsacccttcatctcccaggtggtctgcggctccaagtatcttgtgcgaggtgagagtgcccgtgaccatgtggacctgcttgcctcttcccgccactggccg

SEQ ID NO: 36602 - DNA, 201 bp, Homo sapiens
gatcctcctgcctcagcttcctgagtagctggtactataggcatatgacatcataccatcatacctggctttaactgaaacagctttttttttttttttttgaagatagagtcttgctctattgtccaggctggatagcacgatctcagctcactgcaacctctacctccctggttcaagtgatccttatgtctcagcctc

SEQ ID NO: 36603 - DNA, 201 bp, Homo sapiens
tgttcttgtaactgaagacccttatttgtatcaatggttctcaactggtaacaattgtgcccgcaatgaacaccagaagccaattccacttttaactttgkctggcttttcctggaaaaataagaataccttgtataccttgtatgcaaatatgtatgtgtgtgtgtgtatatatatttttcccattttttttttaacaca

SEQ ID NO: 36604 - DNA, 201 bp, Homo sapiens
gtgacttcatttaaggacagaagtaggaagggagcagcatgccatgggctctggcaggatggccatggcttcggccctgaagctgattgctcatcttcctrggaagaagcgagtgagaactgtacactctctgcagactggcttcctaattaaccctgcgccccccacccttcatctcccaggtggtctgcggctccaagt

SEQ ID NO: 36605 - DNA, 201 bp, Homo sapiens
tataaagattgtcccttcccccggactctgctattcatgtactgctgtcagattacttacacatctcttcttgtcagtctccctaaagcattaattagagwcttgctggtataggctctgggcagtattaaaactatgagttaccagtcctggatactggatttggaaagagaatctttattaaagcatcctgtagaaaga

SEQ ID NO: 36606 - DNA, 201 bp, Homo sapiens
gaattgtggtacagcagtcactaagacgccagtcgtcaaaagtggtgtgcagcctgaggtcactctggggacaactgacaatgacagtcctggagcagacktaccaacaccatccgaggggacaagtacctccagtccactccctgctcctaaaaaacctacagggtaagtcagtgtgtttgtataatatagggctttgga

SEQ ID NO: 36607 - DNA, 201 bp, Homo sapiens
caaagtgctgagactacaggcatgagattacaggccatacctggcctgttttgtttttttgagatggagtctctcactgtgttacccaagctagtcgacarctcctgggctcaagcgatcctcctgcctcatcctcccaagtgcctgcaactacaggcacgtgccaccgcacccagctggtgtgtattctattttttgcca

SEQ ID NO: 36608 - DNA, 201 bp, Homo sapiens
ttccctctcctgcagtaaataagctctgtgcacttgacttggaatttttctccatgttaactcactcttaggggctattatgtgttagaatctgagaatgctttaccaaagagctcttaagaggtcacctgttactggctcttttttttttttttttttttccagacagggacagggtctcgctctgtcacccaggcatga

SEQ ID NO: 36609 - DNA, 201 bp, Homo sapiens
ttaccagacaagcctggtaattgaagagaccttggtgaatggctcaccagacctccccactggaagcctggctgtgccccacccccaggttggggagagtrtatcagtggtaacagtcatgagggtaagtggctttggtactgaagtctttggctttgtctggagttacttaaagggcagctagcaccatacagtgtgatt

SEQ ID NO: 36610 - DNA, 201 bp, Homo sapiens
taaaaaatgccaacatttggttgatgaaacctggagaagcttttcaataagaattcattagaagatgaacagttttattcaaacgaaggcatttaatgctrtagtgaaaggaacctgtagccagaaaacttagattcaggctagttttacacttgagatcttaagttaacttcttcctttcatggaccttagtttccttat

SEQ ID NO: 36611 - DNA, 201 bp, Homo sapiens
  misc_feature (1)...(201): n = A,T,C or G, or insertion/deletion polymorphism (see Tables 1-2)
tgaggaaatggaggcactggcgggcaggggttggcctaggagacacagtacatggtgatgttaggattcaaagagggctggctgagcctagagtgttctcntcaccagatgggttccaccttagtcattccttcttgtcaaaatgcattctcatttctcttctagagtgtgtcctgcccagagctcttggaccagcattat

SEQ ID NO: 36612 - DNA, 201 bp, Homo sapiens
aaagtgtgattcaaatgaagatgacactgctgttgacaggggctgaccttatctgaattaggtcaagagagtagagtttttccagtcccttttgcaggaaraaaaaagaacttacacatatatatatatctttctctctccatgtggtcttagtccatttatctctgcttgtctcccccttcctggcttcctcatcctcag

SEQ ID NO: 36613 - DNA, 201 bp, Homo sapiens
catctgttctggaaggtggccactgttactgtccctgttctcacatgaggaaatggaggcactggcgggcaggggttggcctaggagacacagtacatggwgatgttaggattcaaagagggctggctgagcctagagtgttctcatcaccagatgggttccaccttagtcattccttcttgtcaaaatgcattctcattt

SEQ ID NO: 36614 - DNA, 201 bp, Homo sapiens
attattgtcattactccctggggctcactggctccatgagcatgctggggactccagaaaagtgtcttaacctcagtcagagcctgatctttctgctcccytgcagccactggcctgaatggaccgggggcaataatagcataagtaatccaacatctgttctggaaggtggccactgttactgtccctgttctcacatga

SEQ ID NO: 36615 - DNA, 201 bp, Homo sapiens
  misc_feature (1)...(201): n = A,T,C or G, or insertion/deletion polymorphism (see Tables 1-2)
tagatgtcagaactgataattaggaagaagggaagaataacaaaggttgagtgccccagccaggatgcattataggaagtgaaggcctctggctttgcctnggaggagtcattattgtcattactccctggggctcactggctccatgagcatgctggggactccagaaaagtgtcttaacctcagtcagagcctgatctt

SEQ ID NO: 36616 - DNA, 201 bp, Homo sapiens
accatggataacactgtatggcatgcctgttgtgatctgaagatacactggtttagaaaacactcatcttatccaaccctctccttttattaaaaggggawgctaaggcccagaggaggaaatggacttttccgggtcccacagcagattagtggcagagcccttgtctctgtgtcttggtatattgtaccagacagtatt

SEQ ID NO: 36617 - DNA, 201 bp, Homo sapiens
tattattattttttaaattatataaaattaaaaaaaaaacttaatgaactcttccattttttttttctgccaattacctgactttaggaatgaacccagcwgggcacagtgtaatcccactcatgcctgtaataccaacagtttgagaggccaaggtgggcagatcgcccgagtccaggattttgagaccagcctggccaa

SEQ ID NO: 36618 - DNA, 201 bp, Homo sapiens
  misc_feature (1)...(201): n = A,T,C or G, or insertion/deletion polymorphism (see Tables 1-2)
aggtgaacaacttagggcttttaggccctgtatggcagtatgtcaccctctttctagacacacagaagtagcctttgaataatgtaaaactaaatgtaaanctaaaaaatgccaacatttggttgatgaaacctggagaagcttttcaataagaattcattagaagatgaacagttttattcaaacgaaggcatttaatgc

SEQ ID NO: 36619 - DNA, 201 bp, Homo sapiens; identical to SEQ ID NO: 9447
  misc_feature (1)...(201): n = A,T,C or G, or insertion/deletion polymorphism (see Tables 1-2)

SEQ ID NO: 36620 - DNA, 201 bp, Homo sapiens
cagtcactaagacgccagtcgtcaaaagtggtgtgcagcctgaggtcactctggggacaactgacaatgacagtcctggagcagacgtaccaacaccatcygaggggacaagtacctccagtccactccctgctcctaaaaaacctacagggtaagtcagtgtgtttgtataatatagggctttggaaatgccccatgttt

SEQ ID NO: 36621 - DNA, 201 bp, Homo sapiens
tgagtttccagctaaggaaaaatagattttgaaaaagcgacttactaaattcacacagccaattatcccattgccttttccactaaaccacacttctcagkcattgctgtgctgtttagctgcagaatgtaagacaagcttgtccaacctatggcccaggatggctttgaatgaagcccaacacaaattcataaactatct

SEQ ID NO: 36622 - DNA, 201 bp, Homo sapiens
actacctggtcttcccaaacactggagcaattttcggagcttctggaaccaatgtttcttcagcaccttcgctatcttcctgatggagatcatatgaaatsttcccatattctcttaaaaatgggaaaatttcaagcagaaactggcagaagtctctgcgaataccaaaccaccaatgattgcccctttttggcctaaatg

SEQ ID NO: 36623 - DNA, 201 bp, Homo sapiens
cacattgggatgagtacactgtctgttattaaacttaatccaggcttccagtgttgagtggcctgggtgttctttattactctgtttcagtgaaactgtcyttctcttcattgcccataggattccagtgagagtagctcctctgcaccagccacacagttcatcatgttgcctctgcctgcctactcggttgtggagaac

SEQ ID NO: 36624 - DNA, 201 bp, Homo sapiens; identical to SEQ ID NO: 9454

SEQ ID NO: 36625 - DNA, 201 bp, Homo sapiens
  misc_feature (1)...(201): n = A,T,C or G, or insertion/deletion polymorphism (see Tables 1-2)
attaattaaccctttccctattgatgggcatttagttgtggggtttttgttttgcctttttcaagatatataacttgaataaaatagagatggggctttgntatgttgtccaggctggtcttgaactcctgggctcaagcgatcctcccaccttgggagactacaggtctcccaaagtgctgagactacaggcatgagatt

SEQ ID NO: 36626 - DNA, 201 bp, Homo sapiens
gcttcctgaccgacttgttccttggcgagagagaacagcggtgagtcaggagcaggagcgggcaggagcgggcggaccgcagctccgcaccacctatgacygtgtcttcctcaaagagcaaaacattatatttttttgtgtgtgattattttatttttatttttttaggctcatcagctattgttagtgttagtgtatttt

SEQ ID NO: 36627 - DNA, 201 bp, Homo sapiens
tctctgaagccatcagtgtattcacaatgtattccccaaaaaggcagttctctaactgcagtggggagattgaactggatagtagtcagaatcttccttgrcctttcttgaccaatgcgaaacaggtctcaaatgaccatatttcctgtgcttatacatgaaagactgtcagtgatcactgtgggcttatccctccttcag

SEQ ID NO: 36628 - DNA, 201 bp, Homo sapiens
cctttcctttagccatggacgcatcatatgatggtactgaggtaactgtcgtgatggaggaaattgaggaagcctattgttacacctctcctgggccaccyaagaagaagaaaaagtataaaatacatggagaaaagacaaagaaacccaggttagccaacacattttggttgctgctagcatttataaacagaagttgct

SEQ ID NO: 36629 - DNA, 201 bp, Homo sapiens
agaaaaagtataaaatacatggagaaaagacaaagaaacccaggttagccaacacattttggttgctgctagcatttataaacagaagttgcttggagagytgcattgaggaaaacttttaagactctttgaaaaagagtgttatgattgaagtcctgtgtcgagggatggggagtgggaagtggagggatttctgccagc

SEQ ID NO: 36630 - DNA, 201 bp, Homo sapiens
aaatcatttccattgtatatagtttgtttaaaaaatacaaaagaaaaatggaataaattgttatccaaactcatataccatccaaagaaaagccattattracattttggtgtacttctttccagtctttttttctgtgaataagttctgtatctgtttttttcttcttctttcccttcttttttttttccagtagagatg

SEQ ID NO: 36631 - DNA, 201 bp, Homo sapiens
catttaaacctcagtagtaataatacgtacttaatacgattgctgagagtattaaatgaaatattggtaaagtgtttagcattgtgtggtgcctagctcartgcatagcaactatcactttcttcattcttctggtacctaactgtaatgttgggcaattgtctttccccatttgaacttagtttctccatttctaaagag

SEQ ID NO: 36632 - DNA, 201 bp, Homo sapiens
tgcactgtcacattggtaagtatgcagctaggtggtggtgggttgacatggaggttgttttgattttgtggttgaaggtcagtaggaggctgggggagagrgtggtggtagctgggagggagaacagggtcaggtatagattgttaatgatgaagatcccatccctgatgcaaataatagctactggatgaatctgctggg

SEQ ID NO: 36633 - DNA, 201 bp, Homo sapiens
ataggaagaacaggcgattttacagaggaagaaactcagggcccaagagttaaggttccttaccaccaggtcactcagtgtattagtggcaaaattggaasccaaagcctggtcttcctctttttggtgccataccacttcacgctcatccttgacttaataccactgtcataattggaagccataattgaagccttttcc

SEQ ID NO: 36634 - DNA, 201 bp, Homo sapiens
gaaagccagttctaatagacttcaaatatctgcagaaagcgtggacctgacttgagttccacctctgccagcactgggggagggcttggtgcagagctggyttccactgtttgctgttttgtgggcctagccttggcctctggtgactggcggcagcaccctcccaccagcactgttgtctcttgcaggcagtggcagtgc

SEQ ID NO: 36635 - DNA, 201 bp, Homo sapiens
  misc_feature (1)...(201): n = A,T,C or G, or insertion/deletion polymorphism (see Tables 1-2)
gctattgggcctttgagtgcctcactgtccgagactacaatgacatgatctgtggcatctgtggtgtggcccccaaagtggaaatggctcagaggagtgangagaatgtgctagcactgaagagcgtggaggtaagtgcctcttagccaccgtgagggacctgcggaattttctcattttggcacctcccttcctatatga

SEQ ID NO: 36636 - DNA, 201 bp, Homo sapiens
tcaacagaatttgggtgggtagaaaaggaaagagaggacattattttagtgaaaatggcttaggttaggttcgtgattatcacatgtttaactcagcatgytccaaacttgtatgtgtagaaaaaccttgtatagcagcataccttaaacttctctggggcaattttcacatctctttgagaaatactgggatggtgactt

SEQ ID NO: 36637 - DNA, 201 bp, Homo sapiens
tcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggtg

SEQ ID NO: 36638 - DNA, 201 bp, Homo sapiens
gaagaagtggagacaggcctcatctccacataggtgtccacaccctggctggagaagccactgtccctacataggagagagggttggggggcagaggtcastcatcatcactgcactgctcagctcaggccttgaccacccaccaccccatggtcaactggaacctccctttctgataagaaaccctcctgccacactcca

SEQ ID NO: 36639 - DNA, 201 bp, Homo sapiens
gtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgaggt

SEQ ID NO: 36640 - DNA, 201 bp, Homo sapiens
ttcctgcttggtgtggccagccacatgccaaggtcccctgccttctagcccagaatgacgggactgggcagaacacccccaacttttagctgccacttggstcattacagcagtaccagtatgggggtgggaggggtgaggctgtggagtgaaggcggcgtatagggcagagactaagaggtcctgtgagattcttagagg

SEQ ID NO: 36641 - DNA, 201 bp, Homo sapiens
gaaagacgttccagggaatttgcaggtactcatgtggcacaaagaaccagaggctgactgcattaatgctgttagtttaatgtggacagagacatcccackgcgtgactgttagttaggatgagtcagcttgggggagtttgtgcttcctgcttggtgtggccagccacatgccaaggtcccctgccttctagcccagaat

SEQ ID NO: 36642 - DNA, 201 bp, Homo sapiens; identical to SEQ ID NO: 9446
  misc_feature (1)...(201): n = A,T,C or G, or insertion/deletion polymorphism (see Tables 1-2)

SEQ ID NO: 36643 - DNA, 201 bp, Homo sapiens; identical to SEQ ID NO: 9450

SEQ ID NO: 36644 - DNA, 201 bp, Homo sapiens
ttcccatacagggactgatccagctcagttttggggggctagacttaggtcactgggcaacctccggcatagctgcccacgggtcaggtgctaccccgtgrgctagggagggaggctgggtcttctctcagtattttttaagcaccctaccacatcctgggcatcagctgttgagggtataagggcgagcttgtataaaga

SEQ ID NO: 36645 - DNA, 201 bp, Homo sapiens
  misc_feature (1)...(201): n = A,T,C or G, or insertion/deletion polymorphism (see Tables 1-2)
taggagacacagtacatggtgatgttaggattcaaagagggctggctgagcctagagtgttctcatcaccagatgggttccaccttagtcattccttcttntcaaaatgcattctcatttctcttctagagtgtgtcctgcccagagctcttggaccagcattatactgtggacatgacagaaactgagcactctatccag

SEQ ID NO: 36646 - DNA, 201 bp, Homo sapiens
  misc_feature (1)...(201): n = A,T,C or G, or insertion/deletion polymorphism (see Tables 1-2)
tgaggctccaaggcccgctctgacccaggcagtttattcttttgctttgggtgttgggtgagtgtgtgatgctgagcaccagccgtggtcccttagcattngcccttatgtttttaatcttgtccttctactccaggaccagctctgcttctccttgttggccctctacgaatctgtacagaatggagctagagctatacg

SEQ ID NO: 36647 - DNA, 201 bp, Homo sapiens
  misc_feature (1)...(201): n = A,T,C or G, or insertion/deletion polymorphism (see Tables 1-2)
gtgtggaatcccctttggggcagaagactccaaggtgagtgtcaagggcagtggtggatatcggggcttctggagtaggctgattggtccactttttaggncagggatatgaatatctgtgatggcatctgccttggacacaaggtgctggcagtcagggatgcctaggagatggtcaacagctagatgtgacatgtatgt

SEQ ID NO: 36648 - DNA, 201 bp, Homo sapiens
  misc_feature (1)...(201): n = A,T,C or G, or insertion/deletion polymorphism (see Tables 1-2)
ccaatactatcctctaagaaagcactatgtagagattgcgctttggttttcttccctttgttccagaatttccagatttctcttcttattcttttcagagntgacctgcttacccctgggtccagagctccagagcttaaaggcagagcacggggcaagccctcattactggctgcagcaagacccatgagagcaattttg

SEQ ID NO: 36649 - DNA, 201 bp, Homo sapiens
gacttctcaggtgaaagttgtggaggtcaagcccgatatgtttcctccatataagtacagctgcactgtcacattggtaagtatgcagctaggtggtggtrggttgacatggaggttgttttgattttgtggttgaaggtcagtaggaggctgggggagagggtggtggtagctgggagggagaacagggtcaggtataga

SEQ ID NO: 36650 - DNA, 201 bp, Homo sapiens
tcctgtcttttacttcccaagtaagaaaccaggcaactaaaccattttgtttgtgttatctcatctagaggctgtttccagattgattcaaatccgcttgyctagtagtagtgttaataataatgcagctaagatttattgagcattttattactatgccaagttcttaatctgtgctaagtgctttactatatgacttaa

SEQ ID NO: 36651 - DNA, 201 bp, Homo sapiens
tccagtgaataagtatcaaaaaatatatatagtaaatatattgaacataaactaaatgcatgttttagacacctgggagatagtagttaaacaaagtttckgtcctcatggagctcactttctggtttggaggacacaggaaacaaatatctgtccaggagtagtgagtgctgtgaagcacagtaaagctgggtaagagag

SEQ ID NO: 36652 - DNA, 201 bp, Homo sapiens
ccagacctcaggttctagctcacagtttcatatggcaagaccagtgctctttccagagttcagtccatgctgtttcctgtgtgactgagtgaataagctayattggctaaagtgtgattcaaatgaagatgacactgctgttgacaggggctgaccttatctgaattaggtcaagagagtagagtttttccagtccctttt

SEQ ID NO: 36653 - DNA, 201 bp, Homo sapiens
gtcatccatattgtgtttatcagtgatttattcctttttattgtggagtagttttctgtggtgtggatgtaccacaggttgtttagctgttccccatgggrggatatttggtttgctaccggtgtttggcagttacaaatagagctgctacaaatatttgtgtaccagcttttgtgtgaacctaagttttcatttctcttg

SEQ ID NO: 36654 - DNA, 201 bp, Homo sapiens
  misc_feature (1)...(201): n = A,T,C or G, or insertion/deletion polymorphism (see Tables 1-2)
gccttcttgatacttagaagacctggcctggagtcccagctttactgtttactaattttgtgtttagggaaagtttacctccctgagtttcatcctaaatnttctcatttgttaaatgggaataataatcttatctaacataatagtgttgtttttaagataaaatcagataatgtgtttgaaaacattttctaaacctga

SEQ ID NO: 36655 - DNA, 201 bp, Homo sapiens
ggatcctgtaagtaatttttttttccagctattttttccactggttcagtgatgaaggccttgggaaaaccaagccccttgttctgtttccttttcttttyttgggaaaagtttcatcgttttatccttcttgactctgggcttgcttgtttccattttgataatgccctgcactctcttgtcctcttcggttgcagcaat

SEQ ID NO: 36656 - DNA, 201 bp, Homo sapiens
gggctcatttggagaatagctctacaaattccccgggaaagcattccctcaagtcgtttcaggacatgggagctcaggagtttggctaaggttcaaaagcrctaaataatttgttctgatccacagctaccaagtggcccatccaacaggacttctcaggtgaaagttgtggaggtcaagcccgatatgtttcctccatat

SEQ ID NO: 36657 - DNA, 201 bp, Homo sapiens
cagatacttgtttatgtatcaaaactatcattcatagagccttcattgcaccataggcattgtgctaagtgctttacttataatatcttacttaatctgtrtaatggctctaagagattactatttttatgccccatttcacagatgaggaaattgagactcagaaagattaagtaaattgccttgggtcccacatacaca

SEQ ID NO: 36658 - DNA, 201 bp, Homo sapiens
tcgacttcttgcttttgatttattgaagaatccttttgtagttgactttagtgttcattttaaaagatacttctgaaatttttttttgttctgtttaattktaggtctcatttaactgttcactttgaacttttctgttttccttattgggtgcctttaagtttaaattgaaaaaataaaacataaatgactttttcttgg

SEQ ID NO: 36659 - DNA, 201 bp, Homo sapiens
  misc_feature (1)...(201): n = A,T,C or G, or insertion/deletion polymorphism (see Tables 1-2)
cagtgatatgccttctagtctataaaatgagtatcattcaggccttccaggtttctttgtgcttggatttgttaagtccaggccatgctgtgtgtatttgncaccatttagtcttgttctcctaacatggctgcttcaaagggtggcttgagaatgccatttccccattacctctccaataaaggctccataaaagattca

SEQ ID NO: 36660 - DNA, 201 bp, Homo sapiens
agtaatttttttttccagctattttttccactggttcagtgatgaaggccttgggaaaaccaagccccttgttctgtttccttttctttttttgggaaaastttcatcgttttatccttcttgactctgggcttgcttgtttccattttgataatgccctgcactctcttgtcctcttcggttgcagcaatacgtggagct

SEQ ID NO: 36661 - DNA, 201 bp, Homo sapiens
tccttatttgttgcctcagtgctgtttatgataatgaagcgtgcaactagccggttgttgttgttgttggttggttttttttggtttttttttttttttttgagacggagttttgctcttgtcacccaggctggagtgcagtggcacaatctcggctcactgcaacctccacctcccgggttcaagagattctcctgcctc

SEQ ID NO: 36662 - DNA, 201 bp, Homo sapiens
tttgccttggaggagtcattattgtcattactccctggggctcactggctccatgagcatgctggggactccagaaaagtgtcttaacctcagtcagagcktgatctttctgctcccctgcagccactggcctgaatggaccgggggcaataatagcataagtaatccaacatctgttctggaaggtggccactgttactg

SEQ ID NO: 36663 - DNA, 201 bp, Homo sapiens
tcaggaataagattataacttattataacaccatctgaggatgttatttaaatgtttgtttgcttgactttcagtccctatttagataaatgcttagaaakgagaagctaggttttatcaacctcttgactacccatatcttagcatagtagtacttactggttgaatgaagtcctgggtcgagggatggggagtgggaag

SEQ ID NO: 36664 - DNA, 201 bp, Homo sapiens
aagagctacattatttattattatgccattgttgttatttaaacatttaaaacaaagcattaataaaattacaaaattagaaataaggctgggcgtgatgkctcatgcctgtaatcccagcagtttggaaggctgagacgggtggatcacctgaggtcaggagttcgagaccagcctgaccaacgtggagaaaccccgtct

SEQ ID NO: 36665 - DNA, 201 bp, Homo sapiens
agtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgagg

SEQ ID NO: 36666 - DNA, 201 bp, Homo sapiens
tagtcttaaaccagtaaagaggtacatgagatattcagaaaatcaacttaaattcattattatagaataattttaattttgtatgctttatcttttctttcttttttttagctatataagtaaaatatacattccttataaaacatttgaggccaggcatggtggctcttgcctgtaatcccagcactttgggaggctgag

SEQ ID NO: 36667 - DNA, 201 bp, Homo sapiens
actttggctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagtc

SEQ ID NO: 36668 - DNA, 201 bp, Homo sapiens
gactctgaatgcacttaagtcaccagtttggctcctggttctctcagataagactccctctgtgaggacttgtggtctgaagccaagcacactgaagcagytgggccagcccattcaacagccatctggccctggtgaggtgaaggtaaggcccattttccagagtgggagctgtttgagggtctggctgcttccatttaa

SEQ ID NO: 36669 - DNA, 201 bp, Homo sapiens
aactttggctggcttttcctggaaaaataagaataccttgtataccttgtatgcaaatatgtatgtgtgtgtgtgtatatatatttttcccattttttttttaacacaaatcatagcacaacatacatacttctacatcttgttttttatttttatgtttatttttattgtttgagacaggatctctctttgtcattcagt

SEQ ID NO: 36670 - DNA, 201 bp, Homo sapiens
ttaaaagcatatgtgtgtatatataatactattatttccactgcagtgctaattggataaaagctaagacaccaaggactttttaaagccaggtctagctraaatagcagctgccatttttagtgagtttgaatatttgtagcacataataatgcatgagttaatttgatccagtgcaaagtatgtgacatatgtgcaagt

SEQ ID NO: 36671 - DNA, 201 bp, Homo sapiens
cagcctttatgtttcctagtttacagtgccctttatgatatacatggtgggtagaaaacctttctgaagacaaccactatttaaaaacatttttaaaagcrtatgtgtgtatatataatactattatttccactgcagtgctaattggataaaagctaagacaccaaggactttttaaagccaggtctagctaaaatagca

SEQ ID NO: 36672 - DNA, 201 bp, Homo sapiens
agagctcttaagaggtcacctgttactggctcttttttttttttttttttttccagacagggacagggtctcgctctgtcacccaggcatgaatacagctmatgcagcctcagcctcctggggtcaagtgatcctgccacctcagcctctcgagtagctgggaacacaggcacacaggctgcataccaccatgcctggcta

SEQ ID NO: 36673 - DNA, 201 bp, Homo sapiens
ctttggattgttctaattaacaattgttacaatatttttgacattttggatagcaactgctccaaggatagatgatgaaatcccccctccacttcctgtayggacacctgaatcatttattgtggttgaggaagctggtgagtacagttcagtaagtataaaataaagtgtgggatgggcatggtggctcatgcctttaat

SEQ ID NO: 36674 - DNA, 201 bp, Homo sapiens
taagtactacacttgtgtgtattacctagcatgtaagaaataagacaatttattgataagacaaattctaaggactaaacaaacccaatgaccaatgacaygtgaacctcttgtactttactgcattttcattttcaaaaggaattaatataatagtaatactcagcaccatataattaaatgcttatgtcagtagaatac

SEQ ID NO: 36675 - DNA, 201 bp, Homo sapiens
gtgagaggaggacttgaacccaggaggtcaacaccgcagtgagccatgtttgtgccactgcactccagcctgggtaacagaataagaccctaacttaattmaaaaaaaaaaaaaaagattgaggccaggcactgtggtacacacctgtagtgtcccagctacttgggaggctgaggtaggaggactgcttgagcccagaag

SEQ ID NO: 36676 - DNA, 201 bp, Homo sapiens
cttctgtgcaccttacacagggttagaataggcaggatgtatgagaaagagtactacttaatgcttatattcaaatagagtagataaaattaatactcacrtggaaccactaagtgataatctgtgtggcactgactgtaatcaccaggagtctgggaaaacaggatggcattactggagtggttaggaaaggtttcgctg

SEQ ID NO: 36677 - DNA, 201 bp, Homo sapiens
cagctcatttctgaattttggtatgtgtgttattttactgaagagttaaaaaaattacctaaattactcatttacagtataactgattcaactttaaatawgattttaggttgcatgtataggtccttatgtttatattcttttccatgcaatttatctttttatttttaaccttaactacctcttaacatctcacacaga

SEQ ID NO: 36678 - DNA, 201 bp, Homo sapiens
  misc_feature (1)...(201): n = A,T,C or G, or insertion/deletion polymorphism (see Tables 1-2)
gtgtctactatgttccaggcattctgtaaggcacttggtatatgatggtgaacagaacagatatgggctctgcctttgtggaatgtaagtttggtgagggnttccaacattaaacaaacaacattaaacaaaatttggttgaccatattcacaaatatatacttaataacacatgataaatgctatgaaggaaaacaaaag

SEQ ID NO: 36679 - DNA, 201 bp, Homo sapiens
  misc_feature (1)...(201): n = A,T,C or G, or insertion/deletion polymorphism (see Tables 1-2)
tttctctaacaccatctccagcctctcactagggaccatctagtcctacattttcatttactcacaggacacttaaaacacatttcttggctgagcgcagnggctcacgcctgtaatccccacactttgggaggctgaggcaggcggatcacttgaggtcaagagttcaagaccagcctggccaacgtggtaaaaccctgt

SEQ ID NO: 36680 - DNA, 201 bp, Homo sapiens
tgtgattatgccactgcactccagcctgggtaacacagtgagaccatctcaaaaaaaaaaaaaaaaggaagcggaggactaggtgagaacagggtattatytgtagtcaccccgtgtaatttctgttcccctttagggagtttatggacccaaggcttatattgccacccagggtcctttatctacaaccctcctggactt

SEQ ID NO: 36681 - DNA, 201 bp, Homo sapiens
ctcaggtctccttatgctctgcagctctgtcctgaacggagtcagaaccagaagataataaaagggttgaggtagaatgttttgccagtggaaaaggaaarctctttagagatagcttcttacctcatttctctaggaagattaatttttcttggaatcttattacagaagctgaaaaggcaatctaccaagtacaaggca

SEQ ID NO: 36682 - DNA, 201 bp, Homo sapiens
ttttagtcagaatcacaatgccattcttgtccaaggaaatgaaagttctcagccaggtgtactctgggaggccaagaggggtggatagcttgagcctaggsgttctagaccagcctgggcaacattgcaaaaccctgtctctacaaaaaatacaaaaattagctgggagtggtggtgtgtgcctgtagtcccagctactga

SEQ ID NO: 36683 - DNA, 201 bp, Homo sapiens
acttctgccttcaataaagatgatatactgatttttggatgttctcacactgaattaggcacttgggtagacttgtacccattgagaggttatgcaagctsaaatgtggaaagtttttctagaagagcctgcctttcagggccaaaatgccacaggcacagcataacttcctgaaacaaatttatttcctaagacattggt

SEQ ID NO: 36684 - DNA, 201 bp, Homo sapiens
gctgggactacaggtgtgtgtcaccatgcccggctaattttttgtgtttttagtagagacaaggtttcactgtgttagccaggatggtctctcgatctccygacctcgtgatctgcccaccttggcctcccaaagtgattataggcgtgagccaccatgcctggcctttttttttttttttttttgagacagggcctcact

SEQ ID NO: 36685 - DNA, 201 bp, Homo sapiens
aggtggattgcttgagcccaggagtttgagaccagcctgggcaacatggtgaaatcccttctctactgaaaatatgagaactatccaggtgtgatgcttgygcctgtggtcccagctttcaggaggtaaggctgaggtgggaggtgaggctgaggtggaagaatcacctgagcccagaaagttgaggctgcattgagctgt

SEQ ID NO: 36686 - DNA, 201 bp, Homo sapiens
atttttaaacatttaaatgtattttcttttcttataccttaaacttctctgagcatctgcatcattaaaaaacagagcgagactccgtctcaaaaaaaaaattaattaataaaaacatacccttattttcagggattgtaacaatatcgtcatgtgccatctggtggcagtttcttgtaataccatttaaaatgtttaata

SEQ ID NO: 36687 - DNA, 201 bp, Homo sapiens
aagaaaaacagatataaggatattttgccctgtaagttccatttctctctataaactcatactttctcccaaattcaatcattactatctctttgtacccmttgcttactgatcctgatcttggaacatggcattgacaacttagtttgtactatttatgactgcaaaagaatattcattcattcattcattcattcactc

SEQ ID NO: 36688 - DNA, 201 bp, Homo sapiens
aaaaagtagcaataatttattaacaaaatattgaaaggaatattttcccctttaatttgatagataattcctgagaacttcagtgttttcagtttgatccrggaaatgcggacacagaggccttcattagttcaaacgcaggtatgaactatagtgaatggatcagaacatgtgtctgagtcttgctccatctgtttaatg

SEQ ID NO: 36689 - DNA, 201 bp, Homo sapiens
cagctgttttagtagacatatgatttctgttagttcttgtgaaatactaaaaataggtcaaagatttctatttctactttttcagactcccaggaagtctrtaatttatatatcctttaatgtttgttttcccatctttggagattccaataatgtaggggttgaagcccaaaggggttagacgcacctaacctaaggtga

SEQ ID NO: 36690 - DNA, 201 bp, Homo sapiens
cagctctgtcctgaacggagtcagaaccagaagataataaaagggttgaggtagaatgttttgccagtggaaaaggaaagctctttagagatagcttcttmcctcatttctctaggaagattaatttttcttggaatcttattacagaagctgaaaaggcaatctaccaagtacaaggcagacaaaacctatcctacaact

SEQ ID NO: 36691 - DNA, 201 bp, Homo sapiens
agtaatctgcctgcttcggcctcccaaagtgctaggattacaggcgtaagccaccacacccagcctcaactttaatcttatgaatataagacacaagggcrtaaatgtgcaggtttgttgcatgcatgccactgaataatcccatcacccaggtagtgagcataatacccaataggtggtttttcagcccttgcccctctt

SEQ ID NO: 36692 - DNA, 201 bp, Homo sapiens
  misc_feature (1)...(201): n = A,T,C or G, or insertion/deletion polymorphism (see Tables 1-2)
gctcagatataacaccaatttaccattacgtgctctagagtccattgccattttctctaactctgaatatcccaatatttttcctgtatcccttgtcctgngtcaaattcctttcattccttattttactgtctgttcagaaaatattaagataccaatgtaatattacttacttccttacaaaggatgttgtaaaagtat

SEQ ID NO: 36693 - DNA, 201 bp, Homo sapiens; identical to SEQ ID NO: 9467

SEQ ID NO: 36694 - DNA, 201 bp, Homo sapiens
ggtccccagacaagaagcatcagcatcacctgagaacttgttagaaatgcaatatatattgggctaagatatgttattaaaattaatttcacctcttttcrgttttgaatgtgtctatttgaaaatttaggccgggcacagtggctcacgcctgtaatcccagcactttgggaggccgaggcaggtggatcacgaggtcag

SEQ ID NO: 36695 - DNA, 201 bp, Homo sapiens; identical to SEQ ID NO: 9469

SEQ ID NO: 36696 - DNA, 201 bp, Homo sapiens
gataatctacagtaataaaagttatgtgaggccaaggaaggtggattgcttgagcccaggagtttgagaccagcctgggcaacatggtgaaatcccttctytactgaaaatatgagaactatccaggtgtgatgcttgcgcctgtggtcccagctttcaggaggtaaggctgaggtgggaggtgaggctgaggtggaagaa

SEQ ID NO: 36697 - DNA, 201 bp, Homo sapiens
ttcaacctgtgagggagaaagcttatgtgaaatgaaagcattagctggtttaatgctgtcagacttgaaagaaggctgatccatgtaaatgcataaagatmccagaagtatggaacctagttatataaatagcaatactaatttaataaaactataccccatttcaaaaacgaatttcatttcaggcctacttttaagagt

SEQ ID NO: 36698 - DNA, 201 bp, Homo sapiens
tttaaagagtcaagcaaagcattgtattcctgagaaaaatcacactctccaagcagactcttattctcctaatttaccaaaaaggtgagtacaattttatwtatctaaatgttgactaattgtgtctgggagatgaatctcatgcttatacatcattgtgatgctaggaagcggcctgtttggggtatggtgtcatcatta

SEQ ID NO: 36699 - DNA, 201 bp, Homo sapiens
gggccgagatcacacgactgcactccagcctgggtaacagagtgagactctgtctcaaaaaaaaaaaaaattacaatcacactctatttatgtatcacaaycttttaacctaccccagaatacccatacttgttcactccattaggaatgctcttcccttctcctagcccaaatctctcactgcctacaatattaatttca

SEQ ID NO: 36700 - DNA, 201 bp, Homo sapiens
atttttagtggagatggggtttcaccatgctggccaggctggtcttgaactcctgatttcgtgatctgcctgcctcggcctcccaaagtgctgggattacrggcgtgagccaccatgcccagccctgatttttctttcttaaagaaattagccagatgtggtggctcacccctataatctccgcactttgggaggctgagg

SEQ ID NO: 36701 - DNA, 201 bp, Homo sapiens
cctccaccaatttttttttatcatcaccattaacaaatttgaatgtgcttttttttcttgaatcttctttccccttccctactctccttctcttccagttctggcatagttttctaggttggtaattttttcttttttaaattgagatggagtcttgctctgtcacccaggctggagtgcagtggcacgatctcagctcac

SEQ ID NO: 36702 - DNA, 201 bp, Homo sapiens
agtcttctgcctcagcctcccgagtaggtgggactccaggcacgcatcaccatgcccagctaattttttttgtatttttagtggagatggggtttcaccaygctggccaggctggtcttgaactcctgatttcgtgatctgcctgcctcggcctcccaaagtgctgggattacaggcgtgagccaccatgcccagccctga

SEQ ID NO: 36703 - DNA, 201 bp, Homo sapiens
tcaccatattgcccaggttggtctcgaactcctgggctcaagtgatcctcctgccttggcctcccaaagtgctgggattacaggcataagccactgcaccyggccaatgtttggtactttctacccatcctaagatgctgtcatacaattggattatttaaaatttccagcagtctaacctcagatgtattttctttgaaa

SEQ ID NO: 36704 - DNA, 201 bp, Homo sapiens
acctcaagggatccactcaccttggcctcccaaagtgctgggattacaggcgtgagccactgtgcgcagcctttttttccaatttgaatgcttttttttttcttgcctaagaacaaaattaattaaaaaaattactttggctagaactttagtactatgttgaatagaagtggtaaaagttggcattcttgtcttgttttt

SEQ ID NO: 36705 - DNA, 201 bp, Homo sapiens
aaagaaacaagatataaagagaaccaaatggaaattttagaacttaaaaatacagtaactgaagcaaaatagatgggttcaacagcagaatagagggtacrgaaaaaagaattaatgaattgaaaagtagaacaatagaaattgcccagtctgagcaacagtgataaaatagactgaaaaaaaataaacagagctgcaggg

SEQ ID NO: 36706 - DNA, 201 bp, Homo sapiens
ccaggaggcagaggctgcagtgagccgagatcgcaccactgcactctagcctgggtgacagagtaagactctgtccccctccaccaaaaaaaaaaaaaaaagagttgtttacatgttgttgagttttaggagttctctatgtattctggatattgatcccttatcagatatgtgatttgcaaataccgtcttccattcagt

SEQ ID NO: 36707 - DNA, 201 bp, Homo sapiens
ttcccctttaatttgatagataattcctgagaacttcagtgttttcagtttgatccgggaaatgcggacacagaggccttcattagttcaaacgcaggtakgaactatagtgaatggatcagaacatgtgtctgagtcttgctccatctgtttaatggtgaggcatccaaaaacagctgactgctcagatataacaccaat

SEQ ID NO: 36708 - DNA, 201 bp, Homo sapiens
aaaacacactataggtaaatcaaaatggaattctaaaaaatgcaggaaagagaaagcatcaggaaaaagaaaagagcaatgagaaacagaaagaataaagrgaaaacaaaaaataaaatagcagaatgaaacttgaccatattaataattacattaaacatataagcctaaatacaccaatatttactggtggtagagtga

SEQ ID NO: 36709 - DNA, 201 bp, Homo sapiens
gactaaaagcatgagccatggtgcccagattttgctcattttttaattgaggctgtatgcggtggctcacgcctgtaatcccagcactttgggaggccgargcgggcagatcacttgaggtcaggagtttgagatcagcctggccaacatggtgaaatcccgtctctcctacaaagacaaaaattagccgggtgtggtggc

SEQ ID NO: 36710 - DNA, 201 bp, Homo sapiens
taaatatacaaaaattagccaggtgtggtggtgggcacctgtaatcccagttacgtgggaggctgaggaaggagaatcacttgaacccgaacctggtaggyggaggttgcagtgagctgagatagcatcactgcactccagcctggccaacaaagcgagactctgtctcaaaaaaaaaaaaaacaaaaacaaaaacaaaac

SEQ ID NO: 36711 - DNA, 201 bp, Homo sapiens
ccattaaacaataactccctattctcccctcccactggcccctggcaaccatccttctactttctgtctctatgaatttgactactgtaggtacctgataygggtggaatcatatagtatttgtccttttgtgtctggcttatttcacttagcgtaatgtcctcaaggttcatccatgttgtaacgtgtcacaattttctt

SEQ ID NO: 36712 - DNA, 201 bp, Homo sapiens
caaaacaataaaaagaatgaaaatataaaaaaataaaaaaggtaaaaacatgcttaaatcaaattaaaaaatacaaagcctcatcaaaaaaaaaaaaaaaagagtctcagcaaagaaacaagatataaagagaaccaaatggaaattttagaacttaaaaatacagtaactgaagcaaaatagatgggttcaacagcagaa

SEQ ID NO: 36713 - DNA, 201 bp, Homo sapiens
tgtgctattgattatacatggatgttgctaaaagatggggtgagtttctctcagcaggcacttcccatttgcttagtctactgctttcatacttagtaatkgtttggtttttcaaaacatctatcttcatgattcatcttttctagaaaatgtacttgtagacccactctgtcagatgattaaattagttcccaggtaggt

SEQ ID NO: 36714 - DNA, 201 bp, Homo sapiens
atatatatatatatatttattaaatataaaggattcattgaatcctaacagaaagaagatacctagttctgaaggccaggtttaggtgctaacggtttaawctatactagaaatcagactggtactattgcaacttctggagattcattagaagaccagagacatatcaaagatctggctacatcttggttctataaagga

SEQ ID NO: 36715 - DNA, 201 bp, Homo sapiens
tagccaggcatggtggcatgtgcctgtaatcccagctactcaggaggctgaggcaggagaattgcttgaacccgggaggcggaggttgcagtgagctgagwttgagccactgtactccagcctgggtgacagagagagactccgtctcaaaaaaataaaaataaaaataaaatacataaaggaaaagaaggaaatttttgg

SEQ ID NO: 36716 - DNA, 201 bp, Homo sapiens
attaatttcacctcttttcagttttgaatgtgtctatttgaaaatttaggccgggcacagtggctcacgcctgtaatcccagcactttgggaggccgaggsaggtggatcacgaggtcaggagatcgagaccatcttggctaacatggtgaaaccctgtctctactaaaaatacaaaaaaattagccgggcatggtggtgg

SEQ ID NO: 36717 - DNA, 201 bp, Homo sapiens
ggttctagaccagcctgggcaacattgcaaaaccctgtctctacaaaaaatacaaaaattagctgggagtggtggtgtgtgcctgtagtcccagctactgrggaagctgatatgggagaatcgcttgagcccatgaggttgagactgcagtaagctgagattgtgccacagcactccagcctgggtgacagaatgagaccc

SEQ ID NO: 36718 - DNA, 201 bp, Homo sapiens
tgagcccagaaagttgaggctgcattgagctgtggtcaagccactgcactccagcctgggtgacagagtgaaactttatctcaaaaaaaaaaaaaaaaaaagtgactgcttttggaactgaaatctttgaaattttgctagatatagagaaattttattcagcttaagctccacttccacttagaaaaaaaagcgatctga

SEQ ID NO: 36719 - DNA, 201 bp, Homo sapiens
aaattaggcacaataagagattagcaataatagctagtaatacaatagaacaattatgataatctacagtaataaaagttatgtgaggccaaggaaggtgsattgcttgagcccaggagtttgagaccagcctgggcaacatggtgaaatcccttctctactgaaaatatgagaactatccaggtgtgatgcttgcgcctg

SEQ ID NO: 36720 - DNA, 201 bp, Homo sapiens
gagtagctgggattgcaggcaaagttgcagtgagccgagatcgcgccactgcactctagcctggatgacagagtgagatcccatgtcaaaaaaaaatatatatatatatatatatatttattaaatataaaggattcattgaatcctaacagaaagaagatacctagttctgaaggccaggtttaggtgctaacggtttaa

SEQ ID NO: 36721 - DNA, 201 bp, Homo sapiens
cacttgtagatcactttgaatgtctatttatttatatcttatttaatttctttcagcaaagctttgtagttttcagtatacaagtcttttgcctccttggktaaatctattcctaagtattttattctttttgatgccattataaatataactgtttccttaatgttcttttcagattgttcattgctaatgtatagaaat

SEQ ID NO: 36722 - DNA, 201 bp, Homo sapiens
ccgagtagctgggattgcaggcaaagttgcagtgagccgagatcgcgccactgcactctagcctggatgacagagtgagatcccatgtcaaaaaaaaatatatatatatatatatatatttattaaatataaaggattcattgaatcctaacagaaagaagatacctagttctgaaggccaggtttaggtgctaacggttt

SEQ ID NO: 36723 - DNA, 201 bp, Homo sapiens
tcccagcattttgggagctcgaggcaggcagatcacctgaggtcaggagttcaagaccagcctggccaacatggtgaaccccatctccaaaaaaaaaaaaatttagccaggagtggtggggcatacctgtagtcccagctactccagaggctgaggcaggaggattgcttgaacctgggaggtggaggtcgcagtgagctg

SEQ ID NO: 36724 - DNA, 201 bp, Homo sapiens
tcccgagtagctgggattgcaggcaaagttgcagtgagccgagatcgcgccactgcactctagcctggatgacagagtgagatcccatgtcaaaaaaaaatatatatatatatatatatatttattaaatataaaggattcattgaatcctaacagaaagaagatacctagttctgaaggccaggtttaggtgctaacggt

SEQ ID NO: 36725 - DNA, 201 bp, Homo sapiens
tattaatcagggggaatagtaagtgtaaaagccttgacttggaaataagtttggcatgctaaagtaatggcaagaaaaccagtatacctagagcatagtgrggaggaaaagagtagaacaagatgaaataggtccagagacctaataagtacctgtaaagggctgagatgctgaaatttctaaaggcagagtgtttttgag

SEQ ID NO: 36726 - DNA, 201 bp, Homo sapiens
cccccacctcctctcccagaaagaactctagagtccttctttcttgccgatgaagattgtaagtggtagcactttctctcaaaaaaatcataaaaatgaamatgttaaaagattaacaataaagtaggacctaaatggaaaggtacaaaaatgattacacaaaagaatacattttaaaagcccctaatatatagtcaaaat

SEQ ID NO: 36727 - DNA, 201 bp, Homo sapiens
gagattacaggtgtgagccaccatgcccgactaataattctttagatctcaatttggtggtcaattcttcaaagaaagctttcttttcttttcttcttttytttttttttttttctggagacagggtcttgctctgtcacccaggctggagtgccgtggcttgatcatagctcactgcagacttgacttcctggactcaag

SEQ ID NO: 36728 - DNA, 201 bp, Homo sapiens
ctcccatctggctactttttataggaaactcgaactatctaccagtttcattacaagaattggccagaccatgatgtaccttcatctatagaccctattcktgagctcatctgggatgtacgttgttaccaagaggatgacagtgttcccatatgcattcactgcaggtatgacactatatataaaccttctacccaaaat

SEQ ID NO: 36729 - DNA, 201 bp, Homo sapiens
tttctaaaggcagagtgtttttgagactaaagttacccaccaaagaacatttttaaaactcccacatttgaaaagatgatgatatacacaaatcctttctrgtttctataatactattaatcctttattctggccatctcagtatatgaacgagttcttgctgagttcaatattttggaagctaatctaactctttcatga

SEQ ID NO: 36730 - DNA, 201 bp, Homo sapiens
gcatgtgtagtcccaactatttggatggtggaggtgagaggatcacttgagcccaggagttgggggctgcagtaagccatgattgtgccactgcactccaktctgggtgacagagcaagaccctgtctcaaaaaataaaatgaagtgtgaattaactagattacttctcaggtcctttcaatgttttatgtattatttgct

SEQ ID NO: 36731 - DNA, 201 bp, Homo sapiens
  misc_feature (1)...(201): n = A,T,C or G, or insertion/deletion polymorphism (see Tables 1-2)
tgattgtgccactgcactccagtctgggtgacagagcaagaccctgtctcaaaaaataaaatgaagtgtgaattaactagattacttctcaggtcctttcnatgttttatgtattatttgctgagcaacatttgatgtctaaaagaatactattcctaagaaccgaactatattcactttcttccaggagaattctcacca

SEQ ID NO: 36732 - DNA, 201 bp, Homo sapiens
ttgcttgagcctgcgaggtggaggttgcagagggccgagatcacacgactgcactccagcctgggtaacagagtgagactctgtctcaaaaaaaaaaaaaattacaatcacactctatttatgtatcacaatcttttaacctaccccagaatacccatacttgttcactccattaggaatgctcttcccttctcctagccc

SEQ ID NO: 36733 - DNA, 201 bp, Homo sapiens
gcactttgggaggccaaagctggcggatcacgaggtcaagagatcgagaccatcctggccaacatggtgaaaccctgtctctactaaaaattagctgggcstggtggcgggtgcctgtagtcccagctactggggaggctgaggcaggagaatcgcttgaacctgggaggtggaggttgcagtgagctgagattgcgccac

SEQ ID NO: 36734 - DNA, 201 bp, Homo sapiens
acttgaacctgggaggtggaggttgcagtgagccaagatcatgccattgtactccagcttgggcaacaaaagtgaaagtcctcaaaaaaaaaaaaaaaaaagaaagaaaaagaaaatttaaaatcacatatgtggctcacattatattttactggatatcactgttctactgttgccattctgagttgacaattctaatca

SEQ ID NO: 36735 - DNA, 201 bp, Homo sapiens
  misc_feature (1)...(201): n = A,T,C or G, or insertion/deletion polymorphism (see Tables 1-2)
acttggttcatttgcccatccctgaaccaattatagtcaatgttctgattaggcaggatagtgtcatgccctaatatttaacacttattacatgtggacantgtccaatcaggaatgaggtcagacctatacatctggtgtgaccatgccaatataccaactgaaaatcagccctagttataggtcatttccttaatctaa

SEQ ID NO: 36736 - DNA, 201 bp, Homo sapiens
agtgagctgagattgagccactgtactccagcctgggtgacagagagagactccgtctcaaaaaaataaaaataaaaataaaatacataaaggaaaagaargaaatttttggccgggcatggtggctcacacggtaatcccagcactttgggaggccgaggcaggctgatcacctaaagttgggagttcgagaccagcctg

SEQ ID NO: 36737 - DNA, 201 bp, Homo sapiens
tgtatcttaattagatctgattgaaattcagtatgtagtctagtgattcatactcaggtacctcctcgaaaaggaaggtgtttctagaatcctagtattaygtatgcatgtgcaaatatgcatacctaatatgcatatgcagttcacacagtgcattctgaaaatgttgaaaacaacacaaaaacacttaatatcttccca

SEQ ID NO: 36738 - DNA, 201 bp, Homo sapiens
tggtctctcgatctcccgacctcgtgatctgcccaccttggcctcccaaagtgattataggcgtgagccaccatgcctggcctttttttttttttttttttgagacagggcctcacttggtcatctaggctggagtgcagtagtgtgatcatggcttactgcagcctcaacctctagggttcccatctcagcctcccaaag

SEQ ID NO: 36739 - DNA, 201 bp, Homo sapiens
tttctctaggaagattaatttttcttggaatcttattacagaagctgaaaaggcaatctaccaagtacaaggcagacaaaacctatcctacaactgtggcygagaagcccaagaatatcaagaaaaacagatataaggatattttgccctgtaagttccatttctctctataaactcatactttctcccaaattcaatcat

SEQ ID NO: 36740 - DNA, 201 bp, Homo sapiens
gtttatggacccaaggcttatattgccacccagggtcctttatctacaaccctcctggacttctggaggatgatttgggaatatagtgtccttgtaagtayggtgttgcttttgttactttattctctactttattaaaaacagtgcttttaaaaaattggtcagtggaacttcagggttcaggcatcttttagtcagaat

SEQ ID NO: 36741 - DNA, 201 bp, Homo sapiens
aatatatatatatatatatatatttattaaatataaaggattcattgaatcctaacagaaagaagatacctagttctgaaggccaggtttaggtgctaacrgtttaatctatactagaaatcagactggtactattgcaacttctggagattcattagaagaccagagacatatcaaagatctggctacatcttggttcta

SEQ ID NO: 36742 - DNA, 201 bp, Homo sapiens
tgccatgcttcctctgccatagggccttgcacacatgttgttacctccgccttgaacattcctcacactcctctttacctagataacatttggtaattttktttttttttttttgagacggagtctcgctctgtcacccaggctggagtgcagtggcacgatctctgctcactgcaacctctgcctcctgggttcaagtta

SEQ ID NO: 36743 - DNA, 201 bp, Homo sapiens
cacctcctctcccagaaagaactctagagtccttctttcttgccgatgaagattgtaagtggtagcactttctctcaaaaaaatcataaaaatgaaaatgytaaaagattaacaataaagtaggacctaaatggaaaggtacaaaaatgattacacaaaagaatacattttaaaagcccctaatatatagtcaaaataatg

SEQ ID NO: 36744 - DNA, 201 bp, Homo sapiens
attatctgtatagtcatcttccccactaggataaaggattgctgaatgatacaatttgttgtatacttctgtaacacccctcctcttcattatctggcatrtacatcgatattaaaaatattcattaaatgaatgaatagctgattgactcagatgagacttcaagtttgattatatttgaaaaggatgctaagctttaag

SEQ ID NO: 36745 - DNA, 201 bp, Homo sapiens
ctgaaattctcctcaattaatgtttattgtaatctaattcctgacctctgtgatactgatatttccccttaaactagcatactcccctcttcttggaacasgtgacatggtgaccagcactcttctctgttgtgttcttccttctgaccaagcactacagccacatgaggcagcagtgagatgtggccttgtcactcctct

SEQ ID NO: 36746 - DNA, 201 bp, Homo sapiens
  misc_feature (1)...(201): n = A,T,C or G, or insertion/deletion polymorphism (see Tables 1-2)
agggtcctacattctattattaccattattaaatttgtaagtgctcttcaaatttaaagtgttattagtattctgttatcatttaagctttagattactanaatccctttataatctattactaaactggtcaagatgctgcctaacatttaaaaaaagaccatgtatttgcatatattataatatactctaaaatccaag

SEQ ID NO: 36747 - DNA, 201 bp, Homo sapiens
  misc_feature (1)...(201): n = A,T,C or G, or insertion/deletion polymorphism (see Tables 1-2)
ccatttattgagcacttagtatgtaccaagttcagttctaagcactaaaaatacagcggtgaacaaaaagaaccaaaacctttgcctcctggagctaacantctggtaccggatagcagatgtgaaaacactctgaaagtcttgagtaattagatattattgagtgattagatattatgataggaactccgatgtcagctc

SEQ ID NO: 36748 - DNA, 201 bp, Homo sapiens; identical to SEQ ID NO: 9468

SEQ ID NO: 36749 - DNA, 201 bp, Homo sapiens
gcctacttactatgtactaggcaatctgctaagtgctttgccgtacgtgatctcgtttaatcgttacaactaccccaagaggaaaatattatgttcattttacccatgaaatggaaaagcccggatttgaaaccagtctgttttttttcaaagcctcttaacctctgtacttaaactgtatcaggtaaaaatcatgacttt

SEQ ID NO: 36750 - DNA, 201 bp, Homo sapiens; identical to SEQ ID NO: 9470

SEQ ID NO: 36751 - DNA, 201 bp, Homo sapiens
gtttcaggctgtttctttctccgtacttcattggtttgaggattaaaataaaataacatatatggtccctattagacatttggcaaatacgttttctttcytctttcagagatctttcttatgtgtttctcttgataatcaagatgataagagacttattgtgtgtcacatattgtgatgagggccttatagtcattgtct

SEQ ID NO: 36752 - DNA, 201 bp, Homo sapiens
ttattgtgtgtcacatattgtgatgagggccttatagtcattgtctcatttaattcttaaaataactctgtgagatagactctagaattaataactttttkttttttctgagacggggttgcccaggctggagtgtagtgaagtgattatagctcactgtaacctcgaactcctgggctcaagcgatcctcccacctcagc

SEQ ID NO: 36753 - DNA, 201 bp, Homo sapiens
ttttgatctttacttaagtgggcactttatatgttgaagagtatttagctaatattgcctattgaaattaaatttatccagtgttttgcacagaaatgttyagatagaataatattagtacaaagtacttaaattcaattattctttttaatataaattactatgtaaatagcatttatttctttatatacagttgtaaaa

SEQ ID NO: 36754 - DNA, 201 bp, Homo sapiens
ccagtgaaaatggaaattctgggcaagaaagatattgaaacaaccaccatttcaaattttcacactcaggtaagataaaaattgttgttaaaaattatttagtaaatacgattctaaacagaattaacctctttctgtcgcacagcacataccagcacatttttgataacaaatttatggtaataaaggtgcttcaaattg

SEQ ID NO: 36755 - DNA, 201 bp, Homo sapiens
ttaagtatctttttcaaaaattttcatatataattttgaggtttcactgagaatcaaagctttttaactttaggtagttttatttcttatattacttttaktactctataaaatgataatgttctgtagcattggcgtgtataattttagtgtctacggttccagagaaaaacaaaaaatgttattccctcgttgtgtgtt

SEQ ID NO: 36756 - DNA, 201 bp, Homo sapiens
tccagtgaaaatggaaattctgggcaagaaagatattgaaacaaccaccatttcaaattttcacactcaggtaagataaaaattgttgttaaaaattatttagtaaatacgattctaaacagaattaacctctttctgtcgcacagcacataccagcacatttttgataacaaatttatggtaataaaggtgcttcaaatt

SEQ ID NO: 36757 - DNA, 201 bp, Homo sapiens
ctccagtgaaaatggaaattctgggcaagaaagatattgaaacaaccaccatttcaaattttcacactcaggtaagataaaaattgttgttaaaaattatttagtaaatacgattctaaacagaattaacctctttctgtcgcacagcacataccagcacatttttgataacaaatttatggtaataaaggtgcttcaaat

SEQ ID NO: 36758 - DNA, 201 bp, Homo sapiens
gcgattgcattgttaaataactgggattttgcttaattccctgcttccagtgtaatggttctctcccttgcttgtgccttgtatccttgtgtctgtagtcrtttagttcacttttaccacaaataaggtgaggaaaaaggagcatgggataggaaggtagaatgtaagtggaagggtctcactgactcaagcagattttaa

SEQ ID NO: 36759 - DNA, 201 bp, Homo sapiens
actccagtgaaaatggaaattctgggcaagaaagatattgaaacaaccaccatttcaaattttcacactcaggtaagataaaaattgttgttaaaaattatttagtaaatacgattctaaacagaattaacctctttctgtcgcacagcacataccagcacatttttgataacaaatttatggtaataaaggtgcttcaaa

SEQ ID NO: 36760 - DNA, 201 bp, Homo sapiens
ttcaggtgaccagccccgccctaaagctgttagtcaatattagcatacaaaaatagagctatttggagataacaaggagtttaggagccctacctcaggawatagggatgaagaccagatacatattgcacaatatcacactcactatttattctcctattcttggacattgaggttgtttacagttttataatattatgg

SEQ ID NO: 36761 - DNA, 201 bp, Homo sapiens
gtactcactttgacccagtcacactgttttttcactatatattttaaagtaggaatgcctttctattcacaaggcacaaggttaggaagatcgctggctarttttttcctttctgtgttttaaaaagtcagcttgaataggcttcttcctgaaacgtgagttctgtggaataatccacacccgctctcaacccccatacac

SEQ ID NO: 36762 - DNA, 201 bp, Homo sapiens
tggtacatccagacagtagaatattattcagtgctaaaaagaaatgagctatcaagccataaaaagacatggaggaaccttaaatgcatattaccaagtgraagaagccatcctgaaaaggctgcacattttatgattccaattatatgacactctggaaaaggcaaaactatcaagaaagttaaaagatcagtggttgct

SEQ ID NO: 36763 - DNA, 201 bp, Homo sapiens
gcccccataggctgtcttctccaatgtcattacatgaccggattgctcatatgtatgctcttgtgagtcatctttcttatctcattttttttttttttttttactcttgaccagttgcctaactgctatcaccgagtgtaagtgttcctgagccagatgtttaatggaaattttctctcatgtcaaaaagcagggatttta

SEQ ID NO: 36764 - DNA, 201 bp, Homo sapiens
tcttactaaaaagaaggaatactttgcttgtttggcattagtttcctacagttggtgaatgtttttttgttttatctatttttttctctctttttttttttcttgtcagccttttcaggttgaaagttggtgcatgttgaatttgtggtcataactgctgttcattgttatgctgttaattatttaaatgtatcacaaaca

SEQ ID NO: 36765 - DNA, 201 bp, Homo sapiens
agagatgaagtgaaatgcttaaaattttttagttggtgatagagctgaatacagaactcaatttttttccctcatggcccagttgacctctctttctgctrtgcacactggggttgattatttaacagagatatttaaatgctgtttttatttcttatagggaataagcttgagtgtaactaaactggaggttacctatgt

SEQ ID NO: 36766 - DNA, 201 bp, Homo sapiens
cagtgatattaatcattccaaccctgttgtaggcataggccaatgtgtgcatttgtatctttgtttttaacaaaaaaggtttaaaaaaagtaaaaaaaaaagtttttaagtagaaaataccttacagaataaggacgtaaagaaagtatttttgtatagctgtacaatgtgttttaaactatgtgttattacaagagtcaa

SEQ ID NO: 36767 - DNA, 201 bp, Homo sapiens
aagaatatgcaaaagcatctttcttttctatatttcacctacgtacttaaaaccatgtcacattttttgaaagttttatatttggtaccataacttctttwaaaaaaaagtcttgtttttcctgcagtttctgattgccctgttttttgaggtaggaacataaaaaagtgttctgtttttcctgcagtttctgattaccct

SEQ ID NO: 36768 - DNA, 201 bp, Homo sapiens
ctggggctcaagtgatcctcccacctcaacctcctgagtagctgagaccacacgtgtgcaccaccacacctggctaatgttttttttttttttttttttttgatagaggcagggtctctctgtgttgtccaggctggtctcaaactcctgggcttaagtgatcctcccgccttggcctaccaaagtgttgggattacagac

SEQ ID NO: 36769 - DNA, 201 bp, Homo sapiens
tattacaattggctaatttaaaaatttttttatagagccagagtctcactatgtcgtctaggctagtcttgagcacctggtctcaacggattctcctgctytggcctcctagcatgttcggattacaggtgtgagcactagctttgcttatagtctgcattttctggtgatgctgatgttgctagtaaatggaccaccaag

SEQ ID NO: 36770 - DNA, 201 bp, Homo sapiens
ctagtattttgtagcatagttgtttacttgatggctcttctgccaggaaataaaaattgaacattgttaattctttgtcactcatggatacaacattggtrctcacacaaaggtgtgaacctgaagatcctcgtaagatgagaagcttttctttgtgtatatatgaaaataaacatgttggtcttggcgaaattatgaggt

SEQ ID NO: 36771 - DNA, 201 bp, Homo sapiens
actgtttttggcaataatagtagttatgatgtattgagtatttattatgttctaggactattataagtacttcacatgcgtttttcatttactctgcacamtaattttataatgagatactgttctttcctccggttttaccaatgagaagcagtgcaaagaattaacttgcaaaaagatatgctatctcattcattattg

SEQ ID NO: 36772 - DNA, 201 bp, Homo sapiens
aaagattaatcttccattgaattgcttttgcacttttttcaaaaatcagtacaacctgtaatgtaacaatgattttttttttttttttgagacagagtctygctctgtgccaggctggagtgcagtggtgtgatctcagctcagtgcaacctccacctcctgggttcatgggaatcttatgcctcagcctcctgagtagct

SEQ ID NO: 36773 - DNA, 201 bp, Homo sapiens
acaagagtgaacctgaatgtaaaccatggactgcgggcaggcgaataatgatgcatcaatgtagacttatcagttgtaacaagtattccactctggctggrggtgatgataatcagggagacagactatgcatttgtgggagccaggtgtggttatagttctaggaacctgaaactgctctaaaaaaaaaaaagtaaaggc

SEQ ID NO: 36774 - DNA, 201 bp, Homo sapiens
taccagagtttaatcagtcccctgttattagacatttaggagcattccctgttgtgtcgttttaaataatactgtaatggatatctttatataatcttcarttattttcttagataacttttacttggaagtggaatttctgggtctgaggattagaaatattttttaagacttttaacatgtatcatgaaattgcccttc

SEQ ID NO: 36775 - DNA, 201 bp, Homo sapiens; identical to SEQ ID NO: 9488
  misc_feature (1)...(201): n = A,T,C or G, or insertion/deletion polymorphism (see Tables 1-2)

SEQ ID NO: 36776 - DNA, 201 bp, Homo sapiens
ctcttcctctaattgaaaaatcttaattactgagttcgggtggggcttcttctttactggagggaatgctttatacatgttatacatcattacaaatcttyatggaaaactagcttgaaaacttacctggtctttcacaaatcgggtaatgttagtatggaggatgtgattgagatctgttagtctcaggataactttagt

SEQ ID NO: 36777 - DNA, 201 bp, Homo sapiens
acttttgtagtagattttcttttttcattttcattttttttttaagttttgccctttgaaggtcaaggaatcctatttttataaatattgcagatgagacygaaaacatttctcctaatatagtccataatccccataagttccctatttaacaaggaaagatattgctgagagcagaatcaacatgctctatcatttttt

SEQ ID NO: 36778 - DNA, 201 bp, Homo sapiens
  misc_feature (1)...(201): n = A,T,C or G, or insertion/deletion polymorphism (see Tables 1-2)
aatgactgtaccaacaacttaccttgatacttactttgagatttaaaaaataaccactttttaagaacatttcagattatgattaaattagatattaaacncttcaaccacataagaatattgaggactgttgaatgagtcctgtgctctggtggtcctggaacttaattttatttatgaattttcagtcattagagaaga

SEQ ID NO: 36779 - DNA, 201 bp, Homo sapiens
ctttcttccttgcttaccctttgtttaacaaccaaatcaactctagatcaatgaatgaaataaaaaatctccagtacctacctcggaccagtgaaccccgygaagttctctttgaagataggactagagctcatgctgatcatgtcggtcaggggtttgactggcagagtacggctgctgttggagttttgaaagctgtac

SEQ ID NO: 36780 - DNA, 201 bp, Homo sapiens
ctacatttgagcctaatctaagatatattttcagctttattatggcacacagggagaggaaggtaattacattaagcattataatatagtgtgttaaatgstaatgatcataatcattgaacccttctcagtcctcatcttatttaaatctggtattttagcagacttttttgccttactgctattaattaattttttttt

SEQ ID NO: 36781 - DNA, 201 bp, Homo sapiens
aaaatgaggaagggtcacaggaagatgataatgggaacgcgccgccagactctgaaagccattaacattgtttcggccgttagggcggttggcggcaactyaccgcccagcggcggttgcgtcgcagccagaagcgtgacttcgcgcacgctccctttccactcctccactcagagccggggacgcggcgggggcgcggcg

SEQ ID NO: 36782 - DNA, 201 bp, Homo sapiens
  misc_feature (1)...(201): n = A,T,C or G, or insertion/deletion polymorphism (see Tables 1-2)
tcaggggaaatgagcttaccataatttaccagtactcatcagaaattaactctggagcttgtgaatgaggtcacatacagggcagaatgagatgcctaatnaaaattagggttctgtcagggaattaaaggggaggaatggatgctgggtgggtagccatagtctactccatgtggggctaaatgtctgtctacatttcta

SEQ ID NO: 36783 - DNA, 201 bp, Homo sapiens; identical to SEQ ID NO: 9489

SEQ ID NO: 36784 - DNA, 201 bp, Homo sapiens; identical to SEQ ID NO: 9467

SEQ ID NO: 36785 - DNA, 201 bp, Homo sapiens
  misc_feature (1)...(201): n = A,T,C or G, or insertion/deletion polymorphism (see Tables 1-2)
gaaatcatacgaaatttaaactgtgtccagaaataaagctttattggaatatagctctgttcattcatatatattgtctatggtagtttttgcactacagnagcagaatacagtaattgagacagagaccataagacctgcaaagcctgctgttcggctctttagagaagtttgccacccttgagttcacttaagagacat

SEQ ID NO: 36786 - DNA, 201 bp, Homo sapiens
gatacatcatcatgatcttaatttgcatttcccaaatggctagtgataatacacatcttttcatatcatcatttgctgtctatatatcctggtcagtaaartgtctctttataccttttgcctattttctaattgaattttgtgtgtgtgtgtgtgtgtgtgtgtgtatacatatacatatatatatatatataatttttt

SEQ ID NO: 36787 - DNA, 201 bp, Homo sapiens
gaattgcttgaattgggaggtggaggttgcagtgagctgagatcatgccattgcactccagcctgtgggacaaagagtgaaactccatctcaaaaaaaagraaaaaaaaaaaaaaaagattggcctgtcttggtaacagtgagcctcgtatcctggtatctgggctaaagtgaagactttgaagctagggagtacaaaatg

SEQ ID NO: 36788 - DNA, 201 bp, Homo sapiens
  misc_feature (1)...(201): n = A,T,C or G, or insertion/deletion polymorphism (see Tables 1-2)
gtagtaaaataggaggaaaataatttcccaggcattacaagaatttttagagagttacctatcatttagtgttgcttaattttaatttgattattgttatnacacattttgtttctactgttttcctttgctaattatttcacttgactaaattattacatattttaaagtctcacgtaacttttttctttcttcagtgcg

SEQ ID NO: 36789 - DNA, 201 bp, Homo sapiens
  misc_feature (1)...(201): n = A,T,C or G, or insertion/deletion polymorphism (see Tables 1-2)
actttggacactgactttcaaataacgttttaaattcaaggcagggcaattgttatttttctcataaagcaacagtggccagtgtttgataataacctttnataacttgtttatacatatgccattctcaattagttgccaccacggtaattcaataataaattttgtttactcatggagatttgttagccagtatgaaat

SEQ ID NO: 36790 - DNA, 201 bp, Homo sapiens
aaaaaaattgtatacctagtccttagaaactatgcatctatttctctgctggtagaagcatttccaagaacaaaagaactgaaatttgtcatcatttttcrttgtgagatgtttgtctctgaaacttaattttgttaatcttaggagtgaccaacctcgcataaccaaagatgtgatttgttttcatgctgaggattttac

SEQ ID NO: 36791 - DNA, 201 bp, Homo sapiens
ttaggcagctgtaccaacatcatttatttaataatgcatctgaggtgccatcaaattttatttctgttggtattaaatattcttaagtgaggcattcagaagcattttgaattagaattgaatgaatcaaaatgtaaatactaatgtccatctttttgtgttagtgaaaacttgtggaaaatggtggaataaaaatgtgag

SEQ ID NO: 36792 - DNA, 201 bp, Homo sapiens
ttttcaccaccaatatgcaatgatcttgctctctttttatttttacttttattccctactttctcatttcttgtgtgtgtgtgtgtgtgtgtgtgtgtgtkttttaactgtacagaactagagggaattagtgatcctctggcttaaatttgtattgtagaaaaggaaactgaggcccaaagtagtaaagaggcctgttca

SEQ ID NO: 36793 - DNA, 201 bp, Homo sapiens; identical to SEQ ID NO: 36746
  misc_feature (1)...(201): n = A,T,C or G, or insertion/deletion polymorphism (see Tables 1-2)

SEQ ID NO: 36794 - DNA, 201 bp, Homo sapiens
aactgcctgcaggataaaagatcaaaccccttagtgtggtttacattaataatcaggtcaactgtacctcttctagatgtatctgtgtttagtcttctccrgccataccgaattcactttccaaaccatagtctatcataactctttgcttttgcactattttttttttttttttttttttgagatagggtctcactctgt

SEQ ID NO: 36795 - DNA, 201 bp, Homo sapiens; identical to SEQ ID NO: 9468

SEQ ID NO: 36796 - DNA, 201 bp, Homo sapiens
gttatgctgttaattatttaaatgtatcacaaacatttgcatttattaaatttttaaatgcaagtgatagactggtaatcagcagttcttcttctcccccyccaccccttttttttctttttgccagagtttgtggttgattacttcatttctagccttaacatacagaaattcaacaaatatttatgactacataccagg

SEQ ID NO: 36797 - DNA, 201 bp, Homo sapiens
  misc_feature (1)...(201): n = A,T,C or G, or insertion/deletion polymorphism (see Tables 1-2)
gcccaggagttggaggccagcctggtcaacagagcgagaccttgtctcttttttttaagagtcagggtctagatctgtcacccaggccagagtgcagtggngcgaccactcctcccaccttagcctcacgagtacctgggactacaggcgcgtgtcacgacacccagataatttaaaaaatacttttgtagggacagaggc

SEQ ID NO: 36798 - DNA, 201 bp, Homo sapiens
gcggatgtacttagttggaaagtcacgtcaggcccataaacacagcaagatggagaggccgccaaaaacagaggcagaaatagccagggggtcccccatcmcgcctcactcaaaccacaggctcctgccagacattcttctcccttgctctgacttcccttttctcttctttttttttttttttctctttctcttcaagtt

SEQ ID NO: 36799 - DNA, 201 bp, Homo sapiens
cctaagcacacatattaagccatcctgcttactctttctccagattttccttcccatcagcagtcacccaccaaggagtgcatgcttctgggaaaaacctyacattaactcctatagagtcacgggagttttcactgctcctcccatttacttagaggaaaccccttattttcaagactgttaaaaaccatcctgctttca

SEQ ID NO: 36800 - DNA, 201 bp, Homo sapiens
cagtattttaaaaattcagaattaatgtaaaaaaatctatgttgaactaaacatcaaaatattggcgtgatattggaacctgaagcaaaagaaaaaatcaygaatactgatcctgtctgttttagtctgctcaggttgctataacaaaataccatagactgggagccttaaacaacagaaatttatttctcactgctctga

SEQ ID NO: 36801 - DNA, 201 bp, Homo sapiens
ttctgtaatcttgaagtgttagtggatttaatctattttttttttttttgagatggagtctcgctctgttgcccaggctggagtgcagtggtgcgatgtcrgctcactgcaaactccgcctcccgggttcatgccattctcctgcatcagcctcctgagtagctgggactacaggcgcccaccaccatgcctggctaattt

SEQ ID NO: 36802 - DNA, 201 bp, Homo sapiens
gaggtaggatcctggaacgtcagcatttcttttaaaagctgccaggtcctctatgcctgagaaccgctgatctaagttaattcctcatctctagatgaagwaactgtaacctgcagagggtaagtgatgtgcctaaggttacctgggcagttagtgtggcagagttgtgagcagacccagatctcctgactctcaggtcac

SEQ ID NO: 36803 - DNA, 201 bp, Homo sapiens; identical to SEQ ID NO: 9501

SEQ ID NO: 36804 - DNA, 201 bp, Homo sapiens
ggggggactgtagtatgctgctttaaagactggaataaatgctgccaaaaagatgaaatgaattcttatacactgtcccacttagttgtgaaatagacagsctctctcaattcactggcaatgtctggtaggttctgaacactcccaggctatgttttcagggaaatttatctttgtaagaatagtccatgaacagagtac

SEQ ID NO: 36805 - DNA, 201 bp, Homo sapiens
  misc_feature (1)...(201): n = A,T,C or G, or insertion/deletion polymorphism (see Tables 1-2)
aaaagaaaacagcagctgttgtttttctattctgtacattatcttccttatttgccaatttgccagggacactaatatgaaaaaatcatcttgaaaagttnccagcatttttacttcattgtttagcctgttcttattgatcagaatgaggccagcaaccatttaagagattatgtatttttctaaagtaaagtcactatc

SEQ ID NO: 36806 - DNA, 201 bp, Homo sapiens
  misc_feature (1)...(201): n = A,T,C or G, or insertion/deletion polymorphism (see Tables 1-2)
agagggatcagctaccgatcaagtcatacaagtaagatactgggaaagaaggacaatttagtggacatgagccattgaactatgacgtcactgtaatgatnaaaacatagctgatttatacagatctcatttatcactgaggtgaggaataatgcccatacgtatggcttatcacatagaattttttttaaagcactccct

SEQ ID NO: 36807 - DNA, 201 bp, Homo sapiens
aaatagatattggcaattccttaaaatgtaaaaggcttggagttgctaacttgctaaggttctgtccttaatcagtaagacatctgggattggaactgggwtttttggaccctatagaacacactcatccattaaataaaatttctgtcaagatgctcagagcactcgggacctggcaggtacagaggggaggagggcaca

SEQ ID NO: 36808 - DNA, 201 bp, Homo sapiens
tagcaggcttcatggtacttatactaaaaatttaccagtatgaagggttattattgacattttgaaaacaatggtttcaaataaactgaactttcaaaacrcttcagtgaccctcacttttatcggaagagaagaaagaacttgaattattggatacatatggtgatgggatggggttagagaaaaagccaggactctatt

SEQ ID NO: 36809 - DNA, 201 bp, Homo sapiens
cagcagctgctgtcccatggccatgtttataaagaaccacctctcttgggcacaaataggcgtcccctgttggagggccagccccttctcacaacacccartggaaggtggaatgtaagatgaggaatcaaagtgcctaatattagcagaaggaaaagaagggacgaggaaaagtaggctagaaattaatcccagggccag

SEQ ID NO: 36810 - DNA, 201 bp, Homo sapiens
atggaccaagagagcatcactcaagcagacccactcaaaagcaggcttccttacatggcattttcgttgtttcttctgcttttccctctttctgcctttcyaccatttctcctaacaccattcagttttgatagttttgccctaggccctgaaatattttcttcatcatgtgatcttttcctattctatattttacatttt

SEQ ID NO: 36811 - DNA, 201 bp, Homo sapiens
acatatcttcattaggcccagaaaaaatccctggacttggagagatttctcttacctctaaactcccataggattttgttgccatttctcttagataatartatctgaaaattagcattcgtatgtctggaccttttttgttgatgaagtattaatgcaaatacacatacacaggcaccttgttaatagttcataaaagtt

SEQ ID NO: 36812 - DNA, 201 bp, Homo sapiens
  misc_feature (1)...(201): n = A,T,C or G, or insertion/deletion polymorphism (see Tables 1-2)
aaacatgttcaggtttgtcaatctcaatccatcctagtacaatccagaggctcaagaagaggggaatgagaggaaagatggggaggacacagccacccacnacactctcctcaaatgcctatgagagtctctctcagcccataagcctctcacactcagaaccatccgagtgtagccccctggctgacaactatgtcctcc

SEQ ID NO: 36813 - DNA, 201 bp, Homo sapiens
ccttttgctgccacgaagtgcagggcgacccctcacccgcctctggcgtccacctctgcacctcagagacccgctggggaagcacaaacctcatgggcagsgaaggctttcctaggcaacttcacacacagtctaccgccgctgcaattctaaattcagatctactcccaactcaacgttatttcttgctgagcactatat

SEQ ID NO: 36814 - DNA, 201 bp, Homo sapiens
ctcactgcaaactccgcctcccgggttcatgccattctcctgcatcagcctcctgagtagctgggactacaggcgcccaccaccatgcctggctaatttcyggctaatttttttttttttagtagaaacggggtttcaccgtgttagccaggatggtctcgatctcctgacctcgtgatcttcccacttcggcctcccaaa

SEQ ID NO: 36815 - DNA, 201 bp, Homo sapiens
tccatttgccatctctgtgtgtgtttttgtataaacatttatatataaatacctaacttttttctgaactatttgttagtaaactggagacgcatgcattratacgatctgttatttaacccagttggtatttacattttaccatttgtcctaatatccagtactagtatttttttttcctaatctaagatctaattcaag

SEQ ID NO: 36816 - DNA, 201 bp, Homo sapiens
accattccctaccacttcctttccttttttcagctgcaaatgagctctccccagttagaactgttaggggactgcactctctcgtgacctcatcacattgraactttggcttgcatgtccaatcttcctcttgatattttgagctttttgagaacaaaagttgtaccttttacaaataaacagtatgatgtagaaaacacg

SEQ ID NO: 36817 - DNA, 201 bp, Homo sapiens
cggcctggagcctcacccgggtgagtgcgtcgcagccgaccgcgggaggcgggcggagaggggacgccgaagggccagtcgccggtcgcgggtgaggagcyaggccctgccattgacgccctgccttgccccaacataggtttctgtttcttcgcgcaaatgccctgagcctccctaaattcaccggaaccaatttttggg

SEQ ID NO: 36818 - DNA, 201 bp, Homo sapiens
cctggaaggataactatttggtagacgatcttttatacctgaactataaatctccatgaggcacacatagggaagagtgggctgttgtaactaatccttgrgtcttactaaatttccatatacaagcattccataaactctagaatagggtcagggaattgaaacagaagaggatgaccttatgtgattccctgccttttt

SEQ ID NO: 36819 - DNA, 201 bp, Homo sapiens
ataaggaaacgtgtataaattcactgacacaaacctgacatctaattaatagtagtcagcctacattgctccgtggctgggtctgaacaggcatgaaaagyggggcatagaagcaattttaaagaatagattgcttattaaggaaaaagtgcattgttcgaaattggaggagctgcaatggctctcaaaggaattataatc

SEQ ID NO: 36820 - DNA, 201 bp, Homo sapiens
tagacatggactttggagcaaccagaactttgggattagttctggctcagaagaaggggagtaagagtctgagttctttggataactgattatagactttyctaagaatactccagccaccatttaaaatagttagtttctgatgaaggcagtgatgtgacaataaatatttcaacatcagaatttactttgtagaacact

SEQ ID NO: 36821 - DNA, 201 bp, Homo sapiens
ttaagaggaaaaatggttctgtaaaaatcagccctatcttggacatttgaaggcacctcctgtatggcttgcatgtgacttaggcagactcatcttaaaasactctgtctcaatagtattcacgttttatttttcaggaggcagcacaggcacttccccaaccacctccagcactgggacaccatccccttcggcttcttc

SEQ ID NO: 36822 - DNA, 201 bp, Homo sapiens
aaagacaaggaaaatgcaaacctctctgaacctgaagttaataaaggcacaatcgcaatcagctatagaaacaattcccaaatctctaatactggaggatstcttctgtcttcagatactttattttacaccaagttgtgttcctaagttttaggcttagaaaaatgaatgcttgttaaagtgtaagaatgactcagcaat

SEQ ID NO: 36823 - DNA, 201 bp, Homo sapiens
tcactgtcatacctacgccggcactctcagtcttttggagaagctactagagaagtgcctcaagaccagcctcggaggagcctggctctcgagcctgctckcccccgccctctcccagagcaacagaggaactttcgagctaggatcggctggaacagctgctccggctgcggccttgcaagtatattgctgcggccttgc

SEQ ID NO: 36824 - DNA, 201 bp, Homo sapiens
agcagaaatatgcattggagtgctaccaagtagggtcatgaaatttattataattattgttgtacttatcaaatatttgctgaactttgaaggaatgataytgccatcttttttggattgaaaatgttgcaaggatgtttttttctgtagtctgactatttttccaaataaattgatttcaagccatcatcaatttgcaaa

SEQ ID NO: 36825 - DNA, 201 bp, Homo sapiens
tgaagaggttatataacttggcaaaggttgtactaatagtcagcagggtagcagtttgaagccaggtaatctagccccagagcctgtgctcttaaccattwtgctattttgtccctcatgtgattttagcattactgaattaaagttagacaatttcagtcaaatgcaaagaaacttaatattctagttagccaactttgt

SEQ ID NO: 36826 - DNA, 201 bp, Homo sapiens
tctgacacagtttcctccagatatttccagctggtatggcaccccaaagccactgctgttggtcccatgatagggcccaagtggaatggcccttctgtagyccagggaattggtacaactttttaggagggtatgtttttctctttcgaatccaccattggaagcctgagccagaaactcaaattctataacttagaaact

SEQ ID NO: 36827 - DNA, 201 bp, Homo sapiens
catgggaattcttcattatgttccatcaaaatctgagggctactttaagtactatcagaaattttatcagttaacttactgtgttccagacctttaattaygctttctctaatcttcaaaacaactcgtattttacaaatgaagcaattgaggctcagagaggttaggcagttttcctactgtcacaaagtaaagctggag

SEQ ID NO: 36828 - DNA, 201 bp, Homo sapiens
aattttgatggttattccagattaccctcccgaaaggttgttcaatttacacttccacccacagtgtatgacagcccattttcctatccatttgccaacartatattagaaaatatttttgtctttgctacctaatacccttgtatttgaagggtataatgcttgcaaattgatttcatcataaattctcttctgttctcc

SEQ ID NO: 36829 - DNA, 201 bp, Homo sapiens
aggcatgatttagaacagaaaagtaggctagataagctagtgttgaccagcattagatctatgttgtaggaattagagccactctttaactttgagaattrgactgttgcatcttgaaggatttgcttttggttaggaattgtgatgacatctcagttcaagtgctgaggccctcgttcctctactggcctgaaggctggt

SEQ ID NO: 36830 - DNA, 201 bp, Homo sapiens
cctcgcctacttttcactgctgccctattcacagctcctctccacacaggctttttctcctcttccatgccattattgctgctgtctggagcaccgttcckcctgctttttcccataaaattctttctaaagaaagtttattctactttcaagatctatcttgagcaccaaatatgacaggatcattttaagaaggaaaag

SEQ ID NO: 36831 - DNA, 201 bp, Homo sapiens
  misc_feature (1)...(201): n = A,T,C or G, or insertion/deletion polymorphism (see Tables 1-2)
aagtaggctagaaattaatcccagggccagtttgtttttgctgaaatctgaaacaacttgtcattgggggtgggaggagaaagggtatacagaggatctcngttaaaatttgctaatagagctctctattataaccaagtaactcaaatcttatctatacctttatctattaagttaaacatagaaaattactgtatttat

SEQ ID NO: 36832 - DNA, 201 bp, Homo sapiens
tgacatctcaagtgtctatctcactttcaatttctatattttcatttggtttccctaaagccattgggtatatttgtccagccaatctctttctactcttycctggcactcttaccagcccccaaaaattttgcaaacccttttgttatccctggcatgggtggcttatgccatttagcagatctatggaagtaatcagtg

SEQ ID NO: 36833 - DNA, 201 bp, Homo sapiens
  misc_feature (1)...(201): n = A,T,C or G, or insertion/deletion polymorphism (see Tables 1-2)
ctttcaatttctatattttcatttggtttccctaaagccattgggtatatttgtccagccaatctctttctactctttcctggcactcttaccagcccccnaaaattttgcaaacccttttgttatccctggcatgggtggcttatgccatttagcagatctatggaagtaatcagtgctggacactccagcaggcactac

SEQ ID NO: 36834 - DNA, 201 bp, Homo sapiens
tcagccagtgtgtgtgcgtgtgtgtgtgtgtatgtgtgtaggggagtgttgggggcggtgctgaggggtgttatggagaactgggtgtaacagttccctarcctgcgtgggtgaattggttccggatgttaacatttttttctttggggcttgactacattcttctttttctttgccagtctattttcctgcccaaattct

SEQ ID NO: 36835 - DNA, 201 bp, Homo sapiens
  misc_feature (1)...(201): n = A,T,C or G, or insertion/deletion polymorphism (see Tables 1-2)
tgatgcctctgaagaacaagaagtctcttcagatgctgaactgctttctgaggatatatattgtccataaagatttgaaagttcattattcattcatctgnatgctgatccttaaggcttacagaattctcttataggcttcccttcaggtctttcatggtccagaggccagaatcaacaactccagagaataaccccaga

SEQ ID NO: 36836 - DNA, 201 bp, Homo sapiens
ggctgaatagttttgtatttccacactgtctacacactagattgtaaaagccttgggagcagggccctgaattattcttattagcatcccccattattcawtgattgattggttttctgaaacaacaccaaatgctttgggatatgtgagatgggagatatagtgagatgctgacttgtgtataagtataaagtttttctg

SEQ ID NO: 36837 - DNA, 201 bp, Homo sapiens
tttatggtagaaagagggctgaaggagcttaagttaggagtcctagattctagtgctagctttgaaattgatgttggaaccagggatatttgttttaaaaycagacatattaatgttgaaaaaaagtttcaaaattgttttatagccactgatgaggcctcagtgcctcatttgtgaagtgagggagacaaggctcaaatg

SEQ ID NO: 36838 - DNA, 201 bp, Homo sapiens
tctttgaaactgccacctccagaggcactctctccagaagtcatagttaaattacacttgatgtttagaaattggcttcttagttcttcccctttagtgcrtcatcatgaatttgtttatttattggtgctcagtgggaacattctaacaaggtataaagcaaatgcttgtaaggcctttggagaaaggcccacttttcac

SEQ ID NO: 36839 - DNA, 201 bp, Homo sapiens
tagatagtaaaactgcagaagccatggagggtccatacagaaaactgtaataattaagatttttcaagctctgatacgagatatagcatcaacatagacawggactttggagcaaccagaactttgggattagttctggctcagaagaaggggagtaagagtctgagttctttggataactgattatagacttttctaaga

SEQ ID NO: 36840 - DNA, 201 bp, Homo sapiens
catgaatttgtttatttattggtgctcagtgggaacattctaacaaggtataaagcaaatgcttgtaaggcctttggagaaaggcccacttttcacatcayagaaattaaaagaccataatggcagatacacaatggtgctatgacagtggctgatgtcggaggtggtggtgggaggttggaagtggtggttgcaaagagc

SEQ ID NO: 36841 - DNA, 201 bp, Homo sapiens
caaaaagaaaaaaaaggcttgcgaagtttttaagaagagaattcaaaggtagtcacagaattttaaagcaagggggcactgtagagattatctagtcgatwtcctttgttttataggtgatggggttaaatgatttatccaaagtcacatagttcatttattttagaagtcaggtactggaaagggatgggtagcttctcc

SEQ ID NO: 36842 - DNA, 201 bp, Homo sapiens
gaatgggaaaacccagatgtagagtttggactgtgatagggaggaaggtaaaatgtgctatggtttgcatctccaaaggtcccttcccaccctaggttccygcgcttcagaagccagtaatgatagacccagggatcacaagggggtgtgcgggtctctccttttgctgccacgaagtgcagggcgacccctcacccgcct

SEQ ID NO: 36843 - DNA, 201 bp, Homo sapiens
agtgagggcactgagtgagatgagaacccacacttaaaataattgagaatttagagtcttggtttgaatctaaagacatggttggttttaaggacagaaarttattttttttctaaatttttctttctgtattattgacccttgaaaaatgtgagggttgtggtgctgactccctatgtagccaaaaatctcgatataact

SEQ ID NO: 36844 - DNA, 201 bp, Homo sapiens
  misc_feature (1)...(201): n = A,T,C or G, or insertion/deletion polymorphism (see Tables 1-2)
acatggcagaggttctgaaaccttttagtgacatgtccattggtactaaagaagtcattcagcattatccaattgaagcaaacatattacttttaccatcnatgataaggatgtcctgctatttggttccatgtaatgctatttaatcacttagttcttcctgggaaagtatactgatttctagttttctgtacatctcac

SEQ ID NO: 36845 - DNA, 201 bp, Homo sapiens
cacaagggggtgtgcgggtctctccttttgctgccacgaagtgcagggcgacccctcacccgcctctggcgtccacctctgcacctcagagacccgctggrgaagcacaaacctcatgggcagcgaaggctttcctaggcaacttcacacacagtctaccgccgctgcaattctaaattcagatctactcccaactcaacg

SEQ ID NO: 36846 - DNA, 201 bp, Homo sapiens
tggttggttttaaggacagaaaattattttttttctaaatttttctttctgtattattgacccttgaaaaatgtgagggttgtggtgctgactccctatgyagccaaaaatctcgatataacttccgattttcccaaaacttaactgctatagcctattgttgactggaagccttaccagtaacataaatagctggttaat

SEQ ID NO: 36847 - DNA, 201 bp, Homo sapiens
catgtagactagcagacttgttttagtcgcacaggagattactaatagaccttgttctattagtataggatttttgtctctaatgcctccagtgaaagcaratagaatcaagagcattgtttggtctagattctctgaagcttatcatggttttgggactcttgatccctggctctcacatcatcatttattcattcactt

SEQ ID NO: 36848 - DNA, 201 bp, Homo sapiens
  misc_feature (1)...(201): n = A,T,C or G, or insertion/deletion polymorphism (see Tables 1-2)
cctgggctcaaagtcttcctaggcagggacagggagaggcagggcagagtcttgtggggaggagggtaggagcaactttggcaaggaaatcctgctgtctnggcgacactgccactctttcagaaggcaacagacactcaacaacacaccagctattttggaagctgtcagtttctgaattgctgacacacttgaaggaca

SEQ ID NO: 36849 - DNA, 201 bp, Homo sapiens
ggaggcgccgcggggccggaacggcgaacgggtcaggcgcggcttggctgcgaggcctcggtgtgccagcccgagttcctgttctcgcgcctggggctcckcgctggccccaccgcctcgcctcgcctcgccgcatcgcgccgcgtgcgcccggggttatcgcggggccttggaaacccgggaccctggaaacccgggacc

SEQ ID NO: 36850 - DNA, 201 bp, Homo sapiens
aagcctgttcctgttggggatggggtgaaaacgttcaactttcctgagactgtgttcaccacagttacggcctatcagaatcagcaggtaagaggtggccsttgagagtcttctgctacatctgttttttggtccttctgcataagattccttaggtattatttactttcaggggaatttgacatacaacaacccttagtc

SEQ ID NO: 36851 - DNA, 201 bp, Homo sapiens
gctggactcctgcttttcatgcaggccatagctgtttatcatattctttggcttgtagtcttttatccagtacttaacattttttctgccttatttgttcrccctcccttgtcatgagccttttccaccattgtcctcttggctgtgtggccttgccagagaaaattggcgatcattttgttatctgtggcttttgcccag

SEQ ID NO: 36852 - DNA, 201 bp, Homo sapiens
  misc_feature (1)...(201): n = A,T,C or G, or insertion/deletion polymorphism (see Tables 1-2)
ttggcagggatattgccagttccagagggcaggcattaatggcaacaattgtgttcaatgctgtatccccaagatctactacagggcctggcacccagtangtacccaatgaatagtgaatgggatcacttgctggcactgtggctcaggtgggcagagccactctcaaacttcttcttggagcacaaccacctaatatgt

SEQ ID NO: 36853 - DNA, 201 bp, Homo sapiens
  misc_feature (1)...(201): n = A,T,C or G, or insertion/deletion polymorphism (see Tables 1-2)
aaaactgagttatcatctacctcacagcctggtgccctctccatggggaaggagaacacttgatatcccggaagtttccctccctgccctacccccatgcncaaccattactaagttcttaaatctgtccacatctctaaccttccttgttaccatgccactctgcactgacgtcacctctcactgcatgaccttaatgtc

SEQ ID NO: 36854 - DNA, 201 bp, Homo sapiens
attggtgctcagtgggaacattctaacaaggtataaagcaaatgcttgtaaggcctttggagaaaggcccacttttcacatcacagaaattaaaagaccayaatggcagatacacaatggtgctatgacagtggctgatgtcggaggtggtggtgggaggttggaagtggtggttgcaaagagcaaataaacattgacttg

SEQ ID NO: 36855 - DNA, 201 bp, Homo sapiens; identical to SEQ ID NO: 9499

SEQ ID NO: 36856 - DNA, 201 bp, Homo sapiens
  misc_feature (1)...(201): n = A,T,C or G, or insertion/deletion polymorphism (see Tables 1-2)
cagaagttgaaggctgtctttagggtttacctaaaaaagcgatagtcaattttttatttatctgatattggaacaaattgtaagctcacatagccaaaatnttatcagtgctggtctgtagtaatggacccttacacagttttccttagagttctacaaaaaatgaatgtgccttttgtgtaacactgtcctcatagaaaa

SEQ ID NO: 36857 - DNA, 201 bp, Homo sapiens
catatattgggttgtaggaagaccaaagccattgtcatttgcttcggcatgggtaccaataggtaccatagcctgtcttgattataggagagggtcttatmtcagcacttggactgtacataccttgaagacagggatagtgccttaatcatctttgcattcccctcagagctcaccagagagtcccccaggtagcaggta

SEQ ID NO: 36858 - DNA, 201 bp, Homo sapiens
aaggagatgctcatggaagtgactcagcttgtagtgggaaagaatggggttagacacatgatactcccagctctgctagtactagataggaaattttgagyaaatcacttttcttccctaggcctcaggattcacacttaaatatggggatctagtgagatgaaacttcttatccttttttggcctccatcatcaagcttc

SEQ ID NO: 36859 - DNA, 201 bp, Homo sapiens
  misc_feature (1)...(201): n = A,T,C or G, or insertion/deletion polymorphism (see Tables 1-2)
gatcaaacatatttaagccaccttagttgtgaggatggttaaaatagttagggggtgttacagagttgccagctgttttggctgggttgaacctagtgtgnttttggggagatctgaccattggatcaggatggagaagatgtgcattctagtacatgttagttttcaatttctcttgtttcagtgtccttgtccacaaaa

SEQ ID NO: 36860 - DNA, 201 bp, Homo sapiens
  misc_feature (1)...(201): n = A,T,C or G, or insertion/deletion polymorphism (see Tables 1-2)
tctgtttgctttagagctggctagccccagtctttttcaaataggtaaaataaggaatctctatgccactttaagtaattttaagtaagtaagcataaaantgtttttttccagttaaattccatttattacaaatctaacatttagcaaacatctgttatacatcaagttgtgtttaccagacaaagtccttgtgctcca

SEQ ID NO: 36861 - DNA, 201 bp, Homo sapiens
ctgatgaaaaaggccaggactagtatggcaagtggggagagagatggctgagagagacacggtctggatttcaggacttaggagaaaagatgcttccagcktgttttaggggatcttgggagttgtgatttggactgggtgcctctatttctcagggtccaggtcccatgtggtcctttagaactgagaagcaggaaagta

SEQ ID NO: 36862 - DNA, 201 bp, Homo sapiens
  misc_feature (1)...(201): n = A,T,C or G, or insertion/deletion polymorphism (see Tables 1-2)
agatctgaccattggatcaggatggagaagatgtgcattctagtacatgttagttttcaatttctcttgtttcagtgtccttgtccacaaaatagacatanaaatacaagctatgtctatcttatcaatgggaagacaatattaggtaatgtgtaaaacataaattaaaagttcttttattattattgctagagtgagaag

SEQ ID NO: 36863 - DNA, 201 bp, Homo sapiens
  misc_feature (1)...(201): n = A,T,C or G, or insertion/deletion polymorphism (see Tables 1-2)
ggctcaaagtcttcctaggcagggacagggagaggcagggcagagtcttgtggggaggagggtaggagcaactttggcaaggaaatcctgctgtctcggcnacactgccactctttcagaaggcaacagacactcaacaacacaccagctattttggaagctgtcagtttctgaattgctgacacacttgaaggacactgt

SEQ ID NO: 36864 - DNA, 201 bp, Homo sapiens
gacttgggtgcatttgttctctctaatatttctgggtgggtggcactgggcatgttcccttgtataagtctcaaaatagggttaaaatgcctacctttcargcctcctgctcgtgctccctgggagcctcacctaggtactagatttttttctgcctcctcagtgtgttttccttatcctgagccaggtgagtgtttctga

SEQ ID NO: 36865 - DNA, 201 bp, Homo sapiens
  misc_feature (1)...(201): n = A,T,C or G, or insertion/deletion polymorphism (see Tables 1-2)
ttccctctttctgcctttccaccatttctcctaacaccattcagttttgatagttttgccctaggccctgaaatattttcttcatcatgtgatcttttccnattctatattttacattttctttagtgaggtttgcatttattcatttgaaagtcttctttctgtctctctcatagggacagggaagtgactgagaaaaga

SEQ ID NO: 36866 - DNA, 201 bp, Homo sapiens
tgggaaagaatggggttagacacatgatactcccagctctgctagtactagataggaaattttgagcaaatcacttttcttccctaggcctcaggattcayacttaaatatggggatctagtgagatgaaacttcttatccttttttggcctccatcatcaagcttctgcttcagagagtcagaggaaggctctaggaacc

SEQ ID NO: 36867 - DNA, 201 bp, Homo sapiens
tacctgtggtccggggggagttacatttagtaaacatgtaaatacaaaaatacatgtgtaattaccaattgtgttaagagcaaagatggaatttaaaaggrtgcagttaagaagagtagcagaagtatcctattttggagagatgatcagagaagatctctctcaggagataatatttttgactgaggcttaggacgagga

SEQ ID NO: 36868 - DNA, 201 bp, Homo sapiens
gctcctctttatgtcagtgagtcttggctcagcatgagctggcttcatcttggattctgcatcctcaatcctgtctttgtctcttctcagtgaagcacaartcagacaagagcctgtcccaatgaagccagaggcctcaaagcagcagagaagtctctcctccagaagccacatatgcctaaaccctaagagtatatgact

SEQ ID NO: 36869 - DNA, 201 bp, Homo sapiens
  misc_feature (1)...(201): n = A,T,C or G, or insertion/deletion polymorphism (see Tables 1-2)
ctttaggcagtgacagttcaatttccatgctcccgaggctaataataatgcgattagcgggtgacctgcagagatagagttttatgaattctccgtgtttntgtggcccgttacggtatttgagtttagtgctggggaattatttttattagtcgatgaaaagaaaattaaaaggagatttatttcgaccgtccaagcctt

SEQ ID NO: 36870 - DNA, 201 bp, Homo sapiens
acggaggacgcggcggcacacggcctggagcctcacccgggtgagtgcgtcgcagccgaccgcgggaggcgggcggagaggggacgccgaagggccagtcrccggtcgcgggtgaggagctaggccctgccattgacgccctgccttgccccaacataggtttctgtttcttcgcgcaaatgccctgagcctccctaaatt

SEQ ID NO: 36871 - DNA, 201 bp, Homo sapiens
ctgctacttctcccaccctgatttctgagctttctgttttattcatcttcataggaggatgtttcctgccatgagagtgaaaatcactggcctagatccamatcagcagtactacatagcaatggacattgtgcctgtggacaataaaagatacaggtaacaataactctgggatgtggaaatgtgggtatcaccagcatt

SEQ ID NO: 36872 - DNA, 201 bp, Homo sapiens
ggaggatgtttcctgccatgagagtgaaaatcactggcctagatccacatcagcagtactacatagcaatggacattgtgcctgtggacaataaaagatayaggtaacaataactctgggatgtggaaatgtgggtatcaccagcattccaagacaattcttcaaactccttagaggaaatagtttagcaatgcatgctgt

SEQ ID NO: 36873 - DNA, 201 bp, Homo sapiens
tttgtttttctctcctttcccctgtctcaacttgtttcctgggcctctgtcccttctctgcctctgtctctgaattttcctctcttcctctttatctcagrtatgtgtatcatagctccaagtggatggtggctggcaatgctgattcccctgtgcccccaagagtttatatacaccctgattctctagcttctggagaca

SEQ ID NO: 36874 - DNA, 201 bp, Homo sapiens
caacaatgagttggatgatcaaggacatgtgagtcaaagaatcctatctcccctttctttctctcttcctctgtttgctttagagctggctagccccagtstttttcaaataggtaaaataaggaatctctatgccactttaagtaattttaagtaagtaagcataaaaatgtttttttccagttaaattccatttattac

SEQ ID NO: 36875 - DNA, 201 bp, Homo sapiens
aagcttctgcttcagagagtcagaggaaggctctaggaacctgaattttacatagtaaatggggcattcttctgacatctcccttcccctcatgcactttkagtaatgctccttctccccaaggaagatggctgcctgattcctagcagtactttgcaaacatcgagactgtagaagagtacatgctcaatttcagtggag

SEQ ID NO: 36876 - DNA, 201 bp, Homo sapiens
agtgtgtattgttcccttccctgtgtctatgtgttctcatcattcagctcccacttataagagagaacatgtggtgtttggttttctgttcctgcgttcgwttgcttaggatattggcttccagctccaaccatgttccttccaaggacatgatctcattcctttttatggctgtgtagtattccatgatgtatatgtatc

SEQ ID NO: 36877 - DNA, 201 bp, Homo sapiens
aacaaatatggtattaggtgctgggaggtataaagatgaataaacaccattctctgctcttaagaagacagatatgtaatcagacaagtgaaacacagggsgatgggtgtctcgacagaatatgaacagagtatggggcacagagcctgagttaggaagggggaaccaggaaatcatttttagtctcttgattcccatcag

SEQ ID NO: 36878 - DNA, 201 bp, Homo sapiens
tggctgagttgctcagtctgtcctgagcctgtggatcaaggcaagggagtgtgaatgggttggagaggcaggccagagtaagggcctgctggctctgcaargctagacaaggaatttggattaaattctgagcggtagtggccactaaagagaatgacatggtccagttacatgttaacgaagaccaaatggggtgctgga

SEQ ID NO: 36879 - DNA, 201 bp, Homo sapiens
agtcttctttctgtctctctcatagggacagggaagtgactgagaaaagacttaacgcatatggtcattttctgttccaaatgatggaaacaatttatatkaagtatattcctattgtgcgccaggggcttcactgagacacatggtatccactatctccattttagatgaagaaattggctcagaaaggttaagcagctt

SEQ ID NO: 36880 - DNA, 201 bp, Homo sapiens
atctccattttagatgaagaaattggctcagaaaggttaagcagctttcccagtcataatctgggtctgtggaattctaaaggaggtttgtaatcttttgycttacttcttagcgactctggaaaccccacttcactgcagacaacagagacaccagatgtgtaggggacctggtgagcacagcagtcattctgttcctga

SEQ ID NO: 36881 - DNA, 201 bp, Homo sapiens
tagatgaagaaattggctcagaaaggttaagcagctttcccagtcataatctgggtctgtggaattctaaaggaggtttgtaatcttttgccttacttctyagcgactctggaaaccccacttcactgcagacaacagagacaccagatgtgtaggggacctggtgagcacagcagtcattctgttcctgaaggaggagga

SEQ ID NO: 36882 - DNA, 201 bp, Homo sapiens
aacaaactctctgctgcctcttcttataggggcactaatcccactggaccaacccctacccttatgacttcatctaatcctaattacctcttcaaagtctygtctccaaaaactgccacattggaggttagggttttgacataagaattttgtggggacacaaacattcagtctatagcactatctttattttattaaata

SEQ ID NO: 36883 - DNA, 201 bp, Homo sapiens
caacacaagaccaaaaaataaaaataaaagagagagatttttagagctagaattaaaagctttggtaaagttcttgaaaaagtttttatattaatatcacrtgttcaacagtcctggatcagtgatttccagtccttgtgtatgatgtaacctattgttgcttgcgtgaacgctgttgaaagggttctacggcattagcga

SEQ ID NO: 36884 - DNA, 201 bp, Homo sapiens
  misc_feature (1)...(201): n = A,T,C or G, or insertion/deletion polymorphism (see Tables 1-2)
cacccactccaagcttcctttgatccttgctttgcccagccaagcagggaaactccttagctttccttggtctccagaggtccatctgactgttgatttgngatatttagtcttcctattacagtttgatttgattatgtgttggggaagaagaaagctttgacagcccctggaaagtagctatttagaatggtgctcttc

SEQ ID NO: 36885 - DNA, 201 bp, Homo sapiens
tgaatttacaaaggaagagattctgatttccacagtggcttctttttaatgccctaggattaggaaactgccttgaggacccacggcaagtacacccgctrttagggtagaggttttaactttaacctctgagtgactgctctgattcatttattttgtaacaactctatttagagtagccttgtttggtatggtagcagt

SEQ ID NO: 36886 - DNA, 201 bp, Homo sapiens
gaaactgccttgaggacccacggcaagtacacccgctgttagggtagaggttttaactttaacctctgagtgactgctctgattcatttattttgtaacarctctatttagagtagccttgtttggtatggtagcagttatttgcagaagtctctcttctcaatgaacacttacaccctgtgctccattactcttctaatg

SEQ ID NO: 36887 - DNA, 201 bp, Homo sapiens
atgcttttctggcacacctgttcactgtctttccattactttttctccactccaagtaaccttcctctcttaggaagtctgatgtctccaacagggatttkaagaaaatccagccccctgcccctgttttggtgcgtggattttagcattaatgtgtttcttggctgtttagttgtacagtctgtcatattcctgtctgtt

SEQ ID NO: 36888 - DNA, 201 bp, Homo sapiens
gtttttgctgaaatctgaaacaacttgtcattgggggtgggaggagaaagggtatacagaggatctccgttaaaatttgctaatagagctctctattatarccaagtaactcaaatcttatctatacctttatctattaagttaaacatagaaaattactgtatttataggtcaaaaatggcaaaatgctagcaatttcat

SEQ ID NO: 36889 - DNA, 201 bp, Homo sapiens
tggccgggtgcggtggctcatgcctgtaatcccagcactttgggaggccgaggtgggtggatcacgaggtcaggagtttcagaccagcctggccaacgtgrtgaaaccttgtctctagtaaaaatacaaaaattagccgggcatggtggcgcgtgcctgtaatcccagctactgggggcgctgaggcaggaggattgcttg

SEQ ID NO: 36890 - DNA, 201 bp, Homo sapiens
  misc_feature (1)...(201): n = A,T,C or G, or insertion/deletion polymorphism (see Tables 1-2)
acattggaagtgattaacatattgaataatttggtttgtgaaatgctaaataaattggggtgatttattttggaaagaggaaggagaggtggaacaataangcatattaaaatgtatatttgatggatcgccccatagatgatggagaggaagaacaagagaactgggtaaaatttcaagaagaatatctacttatggaga

SEQ ID NO: 36891 - DNA, 201 bp, Homo sapiens
catttattacaaatctaacatttagcaaacatctgttatacatcaagttgtgtttaccagacaaagtccttgtgctccagaggcttacagtctagtcgagraggcaagagagcaaaacaagacaaatcaaccagtggtagaaaaaatcacaacattcagtagaataacccacaaggctataaaacaagagaaacaagtgaa

SEQ ID NO: 36892 - DNA, 201 bp, Homo sapiens
  misc_feature (1)...(201): n = A,T,C or G, or insertion/deletion polymorphism (see Tables 1-2)
gaggattgcaggcatgagccaccacgcttggcctcttgactttttaataatcgccatttctgactggcgtgagatggtatctcattgtggttttgatttgnatttctctaatgatcagtgatgttgagctttttttcatgtgtttcttggccacataaatgtcttcttttgtgaagtgtctgttcatatcctgtgttacat

SEQ ID NO: 36893 - DNA, 201 bp, Homo sapiens
aatatctacttatggagaattattattcattgatatgggttgtgagtgagattgttaagtaattttccctcaaactgattaaaagccaacatagtctccawgtctcttggatggcttatacatagttcttgccagaaaaaaaaaagttgtggcttatttcttctcttgaggtctcactcaaatcagtaaatcattactcat

SEQ ID NO: 36894 - DNA, 201 bp, Homo sapiens
agtgagattgttaagtaattttccctcaaactgattaaaagccaacatagtctccatgtctcttggatggcttatacatagttcttgccagaaaaaaaaaagttgtggcttatttcttctcttgaggtctcactcaaatcagtaaatcattactcatttttgaaatatctgaagtctaacaacttggccctaaacccatga

SEQ ID NO: 36895 - DNA, 201 bp, Homo sapiens
atctaacatttagcaaacatctgttatacatcaagttgtgtttaccagacaaagtccttgtgctccagaggcttacagtctagtcgaggaggcaagagagmaaaacaagacaaatcaaccagtggtagaaaaaatcacaacattcagtagaataacccacaaggctataaaacaagagaaacaagtgaatgacagtttcag

SEQ ID NO: 36896 - DNA, 201 bp, Homo sapiens
gcccattttgggatcaagatgacagcttttgcctgtttaacaagcctctaatccctggataaatcaacaagcatgcttatttaacattccctttggctgcrcagatatgatttaatataatacagtaccttctagtaatacaaaataacctcgggtctttcccccaggaatcctgaagtttgcatcctgtaggtcagagct

SEQ ID NO: 36897 - DNA, 201 bp, Homo sapiens
gccgaggtgggcagatcacgaggtcaggagttcgagatcagcctggctaatatggtgaaaccccatctctactaaacacacacacacacacacacacacamaaattagctgggcgtggtggctcatgcctgtagtcccagctactcgggaggctaaggcagaagaatcccttgaactcgggaggtggaggtggcagtgagc

SEQ ID NO: 36898 - DNA, 201 bp, Homo sapiens
actcttgggtctctgtattccagtcatgtttgttcctgatatcacttcgttattccctgtgctttagtgaattgagttcatttgagcatctccttgacaamcttcttgtgactcattttgtaattcttctgcagtattttcatttccatatccctgatttcacaagttcaccttaatatctggatactctacacattcccc

SEQ ID NO: 36899 - DNA, 201 bp, Homo sapiens
agctgggaggcggaggttgcagtgagccaagatcgtgccgttgcactccaccctgggtgagagagcaagactctgtctcaaaaataaataaataaacaaayaaataaataaataaatacatttggactaagcttttcagcatataggaatagttcattgaaattaagcaaaacagttatgctacttttgtgttttcaaagc

SEQ ID NO: 36900 - DNA, 201 bp, Homo sapiens
gcttggagaagaccaaaaatagctgctacttagtcctaggtataaaattatgtgcttagacatgtaaaacctagttataaaactttatagtttttttttttgtgggtggggggcagagggggagggagaatgaagatagtgactacatcttcatgtagtgattatgggtaaactgaagtttttggtcagaaacttcccctt

SEQ ID NO: 36901 - DNA, 201 bp, Homo sapiens
ccaagtgtccatgtgaagattagtgtttctcccatgaccacctggctgtcatgtgacaaatcttgagggatagaaccttggctttatttggtctggcctgrttataagaacttagaagggtaggcaaaggacactataggtagctcacaatattctcgttaagttcactgcctcctcaaataaagacaactccttgactgt

SEQ ID NO: 36902 - DNA, 201 bp, Homo sapiens
caccagatgtgtaggggacctggtgagcacagcagtcattctgttcctgaaggaggaggatatctgtctcactacctctcccttagcattactagctctarcatttgtagaacttgatcctttccccattttatcctcatgactgtaagcaccttctcttcttaggttaatgtggaggagagttagtatctgagtattttc

SEQ ID NO: 36903 - DNA, 201 bp, Homo sapiens
tgctgtggattatggaggaagaaagaactgattttcggtcaaacacagaaaagcagtgacactctttaaactcaatacagtattcatatggcagacactcractttagaaagccaaacctttagactcctgctatggtctataaaatacatgtaaaattgcttttgctacattgttggtgctgcataattagtgtgcaatt

SEQ ID NO: 36904 - DNA, 201 bp, Homo sapiens
tggacttggagagatttctcttacctctaaactcccataggattttgttgccatttctcttagataatagtatctgaaaattagcattcgtatgtctggaycttttttgttgatgaagtattaatgcaaatacacatacacaggcaccttgttaatagttcataaaagtttcacaaagtagataccaatgatatcctcatt

SEQ ID NO: 36905 - DNA, 201 bp, Homo sapiens
ccttctagaagctttttaaaaagagcatctataaaagtaacagtaactttatttcaagattataatatttaagaaacaattgagaatagaagattgcatawgcattcatgttattgaacatgtgggctgttgcttacattctttatataaaagtcactggatcctgttttgtgagagagtgaaaatctagaagttcagggt

SEQ ID NO: 36906 - DNA, 201 bp, Homo sapiens
actacattcttctttttctttgccagtctattttcctgcccaaattcttaggcttccacagctgtgtggctcattgctggccagtgctgagaatgaaaaawctgctttattataagggcagtttttgggcatgtgtataggtttagacttttgagaggtttttattcagcgccttttctgaattctgagggcttttttttt

SEQ ID NO: 36907 - DNA, 201 bp, Homo sapiens
caaacatattataggcacatggcccttctcatctcacttccattcccatctgaaatattattttgtaagctgtggaataatgaaatttcactttaaaatgygttttataattggaattttgagtgtcattcttacctttctttctaattggagtgaggctctgaggatcccaaggcccagagtgggaggttgggaatgagt

SEQ ID NO: 36908 - DNA, 201 bp, Homo sapiens
  misc_feature (1)...(201): n = A,T,C or G, or insertion/deletion polymorphism (see Tables 1-2)
atgacatggtgatgtttggactgacccagctgatccttcgatgagaactgtgaggcatattgtgcttttatactggcaagcttgagaactgaagctggttnttttcttccttttttgtgatggtctttgaaacatagctgacattctgagttaagctttcctattagagaataataaaggcccatacttgacaaggtatga

SEQ ID NO: 36909 - DNA, 201 bp, Homo sapiens
ttgggctgttctatcttaggaaaaccccaaaacctactttctaatcccaaccatattaatacttttcaaagaagctgaagtgcctggtattcacgatggasatagaggcctggtgtctttatctccctcctccctcctcaaaaagagggtctaggtaaacagggaagctccctgtgcctggctctggggctcactgtagac

SEQ ID NO: 36910 - DNA, 201 bp, Homo sapiens
gagtgacttgatcacacgctgatgtttcaaggctgggtgctccccagctggagccctgaaaatgcttgtgtgacatccttggagaaggaaacaaacttgaragaaactcccacaaagtaaatcaccaggactggatggttttcatccaagagttggggaggaaatgaagtgtgaaatagcacagatactgatgaagacatt

SEQ ID NO: 36911 - DNA, 201 bp, Homo sapiens
aaacaaatgtcataactgagaatattcattactgtagctaagtcagaaaattactttttgttttaataggagggactatggctattgaaataacgtgagasgagtaagtaatgtctgattacaggctccctaagcaaatgaggcctgggatgtttttctggctgtggcaaatacagcttgttattttatagaggtcatgga

SEQ ID NO: 36912 - DNA, 201 bp, Homo sapiens
ctatggctattgaaataacgtgagaggagtaagtaatgtctgattacaggctccctaagcaaatgaggcctgggatgtttttctggctgtggcaaatacarcttgttattttatagaggtcatggaaaatgaaactccttcagggttttaacactgacaacagaataccattctggaaatgaattaaattagaattaaatt

SEQ ID NO: 36913 - DNA, 201 bp, Homo sapiens
aatatggtgcatggtttattgctgtggattatggaggaagaaagaactgattttcggtcaaacacagaaaagcagtgacactctttaaactcaatacagtrttcatatggcagacactcgactttagaaagccaaacctttagactcctgctatggtctataaaatacatgtaaaattgcttttgctacattgttggtgct

SEQ ID NO: 36914 - DNA, 201 bp, Homo sapiens
acagtattcatatggcagacactcgactttagaaagccaaacctttagactcctgctatggtctataaaatacatgtaaaattgcttttgctacattgttrgtgctgcataattagtgtgcaattttaaaggcaaggaatatttaggaagaaaataaccttgaagcctggaagactctttcaagtcagagtctgtttgtca

SEQ ID NO: 36915 - DNA, 201 bp, Homo sapiens
agtattcatatggcagacactcgactttagaaagccaaacctttagactcctgctatggtctataaaatacatgtaaaattgcttttgctacattgttggygctgcataattagtgtgcaattttaaaggcaaggaatatttaggaagaaaataaccttgaagcctggaagactctttcaagtcagagtctgtttgtcaga

SEQ ID NO: 36916 - DNA, 201 bp, Homo sapiens
tgacctcacttgctttggcaagtttaacaagccattgtggtagaaacaaggtattgcccagaggccacgagaattcatttggtatttgcttccaattccamagggtccttcctctgacacacacgttgacagcctgagaacttgcagaaaattttctacagttttatgcactaaaaaatcttggtggctctttgtttggag

SEQ ID NO: 36917 - DNA, 201 bp, Homo sapiens
tcgactttagaaagccaaacctttagactcctgctatggtctataaaatacatgtaaaattgcttttgctacattgttggtgctgcataattagtgtgcarttttaaaggcaaggaatatttaggaagaaaataaccttgaagcctggaagactctttcaagtcagagtctgtttgtcagaatctcacattgctttgaaag

SEQ ID NO: 36918 - DNA, 201 bp, Homo sapiens
ccctcacatcctgctgatggttgatggctcctgccttttagaaaacacctgtatgctccgccactgtgtacacttcggcaaagagaaatggatagctaacrtaagaatcaaattctttgttgcatagtctaaatcaccagatcaaatccctcatgctgttttcttccccacatcatatttagtaattgagtcacttaaaac

SEQ ID NO: 36919 - DNA, 201 bp, Homo sapiens
tttttctcctgggaaatagttccaaaatatatcagatgcttcctgctttagaaaagagagtttatagaacacccctttcttgatgacttagcctcagtcaytatgactaggttattatatagtgaatctcttattgctgaagtttataggaccatttgctcctgctataaatgtccttagagactgtgtcatttctcttgt

SEQ ID NO: 36920 - DNA, 201 bp, Homo sapiens
tcttcagtgtctgttgttcctgtatttatgtccatgtgtgctaaatgtttagctctcacttataaaagaacatgagatatttggttttctgttcctgttttttttttttttttttttttgagactagatctcattctgttgccctggctggagtacagtgatgccatcacagctcactgcagcctcgaccttcccaggctc

SEQ ID NO: 36921 - DNA, 201 bp, Homo sapiens
gtcttcagtgtctgttgttcctgtatttatgtccatgtgtgctaaatgtttagctctcacttataaaagaacatgagatatttggttttctgttcctgttttttttttttttttttttttgagactagatctcattctgttgccctggctggagtacagtgatgccatcacagctcactgcagcctcgaccttcccaggct

SEQ ID NO: 36922 - DNA, 201 bp, Homo sapiens
agtcttcagtgtctgttgttcctgtatttatgtccatgtgtgctaaatgtttagctctcacttataaaagaacatgagatatttggttttctgttcctgttttttttttttttttttttttgagactagatctcattctgttgccctggctggagtacagtgatgccatcacagctcactgcagcctcgaccttcccaggc

SEQ ID NO: 36923 - DNA, 201 bp, Homo sapiens; identical to SEQ ID NO: 9502

SEQ ID NO: 36924 - DNA, 201 bp, Homo sapiens
cagtcttcagtgtctgttgttcctgtatttatgtccatgtgtgctaaatgtttagctctcacttataaaagaacatgagatatttggttttctgttcctgttttttttttttttttttttttgagactagatctcattctgttgccctggctggagtacagtgatgccatcacagctcactgcagcctcgaccttcccagg

SEQ ID NO: 36925 - DNA, 201 bp, Homo sapiens
tcctatgccacccatgaagagggattctggaaaggtggcttacattcttcacactccctttgtgggtctcactcttgggcctgatgaagcctgaagcttgrcatattgtaattctgctagccaaggaggtgcttgggactcttccctctttatggtggggataggctctgaaggaacttgaggggtatgctcaacaagggc

SEQ ID NO: 36926 - DNA, 201 bp, Homo sapiens
tttctggggcctcttttataaggggcactaatcctattaattagagatcttcaaggagattatggatggagaagccaggcatgacccacagctcataaccrttaggatgagaggtctttgaagacctaggataaactctgtgctcatttaccttgcctggaaggataactatttggtagacgatcttttatacctgaacta

SEQ ID NO: 36927 - DNA, 201 bp, Homo sapiens
gcaatggaacaatgagaacacatagacacaggaaggggaacatcacacaccgcggcctgttgtggggttgggggaggagggagagatagctttaggagatytacctaatgttaaatgacgagttaatgggtgcagcacaccaacatggcacatgtatacatatgtaactaacctgcacgttgtgcacatgtaccctaaaac

SEQ ID NO: 36928 - DNA, 201 bp, Homo sapiens
gtgcatgtgtctttatagcagcatgatttatgtttattgcggcactattcacaacagcaaagacttgtaaccaacccaaatgtccaacaatgatagactgsattaagaaaatgtggcacatatacaccatggaatactatgcagccataaaaaaggatgagttcatgtcctttgtagggacatggatgaagctggaaacca

SEQ ID NO: 36929 - DNA, 201 bp, Homo sapiens
agaaattttttctggcttttccttcccaagagcagtggggaatatgtgcatgaactgacaggagatcccagcttagggctcagccacatggtaccagggarggtagattgtcaggagaaggaaggagaaaaacccctcaaacacagggtaatcactgagcaaatggaggggtgagaaatatgaggcagctctgtgagaatg

SEQ ID NO: 36930 - DNA, 201 bp, Homo sapiens
gagagtttttagagtcacatactgggcaaattttagtttttatagagaagtgagtcgggtgggtcagacatctgtgtgccaggccaagttctatatccagyttcaaattaaatcttgagctgaaaggaaattaaataaaagcaacaactgttattaaaaaagtgatttttgtaattttctaggagtactaagaaagaaatc

SEQ ID NO: 36931 - DNA, 201 bp, Homo sapiens
tttttagagtcacatactgggcaaattttagtttttatagagaagtgagtcgggtgggtcagacatctgtgtgccaggccaagttctatatccagcttcawattaaatcttgagctgaaaggaaattaaataaaagcaacaactgttattaaaaaagtgatttttgtaattttctaggagtactaagaaagaaatcagtta

SEQ ID NO: 36932 - DNA, 201 bp, Homo sapiens
taaactatttctgcttttgagatctctcctaccaacttgtaatttaattatgtaataaccatttctaaattaattcagttacctaaatggtcagtgttcaytgatatttttccaaagatcatcattgtcaccaattttctagattcccactgaaggctttattgtgtagctaagtaaaccgatacagtgaggaaactgtaa

SEQ ID NO: 36933 - DNA, 201 bp, Homo sapiens
atgatttatgtttattgcggcactattcacaacagcaaagacttgtaaccaacccaaatgtccaacaatgatagactggattaagaaaatgtggcacatayacaccatggaatactatgcagccataaaaaaggatgagttcatgtcctttgtagggacatggatgaagctggaaaccatcattctcagcaaactatcgcg

SEQ ID NO: 36934 - DNA, 201 bp, Homo sapiens
atgtaagagggatattgtgacaattcatgcacagcagcattccagtagaagccttagaaataatatgataataaatatgtaatgcatatgctgctattccygactcctgtgtccatgaaacacatcactaatcaatctggtactcttccctatgagcttggattgggcctcatgcttctgaatttcaagctctcaaatgcc

SEQ ID NO: 36935 - DNA, 201 bp, Homo sapiens
tgtaagagggatattgtgacaattcatgcacagcagcattccagtagaagccttagaaataatatgataataaatatgtaatgcatatgctgctattcctkactcctgtgtccatgaaacacatcactaatcaatctggtactcttccctatgagcttggattgggcctcatgcttctgaatttcaagctctcaaatgcca

SEQ ID NO: 36936 - DNA, 201 bp, Homo sapiens
gtgtaaggcaattccttacctcaccccaccctccttttcttggccatcataaaaaatccatcctggggttagcatcctttgatgactcattcccttttggsaagagctttagaggaaaaagaaagacaggagagacttgggaggaagacttttcctggagggtctgggaagttgggatgtgagggtgggattctaagtttt

SEQ ID NO: 36937 - DNA, 201 bp, Homo sapiens
caattcatgcacagcagcattccagtagaagccttagaaataatatgataataaatatgtaatgcatatgctgctattcctgactcctgtgtccatgaaasacatcactaatcaatctggtactcttccctatgagcttggattgggcctcatgcttctgaatttcaagctctcaaatgccacattcaaatggctagagct

SEQ ID NO: 36938 - DNA, 201 bp, Homo sapiens
acttctttcttttctcgaaattctttctcactcctcctatataaaattaaaagctgttacctatggaaagttaggagagaatcaaaatgggtagggaaacyagctatatctaagattattcaatcagaaaatttcatcttgtatagacagtattgaatccacaaatgtgacacatctgtctcataagtgcgtaggctttgc

SEQ ID NO: 36939 - DNA, 201 bp, Homo sapiens
ttgtatagacagtattgaatccacaaatgtgacacatctgtctcataagtgcgtaggctttgcaatgactgtttattttaatagattttttttttttatartttgagggcatttatttacattcaaatgacagattaccaggggttatctttggtattctgtctgtaagaattttcaaataaaccaaaaacttttatttca

SEQ ID NO: 36940 - DNA, 201 bp, Homo sapiens
aaaaatcactcaaaattccagcttgtagacaacaaaattgagcaatatatttttggtcaagcaactacttgttagtggtagagcgtagtagaactcaggcwtatggactacatgtcaaatgctctccttttgatcattctttgtttataacaagacaaaggccgtcattttcaaaatttagccagtgaggaatgaatacct

SEQ ID NO: 36941 - DNA, 201 bp, Homo sapiens
gtgccttttgtgtaacactgtcctcatagaaaaaagaaattttgttggctaggatttgggcttaatgtactagaacttttgaaaaattggcatatcctcakgatataaatgttaatcctggcttcttgtagttcttctggaaaagtagaagttgactgtaacttaaaaagttcttcagtaaacatccatatattgggttgt

SEQ ID NO: 36942 - DNA, 201 bp, Homo sapiens
tatctacatcaaaatatcagttctgaattggatgtagacaaaatttgggacaagaaactgccattgtgtgtgtgtgtgtgtgtgtgtgtgtgtgtgtgtgkagctagtttaacaaattgggaatgtataaaatttgggaggccaaaagttttgtcacccctaggtatcatgggacgattctaaagcatcccagttttgaaa

SEQ ID NO: 36943 - DNA, 201 bp, Homo sapiens
ctcccgcgggatgggggtggggtggaagatctaacagaactaactttatgtaacagagttcggttggtcatttcccattacgttatcattttttaaaaaakaaaaagatgggtatttggattagagaaaacgaaatatatttgtggggcaagtgtctaggaggaagaagctgaaagcccagcaccctctggctttctgcgg

SEQ ID NO: 36944 - DNA, 201 bp, Homo sapiens
ctggaaggtgctcctgctgaacagccagagctggggagtagaccccgcttcacacgctgacaagcccggggagggggcagcggcctgcactgggatagagacggtctggggctcaggagcttggggatctcagccacaaagctgtccaactcagaggagggacagctgtcgcttacattttctctttaggcagtgacagtt

SEQ ID NO: 36945 - DNA, 201 bp, Homo sapiens
gctggaaggtgctcctgctgaacagccagagctggggagtagaccccgcttcacacgctgacaagcccggggagggggcagcggcctgcactgggatagagacggtctggggctcaggagcttggggatctcagccacaaagctgtccaactcagaggagggacagctgtcgcttacattttctctttaggcagtgacagt

SEQ ID NO: 36946 - DNA, 201 bp, Homo sapiens
ttaatgtactagaacttttgaaaaattggcatatcctcatgatataaatgttaatcctggcttcttgtagttcttctggaaaagtagaagttgactgtaacttaaaaagttcttcagtaaacatccatatattgggttgtaggaagaccaaagccattgtcatttgcttcggcatgggtaccaataggtaccatagcctgt

SEQ ID NO: 36947 - DNA, 201 bp, Homo sapiens
cggaacatgtaaaaagcaggggggatgtcatgtctgtattttaacagaaccctaggaggggagaagccaactttaacgttttgtgttaagtgccaagattwcaactgtgcaaaaacagcccgggggaacagctgttgtcggaagaatcttgagtgtgcgcgcgcgcacatacaacgctcgcaacttggtttagcggtttca

SEQ ID NO: 36948 - DNA, 201 bp, Homo sapiens
gcttcaaaggttagatggaggtgcaagggcagtgaagagctgcaggtgttctctaggtctgatttgcatccagttgtttccattcagctgcaaaaatgcayggggctctcgaaactagagcttcctggtgtgaatcagatgaaacctgaactgggcggaaggtggcaagttttccagtgcaagcctagcggatgtacttag

SEQ ID NO: 36949 - DNA, 201 bp, Homo sapiens
tgcacggaacatgtaaaaagcaggggggatgtcatgtctgtattttaacagaaccctaggaggggagaagccaactttaacgttttgtgttaagtgccaaratttcaactgtgcaaaaacagcccgggggaacagctgttgtcggaagaatcttgagtgtgcgcgcgcgcacatacaacgctcgcaacttggtttagcggt

SEQ ID NO: 36950 - DNA, 201 bp, Homo sapiens
aaaaatgcatggggctctcgaaactagagcttcctggtgtgaatcagatgaaacctgaactgggcggaaggtggcaagttttccagtgcaagcctagcggrtgtacttagttggaaagtcacgtcaggcccataaacacagcaagatggagaggccgccaaaaacagaggcagaaatagccagggggtcccccatcccgcc

SEQ ID NO: 36951 - DNA, 201 bp, Homo sapiens
tgacaggcagtgatgctgagtggtatggaattgaagaacataatgtttgcactgaatctttacttgcacaaatgtaatagtctaatctaggtttggacctrtaatttataattattttagtttaatatggcatttattttgttgccccagtttggcctcattctcttcaacatggtgacattagtactatttatattgcct

SEQ ID NO: 36952 - DNA, 201 bp, Homo sapiens
aaaagcccaagcaagctgactacaaactttttaacatttgcctctcatctggtcagcagaaatccctgtaacttgttaatagttccaccccccaccttttyttttttttctttttgtagtgaaaccagttgaggccttaaatcagtaccattccttccatcttgggccatcagagaaaaccatttagagttgtaggaagtc

SEQ ID NO: 36953 - DNA, 201 bp, Homo sapiens
aatgctttgaggctgagacaggaggatttcttgagcccaggagtttaagaccagcctgagcaacatagtgagaccctatctctactaaattttttttttttaaattaatgcctatgtgccagatacagttatgagcactttgtaatgtatactattatatcttacctatttctcaaaacatctctacaaaatagatattgg

SEQ ID NO: 36954 - DNA, 201 bp, Homo sapiens
ctgtatccccaagatctactacagggcctggcacccagtacgtacccaatgaatagtgaatgggatcacttgctggcactgtggctcaggtgggcagagccactctcaaacttcttcttggagcacaaccacctaatatgtatgtagacattgataaggagtgatcattgagggacgccattgggcaggcacagacacagg

SEQ ID NO: 36955 - DNA, 201 bp, Homo sapiens
tgactatgtggagatgtctcctattcctacttctaacagattaacagctaataaacaccatgtaacactctcttctctgaacctcttcttaaaatacagagtttggtttgccaacattggtgtatttaaagcctccaagattccagggaagactttagaaagttaactgtgcaagtgaggcctgttcagagaggaaatttt

SEQ ID NO: 36956 - DNA, 201 bp, Homo sapiens
gaaagtatactgatttctagttttctgtacatctcacctccaatctgtgcttttcctatagtgcttcaacttagtgatttatttttgcatgagaacaaaaygtaggttccttaaagccaagcctggtacaattcccctttttatttcagatcattctgcactctatgcacaaataccagcctcgagttcatgtgattcgca

SEQ ID NO: 36957 - DNA, 201 bp, Homo sapiens
gtgactatgtggagatgtctcctattcctacttctaacagattaacagctaataaacaccatgtaacactctcttctctgaacctcttcttaaaatacagagtttggtttgccaacattggtgtatttaaagcctccaagattccagggaagactttagaaagttaactgtgcaagtgaggcctgttcagagaggaaattt

SEQ ID NO: 36958 - DNA, 201 bp, Homo sapiens
aatacacactgaatacataaataaaatcaataatataaatctatgagaccaatattattctctgtaggataatatatattataggatcatttctattatakaataatttatatatatgctatgtaggatatatttataagacatagatccactgtggattaataagacatggttaggcatgtatggtcttagccattattt

SEQ ID NO: 36959 - DNA, 201 bp, Homo sapiens
ttaagagctaaaacagtgtgaaaaaaaatgtaactgtttttctcctgggaaatagttccaaaatatatcagatgcttcctgctttagaaaagagagtttayagaacacccctttcttgatgacttagcctcagtcactatgactaggttattatatagtgaatctcttattgctgaagtttataggaccatttgctcctgc

SEQ ID NO: 36960 - DNA, 201 bp, Homo sapiens
catgatggggcaaggatgaattactaaagatagaagccatttttgtccttcagcattctggaaaactagattaaaataaattgctacggcaagtaaggggrcccttgtatttttctctttaaatatctcaaaattacctgataatcacactttaattctcactggctacccacaggatctgataagggcaacaattattaa

SEQ ID NO: 36961 - DNA, 201 bp, Homo sapiens
  misc_feature (1)...(201): n = A,T,C or G, or insertion/deletion polymorphism (see Tables 1-2)
tttggttttgcagaacacaaaacatttgtggaagactttggagttacagagtttgccaaacctcaaaccaaaacatgttcaggtttgtcaatctcaatccntcctagtacaatccagaggctcaagaagaggggaatgagaggaaagatggggaggacacagccacccacaacactctcctcaaatgcctatgagagtctc

SEQ ID NO: 36962 - DNA, 201 bp, Homo sapiens
agtgtcaaggattgatgctcaagaagctctgacccttgacaccattgaaaagtcactcatcagagtacaacacttgtttccagcctttactcatgaatatwtttaactccaaggaaagcaatcagaattctagatgttaagggtgggttagagaaatggattcttaggcttgacttgcagcatcatttgacctaagaaaat

SEQ ID NO: 36963 - DNA, 201 bp, Homo sapiens
  misc_feature (1)...(201): n = A,T,C or G, or insertion/deletion polymorphism (see Tables 1-2)
aactccaaggaaagcaatcagaattctagatgttaagggtgggttagagaaatggattcttaggcttgacttgcagcatcatttgacctaagaaaattatnctagataatctgaatttgaaaaatgttaggacacacaattcttggcattaagctcctaaaggtaaatatttaaaattccagtaaatcttcccgggtaaat

SEQ ID NO: 36964 - DNA, 201 bp, Homo sapiens
ggattgagcaaagccttcttttgctgaaaataattagagcaatttggccatactaattatcctgcagcctagtggcctctgtgtaagaggatatgtgataragccaatctctcggtgtggactgtaaactgaccttttaaagatgttatctgtctgcccccattataaaatgggttattttgcttgatcagtgaaaagttg

SEQ ID NO: 36965 - DNA, 201 bp, Homo sapiens
aaaattatgctagataatctgaatttgaaaaatgttaggacacacaattcttggcattaagctcctaaaggtaaatatttaaaattccagtaaatcttccygggtaaatctggctctagccttctccatcagtcagcttcccctgccccccagccccacttgtcttcatgagtacagaagacacaggaaaggaccatctgg

SEQ ID NO: 36966 - DNA, 201 bp, Homo sapiens
gcaagatggtctcaggtggccattttaatactcattactacatagagaaacacaatcccttcctcttcataataaagataaaatatatttttattaagatscaccattagtaatctgtgtcatattcttttgaatctttttcattgtaaatatctggctgagggaaaaagcattttgttacagcagaatagagcttggaaa

SEQ ID NO: 36967 - DNA, 201 bp, Homo sapiens
ccttagaaataatatgataataaatatgtaatgcatatgctgctattcctgactcctgtgtccatgaaacacatcactaatcaatctggtactcttccctwtgagcttggattgggcctcatgcttctgaatttcaagctctcaaatgccacattcaaatggctagagctgacatgcatgttgaaactcatttgctctccc

SEQ ID NO: 36968 - DNA, 201 bp, Homo sapiens
attctcatttacaaattgatgattttgtctgaatcagtactagtctatggagaagttttttatggtccactgaaaaatgagaaaaataaagaaatatgggkacttttatgaatgtagacattcaatttaatagactattttattttgtctttcctacttttttgatataaaaatgtcacttattttatgaaattatgagac

SEQ ID NO: 36969 - DNA, 201 bp, Homo sapiens
tgtgcccctcggttataatatttccctcctgggactgctatcaggattatgaatgggtcatttctctgaaagtcctgccacagaggagatttccaaaaagyagtggctgttctcgttcttgtgaatttcttcctggcaaatggtgactttgaatatgggagttcccagacccaccctctttgggcagatatgtctgaatgc

SEQ ID NO: 36970 - DNA, 201 bp, Homo sapiens
cactccacaggtgttggccgcatcaggtcttgcaggactctgctgggtgccgaggtgggagggaagaggggaacccttggtccgtttccctgagggatgaygagcagcagatggagaggacagcgtgaaggggcgtggcggtgaggctggaggggagtttgtctggcctgcagagcctccttcctgatgcacgcgctgctg

SEQ ID NO: 36971 - DNA, 201 bp, Homo sapiens
catagccaacaccggcctcttaggatcacctgggtcctgttggccgacttggaggtgctgccttttcaatgacaaggcgtttgttatgtgtaaagaaaggygttgaattggacggtctccagcttctgcccagcatggagcctgcaacattgtgtgggagtggggctcccatagggtaacaatggctcacccagctcaccg

SEQ ID NO: 36972 - DNA, 201 bp, Homo sapiens
ggtcacctgtcaaagacggctagccctcctggggattttgaaatcagggcacccgcggcaagttcccaggctgtgcctggggctcaaggcggtggctgctyctgtgctctgggcttattcccaggattctcagacggctgatggaaaacgccccggaccctccgtagtgccgcggggaagtccccggaaagggtgtgaaaa

SEQ ID NO: 36973 - DNA, 201 bp, Homo sapiens
gttatgtgtaaagaaaggcgttgaattggacggtctccagcttctgcccagcatggagcctgcaacattgtgtgggagtggggctcccatagggtaacaayggctcacccagctcaccgtgcccactgtttgccagccatggggtctcctgcacaccccatcatagacgcaggtgctgggccggcatccccctttcacagg

SEQ ID NO: 36974 - DNA, 201 bp, Homo sapiens
cttcagcatctctttttgaggggcccagcgtgctctcaacttgtggtctcttgtccttctcctgagatgcgtcagggtgtaaggcatggttcccccacttyggcgatgagatgtggggcccagagaggccaggtgacctgttcaagatcacacaggcagcagcttacaggattcaattccgagccagtttctggagaggcc

SEQ ID NO: 36975 - DNA, 201 bp, Homo sapiens
aatctgtagatcagtttggaaagtgttcccatcctaacaatattatgtttttcaatctatgaacacagggtatctttccttttatttatatcctctttaakttccttcaaaaattttttatagttttcagtgtacaaattccttcactttttaatgtaggcagtaaaccacagaggtattagtagtacttgtgactttgtc

SEQ ID NO: 36976 - DNA, 201 bp, Homo sapiens
cagaccttccatcccggacttcccgccgggactgagtgtgggtacaagggttatggctcttgggatcattttccagaaggcttctaaggtcacaatgaggraactgagcctcagagcatttatgggacatacccaaggtcactgggctgaaggttacagtcctccaggatgcagaagtttctggcagtgcctcttactcca

SEQ ID NO: 36977 - DNA, 201 bp, Homo sapiens
actgagcctcagagcatttatgggacatacccaaggtcactgggctgaaggttacagtcctccaggatgcagaagtttctggcagtgcctcttactccacygtgcttggagccagatgtctctcacgtaagacctctcttaacctgaacaacagcaacgtgttgctaacggtcagagttcagggaggcgatgtcacctgtt

SEQ ID NO: 36978 - DNA, 201 bp, Homo sapiens
ctggtctcccctgacatttgccagacacttattctgcaccaggaactattctgccagttttacaggtttaaattcttttaatgtgttgataatgccatgakgtcactaccatgttacccccattttgcagatgtggaaatgcaggcacggagagtttgagaattgcccaaggtcacctagcctgttagtggcaggtgggga

SEQ ID NO: 36979 - DNA, 201 bp, Homo sapiens
cttattctgcaccaggaactattctgccagttttacaggtttaaattcttttaatgtgttgataatgccatgaggtcactaccatgttacccccattttgyagatgtggaaatgcaggcacggagagtttgagaattgcccaaggtcacctagcctgttagtggcaggtggggatagaatccaggtcgacagaatattgat

SEQ ID NO: 36980 - DNA, 201 bp, Homo sapiens
caagagtgtggttacaaggtttatggctcttgggatcatttttcagtgaccctggaatgggctccgctgttctttctccccaaggctggctttgggggtcrtagcaccggatgagaggccctctggctgcccgcctggggctgaccatccccagttgctggggtctctttgttctgtcctggtccccaccatcgtggagag

SEQ ID NO: 36981 - DNA, 201 bp, Homo sapiens
tcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgataggaggtggctgggctgccactgaatttgtcaacttaga

SEQ ID NO: 36982 - DNA, 201 bp, Homo sapiens
tgcaggaccggaagctggtctgggtgggtgagtgagggagtgggtggtgagtgaatgcgaaggccgaggcatggctgtgcactcctgtagacgagtgagcrctggacatgtgggctacactccattcataacatactctttcttcagtaataaattaacctgagctcactgtaacctttttacttcataaactttttgtgt

SEQ ID NO: 36983 - DNA, 201 bp, Homo sapiens
ttcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgataggaggtggctgggctgccactgaatttgtcaacttag

SEQ ID NO: 36984 - DNA, 201 bp, Homo sapiens
caagtcccacagagaggaaggccttgcccaaggccacgcagggaaaggggagcagggctggggggcacacccaccctcctgacctgtgtccctctcctgcytgtcccaccgcaggagccacactggtgctgggctctctacaggcatggaaatgctcgctttgcatatataatgctcattcccaaaagcccacaagtgaca

SEQ ID NO: 36985 - DNA, 201 bp, Homo sapiens
cttcttcctttgaacaaaggctccttggacccagtggcgggaaactggccctcccacaccccctgcctgctctgggggcagcagtctttggaggagtaataatgccaggcagcccctcactgagggccccagtctcccctgcatttcttccctgattgattgataggaggtggctgggctgccactgaatttgtcaactta

SEQ ID NO: 36986 - DNA, 201 bp, Homo sapiens
ctcagcagtccggggaagggccctcctcgaaagtgggcccagccagggtctgccgtgggaaatgcccaggatgatacctaccggatcccagcggattgctstgggggagggagggagagagacgggaccatgtccgccacatgaaagaggagaggatgtactgggggaagccaagtcccacagagaggaaggccttgccca

SEQ ID NO: 36987 - DNA, 201 bp, Homo sapiens
agaggacaccagggctttacaacaagcagaagcggagggtgcgggcttcagggaacgagggcagtgctggccctgacccagtgggaaggggtttgtgatgktagaggagcacagagggagcagcgggcagtggggacgtgctggtgggggtgtgctggtggggggctagccacaggcacagggaggcggcagaggatgaac

SEQ ID NO: 36988 - DNA, 201 bp, Homo sapiens
ttggcattttccactagcatctaatgagggggtgtcctttccggagaaggcacctaggaaggccagggagctgctggtctgtatccagctgcccttggccraagctggagaaaggagaggcgtgagctcatgaagtccccttgacctcctccctccatatttgtgcgtgtgtttgtcacacaccaacgctaggcagcttgt

SEQ ID NO: 36989 - DNA, 201 bp, Homo sapiens
acgcacttgctggttccccacagggaggagggggtggctaaaactgccttccctatcctgcaagcccaagtcccgctggatacctggcctgggtgggagaygacccaggagatgaagccccagtcctgtgtccggctgcagatgagactggcggccacaatggaaggggcctggcaccttttgtttaaaaggcgctccagg

SEQ ID NO: 36990 - DNA, 201 bp, Homo sapiens
ttttggctttgagacatactctcgtccctgccaggctccctggcagccgggtgagtgccttcaaggtccaggtccagtgtcatctagtgacccatgccccrtgccctccagccggggcaggctgtccccctccaagccagctgtcttgcagctgtcgtgagttcatctgtaaacaccagctgaacacctactgtgtgctgg

SEQ ID NO: 36991 - DNA, 201 bp, Homo sapiens
aggcccagagaagttggggaacctccccaagctcctccaagtgcaggcccagctgagtcacgctcccctcaaggcacacaccccacaggtgagggtggctytgtatgagatgggtatggggggcggcaggagcctctcagaaagccttccctggcccatgtgggctcacggcaaggcctctgcattctgcttccgttggga

SEQ ID NO: 36992 - DNA, 201 bp, Homo sapiens
cgggctagaaccaccccccttctctccgcgtccgggcatcgtcccagcggcccctcctctgtgcccaggatgctcgggcggcggctgcagtgggacctccrccttctctgccaaccagagcggaggaacctttccgcctccctccaagcggcgcactgagcgctctttgcctagaacgacttccctcccgctgcctggggc

SEQ ID NO: 36993 - DNA, 201 bp, Homo sapiens
cagtttcattgcaccaaaatcaaggggtgtgccgggccctgctctgtccggaggctcttaggcagacactgtttccctgccgcttctgtcttctggaatcrcatggggctcatggtcccgtcctccgccgtcatatcctgtagcgcaatgtcttcaagcttctctctgctcttttctctgtcttcaagtcgccgcctcctc

SEQ ID NO: 36994 - DNA, 201 bp, Homo sapiens
tcagcctgtaggggagctctttgccacaccacgggccgcccgctgactctccctggatgtatttctttgcccttctccccttgactgttccagggactctygcattctcgttgcacggttcggctggctcctcagccgttgggcctgggatcctggaggaaaggcttggccaggtttcggaggacacccccgaggaggtgg

SEQ ID NO: 36995 - DNA, 201 bp, Homo sapiens
cctccttgaggctctagggggcttcagggagcaagaagtattctcctcagcatttgcatcagtaaagataccaagaggttgcaggggccatgccaaatgggtcatgtgaggagatgtatttcaaagaattgtctgcaaaggtggccagggtgtagggctcaaaagaagcgttcagtggcctgggctcgcaaggggagctat

SEQ ID NO: 36996 - DNA, 201 bp, Homo sapiens
aagggggtttcctccttgaggctctagggggcttcagggagcaagaagtattctcctcagcatttgcatcagtaaagataccaagaggttgcaggggccaygccaaatgggtcatgtgaggagatgtatttcaaagaattgtctgcaaaggtggccagggtgtagggctcaaaagaagcgttcagtggcctgggctcgcaa

SEQ ID NO: 36997 - DNA, 201 bp, Homo sapiens
ttgagagcccgctctgctgtctgccaggcgcacaccccagggccagtgaggagatgagagtgaggataacagcagcgacagcagacagctccgtcatgctsccccccaacccaggtgctgttctcagtgtcccgtgactgtccctggaaggcgttcctttcactgctattcacaggctggagccaggtgccagactcccgg

SEQ ID NO: 36998 - DNA, 201 bp, Homo sapiens
gaatttttgtgaagctaaaaaaaactaagatagtgacagggaaggtatttcatggtcatcatcatcacctaatttttcgcctggaggatggttaaaggggktttcctccttgaggctctagggggcttcagggagcaagaagtattctcctcagcatttgcatcagtaaagataccaagaggttgcaggggccatgccaaa

SEQ ID NO: 36999 - DNA, 201 bp, Homo sapiens
tgcccagtgaacagtgatgcttctaacctcttgtgcccagctgcccttaccaggttcttccagagatagtctctgcacatgctgtgtgggggggggccttygtgtgcgggtgtgtgtgtgtctgtcctgctgccttccggccacccctgacagtcccacctctgcccacaggtctccgtgttggtcctcttcgccctggcc

SEQ ID NO: 37000 - DNA, 201 bp, Homo sapiens
gggatgagctgcagtgactagtgtggctctccaggcatctgcagccttgcagagacggggacgtggtggaggtgtcgtcccatgtcatagggaaggagtcygtggctcagagaggttaaggggcttccaaggtggtgaggctggtaagctgcgaaggtgcagagctgcaggcagaatctgcaccctgggccctggtgctgg

SEQ ID NO: 37001 - DNA, 201 bp, Homo sapiens
agcttcgggactgcagccttaggaagcagcagagctccccagttctttaaccttgttggctgtagggtctgtatgtggccaggggagagtcccagcccctygcatcctccaggctgctgggaggggcggtggggagcgagcagctctgtgcatgttcatacgattacggaggccctgccacgtgctggcacctggcatcct

SEQ ID NO: 37002 - DNA, 201 bp, Homo sapiens
gctgaccatccccagttgctggggtctctttgttctgtcctggtccccaccatcgtggagagcaggtgacggactgcccaatgaaggggcctcgtccctcrggggagaaagagcttggaggtggctggctgtctctagtgcaacagcctctcctggaacctggcttggggagcggggtttggggattagagacctataaca

SEQ ID NO: 37003 - DNA, 201 bp, Homo sapiens
ctcccagtggccccaagctgaggcatatcgtgaggagggtgaaaaaggcagacgtggcccgagaggacactaggtttctacctctgcctttaaaaaaaaamaacaacaacatgaaattactacatgttttataaaaaagttttaaacataatggggaaagtgccccaaatcccacatttttatactggcttttccctttat

SEQ ID NO: 37004 - DNA, 201 bp, Homo sapiens; identical to SEQ ID NO: 9505

SEQ ID NO: 37005 - DNA, 201 bp, Homo sapiens
ccctctgcctgctccctactaatagtaggtactatttgtattaccagtgttacagatggggaagtcgaggcacagagcagtctgtgtctgtccctgctggwatgtaaggatgtcgtgtgtgccgagaggctcttttggtggctcctggctcggcccatcgtacgtttttgaggttcttggccaggaccaagacatattgat

SEQ ID NO: 37006 - DNA, 201 bp, Homo sapiens
gacagcttctgtgcagctccctggcccagccatcatcttagctctttcatctccatgcatgaattgcaggaatggaatctcgcctttccgatcttgaagtracaggtaaatcgtttgtcccctcctctctccaatttgtgtagctcagaagcacctcatctttataggcgtttggatggcatccttgaaacggagtgtctt

SEQ ID NO: 37007 - DNA, 201 bp, Homo sapiens
ggccagtgggattagcgcgtgccttatctgctgccactcacctgtcctgccccatttgcaccctgggtttggctgctgtccctggttgaggcaggagtggmcttgatttcaaggtcatggtgtcctctgtcctgatggctaaatgctgtgtgatgtctgagtgtgtctgggtttctcaggccccacttgccctttgctttc

SEQ ID NO: 37008 - DNA, 201 bp, Homo sapiens
gaagctgcagctggttgagggctgggcgggtctctctttctgaaacgggagcatatggggagcaggctatgctggagacacgggcatgatggagggtccgsaatagagattcaccctccctggcttgtgtacccccctgccagggcccagtcgaagctgtggttgggacagagcatcttcctcgtcccactagtgactgga

SEQ ID NO: 37009 - DNA, 201 bp, Homo sapiens
gcagatcacacctctgccaggaagcctcctgggtcactctcatttgcaacagacctcaccgccctgtttccagtgccttttgtagccaggctgcaatggcrtctaacagtaacggagtgatccatgagctagactctgcttcacactcctaatgctcatattgtctcatttaatcttcataaacacctcaggaggtaggcg

SEQ ID NO: 37010 - DNA, 201 bp, Homo sapiens
tcttgcacacacagtaacagcttgataagtaaatggatgactaattgtgctgctggcctcccatgaatggggtacttggcgagatttcctgggtctgcccrtgggtccttgcttgttgagtaagttcagctggcagctcattggattgaagcctctctcggggccatgcttacgcgtaagcctctaacaggtgatgcctgt

SEQ ID NO: 37011 - DNA, 201 bp, Homo sapiens
cctctgccaggaagcctcctgggtcactctcatttgcaacagacctcaccgccctgtttccagtgccttttgtagccaggctgcaatggcgtctaacagtracggagtgatccatgagctagactctgcttcacactcctaatgctcatattgtctcatttaatcttcataaacacctcaggaggtaggcgcccttatagc

SEQ ID NO: 37012 - DNA, 201 bp, Homo sapiens
acagtaacggagtgatccatgagctagactctgcttcacactcctaatgctcatattgtctcatttaatcttcataaacacctcaggaggtaggcgccctyatagctccattttacatagaggggaaactgaggcagagagccttggcagcctgctcttggctgtggcaccagaggtccttggtttcttggagaagtgggt

SEQ ID NO: 37013 - DNA, 201 bp, Homo sapiens
gccttggcagcctgctcttggctgtggcaccagaggtccttggtttcttggagaagtgggtttgtgtgggagcactcaccccaggcgccatcgctgttgarccattccacttcttcaaatccttttcctttgttgattcaaaacccttgctctgctgccttgagccacacagaatgtgcagcgccctccttccccatcccc

SEQ ID NO: 37014 - DNA, 201 bp, Homo sapiens
cccaggcgccatcgctgttgaaccattccacttcttcaaatccttttcctttgttgattcaaaacccttgctctgctgccttgagccacacagaatgtgcrgcgccctccttccccatccccaaggccttcagagacatggcaggcacaggtaccccggaagcctccccagtgtacagcttctttttctcttgtgtctttc

SEQ ID NO: 37015 - DNA, 201 bp, Homo sapiens
ttccgtctacacggtggctgcgaggtcaccaggcgacaggaggtttcagctccgtgacagtcttatggggccaccatggcatgtggtccatcgttgacccraatgctgttatgccgcgtgtggctgtaaaacgcacttgctggttccccacagggaggagggggtggctaaaactgccttccctatcctgcaagcccaagt

SEQ ID NO: 37016 - DNA, 201 bp, Homo sapiens
acagggtcaggatccacagtatcaccgccttctgcctccacaccctgtcccactggaaggtcttcaggagcagtgacaggcacagggctgtcatctcttakgataacaatgccaggccaggtgcagtggctcacgcctgtaatcccagcactttgggaggcctaggtgggtggatcacctgaggtcaggagttcaagacca

SEQ ID NO: 37017 - DNA, 201 bp, Homo sapiens
ggctcatggcctcttgtcagcacccccacaatagtttgcgacaccagcctcccgcctctctcctctggcccattctttatttttttctttttcttttttaytttttgagatggagccttgctgtgtcacccaggctggagtgcagtggcacgatctcggctcactgcaacctccaccccaccaggttcaagtgattctcct

SEQ ID NO: 37018 - DNA, 201 bp, Homo sapiens
gattacctttagagcccacctaatcatccaggataatctcctcttctcaaggtccttgacttgattgaatcagcaaagtcccttaccatatacatttccgkgagtaggacctgggtgtctttagggccgttattcagccaacgacagccagtttgcctgggcccagtcatgtacatctgagcctcagtttccccatttgta

SEQ ID NO: 37019 - DNA, 201 bp, Homo sapiens
tagctttttattgattgatttattttgaggtagagtctcgctctgtcacccaggctggagttcagtggcactatctcagctcactgcagcctctgcctccygggttcaagcgattctcctgcctcagctttcctgagtagctgggattacaggtgcgcaccaacatgcccggctaatttttatttttagtagagatggggt

SEQ ID NO: 37020 - DNA, 201 bp, Homo sapiens
tgctccagtgcactatcccttaacacccacagcagtgggggctgggccaccttgggccaccgtgggatgcacagcaatgagtacaaatccctgcccagcarctataatcccattgcccctgctttagagcttttactgccagctgcacagaagtgatgtaaatttcgggataatgtagaccctgctgtaatacacacatgc

SEQ ID NO: 37021 - DNA, 201 bp, Homo sapiens
aagttttaaaattgagaactcctccaatttgttctttgttttcaagactggttttgaaaacagttttggctctttagggtcccttgtaatttccattttckgcaaacaaacaaaaagacctttgggttgctgacagagatggttttgaatctgtagatcagtttggaaagtgttcccatcctaacaatattatgtttttca

SEQ ID NO: 37022 - DNA, 201 bp, Homo sapiens
gagagaagcaggcccgttcttccgtggcccacttcttcctttgaacaaaggctccttggacccagtggcgggaaactggccctcccacaccccctgcctgytctgggggcagcagtctttggaggagtaataatgccaggcagcccctcactgagggccccagtctcccctgcatttcttccctgattgattgataggagg

SEQ ID NO: 37023 - DNA, 201 bp, Homo sapiens
ctgagtaatattccattgtaccgatagaccacattttgtttattgattcattggttgatagacatttgggttgtttccacatttgggctgttgtgggtagygctgctgtgaacattcatttacaggtttttgtttgaatacctgttgaatttttgggggtatatgccccggagtagaattgctgggctgtgtggtaatttg

SEQ ID NO: 37024 - DNA, 201 bp, Homo sapiens
cctggcttctttacttgagccactgtgcattgacttgagtcctcagcaacacggtggtgtgactcattggccgcattttataggtgagggacctgagattsagagagaaaacactccgcacgtgaactcagctggtacggtgggcctggctccaaagcttcccttctcctgtagcgccgccctcctgccagtggcagcccc

SEQ ID NO: 37025 - DNA, 201 bp, Homo sapiens
ggattacaggtgcgcaccaacatgcccggctaatttttatttttagtagagatggggtttcgccctgttggccaagctggtgtcgaattcctgacctcagstgatccacccacctcggcatcccaaagtgctgggattacaggtgtgagtcaccacgcccagcccgttttggctttgagacatactctcgtccctgccagg

SEQ ID NO: 37026 - DNA, 201 bp, Homo sapiens
gtgaacagtgatgcttctaacctcttgtgcccagctgcccttaccaggttcttccagagatagtctctgcacatgctgtgtgggggggggccttcgtgtgygggtgtgtgtgtgtctgtcctgctgccttccggccacccctgacagtcccacctctgcccacaggtctccgtgttggtcctcttcgccctggccttcctc

SEQ ID NO: 37027 - DNA, 201 bp, Homo sapiens
agtgaacagtgatgcttctaacctcttgtgcccagctgcccttaccaggttcttccagagatagtctctgcacatgctgtgtgggggggggccttcgtgtkcgggtgtgtgtgtgtctgtcctgctgccttccggccacccctgacagtcccacctctgcccacaggtctccgtgttggtcctcttcgccctggccttcct

SEQ ID NO: 37028 - DNA, 201 bp, Homo sapiens
cggggtctcaccatgctggccaggctggtcttgaactcctgacctcatgatccacccgcctctgcctcccaaagtgttgggattacaggcgtgagccaccwcgtctgcccctgaaaccctcttctaacaggacatctgcacctgtggtggcttggctctcttctcagaatagtgttttcagatgcacagaataaaatgcaa

SEQ ID NO: 37029 - DNA, 201 bp, Homo sapiens
gttcaagcgattctcctgcctcagcctcctgagtagctgggattacaggcactcaccaccacgcccggctaattttttatatttttagtagagacggggtytcaccatgctggccaggctggtcttgaactcctgacctcatgatccacccgcctctgcctcccaaagtgttgggattacaggcgtgagccaccacgtctg

SEQ ID NO: 37030 - DNA, 201 bp, Homo sapiens
tctctatgcaggaccttgggtactaaaaataactaatttaaaatgaatgtcacttatgaatatggtgaaaaattaaaatgttaccaaaaaattgcccagtsaacagtgatgcttctaacctcttgtgcccagctgcccttaccaggttcttccagagatagtctctgcacatgctgtgtgggggggggccttcgtgtgcgg

SEQ ID NO: 37031 - DNA, 201 bp, Homo sapiens
gcccaggctggtctcgaactcctgggctcaagtgatcctctcgcttcggcctcccaaagtgctgggattacagcatgagccacagcacccagcctggtttyttattttttcctttgattttttttttttttcgagatggggttttgctgtgtagcccaggttggagtgcagtccatgatcttggctcactataacttctat

SEQ ID NO: 37032 - DNA, 201 bp, Homo sapiens
agtgggcagcccaaccccacttctcacacatgtgtcttagtggcccgagagctgcctgggcaacagtggggcttcttcatatctgtaccctgagctctctrtgcaggaccttgggtactaaaaataactaatttaaaatgaatgtcacttatgaatatggtgaaaaattaaaatgttaccaaaaaattgcccagtgaacag

SEQ ID NO: 37033 - DNA, 201 bp, Homo sapiens
agccctgagcggggccgccactccacaggtgttggccgcatcaggtcttgcaggactctgctgggtgccgaggtgggagggaagaggggaacccttggtcygtttccctgagggatgacgagcagcagatggagaggacagcgtgaaggggcgtggcggtgaggctggaggggagtttgtctggcctgcagagcctccttc

SEQ ID NO: 37034 - DNA, 201 bp, Homo sapiens
gtcagcacccccacaatagtttgcgacaccagcctcccgcctctctcctctggcccattctttatttttttctttttcttttttattttttgagatggagycttgctgtgtcacccaggctggagtgcagtggcacgatctcggctcactgcaacctccaccccaccaggttcaagtgattctcctgcctcagcctcctaa

SEQ ID NO: 37035 - DNA, 201 bp, Homo sapiens
gtgccccaaatcccacatttttatactggcttttccctttatattggccattcttttttttcatgtagacaggttacacgttcttgctatgttgcccaggytggtctcgaactcttgggtttgctcaagtgatccaccctcagcctcccaaagtgctgggattataggcatgagccatcgcacccggaccttagtggctac

SEQ ID NO: 37036 - DNA, 201 bp, Homo sapiens; identical to SEQ ID NO: 9503

SEQ ID NO: 37037 - DNA, 201 bp, Homo sapiens; identical to SEQ ID NO: 9504

SEQ ID NO: 37038 - DNA, 201 bp, Homo sapiens
gaggacacatattccctccttatccactcgttataaacgcaccctgaggcccagatcctgtttgtatttctctgttcccggctgttctttccagaaaacamtcctcaggtctcccttgccttccactggggctcatggcctcttgtcagcacccccacaatagtttgcgacaccagcctcccgcctctctcctctggccca

SEQ ID NO: 37039 - DNA, 201 bp, Homo sapiens
gtcacccaggctggagtgcagtggcacgatctcggctcactgcaacctccaccccaccaggttcaagtgattctcctgcctcagcctcctaagtagctggkattacaggcacctgccaccatgcccggctaatttttgtatttttagtggagatggggtttcactatcttggccaggctggtcttgaattcctgacctcgt

SEQ ID NO: 37040 - DNA, 201 bp, Homo sapiens
agatcctgtttgtatttctctgttcccggctgttctttccagaaaacactcctcaggtctcccttgccttccactggggctcatggcctcttgtcagcacmcccacaatagtttgcgacaccagcctcccgcctctctcctctggcccattctttatttttttctttttcttttttattttttgagatggagccttgctgt

SEQ ID NO: 37041 - DNA, 201 bp, Homo sapiens
ccttgcaggtgttgtgttaggagtacgcagactttaaatgctgaccagagtgcagaaggcggcggacgtctccagagctcctcctaatggtagtgttttgktgtgagagtataaagtctggtggggggtgtagctcgagagcccccaggaattctgcccagatgtggaatcctttgtttatccccttgcttccagcttagg

SEQ ID NO: 37042 - DNA, 201 bp, Homo sapiens
tgttctctcccttgaactcaaggctgctcctgccgtctcccccagctggcccacggacaggccttagagcagcagggggccagtgtcaggagtgtccctgyggaaggcccacctggagagcagggcaggtaggcagggggcacatgagacccacaggaaggaaactcccggacttggcccctgggagctgacctcagcagt

SEQ ID NO: 37043 - DNA, 201 bp, Homo sapiens
gggcggggtgcctctgccaggagcctgggttcagaccaggctggcctgtggtcaaaggcacacttagaccctggctggagagttggggcgagttacgagakacccactaggtcacctgtcaaagacggctagccctcctggggattttgaaatcagggcacccgcggcaagttcccaggctgtgcctggggctcaaggcgg

SEQ ID NO: 37044 - DNA, 201 bp, Homo sapiens
cttccggccacccctgacagtcccacctctgcccacaggtctccgtgttggtcctcttcgccctggccttcctcacctgcgtcgtcttcctggttgtctayaaggtgtacaagtatgaccgcgcctgccccgatgggttcgtcctcaaggtaaaactccgttttcccccagaggccctgggacgcctttgcaccccatgtt

SEQ ID NO: 37045 - DNA, 201 bp, Homo sapiens
tctgttttgtgtccctgtgacttacctattctagacatgtcatagaaatagaatcttgtaagatgtgatgtgaccatctatctggcctctttcacttagcwtgctatttcaaagctcagctacgttgtagcacttacaactgcttcattccttttcatggctgagtaatattccattgtaccgatagaccacattttgttt

SEQ ID NO: 37046 - DNA, 201 bp, Homo sapiens
tcttggctcactgcaacctccgcctcccgagttcaagcaattctcctgcctcagcctcctgagtagctgggattacaggcgcccaccaccatgcccggctratttttgtattttagtagagataaggtttcacctcgttggccaggctgttcttgaactcctgacctcacctcaggtgatccacctgcctcagcctcctaa

SEQ ID NO: 37047 - DNA, 201 bp, Homo sapiens
tgcccggctaatttttgtattttagtagagataaggtttcacctcgttggccaggctgttcttgaactcctgacctcacctcaggtgatccacctgcctcrgcctcctaaagtgctgggattacaggcatgagccactgcacgtgacttttttattgtaaattctatcaattttctacatacataatcataccatatgtga

SEQ ID NO: 37048 - DNA, 201 bp, Homo sapiens
agtgacttcattacagtctcccccgaggatccatccctgccatccctctcccctccgctcccaaccctaccccggtgatgaactgcacagacctcttaccrtcatcctgggcggcagcagtcctttctaggggcctgtggtattgacatgcttcaatggaggatgcatcacctttccttgatcataatgaaaaagttctcc

SEQ ID NO: 37049 - DNA, 201 bp, Homo sapiens
actgtgtattacttgaatttcatgggtagacagggactcatatatctttgtatgtgaatatctttagataaaatctatgaagctacatcaaagcagtaacwtctgggagaggaataggattggagaacagtatatcacttcctgtatatatatatatatgtatgtatatatgcatatgtattttttacaataaaaatatgt

SEQ ID NO: 37050 - DNA, 201 bp, Homo sapiens
agtatgctgttcagtcttcagtcaaatgcaagaagccagggaatttggggagctggactagaccttagggatcagggaatgcagtctcttcattttattarcaaggattgaagcctggagaaggaacttgaccaagggtacactgtgagcccaaatatatgtactgtacaatatgtagtgtacaaatagttaataaatact

SEQ ID NO: 37051 - DNA, 201 bp, Homo sapiens
tagcccataggaaagacagagatttgctatgtggggataaattgttacccctgaatctttgctttaactctgctgctctgcatgggccctatttacaaacscaacagcttcagctttagaactgtcccttagaacacttggaagaaggaatacttgctgtgcaattttagctataagaaaagaaaaggaattaaccttatt

SEQ ID NO: 37052 - DNA, 201 bp, Homo sapiens
tggtcttctattttcaattttttttttaacagaaaaaattttggctgaaacacaacctgaattgggaacgtggggagatggcaaaggcgaagatgagttawccccagaagaaatacaaatggtaatgctattctctgcctaattatttatttttaactggttttcataagactgtttcactaaggagaaactcatcctcaa

SEQ ID NO: 37053 - DNA, 201 bp, Homo sapiens
caaaggcgaagatgagttatccccagaagaaatacaaatggtaatgctattctctgcctaattatttatttttaactggttttcataagactgtttcactraggagaaactcatcctcaatgcccttgcccttatttttatactgagttttaaaaattataaatgtgtattttatatacactttcccatttgatttcctaa

SEQ ID NO: 37054 - DNA, 201 bp, Homo sapiens
gagagcagagggccagggagacttcaagaggaggtggcactaagaagtgagtctgggccaggcgcagtggttcacacctgtaatcccagcactttgggagkccaaggcgggttggatcacctgaggtcaggacatcaagaccagcctaacatggaaaaaccccatctctactaaaaatacaaaattagccaggtgtggtgg

SEQ ID NO: 37055 - DNA, 201 bp, Homo sapiens
gggagtaagcttggaagggtgggtagggccttgaatgccagagtagggagtctggacttgcctctgtggcaccagggtgcacgggtggcctgggcagaggmctggcatggtgggtgctgtgcttcaggctgatccttagggcagcctatcaagaaggcttctgatggccacaaatgagcatgttgtagagtgtgagttctg

SEQ ID NO: 37056 - DNA, 201 bp, Homo sapiens
cccaacagacttaaaagtcagatttccgaccgggcgcggtggctcacgcctataatgccagcactttgggaggctgaggcgggcggatcgcgaggtccggwgatcgggaccatcctggctaacatggtgaaaccccgtctctattaaaaatacaaaaaaattagccgggtgtggtggcgggtgcctgtagtcccagctact

SEQ ID NO: 37057 - DNA, 201 bp, Homo sapiens
gaacaagtacaacgatgtattttataatacaaaactttaacttcaagaataatgaattcatttttaatagcacattatttaaaagtggctatttgttcttyacatctaatagtatagctttttaggtatcttattcctttaagtctgatatagaagcaaaaatatttaaagtgcatttttatgtgaaaggatttgatgagt

SEQ ID NO: 37058 - DNA, 201 bp, Homo sapiens
ttttacttggattagaggtaatgtcacctggaatgatttgtgccatgatggttaagagcatggactctgggctctaccacctcctgcaactgatctgtggrtaaaatatttaacctcatttcctcatctatgtaatgggaataaagtagtacctaattttggagaattaatttgagtaaagcaccttgaaagtgcttagca

SEQ ID NO: 37059 - DNA, 201 bp, Homo sapiens
cgtctgtcctgtagtgaaacatgcagagatgaaaaagatagtttctcacacactaaatatttatcgagcagatgaaggaatgatgcaagtcatcgaaaatkccatttggaaagaaaaagagaaaaaaacattataagcaacacttctaaaacgctttctggaatagactccagctctccatagacagtgggagtacaggtg

SEQ ID NO: 37060 - DNA, 201 bp, Homo sapiens
gcagtagcacctgtaagagcacccagcagagggcagggcagagcaaatggtgactccctcccaccagaaggatactgccatgtctgtgcattgtggcatgscctgcacgtgttttagcaactgatatgtcagagtacggctcctctccccacattgaggttgatgcagcatgcttctgtttcattccactgtcccgagtca

SEQ ID NO: 37061 - DNA, 201 bp, Homo sapiens
atgtaaatggagattgaagccttgaggaaagagtgggatcacccaaggggaatttcaagtcagaagaaaagagggcctcagagtagtccctgggaaaagastacatttgagaagccagcagagaataagaagtctgaggaggcagctatggagaacgtaggcctgtggatccctccaagtaataagcttgtttttacttgg

SEQ ID NO: 37062 - DNA, 201 bp, Homo sapiens
aacatccataggcaattttatgcttttaaatgcacttcatttgcattattttggaatatactaaaataattattccgatgcatagtaccaagaaaaccttrtttttaagctctgagttaaaaatagttggttaacactagatcgcagtgtcaattttatttctaaaggtgtgtatgtgtatcaaatactgatttgataggc

SEQ ID NO: 37063 - DNA, 201 bp, Homo sapiens
cttagtaggtgtattagtttctcattgctgctgtaaccaattacgtcaaacttgtggcttacaacaacacagatttattatcttatagttctataagtcargtgtccaaaatgggactccctgagctaaaatcaaggtgttggcaggaccgtgttcttttctggaggctctaaggaaggcccattgccctgccctttccag

SEQ ID NO: 37064 - DNA, 201 bp, Homo sapiens
tatctgacaagttaggttgacgaggtggttgtaaatatctttcatacaaatcacttattaacttcccttttccttgaaaagaaatccagcaaagtaaatgmttagagtgttggtttgattcacaccactccttacgaaccatgtgaatctgtgaaactcagtgtcttcctctaatgctacaggtcagcaaataacagccac

SEQ ID NO: 37065 - DNA, 201 bp, Homo sapiens; identical to SEQ ID NO: 9544

SEQ ID NO: 37066 - DNA, 201 bp, Homo sapiens
gcccctttgcaacataggagagagaggaacagagcggaacctctgctgtctctaagtaggtaaaagagaggagagaaaggtgtggtgactatatgcacacsccatgctttctgcgagggggccagagggaggaggctctgggaggaggcaaggtgtcatttggggaagttggttcccacagaaacatgaggattagggaat

SEQ ID NO: 37067 - DNA, 201 bp, Homo sapiens; identical to SEQ ID NO: 9545

SEQ ID NO: 37068 - DNA, 201 bp, Homo sapiens
ataattaggaagctgtaattttttccagaatgtagagctcagactttattgacccatttaatttttttttaataatgacattttactagagcagaacagcrtgtaacctagatagcctgtggctagatctctgaatgattttaattaaaaataatgtctccacttctggtagatggactttttccacaatatcctggcaac

SEQ ID NO: 37069 - DNA, 201 bp, Homo sapiens; identical to SEQ ID NO: 9546

SEQ ID NO: 37070 - DNA, 201 bp, Homo sapiens
gtggtttaaggagtctcatctccagactgccatgggatttacagaattgctggagtaacctgacagccaagacagcgtgggagggcatcaggtcagtctgstgtgcagtgtggccaaggagaaagccccctaccactcgagtagcctttggccaccaccctaggccactgccctgctactctgtcaaggctccttcagtcc

SEQ ID NO: 37071 - DNA, 201 bp, Homo sapiens
atgtagatatatgtgtgtgggggagggtatatgtggggggtatatatacatatctgcacatatatggtgtgtgtgtgtatgtcttgggggtatatatgtgwgtgggggtatatatatgtagtatatgtattatatgaatatatgtataatatgtattatatattattattaataacatactcagcaatctttttgcattag

SEQ ID NO: 37072 - DNA, 201 bp, Homo sapiens
ggtgtgtcagtctatggagtgtattcagcacataccgactgcagcctccccctgcatgctggtcactgtgccgtggctgcaaatgcagagggcatgcacartctctaccctgcaggcaataatgccagtgttaagtgccccagtggaggtgtgtccggatggccactgggcccagaggcagtgactgctccccagtacagg

SEQ ID NO: 37073 - DNA, 201 bp, Homo sapiens
tgtgaaaaaagtaagataatgactgaaaagtgaaaagagtaacaccttaactactgatagcacctccttttagttacctgccttctggtttccagctgctmtagcttaccatctatgggtgggtttcaaaaggaactgataggtctgccaagcccctgccagctcacgtccagcaatgtctgtgtgcagctcatctggaca

SEQ ID NO: 37074 - DNA, 201 bp, Homo sapiens
taaaaatgaattttattagatcattttcctgtttaaaaatttggtctgggggaggtgctggaggtggactaatacaagattatctttgtttttgcgtttarttgtacaatttaaatataaaagaaagcaagccaaggcaggaggatctctagaggccaggagtttgagaccagcatgggcaacatagcaagacctcgtctc

SEQ ID NO: 37075 - DNA, 201 bp, Homo sapiens
tcctgttatggaaataaaatacctgcctgctaattatttatttttagatctaagctggaaccagaaccaaatacaaagacaagagaatccacatcttctgmgaaagtttcacagagtccttcaaaagactctgaagaaaaccctgccactgaagaacgtccaggtacgaattgagatgaaaatctcaccttgcatttcttc

SEQ ID NO: 37076 - DNA, 201 bp, Homo sapiens
gatggaatatgctatctgtgtgtgggaatagatgtcacctagagctgctaggatgtgacactgtcctctaagacgtggggaatgtgactaccacacggcaygcctccagtgactgtgcctggcaagtgatagcattttaagtgtgcagcagtttgcagtagacaaaactttttgattctcattttatccatgatactttta

SEQ ID NO: 37077 - DNA, 201 bp, Homo sapiens
gtttgagtttactcaacaaaattcatttgcctaaaaatgaattttattagatcattttcctgtttaaaaatttggtctgggggaggtgctggaggtggactaatacaagattatctttgtttttgcgtttagttgtacaatttaaatataaaagaaagcaagccaaggcaggaggatctctagaggccaggagtttgagac

SEQ ID NO: 37078 - DNA, 201 bp, Homo sapiens
gactaccacacggcacgcctccagtgactgtgcctggcaagtgatagcattttaagtgtgcagcagtttgcagtagacaaaactttttgattctcattttwtccatgatacttttaataattgcacaaagaggtggtggaacattagcatctcattttaacattggcaaaaggcagcaaagggtcttgcccagagtcccct

SEQ ID NO: 37079 - DNA, 201 bp, Homo sapiens
cttctttcatgttccagaattcaccttatgacttgaaataagtgctcaccaaatccagcaaatgtgggacctaggccctcgaggtgcacattgtatagtcrgtggttagaggaagacagccgcagggattccaagcagtcattgctgtcagtcaggttgagagatgaggagggccttgagccgggagtggcagtgaaggta

SEQ ID NO: 37080 - DNA, 201 bp, Homo sapiens
tagaaatcacctactcatagtgtcataggtcctaataattagaggtggaaggaaccatcgatgagagactgaggcccaggaatggtaactaatttgtgacygtacgagagtccaaaaccgacggtgctcagtttgtagcttcagaatctttctgcaatttgcattttattctctattaatttaaaattcattacatgagtg

SEQ ID NO: 37081 - DNA, 201 bp, Homo sapiens
tcctttaaaccagattagaaaccttttagcagggcttgattggaaagtctaactgacttctaaatgggataaagcagttgaataatgatattgtctaatgygcatgtgacacataccatgtgccaagtactgctctgagcccttcagcatatgttcatttatgcaacccatatggagagagtattgctggccccgttttac

SEQ ID NO: 37082 - DNA, 201 bp, Homo sapiens
tgttcatttatgcaacccatatggagagagtattgctggccccgttttacagagagcttaagtcaccagccctaggtcacataggtcccaagtcctaggcygttcaacatgatgctgtgctgccatggttggagggtgggggagagtgctggtctagctgaaggaaagcattgtgttttggtaggagaccgtaacagcgta

SEQ ID NO: 37083 - DNA, 201 bp, Homo sapiens
caggatgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaatttta

SEQ ID NO: 37084 - DNA, 201 bp, Homo sapiens
ttggtaggagaccgtaacagcgtagagcagatgggccaatgcagggagcccagagcagcggctggcaaccaccatgcatggagggcccaacctgcccaccrtacccaccatctaggcctctcaccttcctttgcaattccataggaaaataagaatttccttgattgtgttcaggtttgtcttcacaaagcatctagatac

SEQ ID NO: 37085 - DNA, 201 bp, Homo sapiens
tatatgccatgcactttggtagacaactcacatgtattcactcatgtattccttctaacaaccccactacttaagtactgttactatccccattttagtgrcaaagacagagacgcccagagattgtgacctccaaaacagcttactgcttagaaggtgaggggctggaagtccagccgtgactttgcatcctcagggtca

SEQ ID NO: 37086 - DNA, 201 bp, Homo sapiens
aggatgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttat

SEQ ID NO: 37087 - DNA, 201 bp, Homo sapiens
ggatgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttatt

SEQ ID NO: 37088 - DNA, 201 bp, Homo sapiens
ttacagagtacattaaatagtaagtagagttcaaagctgccagatgctgttgtgctcacaacacagacttttgttggggaggtttttattagaatgctgayggaccacttggagactctgatggaagcaataggcattcttgccagaaaaatgtacatacacaaaattctatatgcaatttcacagagctcctgagtcccc

SEQ ID NO: 37089 - DNA, 201 bp, Homo sapiens
gatgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttatta

SEQ ID NO: 37090 - DNA, 201 bp, Homo sapiens
atgtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttattag

SEQ ID NO: 37091 - DNA, 201 bp, Homo sapiens
tgttgggtgaggcaccttcctgctgcttgagacacactcggctgtgagccagcagcaggcagttctcctagtacctgggggcctcaatccgaaagatgcartttagccacacaacctgtattagttcattttttgcattgccataaaggaatacctggagctgggtaatttataacgaaaagaggttaattttggcttatg

SEQ ID NO: 37092 - DNA, 201 bp, Homo sapiens
gatcactctagatatggctatggaggaaggtttgcagacagcagggtcggttcagaaaatcaattccacaaaatgcatttatctgagatccaaacccttcrcatatccagtgtaaatttatttttttacagcatccaataaatcccagtaaaggagctaaatgaagatcttaacatgaaaagtggtgtcagagctctttag

SEQ ID NO: 37093 - DNA, 201 bp, Homo sapiens
tttttaagtgtctagattaaaatagatcagtattcagggtgtgagtatattgctaagtctcttaacactcattgaaccagacgtcgtgtgtgttcattttyaaatgatggggtggattacttttatatttattatgaacacaaacactgatgctaacaactgacatgtgaaaggaaagcaggcaatagtgatgaaaaccat

SEQ ID NO: 37094 - DNA, 201 bp, Homo sapiens
taaatgtgtcatccaggaagtcactgtaagatacgttggtgaaaaagccttcaagcttagatattgtgtattctgcttacctgcttaccaactcatgcttyccagagtacctaactcacaaacgtgcctcaaatgcagaaaagcaaatctagttcagtattatacaggactggtaatgtcctggctgtttgctctatggtg

SEQ ID NO: 37095 - DNA, 201 bp, Homo sapiens
gcaggcactcctgcttgtaaggacgtctagcaccgtctctgctcctgtggggccagacgccccctgtgttatcccacgcttctcaagcttttcaaggcttygtttggagtaaacgttttctgtaagcatcctgcatcctattttgatttttaaattttagcctgttttttaagagatatgatgatagtaaaacacaaagca

SEQ ID NO: 37096 - DNA, 201 bp, Homo sapiens
ccactgaactttttctccagttcgcatactagccggacttggattttctggaaagatttcagtggaggaacgggaacaaagattgtgatagctttctgacyaccaccaacttcaatttccttggctgccataatattcagctctgtgagctgagccttgaggtccgagttcttttccagctccagaagagcctgggagatg

SEQ ID NO: 37097 - DNA, 201 bp, Homo sapiens
ttttatttgtaaatacgtgtttagtgtttttctccctaccagatgtgtaagtcagtgacctttacacatttttattcatgtatcccctaaaagaattttgaaaaaaactgagtaaccgctcatatgtatctattaatctgacatctataattctttatcgtaagtttaaataattgcaaaggatatagttttcagtgtgct

SEQ ID NO: 37098 - DNA, 201 bp, Homo sapiens
tattctgtggtttatttattttcttaatggtgtctcttggtgagcagaaatgcttaattttgaggaagttgaattttattaatttttactttgtctacccyaaggtcactaagatattattttatgttttcttctagaagctttatgattctgggtggtatgtttaggtctatcatctgtctcagaccaactttttgatag

SEQ ID NO: 37099 - DNA, 201 bp, Homo sapiens
gaagctttatgattctgggtggtatgtttaggtctatcatctgtctcagaccaactttttgataggatgaaatggggttgaggtttattttattctatataataactggggttgaggtttattttattgtatataaatatctatttattatatcaatgtttgtttaaaacactttctttttctcattgaattgacctggca

SEQ ID NO: 37100 - DNA, 201 bp, Homo sapiens
tggccaggctgttcttgaactcctgacctcacctcaggtgatccacctgcctcagcctcctaaagtgctgggattacaggcatgagccactgcacgtgacytttttattgtaaattctatcaattttctacatacataatcataccatatgtgaataacagtagttttgctttttaatctttatgccttttatttcttgtt

SEQ ID NO: 37101 - DNA, 201 bp, Homo sapiens
gggaacaaagattgtgatagctttctgaccaccaccaacttcaatttccttggctgccataatattcagctctgtgagctgagccttgaggtccgagttcwtttccagctccagaagagcctgggagatgccggactctttatagtacactgtaaagtatgggttgtttaccctcataattgcatggctgactgagagctg

SEQ ID NO: 37102 - DNA, 201 bp, Homo sapiens
cagaccattttcatatgcctttcatatacaattcagtttcacacagatttatccacccagatgagtggtttcccctttaaaatcatcgccttgaaagcttsaaactgattccagtgatggtaccattagccctgactttcctgagacttgctttgggggttctccttcagagcctgtgatattttctttggaatactaagc

SEQ ID NO: 37103 - DNA, 201 bp, Homo sapiens
gctcttgattaagggacaaggatttaatacttcaccattaagtatgaagtgttgggattataggcatgagccactgcacccagcgcacccatgtttgtttrtttgtttgttagtttgttttcatatttgtggttcatttttttatgtgtatatcacagaagtaggtattatgtagctgttctttatcaggttaaggaaatt

SEQ ID NO: 37104 - DNA, 201 bp, Homo sapiens
tttatttgtttgttagtttgttttcatatttgtggttcatttttttatgtgtatatcacagaagtaggtattatgtagctgttctttatcaggttaaggamatttcctttcttattgagggatttgctagaagaactcatggaactcagaaacactattatactcatagttacagtatattatagtgaaagaatacagatt

SEQ ID NO: 37105 - DNA, 201 bp, Homo sapiens
attaagtatgaagtgttgggattataggcatgagccactgcacccagcgcacccatgtttgtttatttgtttgttagtttgttttcatatttgtggttcatttttttatgtgtatatcacagaagtaggtattatgtagctgttctttatcaggttaaggaaatttcctttcttattgagggatttgctagaagaactcat

SEQ ID NO: 37106 - DNA, 201 bp, Homo sapiens
catttttttatgtgtatatcacagaagtaggtattatgtagctgttctttatcaggttaaggaaatttcctttcttattgagggatttgctagaagaactsatggaactcagaaacactattatactcatagttacagtatattatagtgaaagaatacagattaaaatcaccaaagctaaaaggcacatagggcaaactc

SEQ ID NO: 37107 - DNA, 201 bp, Homo sapiens
tttttttatgtgtatatcacagaagtaggtattatgtagctgttctttatcaggttaaggaaatttcctttcttattgagggatttgctagaagaactcayggaactcagaaacactattatactcatagttacagtatattatagtgaaagaatacagattaaaatcaccaaagctaaaaggcacatagggcaaactcca

SEQ ID NO: 37108 - DNA, 201 bp, Homo sapiens
attccggaggattttctaccacacacccttcatatgtgttctactatctatctagatggttctctcaccttttcacctggcctgttcctcctcacccttcwagtctcagcttaaatgtcacctgatcagggaggccttttcttctcttcccatcccactcagactatattatgttctcatttgctgctgccctttcctttg

SEQ ID NO: 37109 - DNA, 201 bp, Homo sapiens
accaaagctaaaaggcacatagggcaaactccaggagagatcaggtacaagcttctagctgtcctctcccagtggaatagtgtagacagcacttaattctyccaatatgtgtctcccaatacctgtgtcaccatgtattgtcaatcagggaagctcacctgagccttggtgttcagggttttcattgggggtcagtgatgt

SEQ ID NO: 37110 - DNA, 201 bp, Homo sapiens; identical to SEQ ID NO: 9547

SEQ ID NO: 37111 - DNA, 201 bp, Homo sapiens
cagtgaagacaaatttgtgtgtgtgtgtgtgtgtgtgtgtgtgcgtgtgtgtgtgttctgtgtggcaaattgtatgtgtgtgggtgtgtatgtgtgtatgyacatgtgtgcctctgttctgtgtggcatttagtgggatgggagttgacagcagcctggggtacttaagctctacttgtaatattcaagtaaactttccta

SEQ ID NO: 37112 - DNA, 201 bp, Homo sapiens
actgatacagtggcccaaggcccccagtcataaatcactctgttagcataaactatctggaatgcccccaggtatacaaagatactctcatcagacaagasgtactaggagcttagaggttatctcccaggagccaagcaagggccagttttttccttggaatgtgcagaatttgaacaccacaaacctgctgagtcatcc

SEQ ID NO: 37113 - DNA, 201 bp, Homo sapiens
caattttgtgctcccaccaacaatgtatgagaattctagttatttcacattctcaccaacacttggtatttttagtattttttatttcagctattttaatmggtgtgtagtgatacatcattgttaattagcatttctctaatagctaatgaagccaaacatctttcatgtgccccccttgccttctttagtgaagtgtct

SEQ ID NO: 37114 - DNA, 201 bp, Homo sapiens
attgttcaagtctttttggaagactagataaattgtacaatgttgtttttgggatgatgaatttttttagatactaaagatcattttgattgtaagtcttmaacatgtggacatcttatgttttctgaaagatatatttcactaggcaggagtctttgattaacctggaggaagttttgttgctttgagtacatttattta

SEQ ID NO: 37115 - DNA, 201 bp, Homo sapiens
gttccagggcctgatcagtcagtgatgattaagtacatttctccccctggtttttctgccctgatggtgcattataagcattttagaaaacagaagtctgygctcctccttggcatattgtccagtaatcctgggaattcagcctgtgcctctgagagcaaattggaggtcgagctatcctgaccccataccaaggagacc

SEQ ID NO: 37116 - DNA, 201 bp, Homo sapiens
tctgtggaacaagaattccccttatctagaaaaggatgacttagtttgaatttcctaattaataccgttattaaagtcttatgtgactgtttttagtacgwaggaaaacacaacatcgcccacttacatgaattggtaatcatccctttctttgacagaccatagaccttagacggaggcacctgtgaatacattctctct

SEQ ID NO: 37117 - DNA, 201 bp, Homo sapiens
cgacttctccagccgggcccgcgaagtggtgagctggttgctatggaaacggcgggttgaggagggggcagtcctgcgacagggaccccgggccccaaacsagaccccgtcccgtaagcattgtgtgaagggggtggctctaagggggacagaagagttggcctcagagaccctacagctttttgggggaaggaacagcct

SEQ ID NO: 37118 - DNA, 201 bp, Homo sapiens
aaatgtactggaggaaagatttctaagccaggaatttagactggaaaagacatcagaatgtaaatggagattgaagccttgaggaaagagtgggatcaccyaaggggaatttcaagtcagaagaaaagagggcctcagagtagtccctgggaaaagactacatttgagaagccagcagagaataagaagtctgaggaggca

SEQ ID NO: 37119 - DNA, 201 bp, Homo sapiens
tggagtacctattatgtgccagtcattgggctgaggattgaagatacaaaacaaacaaaaaccaccagtgctactgtgttctaatttagtgttttaagatrtagtaagtctaatagggacacctttctgatatattggcagtaatattattttggggggtatattatcatcattgatcttattatgcagtactattttgcg

SEQ ID NO: 37120 - DNA, 201 bp, Homo sapiens
aaggcgcctctaacgcccttgctttgtggcagccactgagctgcagcacttgcaggcctcactttctcataatgccccctctggaggaagagagaggctcyttgcttgactgggtttcactttctcttactggctcaaattgagtgatattcttatcctcaatccactcctgttgccactaaaaggatatactgcctagct

SEQ ID NO: 37121 - DNA, 201 bp, Homo sapiens
caggtaattttccatcttttaaaagccataaaaatccagttttccatttagtttttttcatcattaacagttctccctcaagcacttctcctttgcctgcyttgagcttcatactgaaatttaaatcaatttcctctcattcttttccctgtgaaattggagaacagctgtttagtcacctccttataaataacccttcaa

SEQ ID NO: 37122 - DNA, 201 bp, Homo sapiens
tggtgaggatcccagtggtcagggacagtgacccatttggaacatgagcagttgggtcaaatccacaaataactgttttaaacagcagtcattttatttgaaaaaaaaaaagtcgatttgaaaagccatttccccccactgaacgcacattcttttattcttttatttagcaagcagtttggagtgcctactagttagttc

SEQ ID NO: 37123 - DNA, 201 bp, Homo sapiens
tgggtgtaagagtcctagaagtcttttaaaatggaagttgcattgagtttaatgggaatcttaagcattataaggtgccactcaacttttgaaattaaatcatgagttctttgtgtcatcaacactaagattctaggtttttgttttttttaatttctgggtttctttaaagatgataggggcttaatattagaaaggaag

SEQ ID NO: 37124 - DNA, 201 bp, Homo sapiens
aaaggctctgtggtctggcacgcaggtggttgcaggaagtgcaggaacagaagctggtagatggagctggctcctttagccagtgtttaacaaggtgagtsgatgggactgactgaccaatttcatttgtagggtgaaaaagagagaagagtgtaaaatggccaaggtgttctaacttggaatctagaaaggatgaagact

SEQ ID NO: 37125 - DNA, 201 bp, Homo sapiens
catctttttgtcagctttatcatgcttaattttcaagaaaataatgtgtttgttactgtggtcacaccgtgattttgcattggcttatgtatgatattttwttgtctctgtcctagaaaattatagcagtttttatgaggagtggtttgtgggttcacacaacccacttggagtgccatttactacaattctcttctaaaa

SEQ ID NO: 37126 - DNA, 201 bp, Homo sapiens
ccaagggctgaacttacaagaagtttcagagattaacaaaggcagagagggaatgaatgaaggtgaagaaaaggagttataggttttagaaaagaacctasagacagtggtgttctggaacccgagggaggctagtgcttcaggaggggacaaggaaggaggaggcaggagcagggaggagagccatccgagtttggtgag

SEQ ID NO: 37127 - DNA, 201 bp, Homo sapiens
ctatgggcttgccaatccaaagccccccatgtcgtaaaacacaaggaacagtagtagccaacttcagaggagacaaatgtcaatcagtgaaaacgtttttgttttttttttttgccgatctttctgtatccagtgtagttaatttgttaaaaaatcaacatatacaaatactctcacaaatactctcatgaagctcagttt

SEQ ID NO: 37128 - DNA, 201 bp, Homo sapiens
acctggcacacacgtggcgggtgctctgtaagtagcgatcacgattgggtgaaatcaagcatgtactgcatgttgaatagagatgtagtacaaaaagaaawgagcaggttgatgttgatattgcccacgtggaggctttttctcagttcccaggtgcttccttgcaaatatagcactggaaaactgtagttgtgacttgcc

SEQ ID NO: 37129 - DNA, 201 bp, Homo sapiens
tgaagtcagaggggcccagaggcagctcggccaagctgcccacctccccttcctctccagaccctccccacaccagatccttctccatattaaaaaatatrtatagtccttcagtatagttcatgagagaaaacaacaacaaaagaattttcttaataatggtactagagtcaggaagcaggccgtgggatcccaggggag

SEQ ID NO: 37130 - DNA, 201 bp, Homo sapiens
atacattattgtctttacatattgctaaaatcagtttgtttgtattaaggatgcttttatgttcatgaagatatgtgtctaattttctcttcttgtaataycttcataggtttctgaatctgggtaatactggcctcataaaatgattttgtaattgttttctcttcctctgttgttcagatctactgggtccttacgttg

SEQ ID NO: 37131 - DNA, 201 bp, Homo sapiens
gggcatgtggcctgaatccacaactccctcagcttgtgggcctgtgggttacctcctgcctgctgccactgctgcggggggcccaggtgcttcccaccccgagagatacaggagtgactacagattacctgcgtataatttccaccaccattcgggctgtttccacgcagcgactctgaaatgaaatggggcccttatgaa

SEQ ID NO: 37132 - DNA, 201 bp, Homo sapiens
agtactgcagagtgtcttccaccagttccatgttgatggacatgtggattttttcctaggcctttgccatattaaaattgaattacgaaattgctataatyaataactttttcatattattgttatatctttgggatagagtcccataagtgggattgctggattagagattaaatacatgttaatttgcaggatattacc

SEQ ID NO: 37133 - DNA, 201 bp, Homo sapiens
cctcttctgcaaatggttccactggggtctgcctgctcctgtacccaccagggagtcaggaatgcagaaggcaaggccttggtcactcacacatgcacccrttagcctctagtttctgtgggaaggcttggagcatgctgaaagtaaggcccaggactttgcagagcctgttgtattgtggacatgtcccccaaataaaat

SEQ ID NO: 37134 - DNA, 201 bp, Homo sapiens
tgggtgatctcggctcactgcaaacctccacctcccaggcgtaagcaattctcccacctcagcctcctgagtagctgggactacaggtgcgtgccaccacrcccggctaatttttgtatttttagtagagacaggctttcaccatgttggccaggctgggcttagacctcaagtgattcgccctcctcggcctcccaaagt

SEQ ID NO: 37135 - DNA, 201 bp, Homo sapiens
tcatcagcatattctgaccttctgaatccccaccatgtgttaccatggtgatgaggctaggcagagaacttactggagactgctttctgtaactggggcayaaccaggccctccccattccccgagcagtgacacagaatgcaaagggcactgcacacacccacctcttgggactgagggtcagttggcatggtagagtgg

SEQ ID NO: 37136 - DNA, 201 bp, Homo sapiens
tctgaatccccaccatgtgttaccatggtgatgaggctaggcagagaacttactggagactgctttctgtaactggggcacaaccaggccctccccattcyccgagcagtgacacagaatgcaaagggcactgcacacacccacctcttgggactgagggtcagttggcatggtagagtggacttccaaaaagaccagtgt

SEQ ID NO: 37137 - DNA, 201 bp, Homo sapiens
aggcaaatcgaagggagagtggttgagatttccagactccaagagatattcacggaaaaggttttgcaacaggtaaaaaaacaaaaacaaaggagctgtaygttttcactcaaaggggaatgtacttgagagcacgagacatttttcccaaaggctgctgctctacacagccaggagcagagccatgtgttgctagcaggt

SEQ ID NO: 37138 - DNA, 201 bp, Homo sapiens
gtgagagctgtagagtgggttggaggggtgggttagatgggtgagtagtctttggtaaatgaagtcaggtgggattttgtaggatgtggtgaaaatgtttwtcatcttcaaagattgttcaagtctttttggaagactagataaattgtacaatgttgtttttgggatgatgaatttttttagatactaaagatcattttg

SEQ ID NO: 37139 - DNA, 201 bp, Homo sapiens
aaaggtcctgaggtgggagtgtgcctggaatgtttagggaacaccctccaccctctgattcagtcattttgtagtgtgagacccttcagtagctgcgccaytgttctcaaaagcagagcctacattctttataagcctggcttatgctgtagccctgactccacgctccttctccctctccctctccccatctggcttacg

SEQ ID NO: 37140 - DNA, 201 bp, Homo sapiens
cacatttcggtcagtttctagtgtgttacttttaatcaggctagttttctcatgcatctaaaggaattggcaatattctcaactcctccccattatggtcrgggatatgaacttactgtcttcttctttcattttcccaagtaaatgtcttgaaccactgattagatctgtgtgcccacaataacataagcaggcacgaag

SEQ ID NO: 37141 - DNA, 201 bp, Homo sapiens
cttcttgaattaatgaataactgttaatctactgtctctctcagttttggggctaggtgatctctgtccaaggctcattgcagttctaaagctctgtgatmctcacatgattcttgaatattacatgatgcacatttatacttagtccggtattaagagtaaacattcagtaaatagtagcttttattactaagattccgt

SEQ ID NO: 37142 - DNA, 201 bp, Homo sapiens
tacctgtgtcaccatgtattgtcaatcagggaagctcacctgagccttggtgttcagggttttcattgggggtcagtgatgtagatgtgaagtgctagcatagcaggccgtagttaactcagtctccagcccctccagaggtcaaactgatggtcatgccagacccctgttaacttcagtagggatggcacttggttcaaa

SEQ ID NO: 37143 - DNA, 201 bp, Homo sapiens
caggccggaacctttcttctcgcgtcgccgttgccggggggaggcgtgtggggcaggaccagtccttcagcggccgggttcgcgccgcggtcgccggctgmttacgtgggcgggcctagtgtggggctgagggtgcgggtcgctatggcggtggacatcacgctgctattccgggccagcgtcaagaccgtgaagacgcgg

SEQ ID NO: 37144 - DNA, 201 bp, Homo sapiens
gcgcaggccggaacctttcttctcgcgtcgccgttgccggggggaggcgtgtggggcaggaccagtccttcagcggccgggttcgcgccgcggtcgccggytgcttacgtgggcgggcctagtgtggggctgagggtgcgggtcgctatggcggtggacatcacgctgctattccgggccagcgtcaagaccgtgaagacg

SEQ ID NO: 37145 - DNA, 201 bp, Homo sapiens
atagagcagtccagtggcagtgggctggacaggagaaccactactgcttgtaaaaagaatgtagtttgtatacaccttcacttagccaccctcccgccaarcaacctccacatggcagccctcattacttaaattgccatcaagtgtgtctgccatgcactgatacagtggcccaaggcccccagtcataaatcactctgt

SEQ ID NO: 37146 - DNA, 201 bp, Homo sapiens
aatttattttccttaaactgcaagaagtggctacagtttgggtttaaataatcttttcctggccgggcgcggtggctcacgcctgtaatcccagcattttsggaggctgaggcaggcggatcacgaggtcaggagatcgagaccatcctggctaacacggtgaaaccccatctctactaaaaatacaaaagaattagccag

SEQ ID NO: 37147 - DNA, 201 bp, Homo sapiens
gccatctcggctcactgctacctccttctcctaggttctagcaattctcctgcttcagcctcccgagtagctgagggtataggcgcccgccaccacgcccrgctaatttttgtattttttagtagagacagggtttcaccatgttggtcagcctggtcttgaactcctgacctcaggtgatccacccaccttggcctccca

SEQ ID NO: 37148 - DNA, 201 bp, Homo sapiens
acagtgagagagaggtggcagcaatggtcctggagtgtggcctgcctgcctaggaggctgggaggggtgctgtgaggcaaacagaatgaggaaccatgtcrcaaaaatgtggctatattttagaaatgctcctaacttttaactttgtaactcctttttaaagctgttatgttaaggaatgacaaaatcagacacaggttc

SEQ ID NO: 37149 - DNA, 201 bp, Homo sapiens
aggggccgggcacggtggctcacacctgtaatcccagcactttgggaggccaaggcgggcggatcacgaggtcaggagatcaagaccatcctggctaacayggtgaaaccccatctctactaaaaatacaaaaaaattagctgggcatggtggcacgcacctgtagtcccagctactcgggaggctgaggcaggagaatca

SEQ ID NO: 37150 - DNA, 201 bp, Homo sapiens
ggtaggtaacagtctgacataagttggttcaataaacatttgagtgagactggaatgtgggactctcataaaaattggacgcggagatcttaaagggcttwgtgtatcattgcagagtttgaattttgccctgtagatggtcagatgttatctggtagagaaagcaccagagaaggagccaagagacgaggttgttgtctg

SEQ ID NO: 37151 - DNA, 201 bp, Homo sapiens
aaacacgtttgtccctattgactgtggtctgagcgttcttcccaccactttttatttatttgtgaattgctagttccatgcacagtacctggcatgtagtrggtgctttagaataggtttttattatactagaaacagccatcacaaacacagtgctttgtacctgtatctttgagttctttttcttcatccatggaaata

SEQ ID NO: 37152 - DNA, 201 bp, Homo sapiens
ttatttgggaggcccatgaactattttcagaggtagtaagtatggccagaagccgcagatgtatttcatataaaaaattcctgagaggaaggggccgggcrcggtggctcacacctgtaatcccagcactttgggaggccaaggcgggcggatcacgaggtcaggagatcaagaccatcctggctaacatggtgaaacccc

SEQ ID NO: 37153 - DNA, 201 bp, Homo sapiens
caccttcagcattattactgtctcaagtttatacctcagagatgaaggctggaagaggttaagtgacacaaagccatgtcactagtaagtggcagagctgrgatctgaacccaggtctgttttacctggtttcatcctttgcagtatggagactcagaagaatgcagcatgcatgcacactctccacacacagcctccaga

SEQ ID NO: 37154 - DNA, 201 bp, Homo sapiens
ccatcacccaggtattaaacccagcatccattagctattcttcctgatgctctcccttctcccacccctgatcctccaacaggccccagtttgtattgttscccaccgcctcatgtccatgcgttcccataattcagctcccatttataagtgagaacatgtggtatttggttttctgttcttacgttagtttgctgagga

SEQ ID NO: 37155 - DNA, 201 bp, Homo sapiens
cattccccattccctagccccctgcccaccaaactggcttttaaaaatcgagcctccaaatcttcagggaggctgatttgagtaataataaaaccccagtstcccttttagacagctctatgtatatttaactctttctctattgtagttcccctgtcttgataaatcagctctatctgggcggtgggcaagatgaacctg

SEQ ID NO: 37156 - DNA, 201 bp, Homo sapiens
ttgagagataactgcagaagcatccagcacgatgctgacgggcagttgcttttcagtcagtaggttacaggagctcagacccaggcctctcacaacgcgcrgtccatgccacctcagggatggtgtctgcgtgggaaataggattgttcttttcaagtgaattttctgaaattcttccagccaataactggcaaaactttt

SEQ ID NO: 37157 - DNA, 201 bp, Homo sapiens
acctgccttggcctcccaaagtgctgggattacagacgagagccactgcgcccggcccactgggagttcctaagtcctgaggaacaatgtgtctttcttgttttttccatcagtgttgcattgtagttcatattgattctctcattggaaccttggcagtggtcacttagttcacactttgagactctctaaaaaggggtg

SEQ ID NO: 37158 - DNA, 201 bp, Homo sapiens
tgaggcaaagccatcccagtaatattcattgctgggaatcagaggccacatgctgccttcctccctacaatgtgtcagtcaggtttctctaaaaacccacrctagcattcattctgccctgaccctgttaggaagcagcttcaccaccaccgaaaggaggagagaagcaggcactcctgcttgtaaggacgtctagcaccg

SEQ ID NO: 37159 - DNA, 201 bp, Homo sapiens
ctgcaacaagatggggtctcagccctgcgcggtggctcatgcctgtaatcccagcactctgggaggccgaggcgggagcatggtgtgagctcaagagttcragaccagcctgggcaacatagggagaccccccatctctacaaaaaattttaaaaatttagccaggcgtggtggcacatgcctatactcccagctacttgg

SEQ ID NO: 37160 - DNA, 201 bp, Homo sapiens
ctacaaaaaattttaaaaatttagccaggcgtggtggcacatgcctatactcccagctacttgggaggctgaagtgggaggatcgtttaagccctgtctcaaaaaaaaaaaagtctcagtcctgccacttggttgctgtgtgatgtgactttgggcaagttagtaaacttctctgagccgtgagtttccgtttcataaaat

SEQ ID NO: 37161 - DNA, 201 bp, Homo sapiens
gtgagtttccgtttcataaaatagaggtaatacctacttcttggggtgctgtgaggatttgtggctatgcaagtaaagccgttagcccttggtgacggctmctgttcttgtcatgatatacgcttcagggaggaggaagtggctgtatatgtcaagcatccctaaacttcaaaatgtgaagtcctaagtgctccaaaatct

SEQ ID NO: 37162 - DNA, 201 bp, Homo sapiens
ttactgtagggctgttggtctttttctctgtctgctttacctatggtggggcttttttttttttttttttaataaacttgttattttaagagcagttttaygttcatagcaaaattgagcagaaagtaccaagagttcccatatacctctttcactgtcctccccacccgccaatacactaatagccttcaccaccaatag

SEQ ID NO: 37163 - DNA, 201 bp, Homo sapiens
ggaggaaggctctggagccagggctgcttaggttgcaccccaactccacccgtccgagccatatagccctctgcaaatcacttaatctccctgggccttgttttttgtctatgaaatgcagacaattagggaatgtatctctagggttgttatgagcattaagttaaattcctacagcatgcttagaactgtgtctggcac

SEQ ID NO: 37164 - DNA, 201 bp, Homo sapiens; identical to SEQ ID NO: 9539

SEQ ID NO: 37165 - DNA, 201 bp, Homo sapiens; identical to SEQ ID NO: 9541

SEQ ID NO: 37166 - DNA, 201 bp, Homo sapiens
tggcagtcatggcttactgcagccttgaactcctgggctcaagcagtcctcccaccttagcctctcgagtagctgggactacaggcatgtgccaccatgcscaagatttttggaatggtaaatgagcatcggcttcagcttaaaatcatctgctgcattagcccttaacaagaaagtcaccctatcctttgaagcattgaa

SEQ ID NO: 37167 - DNA, 201 bp, Homo sapiens
tgagggtgggggttgctgaaggttggggtggttgtggcagtttttaaaataagacaacaatgaagtttgctgcatcaactgagtcttcctttcacaaaagrtttctctattgtgtgcagtgctgtttgatagcattttacccatagcagaacttctttcaaaatttgagtcagtcctctcaaaccctgttgctgctttgtc

SEQ ID NO: 37168 - DNA, 201 bp, Homo sapiens
tttggaacgagtgcaaagtgtgtgagtcggaagctggagtaagacgtcgtcagaggaccagcaggccactggctagtaatcattctccctctggaaacacrtttgtccctattgactgtggtctgagcgttcttcccaccactttttatttatttgtgaattgctagttccatgcacagtacctggcatgtagtaggtgct

SEQ ID NO: 37169 - DNA, 201 bp, Homo sapiens
ttggccttgacagaaaaacttccatggaagagatgaaagttccgcagaccttgcaaggctggggccacgtgtgtttggaacgagtgcaaagtgtgtgagtyggaagctggagtaagacgtcgtcagaggaccagcaggccactggctagtaatcattctccctctggaaacacgtttgtccctattgactgtggtctgagc

SEQ ID NO: 37170 - DNA, 201 bp, Homo sapiens
gaagtagttgagtgtttgacccctggtaggcaggggaaggaggtaaggagatggaaaccattgaaggttttgaaacagaggagtagcttggtcaaatcttktatgtgatggaatgaacaccttgcttgcgtatctcttaatttttttcccaacagacttaaaagtcagatttccgaccgggcgcggtggctcacgcctata

SEQ ID NO: 37171 - DNA, 201 bp, Homo sapiens
tttgggagtttggactttttcccgttgtttagacactgagatgactcattggctttcctttggcaaatcagcatgcagagctgcttcctttaactgcagtrtattttgaaaccagaattcaccactgtcgaatgtattctacccacgcatttcccttgctttgctcatttatgctgttcacatggcccctggaagtagttg

SEQ ID NO: 37172 - DNA, 201 bp, Homo sapiens
aactcatgtgctgcattaatgccctgttgtcatgtaacaccatatagtcacaggttctggcgattaggagttggacatcttacagggggatgggcctgggsaagctggaaaaccattattctgcctacggtagcaggtataatccttctgggattattcagtacccactatttattcaatatttagtaaaagtttctgagg

SEQ ID NO: 37173 - DNA, 201 bp, Homo sapiens
tttgtatggaaaactttatggcttctaaaaaaacacctgttgtggatagtaaggttcttagtaggtgtattagtttctcattgctgctgtaaccaattacrtcaaacttgtggcttacaacaacacagatttattatcttatagttctataagtcaggtgtccaaaatgggactccctgagctaaaatcaaggtgttggca

SEQ ID NO: 37174 - DNA, 201 bp, Homo sapiens
gaagcctgatacatcttactgttttaaaaatgtagtgtcacttggcacaagacttgttttatagctgtgttttaaaaaatactctcaataaagaaagtgtygtgaggaagctgatgaattgctctttaggataattgagtgcgaaggcctgaacattgtctttttctgttacagctcacaaggagatacattcccagcaag

SEQ ID NO: 37175 - DNA, 201 bp, Homo sapiens
cgatgaagtgtgtgtcatggcagattctcatgcagatctgcataggaagacagatgaaggttagggacctagacatcagttcccttgaaattacatgtgcygcacacacaccttagcaattcagcctccacttccagggatacccatccctccgttgtgtggactgctgctgagagctacaacagggcaaagagctgtgta

SEQ ID NO: 37176 - DNA, 201 bp, Homo sapiens
ctgtgacccagaaatcttttattgatcattttatcatagttctgtgcgacagaaatagatatgcaaattgaaatttaatttttaaaaaaatttccagtgawgactgaaagtctctaagtgttgtatgttgagttctgtgttgagttacctttgtaattattactagtgtgtgtggattaaacaacaacaataaaaatacac

SEQ ID NO: 37177 - DNA, 201 bp, Homo sapiens
cttttaaacatttaacttttatgctcaattttactaaatttatatatactcaaatgcatgtctacccattaaattacaaatggagagtaacgacttttcarattatttgggggaggaacttatattattcgaacaactccaaataataatgaatatgtcactctgcaatgggaatttgattagttaactcatttgaagtgt

SEQ ID NO: 37178 - DNA, 201 bp, Homo sapiens
ctaatggtaggaggttatctatgtgtgcttggcagaaaagaaatgcctgtttcagcagtgcctgccgtccacccagcgtgtgtgagctctggggtgagggygagatggggcttgcgaatctgccgttcccatcattggttttgttccctagggcctcttctactaagagtatcttgcttactgcctgcgagtctagcattt

SEQ ID NO: 37179 - DNA, 201 bp, Homo sapiens
gaatgaatgaattccctgtttttactgataagcaacagattttttctgagagataataaatacataagaagtaaatctgaatagatcattttcctgattamaacactcccttccaggtatctctttagaaaaaaaaataagtaatctctactctagattagaaagcatggcatgatccagcttgattccttgaacatttta

SEQ ID NO: 37180 - DNA, 201 bp, Homo sapiens
cactcgtacttctaagagagcaaaggatataggctgctcatggaattctagtataagcagtgatcccagaaaaagtgtgtggtgagtcaaagactgttccrtgcaggaaagtaccagtagcatcgagaaaaaggagagctttgggagcaggagaaaagatacggaggagagcgcataggggacagggcagggacaggctgc

SEQ ID NO: 37181 - DNA, 201 bp, Homo sapiens
tcttaaaactaggctgttgtcattttgatgtactgtactgctcactgaggaacagtgtggtggagagcaccacctagtggatgggacccatacttgatggrctgtgtaggagatttcgtctacattgatgtaactcttgcccttgtcttgcaaataagtgatttttaatcgtcctagcacatatttttaagtagcgctagg

SEQ ID NO: 37182 - DNA, 201 bp, Homo sapiens
gccagttaaaattccctcttcttatttcgatttaggttttaaaacgttaaaatcttttctttcttgatcaatgttttaaccaaagctgttaaaagtactgmaaaggctgtatcattcaagttaaaccaatgagaggagggagatggaaaggacctctccaaacagaaccaaaaatatatctaggggccaggggcagtgaag

SEQ ID NO: 37183 - DNA, 201 bp, Homo sapiens
tgccttctttagtgaagtgtctgttcaagtcttttgcctatttttaatttagttttttgttttcttagttttgactttgagagtactttatacattctgarcaacaagtcctttgtcatgtgtataatttgcaaatattttctcttagtctcccatttaacttcacttttccttctctgaaagtaaatacttcttgctaag

SEQ ID NO: 37184 - DNA, 201 bp, Homo sapiens
acatctttcatgtgccccccttgccttctttagtgaagtgtctgttcaagtcttttgcctatttttaatttagttttttgttttcttagttttgactttgmgagtactttatacattctgaacaacaagtcctttgtcatgtgtataatttgcaaatattttctcttagtctcccatttaacttcacttttccttctctga

SEQ ID NO: 37185 - DNA, 201 bp, Homo sapiens
ctaaagagacaaccagggaaggatttcctgtgtctgtctcctctcattctctgggaagtcttaaaatttttcagcttagactgcttccttctttaaattcyaaattgaatacccttatgtccgtttgatatgtatattattattatattcctggattttattcttgaacccagttggagtttcaaggcaaacatttggttt

SEQ ID NO: 37186 - DNA, 201 bp, Homo sapiens
gctaaaagagaaaaaaaatcagtttgagtaaagcaaaaacatttctacttttggggtttgaatgataacaaagcagttgagattaaattattgacatctgwcaagcagaatggatgttgaatgtatgttcttgctatgggccgcttgaagttgcttttgctattctctttgctgatgtgaagcagaaaatgaacaaggtaa

SEQ ID NO: 37187 - DNA, 201 bp, Homo sapiens
ttactttcctttcttaggtacatgactgtgtatctcttaaaagtgtatatgtatttgtggggggcagttagtgttacatttttattgtaaatttattacarttcgatatgtgattttgagtgaaattcattgcaatatgaatgaaaattttttgtatgtatggtgtttcaaatgctttacctaattaattgtctgaaaaac

SEQ ID NO: 37188 - DNA, 201 bp, Homo sapiens
tgtctgtggtcttgggtggaaatgaaagattggcacgaattcacggttttcaatttccaaagatcaatacagaagtaactatggttgtaaatgtgtacgtrtgtacacatttatacgcgtgtatgaaaatgcatgcatatattttcttgctctggccactgaggaggcctggaaacagtgacactgtaatagcaataagcg

SEQ ID NO: 37189 - DNA, 201 bp, Homo sapiens; identical to SEQ ID NO: 9537

SEQ ID NO: 37190 - DNA, 201 bp, Homo sapiens; identical to SEQ ID NO: 9538

SEQ ID NO: 37191 - DNA, 201 bp, Homo sapiens
ctcacttcagattaaacttcctggttcgtcacaggtttattgaattctagatgcttagggcacatctgggggtaaaatacaaatattcctgccctcatggmgtttgcattctcgtgggctggcaaagacaagcactacgtgtatagtacattaggtcataggtcctatggaaagaaaaggaagagtagaaccaaggtaaca

SEQ ID NO: 37192 - DNA, 201 bp, Homo sapiens
gggaccccgggccccaaaccagaccccgtcccgtaagcattgtgtgaagggggtggctctaagggggacagaagagttggcctcagagaccctacagcttyttgggggaaggaacagccttattttgaggaagggggacgcatattggggaacagatttctcctgcggcgacagggattgggggacaagaaaggagatcct

SEQ ID NO: 37193 - DNA, 201 bp, Homo sapiens
atcaacatatacaaatactctcacaaatactctcatgaagctcagtttctttctatgaagaaaaattcagacctaactaagctaaacataacatgaacacygtgagtcatacagatctgtgatcaatgccaattcttccgtttattagccttgtgaccttgcttaggtttgtttccatgtttactaggtggggcaggagga

SEQ ID NO: 37194 - DNA, 201 bp, Homo sapiens
gccagtctttctgaccattctttttccttgctgtatttgtgaaccttcttctcaatacccctatgggcttgccaatccaaagccccccatgtcgtaaaacrcaaggaacagtagtagccaacttcagaggagacaaatgtcaatcagtgaaaacgtttttgttttttttttttgccgatctttctgtatccagtgtagtta

SEQ ID NO: 37195 - DNA, 201 bp, Homo sapiens
aaaagggtaataatgatacctaccctaagggattgttaggagaagcaaatcggatgcatagcatttagattggtgcctgccgtatagtatgtagtactcamtaaaaattgactattaacttgtgccactactattttttaaaaatagtttttacccaattcccttttgtagtgaagcccacggagattaagcaacttgctc

SEQ ID NO: 37196 - DNA, 201 bp, Homo sapiens
agtggtttttctggctgtgcctttggctgcatactaactgaacagcaagctgtgtccactgattgaatgaaaaaaaaataatgattttgtgttacagggamctttttacaatatgccagagggacctactggagtctctttaatcttgaacaatgcttgtttcttgcagaggcaaattatgcaaatcagtacttagtgttc

SEQ ID NO: 37197 - DNA, 201 bp, Homo sapiens
gtggtttggattttatattctctgattaacctgtttatgccactttcactggattgtaagctccttcggatcaaagactagatggatgttatcctatcctrttgtattactgcttaaaacacagtgcctggcttgtgacaggcacttgctccttgttgaccaaatgaggacagagtggatcatccattcggaatcttagta

SEQ ID NO: 37198 - DNA, 201 bp, Homo sapiens
atgcttgtgtgttaagcatattgagtaaactgtcaagatttttctctttgtcatctttttgtcagctttatcatgcttaattttcaagaaaataatgtgtytgttactgtggtcacaccgtgattttgcattggcttatgtatgatattttattgtctctgtcctagaaaattatagcagtttttatgaggagtggtttgt

SEQ ID NO: 37199 - DNA, 201 bp, Homo sapiens
tggaaggcacctattggtccctagtggtctgaaatgggaaatgcattccctgaaaatttcattaggactttccataaagcttaacatttgactagaaacaraaatgttagtagctttagatagattgattaggttatttaaagtgttccttgagctacagatgaagttaataattttcttaatctcttattaaaaatagat

SEQ ID NO: 37200 - DNA, 201 bp, Homo sapiens
gtgtctggctggtacccctgcgtagggatgcctgcatagtttgccatatctcaaaggcagagtggagcagggttctttgtgtgaatcacagggtgatggcrtgctggagccaggagagacctgggagtcccctttagcatccttctccgtagtctcatggcagttcttattaactcttgtcttccagatgctaggcatggt

SEQ ID NO: 37201 - DNA, 201 bp, Homo sapiens
tgtattatatattattattaataacatactcagcaatctttttgcattagtgtcaactactgggtaagcatcaatccagcttcctgggtttgttgagtgcrgtgtgtcagtctatggagtgtattcagcacataccgactgcagcctccccctgcatgctggtcactgtgccgtggctgcaaatgcagagggcatgcacaa

SEQ ID NO: 37202 - DNA, 201 bp, Homo sapiens
agaattgtgcaggacccaaatgatggccaaacagagggaaatataacccatttgtcttctggtggatctcaaaagccatctattcaaggtaagcacagatrgaacgacacccatagttacagccaggatcaggagagcacgtgggaagaggggggcatttcagggctgctcaaaccaaaatcctgtgtgataaaaacacct

SEQ ID NO: 37203 - DNA, 201 bp, Homo sapiens
tgtgtacagacagtccactgggcagcacaggtatcctcatgttctttatttgcacagagtgaaatgtcagaagttacatgtaaatgaattcacagtcaatwaagtccacgtctacctggaaatacaggctcggcctctgcactgtgcgcacacgggcttcacttgtgtctattcagatgcgcagggaagctttggcactga

SEQ ID NO: 37204 - DNA, 201 bp, Homo sapiens
atgcaatttttttctaaagcttaagattaatttctatggttactagggatataaatctctagattgctttaaaacaaagatttttgtccaggagagagttracagctccctataagagaagctattacttaatttttctttcctaagtttaaacacataaaaatatttgtaatgataccccaaaggcatcataaaaatgta

SEQ ID NO: 37205 - DNA, 201 bp, Homo sapiens
cctggcctgttcctcctcacccttcaagtctcagcttaaatgtcacctgatcagggaggccttttcttctcttcccatcccactcagactatattatgttytcatttgctgctgccctttcctttgctgtctttttttagccataccatgtctgaatatgggaggatgacagacacagaacgagaccagatagaccaggat

SEQ ID NO: 37206 - DNA, 201 bp, Homo sapiens
gttgatgcatcgtcatactaaggcacgctgaaaaatattttcagtttcctaataaaaacaaagtgacctccccatgagtgattctcctaattgttattgtyaaatgcttttctttatgctttttttcttgctcacactcagataatctacaaacactgtttgaatcctgtgtttcactttcttttcttatgaaaagttttc

SEQ ID NO: 37207 - DNA, 201 bp, Homo sapiens
tttaaaaccattattaacaatattttctattgatgctttagtatagatttagacttctagtatcattgattattataatttgaattaaaagtgaaaattcrtgataggtactgtttacttggaggaccaattgctgtggaagtgtgcagcctacaatgaagataataagatgcgtcatttgaatcaatatttctcccacct

SEQ ID NO: 37208 - DNA, 201 bp, Homo sapiens
gtatttttaaatactttttgcagtgataactgcccattaccttgtgatattttccctgagtctctgaaagagtgaggttttttttttgttttggtttgttgttgttgttgttgttttcaaagttagcatttttggtgtgttttcacaaatgtatttgatttaaaagtggtgatataattttataatggaattttattagca

SEQ ID NO: 37209 - DNA, 201 bp, Homo sapiens
atgatgatttaacaactacaccatttgaactagtcgtccttttaaaatctcatttgagcattcccttttttgcctatatagtgttcagttcttctcagctrttttacagctaatgatttggttctattagggagaaggtaatacatgcttattttcgcagcatgttaattctattaactgttcagtaactgactcgggaat

SEQ ID NO: 37210 - DNA, 201 bp, Homo sapiens
atttgagatactccttaacagcaccctattgggaaagagttgggatctttgagctatatgcaaaaatactatttaatttcagcataattcgttatgagcarccattttaatgtaagagtctgaaaagcaataaaatgtatctgttaaggtttgtactagttagcttgtttctgggcttcatgtttatttcacttcaattct

SEQ ID NO: 37211 - DNA, 201 bp, Homo sapiens
tcataaaataaagtgcacgtgtgtataagtaaaccgttgtgagctagagctaggctagaactgggtgttgttgatgcagataatatcaaattcattatttyataatcttttaagatatgttttctgtgactttggaaatgaaattaaagaaattaaggaagaaaggaaaagagagaggaaggaattaatttatagcttgta

SEQ ID NO: 37212 - DNA, 201 bp, Homo sapiens
tgatatagaagcaaaaatatttaaagtgcatttttatgtgaaaggatttgatgagttcacatttcatgtcttcaacttttgttctctagctcactgttttrgaattgcacttattatattttgtgtgtgtggaaggaaggagaccaaatttctgtgtacagtgtcttaacagatttaatcgaatcactgccatattctcct

SEQ ID NO: 37213 - DNA, 201 bp, Homo sapiens
gaaaagtatttcattttcttttaaaggtcaaatgtaacatttcacaatagatgtgatgcagaatttagctttgctagctgaagactgtagtatctcattayatttaatgatggctttgcctgagaagctgttttaagcagtctctcttctggtattttcttctgcaacaggagtatgtaaactttactcagaacagagagc

SEQ ID NO: 37214 - DNA, 201 bp, Homo sapiens
acagcattcaccagttagttgtgggggcaactgaaaatatcaaggaaggcaacgaagacataagagaggtaggcactgtttaggttccccaggtgcgacgkggcgcagcactgagtcccagcagcgggtgttagtctcgccggcacagctgcccaggagccttgctgggcagagctcacggggctgatcacaaaattgtgt

SEQ ID NO: 37215 - DNA, 201 bp, Homo sapiens
ttcattttcttttaaaggtcaaatgtaacatttcacaatagatgtgatgcagaatttagctttgctagctgaagactgtagtatctcattatatttaatgrtggctttgcctgagaagctgttttaagcagtctctcttctggtattttcttctgcaacaggagtatgtaaactttactcagaacagagagccatccgagt

SEQ ID NO: 37216 - DNA, 201 bp, Homo sapiens
aacagagagccatccgagttaaaagagtggtggataagaaaagattgtaagtattgctttcattggtgtttcttaattaataatagtactactaataatakcagttaaagtttgtagagcacttaccctatgcaatgtaccgtgtttgaacttcttcgcaaaatgccatagctggcgctaccgggcactcactgtgtgcca

SEQ ID NO: 37217 - DNA, 201 bp, Homo sapiens
ttaatttattttaacattacagaggctaaaaatgtaattaagctcaagcaacatttaccattttatctgatagaatagaatattatattagctattcatgytttttaaacttacacaatcaaagatactgccaacacacaatattttttaaagcccagtttcaaaatttagatttccctagggaaccctgagtgcattcat

SEQ ID NO: 37218 - DNA, 201 bp, Homo sapiens
ttgcctcaaaatcatgtgaggtacctgagtaagtgttagtccctactgcaatccaaccgaattggaatctcaggggaaggggcgataaacccagatttttmatgttgtcctcccacaacccttgcacttaattattatgtatgttaatgtttgggaatctctattcaagagaatgtgtataatttcaagccaattaattta

SEQ ID NO: 37219 - DNA, 201 bp, Homo sapiens
actatcagtaatggtattatcgtgaatacagctactagaatttaagttacaatgactaagagtaaataaactcctttacggcagtgtttcttgaagtgtgstccattgactacttgcctcaaaatcatgtgaggtacctgagtaagtgttagtccctactgcaatccaaccgaattggaatctcaggggaaggggcgataa

SEQ ID NO: 37220 - DNA, 201 bp, Homo sapiens
tcataaatttagatctttaatccattctgagttgactttgttcagtttagtcatatttaagagaaggaaagctacaggtgattgctactatcagtaatggyattatcgtgaatacagctactagaatttaagttacaatgactaagagtaaataaactcctttacggcagtgtttcttgaagtgtgctccattgactactt

SEQ ID NO: 37221 - DNA, 201 bp, Homo sapiens
catttgattttgatatgtatttctctgatgattagtgatgttgagcattttttatacacttgttgaccattggtatgtcttcttttgagaaatgtcttttsaagtccttggcccattttttaatcaggttatttggtttcttactactgagttgtataaatttcctatatatttttgatactaactaactccttacttgac

SEQ ID NO: 37222 - DNA, 201 bp, Homo sapiens
gaagttttcagtaggggaggaaaattgttctacaaaaggcaaaacaaaaatatctgaccagatccaatactaaagcaatgtattttaaatggagggagtcmtgacttttgaagtttatctgtttctatcctttgttttacaggaacagccagctgaaaactctcctggccattggaggctggaacttcgggactgccccgt

SEQ ID NO: 37223 - DNA, 201 bp, Homo sapiens
tttgatgccagacacaaaatgtccacaatagaaaatctgaccacagtatctaaacagttgcttatcagcccttggaactgccaaaaaagctattaaactgrtgttttccatggtgatggtctccaccaccctgttaggagccatgacattgttctgtccttgttgggcagagaaggtggtgatgctggtggtgggagggtg

SEQ ID NO: 37224 - DNA, 201 bp, Homo sapiens
gcaccagctgagaagctcatcgttggattccctacctatggacacaacttcatcctgagcaacccctccaacactggaattggtgcccccacctctggtgytggtcctgctgggccctatgccaaggagtctgggatctgggcttactacgaggtatgtagattggactgaaaagtgctctgtgaattccgtgcactgtgc

SEQ ID NO: 37225 - DNA, 201 bp, Homo sapiens
gttattttgctgaattcattttttagctctgacaaaatttttggtgtggaatctttagggtttttcctatataagaccacatctgcagggacaattttacyacttccttcccaaattggatgccttttatgtcttatttttgcccaaatgttctggttaagactatgttgaatagaagtggcaaaagaagcattcttatct

SEQ ID NO: 37226 - DNA, 201 bp, Homo sapiens
atcatttgggtagtatagacattttaacaatattgagtcttccaactcatgaacatggggcatgtttccatttattcatattttctttatttgaacagcakgctatagttttcattgtacaagtctttcacttcattaagttaatttctaagtattttattctttttgatgctattgtaaatgaaattatttttataattt

SEQ ID NO: 37227 - DNA, 201 bp, Homo sapiens
tatgatcatgccactgcactcgagcctgggtgacagagtgagaccctgtctcaaaaaacaatgacaacaaagaaaacatcactgggatttcgatagggatwgcattgaatctgtacatcatttgggtagtatagacattttaacaatattgagtcttccaactcatgaacatggggcatgtttccatttattcatattttc

SEQ ID NO: 37228 - DNA, 201 bp, Homo sapiens
ttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaact

SEQ ID NO: 37229 - DNA, 201 bp, Homo sapiens
tttcaggttgcacggctccagctcagcccattgagccaataactgctgctcccagtggcagcgggaacgggagcgggagtagcagctctggaggcagctcrggaggcagtggattctgtgctggcagagccaacggcctctaccccgtggcaaataacagaaatgccttctggcactgcgtgaatggagtcacgtaccagc

SEQ ID NO: 37230 - DNA, 201 bp, Homo sapiens
tataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaactt

SEQ ID NO: 37231 - DNA, 201 bp, Homo sapiens
atgatatttgctgtgggtttttcaaacatagcttttattatattgaggtagtttgcttctatttctagtttgtttttattatgagagggtattaacttttrgcaaatactttttctgcatcaattgagatgattatgccatttttttcttcattcttttaatgtggtgtattacattcattggttttcataagttaaatca

SEQ ID NO: 37232 - DNA, 201 bp, Homo sapiens
tctttcaccattgagtatgatatttgctgtgggtttttcaaacatagcttttattatattgaggtagtttgcttctatttctagtttgtttttattatgasagggtattaacttttggcaaatactttttctgcatcaattgagatgattatgccatttttttcttcattcttttaatgtggtgtattacattcattggtt

SEQ ID NO: 37233 - DNA, 201 bp, Homo sapiens
gcatgttctcactcataagatggagttggaacaatgagaacacatggacaccgggaagggaacaagaaacactggagccagctgaggggttgggggcaagsgggggagagcattaggacaaatacctaatgcatgtggggattaaaacctagatgacgggttgataggtgcagcaaaccatcatggcacacgtatacctat

SEQ ID NO: 37234 - DNA, 201 bp, Homo sapiens
catgttctcactcataagatggagttggaacaatgagaacacatggacaccgggaagggaacaagaaacactggagccagctgaggggttgggggcaaggsggggagagcattaggacaaatacctaatgcatgtggggattaaaacctagatgacgggttgataggtgcagcaaaccatcatggcacacgtatacctatg

SEQ ID NO: 37235 - DNA, 201 bp, Homo sapiens
tagtattttatttaaacatctatattttaaaaataattgtaataatgagaatacatagacacagggaggggagcaacacacactggggcctgtcggggggsggtgggggtagggaaagcatcaggataaagagctaaagcatgtggggcttcatacctaggtgatgggttgataggtgcagcaagccaccatggcacatgt

SEQ ID NO: 37236 - DNA, 201 bp, Homo sapiens
tttgaacccatcacaaggaagctaacaattttgaaaaaaggttagacgaatggctaaccagaataaacagtgtagagaagaacttaaatgaactgacagarcggaaaaccatggcacgagaacttcgtgatgcatgcacaagcttcagtagctgatttgatcaaatggaagaaagggtatccgtgattgaagatcaaatta

SEQ ID NO: 37237 - DNA, 201 bp, Homo sapiens
cttaaaaatagtaattgtaataaatttatatttgaaacatgtaaggtatttaattcacacacaatgttttgtgtgcaaactcccctttcccctataattaytcctcagctatccaaggacttgaggtcttcagattgggaaaaataacattaactaaaatttattaaataactaacatgtgctaggcccagtgctaggtag

SEQ ID NO: 37238 - DNA, 201 bp, Homo sapiens
atccatatgtaatacatgaggaaattgaggttcacaggtgaaataacttgtctaatgtcacatatctagaaagaaggagaacaaaaattgaaatataagtyagcgattctagagaccatgctgatattctgttctgtcatatggcaacctttgtgctggacaggtgtgggagaatgctctctgcaattgactggcattggt

SEQ ID NO: 37239 - DNA, 201 bp, Homo sapiens
ctaactgccccaattaaaagacacagactggcaaattggataaagagtcaaggtccatcagtgtgctgtaatcaggagacccatctcatgtacaaagacayacataggctcaaaataaagagatggaggaagatctaccaagcaaatggaaagcaaaaaaaaaaaaaaaaaaaaacaagcaggggttgtaatcctagtctc

SEQ ID NO: 37240 - DNA, 201 bp, Homo sapiens
atctagaaagaaggagaacaaaaattgaaatataagtcagcgattctagagaccatgctgatattctgttctgtcatatggcaacctttgtgctggacagrtgtgggagaatgctctctgcaattgactggcattggttattctaacagtcttaccctctttgtatgtgaataaactggcattctcacttacattgactgc

SEQ ID NO: 37241 - DNA, 201 bp, Homo sapiens
acaataataatgggagactttaacaacccactgccaatattagacatatcaatgagacagaaggttaacaaggatatccaggacttgaactcagctctgcrctaagcagacctaatagacatctgcagaactctccaccccaaatcaacagaatatacattcttctcagcaccacatcacacttattccaaaattgaccac

SEQ ID NO: 37242 - DNA, 201 bp, Homo sapiens
aaaagaacagaaatcacaacaaactgtctctaagaccacagcgcaatcaaattagaactcaggattaagaaactcactcaaaaccgcaccactacatggaragtgaacaacctgctcctgaatgactactgggtaaataacgagatgaaggcagatataaagatgttctttgaaaccagtaagaacagagacacaacgtgc

SEQ ID NO: 37243 - DNA, 201 bp, Homo sapiens
aaaatcaacaccctaacatcacaattaaaagaactagagaagcaagagaaaacgcattcaaaagctagcagaaggtgagaaataactaagatcagagcagmactgaaagagacagagacacaaaaaacccctcaaaaaatcagtgaatccaagagatgcttttttgaaaagatcaacaaaattgatagactgctagcaaga

SEQ ID NO: 37244 - DNA, 201 bp, Homo sapiens
cttaggatgcatttgcaagagtgttcatactaattacctccacacagagatcaggcatctgaggcacagggagggaaacagaggcaaggccaaaactcacmgcacacttcagtggatcctaaaccaggccattgtccctcctgctgactacacacaggctctgcctaccagctgacatgctacttcaccaactgggcccag

SEQ ID NO: 37245 - DNA, 201 bp, Homo sapiens
tatttaaaaaatggtgctgggataactggctagccatatgtaggaagctgaacctggatcccttccttacaccttacacaaaaatttattcaagacagatkaaagacgtaaatattagacttaaaaccataaaaaccctagaggaaaacctaggcaataccattcaggacataggcatgggcaaggacttcatgactaaaa

SEQ ID NO: 37246 - DNA, 201 bp, Homo sapiens
ctgctgactacacacaggctctgcctaccagctgacatgctacttcaccaactgggcccagtaccggccaggcctggggcgcttcatgcctgacaacatcracccctgcctctgtacccacctgatctacgcctttgctgggaggcagaacaacgagatcaccaccatcgaatggaatgatgtgactctctaccaagcttt

SEQ ID NO: 37247 - DNA, 201 bp, Homo sapiens
taaacaggctcaatggcttaagcacaacaaatctggaggcgccatggtctgggccattgatctggatgacttcactggcactttctgcaaccagggcaagyttcccctaatctccaccctgaagaaggccctcggcctgcagagtgcaagtaagtgactgagggggaatgcccaggtgtataaataccccttctccaactc

SEQ ID NO: 37248 - DNA, 201 bp, Homo sapiens
catcgtactgttaccaaaacagatatatagaccaatggaacagaatagaggcctcagaaataacaccacacatctacaaccatctgatctttgacaaacckgacaaaaacaagaaatggtgaaaggattccctatttaaaaaatggtgctgggataactggctagccatatgtaggaagctgaacctggatcccttcctta

SEQ ID NO: 37249 - DNA, 201 bp, Homo sapiens
aatctcttgacttttgaaagatctgtaccttcctgaaaaatggagccactcagggatgggatgcccctcaggaagtgccttatgcctatcagggcaatgtrtgggttggctatgacaacgtcaagagcttcgatattaaggtaagatcagtcccttaaatgtgctgaggtcccagccctgagtcccaggaaagcaagtgat

SEQ ID NO: 37250 - DNA, 201 bp, Homo sapiens
aggcgccatggtctgggccattgatctggatgacttcactggcactttctgcaaccagggcaagtttcccctaatctccaccctgaagaaggccctcggcytgcagagtgcaagtaagtgactgagggggaatgcccaggtgtataaataccccttctccaactcaaaaagcaaccctgatgtcttcccacctcccccttg

SEQ ID NO: 37251 - DNA, 201 bp, Homo sapiens
cctgacttttgaagtttatctgtttctatcctttgttttacaggaacagccagctgaaaactctcctggccattggaggctggaacttcgggactgccccrtaagtcttctatggagagcatgttgttcgtttgctatggaaaacaagttagccccatgtgatcactgtccctttagacttcacaatctaagacagggtat

SEQ ID NO: 37252 - DNA, 201 bp, Homo sapiens
tcattataaggcaccataaagagagtgaaaaaataacccataaagttggaaaagatatgttcaatgcacgtaactgaaaaataattacaatccagaatatrtaaagcatggctataaaaattaataaacttgtgggcagcacaatagaaaaatgggcaaaagatacaagcaggcatttcacagaaaaggaaacaaaaacag

SEQ ID NO: 37253 - DNA, 201 bp, Homo sapiens
aaggttgagcattactgtacaatcgcttctgcttctttactgtaggatcttagatgtaattgatccctatttcccaatgatatacagttgctccaccagcmcccaagcctgcagcatgcactgctagtcctggatgttgggtagcggaagcagggggattaaaggaaaatacatggtcccttcattctcaaaacatgtatt

SEQ ID NO: 37254 - DNA, 201 bp, Homo sapiens
gagtgtgttgtttagtttccacaaattggtggcttctacagtttcacttctattatcaatttctaacttcacgtcctttgtggttggagaagatactttgyatgatctctatatttttaaatctgttgagacttaatttgtgacctaatatatagtctatactgaaaaatgtcccgtgtgcgcttgggaagaatgtaaatg

SEQ ID NO: 37255 - DNA, 201 bp, Homo sapiens
caagagaaaacgcattcaaaagctagcagaaggtgagaaataactaagatcagagcagaactgaaagagacagagacacaaaaaacccctcaaaaaatcartgaatccaagagatgcttttttgaaaagatcaacaaaattgatagactgctagcaagacttacaaagaagaaaagaaagaagaatcaaatagatgcaata

SEQ ID NO: 37256 - DNA, 201 bp, Homo sapiens
ttttcttgtttttcagtgtgaatatttagagttataaagttctcacttagtagtgccttcacagtatcccataagttttgctatgttatgtttttattttyattcatttctaagtatttttaaatttcccttatgactacttctttaatctattattaagagtgtgttgtttagtttccacaaattggtggcttctacagt

SEQ ID NO: 37257 - DNA, 201 bp, Homo sapiens
acgcattcaaaagctagcagaaggtgagaaataactaagatcagagcagaactgaaagagacagagacacaaaaaacccctcaaaaaatcagtgaatccargagatgcttttttgaaaagatcaacaaaattgatagactgctagcaagacttacaaagaagaaaagaaagaagaatcaaatagatgcaataaaaaatgat

SEQ ID NO: 37258 - DNA, 201 bp, Homo sapiens
tccctaactcattttatggggccaacatcatcctgataccaaagcctggcagacacaccacaaaaaaagagaattttagaccaatatccctgatgaccatygatgcaaaaatcctcaataaaatactggcaaaccaaatctggcagcatatcaaaaagcttatccaccacgatcaagttggcttcatccctgggatgcaag

SEQ ID NO: 37259 - DNA, 201 bp, Homo sapiens
aaactactttaaagttcatatggaaccaaaaaagagcccacattgccaagacaatcctaaggaaaaagaagaaagctggaggcatcatgctacttgacttmaaactatactacaaggctacagtaaccaaaacagcatcgtactgttaccaaaacagatatatagaccaatggaacagaatagaggcctcagaaataacac

SEQ ID NO: 37260 - DNA, 201 bp, Homo sapiens
cacattgccaagacaatcctaaggaaaaagaagaaagctggaggcatcatgctacttgacttcaaactatactacaaggctacagtaaccaaaacagcatsgtactgttaccaaaacagatatatagaccaatggaacagaatagaggcctcagaaataacaccacacatctacaaccatctgatctttgacaaacctgac

SEQ ID NO: 37261 - DNA, 201 bp, Homo sapiens
accaccaaggtctcaccctgccttctttgggtctccctcagtttcactgccatggtttctactcctgagaaccgccagactttcatcacctcagtcatcarattcctgcgccagtatgagtttgacgggctggactttgactgggagtaccctggctctcgtgggagccctcctcaggacaagcatctcttcactgtcctg

SEQ ID NO: 37262 - DNA, 201 bp, Homo sapiens
gggaatatcacacaccagggcctgttgcggggtgggggattgggggagggatagcatcaggagaaatacctaatgtaaatgacaagttattgggtgcagcmaaccaacatggcatatgtatagctatgtaacaaacctgcacgttgtgcacatgtaccctagaacttaaagtaaaatttaaaaaaaagcctcataatcctt

SEQ ID NO: 37263 - DNA, 201 bp, Homo sapiens
tgttgcggggtgggggattgggggagggatagcatcaggagaaatacctaatgtaaatgacaagttattgggtgcagcaaaccaacatggcatatgtatasctatgtaacaaacctgcacgttgtgcacatgtaccctagaacttaaagtaaaatttaaaaaaaagcctcataatcctttttattttttatagtcagtagt

SEQ ID NO: 37264 - DNA, 201 bp, Homo sapiens
ttctgagttagaatcttaggatgcatttgcaagagtgttcatactaattacctccacacagagatcaggcatctgaggcacagggagggaaacagaggcarggccaaaactcaccgcacacttcagtggatcctaaaccaggccattgtccctcctgctgactacacacaggctctgcctaccagctgacatgctacttca

SEQ ID NO: 37265 - DNA, 201 bp, Homo sapiens
ttatgataaaactaaaatgaaagcgtaaaaggccaagaaaactaaggcattcctgaagatgataaacagtgtgtgtgagttggagggtgggataccattasctatgacaggtctgaggagtggtagaaatggcatttcaaattagcgtggaaaagatgggttattaaaattatgctggggcaagtagttacccacatggaa

SEQ ID NO: 37266 - DNA, 201 bp, Homo sapiens
aattaaagaaactaaaaataatacaaggttattgaaaacaataatgtaaaaggatacacatggtcacagtttaaaactattcattctatgactcataaacrcagtaattctttccaataaccaagtgctcagatgggatgcaagtttgctggggctcttaaggagctattaaaaagaaatgtttaatctgtaggtcatgtc

SEQ ID NO: 37267 - DNA, 201 bp, Homo sapiens
tagttacacccttcattttcttggttaaagtccccatgtgagagtggcaactcatggaaataatacatgagagatccaggcttactggaagttcccctgasgacctgttcttgcccagaacgactgaggaatccagaaggtccatgctatcttctctacctgggagcttgagaggcaacaaaaccatatcatggatcagac

SEQ ID NO: 37268 - DNA, 201 bp, Homo sapiens
ttctaagcattacactaggctgcccgttattactgagtacgtattctgtggcagacattgtcaggctctgaagaacttcttctgaggtggaagactgaaakaatatgaacaatgtcaatgcattgtgataaatgccatgttagaggtctgcagagtacaaaagtaacaaggaaagagggtaactaattctgctctggggca

SEQ ID NO: 37269 - DNA, 201 bp, Homo sapiens
ctttctcagcccacctggggagatttaagaaaccctcaccaatgctcacatatctctaatcagtgattcaggggatgtatcaattctctaaattttttccrgatttttcctagaatttatttgttcaccatttatgcccagattctagaaaagtgttttgcatacatttggtggttagtaaatttttttttgaatgattta

SEQ ID NO: 37270 - DNA, 201 bp, Homo sapiens
agaagctcatcgttggattccctacctatggacacaacttcatcctgagcaacccctccaacactggaattggtgcccccacctctggtgctggtcctgckgggccctatgccaaggagtctgggatctgggcttactacgaggtatgtagattggactgaaaagtgctctgtgaattccgtgcactgtgccttagggcta

SEQ ID NO: 37271 - DNA, 201 bp, Homo sapiens
ccttaaatgtgctgaggtcccagccctgagtcccaggaaagcaagtgattcctgttatcctctttctttaaacaggctcaatggcttaagcacaacaaatytggaggcgccatggtctgggccattgatctggatgacttcactggcactttctgcaaccagggcaagtttcccctaatctccaccctgaagaaggccctc

SEQ ID NO: 37272 - DNA, 201 bp, Homo sapiens
gatctgtaccttcctgaaaaatggagccactcagggatgggatgcccctcaggaagtgccttatgcctatcagggcaatgtgtgggttggctatgacaacrtcaagagcttcgatattaaggtaagatcagtcccttaaatgtgctgaggtcccagccctgagtcccaggaaagcaagtgattcctgttatcctctttctt

SEQ ID NO: 37273 - DNA, 201 bp, Homo sapiens
catttttgataaaggtggggaaaggtagatctactgttgtattcactgaaaagcctttggaatcaccaccaaatctcactgaggctgtaacaatttatggyaaattggaaggcaatcaatccttcagaattagattctacggggtacagacaatcggttcaaagtacatgctttttctttctatccaggtcttgtccttat

SEQ ID NO: 37274 - DNA, 201 bp, Homo sapiens
acgaaggtaccacggtcatttttgataaaggtggggaaaggtagatctactgttgtattcactgaaaagcctttggaatcaccaccaaatctcactgaggytgtaacaatttatggtaaattggaaggcaatcaatccttcagaattagattctacggggtacagacaatcggttcaaagtacatgctttttctttctatc

SEQ ID NO: 37275 - DNA, 201 bp, Homo sapiens
tgtagatttgataggcatttccttaatgattaatggcattaagcatctttttatgtgtttattggccatttcaatatcttctttgaagaaatagatattcwagtcctttgtccattttgaatcaagttgtttggttgtgtgtgtgtgtgtcattgaattttagaagttctctctatattctgaatatctcttatcagataa

SEQ ID NO: 37276 - DNA, 201 bp, Homo sapiens
tgtgtcattgaattttagaagttctctctatattctgaatatctcttatcagataaactctttgcaaatattttctaccattccgtgagttgcacttttaytctgtttgcattgtcttttgatatacaaacatttaaaatattcatgaagtccaatttgtgcattgtattcttttgttgtctgtgatttaggtgtcatatc

SEQ ID NO: 37277 - DNA, 201 bp, Homo sapiens
cttacatttaggccattgatctattttgagttaattttgcctatgatgttagaaaatggcccaaaaacatcaatggggccagatgtggtggctcatgcttrtaactccagtgctttgagaggccaaggtgggcagatttcttgagctcaggagtttgagaccagcttgggcaacatggcaaaaccctgttcctataaaaaa

SEQ ID NO: 37278 - DNA, 201 bp, Homo sapiens
agatccaaacattcttagataaaattatcatttagtcatgacttgaagccattccaaagaacatgtgtgagtagaatattgagagagtagcacctaaagarggaagatttcttaggcactgattgtacaaattacatatgaataattccatgaggaaaaaaaggtttaagaacagctaataacttccaaagtttcttttta

SEQ ID NO: 37279 - DNA, 201 bp, Homo sapiens
caggagtttgagaccagcttgggcaacatggcaaaaccctgttcctataaaaaatacaaaaaaattagccaggcatggtggcacatgactgtggtcccagstaatcaggaggctgaggtgggaggattgctcgagcccaggaagtcaaggatgcagtgagctatgatcatgccactgcactcgagcctgggtgacagagtg

SEQ ID NO: 37280 - DNA, 201 bp, Homo sapiens; identical to SEQ ID NO: 9586

SEQ ID NO: 37281 - DNA, 201 bp, Homo sapiens
cacttcagtggatcctaaaccaggccattgtccctcctgctgactacacacaggctctgcctaccagctgacatgctacttcaccaactgggcccagtacyggccaggcctggggcgcttcatgcctgacaacatcgacccctgcctctgtacccacctgatctacgcctttgctgggaggcagaacaacgagatcaccac

SEQ ID NO: 37282 - DNA, 201 bp, Homo sapiens
ttctactttctgtctccatgattttgactattctaagtatctcacataaacagaaaaatcatatattatctgtctttttggactggcttttttcattgagwataatgtctcaagattcatccatgttgtagcaagtcagaatttccttttaaaggctgaataatactttattgtatgtatatataacagttttgttatcca

SEQ ID NO: 37283 - DNA, 201 bp, Homo sapiens
ttctttttatttatttttccataaagacttgctttgatgccagacacaaaatgtccacaatagaaaatctgaccacagtatctaaacagttgcttatcagyccttggaactgccaaaaaagctattaaactggtgttttccatggtgatggtctccaccaccctgttaggagccatgacattgttctgtccttgttgggca

SEQ ID NO: 37284 - DNA, 201 bp, Homo sapiens
taatagctgattaattttctcatcagcaaaattggtgtgatagtaataatcctctttatagggtaaaagaaacaataaagtcaagccctctgatgatagtyattttttttagtcactcagctttactttttattcttttagaatttcattttgtgaccagtccttgtgaaaatgtaaatccaagtgccctgccctttccct

SEQ ID NO: 37285 - DNA, 201 bp, Homo sapiens
ccttggactagcttttctggggaagaaaatcagtaggaactgagatagagttatgcaagttgtctttgttctgctgttttcagaattatttctctatttaytcccctattatcctactgagttgatgatgtaccataaacatgttagaaattaaattattcaaagaggttgattcagtaagttgtttagagacaagtcata

SEQ ID NO: 37286 - DNA, 201 bp, Homo sapiens
ttcaccaactgggcccagtaccggccaggcctggggcgcttcatgcctgacaacatcgacccctgcctctgtacccacctgatctacgcctttgctgggakgcagaacaacgagatcaccaccatcgaatggaatgatgtgactctctaccaagctttcaatggcctgaaaaataagtaggatgagggagatatttaattt

SEQ ID NO: 37287 - DNA, 201 bp, Homo sapiens
agaaccttttccaaatgaaacctcaagctcaatttataaaacaatcagagtagaagaattgctttgtagaagtcagggaaaggtatctggagtctcacccmatagttcctagctcttctctcctcatataaggcctcctgaaagtcattccaaaaaaccactaaaggccagaagatactgaattctctgatttagcagatg

SEQ ID NO: 37288 - DNA, 201 bp, Homo sapiens
ctccatagtctggtgagtgtaaatatatatatatcttttcccttctccctttcccattgcaatttgattgttatatcaatttgcttattatatcaagttgyttattatatcgtttgcttattacatctgcattgccatttatgtgagataaaggttgtttacccttaaaggtattgtgtgtgtgtcttttctcctcccctc

SEQ ID NO: 37289 - DNA, 201 bp, Homo sapiens
tccctcctgctgactacacacaggctctgcctaccagctgacatgctacttcaccaactgggcccagtaccggccaggcctggggcgcttcatgcctgacracatcgacccctgcctctgtacccacctgatctacgcctttgctgggaggcagaacaacgagatcaccaccatcgaatggaatgatgtgactctctacca

SEQ ID NO: 37290 - DNA, 201 bp, Homo sapiens
tgaaaaaaatagacagtctcaaaaaacaagctgacctttttatgttccttgaacctagttgtgaagggcccttgttactgggcctcatgccaaacaactcrttacaaaaacagctagagtcccagacggtgccaaagcttcatgaaacctctcctcgtctgtgcacgaacaggtggccaactctggagcccaggctgttgc

SEQ ID NO: 37291 - DNA, 201 bp, Homo sapiens
cctaccagctgacatgctacttcaccaactgggcccagtaccggccaggcctggggcgcttcatgcctgacaacatcgacccctgcctctgtacccacctsatctacgcctttgctgggaggcagaacaacgagatcaccaccatcgaatggaatgatgtgactctctaccaagctttcaatggcctgaaaaataagtagg

SEQ ID NO: 37292 - DNA, 201 bp, Homo sapiens
aaataaaaacctgtaactagaaattgagcaaaaccccaactggagacatgaaagaagaaaaatttgaaacatgtttttctttaatgggagtaacatttaawagatttgaatctcttgacttttgaaagatctgtaccttcctgaaaaatggagccactcagggatgggatgcccctcaggaagtgccttatgcctatcagg

SEQ ID NO: 37293 - DNA, 201 bp, Homo sapiens
taaacacagctgcttaaagtgtttaaatagcattcatttacataatccaaatgaatagcatttaacaatgcataatatcccttcacacaacagactacctyttaaatgtaatttatattagcacacaggtaataaaataaatatacctctcatattactgtgggttcccaaaatcatttgacaagcaacttgatcctcttt

SEQ ID NO: 37294 - DNA, 201 bp, Homo sapiens
acagatacaggtggattaatctctagtattgaatgggaacctatcatctagctgttaccaccttccttattggccaatacaccattttatttgatgggatktcagtcctataaagtagttcatctactttatgaaacaaatttctatactgctggatgtagggtatcactgcaactagagcttcaaagtatagagatacaa

SEQ ID NO: 37295 - DNA, 201 bp, Homo sapiens
gaacatactctggcgcaccctaatagtgcaattataagaactaaacccagtactccaaatgagattacagtcgcacagatacaggtggattaatctctagkattgaatgggaacctatcatctagctgttaccaccttccttattggccaatacaccattttatttgatgggatgtcagtcctataaagtagttcatctac

SEQ ID NO: 37296 - DNA, 201 bp, Homo sapiens
gcaaccagggcaagtttcccctaatctccaccctgaagaaggccctcggcctgcagagtgcaagtaagtgactgagggggaatgcccaggtgtataaataycccttctccaactcaaaaagcaaccctgatgtcttcccacctcccccttgcccagggatcctctttccacttcacctcaccgctcttgcccagatgagag

SEQ ID NO: 37297 - DNA, 201 bp, Homo sapiens
ctggagttcaggacaaaaaagcttgatatacttggtttttagacttactgtctcccaagacagattgtttgctattccattctatgtaacagatcgtcacycagcctctgaatagtttcaatgttaagtaataggtgaaaagtcaatttacttacttgttgaattgccctaatgatcataaaggaatatctctttcttggc

SEQ ID NO: 37298 - DNA, 201 bp, Homo sapiens
gtaaatacaggaagaagtgtagatttgaaagaagaagaattgaccttgaacttgatgagtatgaggtatctgtagagcatcctaacagagtgcccagtagscatcagataaatatcaatctggagttcaggacaaaaaagcttgatatacttggtttttagacttactgtctcccaagacagattgtttgctattccattc

SEQ ID NO: 37299 - DNA, 201 bp, Homo sapiens
tattaactaagatggtaaatacaggaagaagtgtagatttgaaagaagaagaattgaccttgaacttgatgagtatgaggtatctgtagagcatcctaacrgagtgcccagtaggcatcagataaatatcaatctggagttcaggacaaaaaagcttgatatacttggtttttagacttactgtctcccaagacagattgt

SEQ ID NO: 37300 - DNA, 201 bp, Homo sapiens; identical to SEQ ID NO: 9570

SEQ ID NO: 37301 - DNA, 201 bp, Homo sapiens
aataatatgaacaatgtcaatgcattgtgataaatgccatgttagaggtctgcagagtacaaaagtaacaaggaaagagggtaactaattctgctctgggkcaggatcagaaagtgtttcctagagaaagtgatgcttgggctcagtcttgaaagaaactggtgttaaccaattaagtgaggatgggaatggcacaaatga

SEQ ID NO: 37302 - DNA, 201 bp, Homo sapiens
ctggaggcgccatggtctgggccattgatctggatgacttcactggcactttctgcaaccagggcaagtttcccctaatctccaccctgaagaaggccctyggcctgcagagtgcaagtaagtgactgagggggaatgcccaggtgtataaataccccttctccaactcaaaaagcaaccctgatgtcttcccacctcccc

SEQ ID NO: 37303 - DNA, 201 bp, Homo sapiens
aaactctcctggccattggaggctggaacttcgggactgccccgtaagtcttctatggagagcatgttgttcgtttgctatggaaaacaagttagccccaygtgatcactgtccctttagacttcacaatctaagacagggtattgaggatgtacataaacaaatatatgaattaaatatattgctacaccagaacctcat

SEQ ID NO: 37304 - DNA, 201 bp, Homo sapiens
atggagggagtcctgacttttgaagtttatctgtttctatcctttgttttacaggaacagccagctgaaaactctcctggccattggaggctggaacttcrggactgccccgtaagtcttctatggagagcatgttgttcgtttgctatggaaaacaagttagccccatgtgatcactgtccctttagacttcacaatcta

SEQ ID NO: 37305 - DNA, 201 bp, Homo sapiens
aacactgcatgttctcactcataagatggagttggaacaatgagaacacatggacaccgggaagggaacaagaaacactggagccagctgaggggttgggrgcaagggggggagagcattaggacaaatacctaatgcatgtggggattaaaacctagatgacgggttgataggtgcagcaaaccatcatggcacacgtat

SEQ ID NO: 37306 - DNA, 201 bp, Homo sapiens
atctaccaagcaaatggaaagcaaaaaaaaaaaaaaaaaaaaacaagcaggggttgtaatcctagtctctgatgaaacagactttaaaccagcaaaaatcraaagagacaaagaaggccattacataatggtaaagggatcaattcaacaggaagagctaactatcctaaatatatatgcacccaatacagaagcactcag

SEQ ID NO: 37307 - DNA, 201 bp, Homo sapiens
cagaaaactaaacactgcatgttctcactcataagatggagttggaacaatgagaacacatggacaccgggaagggaacaagaaacactggagccagctgrggggttgggggcaagggggggagagcattaggacaaatacctaatgcatgtggggattaaaacctagatgacgggttgataggtgcagcaaaccatcatg

SEQ ID NO: 37308 - DNA, 201 bp, Homo sapiens
gagggctaatattcaacattcttaaataaaagaattttcaacccagaatttcatatccagtcaaactaagcttcataagtgaaggagaaataaaatccttyacagacaagcaaatgctgagagattttgtcaccaccaggcctgccttacaagagctcctgaaggaagcactaaacatagaaaggaacaactggtaccagc

SEQ ID NO: 37309 - DNA, 201 bp, Homo sapiens
tggttattgcagcactatttacaatagcaaagacatggaaccaactcaaatgcccatcaatgatagactggataaagaaaatgtggtacatatacatcacrgaatactatgcagccataaacaggaatgagatcatgtctttgcagggacatggatgaagctggaagctatcatcctcagcaaactaacacagaaacagaa

SEQ ID NO: 37310 - DNA, 201 bp, Homo sapiens
attgtgtgtgtgtcttttctcctcccctcacacatctctcacacagatcattttatacccaaagggatataaatcattctactataaagacacatgcacaygtatggttattgcagcactatttacaatagcaaagacatggaaccaactcaaatgcccatcaatgatagactggataaagaaaatgtggtacatatacat

SEQ ID NO: 37311 - DNA, 201 bp, Homo sapiens
aatttttataaaggaagttttcagtaggggaggaaaattgttctacaaaaggcaaaacaaaaatatctgaccagatccaatactaaagcaatgtattttaratggagggagtcctgacttttgaagtttatctgtttctatcctttgttttacaggaacagccagctgaaaactctcctggccattggaggctggaacttc

SEQ ID NO: 37312 - DNA, 201 bp, Homo sapiens
ttttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaa

SEQ ID NO: 37313 - DNA, 201 bp, Homo sapiens
tttataacagaactgaagtcctatatttaaatcaatgcaatattcatcccctatacttacactacagcttatccaatattcatttctttaattatcttgttgtttgttttgtttttgtttgccaagaaggacttggagtatcttccattttcttgcatgtatgaaagtgcctgactgttgcctttatacttgattggtaac

SEQ ID NO: 37314 - DNA, 201 bp, Homo sapiens
ctcccgggttccagcaattctcctgccttagcctcccaagtagctgagattacaggcacctgccaccacacccagctaatttttgtatttttagtagagayggggtttcaccatgttgacccagctggtctcaaactcctgacctcaggtgatccacccgccttggcctcccaaagtgctgggattacaggtgtgagccac

SEQ ID NO: 37315 - DNA, 201 bp, Homo sapiens
tcagtgcaaatctgcccttgaacctttctagtaagttttccatttcagttatattactttttagctccagaatttattttctgtttttgtccaaatttttwaaaatcttattattgaaatttacattttgttcatacatcattttcttcattctctacatcctttttttagagcatattcaagacagttgttctaaagtct

SEQ ID NO: 37316 - DNA, 201 bp, Homo sapiens
agtttctgatgagagatctgctgataattttattgaagatcccttgtatgtggccagttgcttctcttttgatgatttcaagactctctttgcctttgtcytttaaaatttgattatattgtgtcttgcgtggatttctttgagttcatcttacttggagttcgctgagttcttggatgtctatatacatgtctttcatca

SEQ ID NO: 37317 - DNA, 201 bp, Homo sapiens
ttcatcctataggactcccttgagtatttcctgcaggacaggtctattggtaacaaactacatcagcttttgtttatctagaaatgtctcatgttatcccytgttttgaaggatagttttgccagaaaaaagatttttggttgacactttttttcttttagaactttgaatctatctgccaactgccttctggcctctaaa

SEQ ID NO: 37318 - DNA, 201 bp, Homo sapiens
aaaggcaaaacaaaaatatctgaccagatccaatactaaagcaatgtattttaaatggagggagtcctgacttttgaagtttatctgtttctatcctttgytttacaggaacagccagctgaaaactctcctggccattggaggctggaacttcgggactgccccgtaagtcttctatggagagcatgttgttcgtttgct

SEQ ID NO: 37319 - DNA, 201 bp, Homo sapiens
tggatcatgtgttttaattgattctgccaatctcagtattttgattgaagcattaatatatttatatttagagtaattactgataaagagggaattatttmtgtcattttaattatttgtttcctatatgccttttagcttttttgtcactcatttctggcattattgtctttctttgtggttagttgattgttcgtagtg

SEQ ID NO: 37320 - DNA, 201 bp, Homo sapiens
atgacaggaacaacacaaagaatttttataaaggaagttttcagtaggggaggaaaattgttctacaaaaggcaaaacaaaaatatctgaccagatccaayactaaagcaatgtattttaaatggagggagtcctgacttttgaagtttatctgtttctatcctttgttttacaggaacagccagctgaaaactctcctgg

SEQ ID NO: 37321 - DNA, 201 bp, Homo sapiens
gactgtccaaccaatacggccaaaaagtcactccaaggcagaagctgttttcttcactactccaccatgctctgctcttaaggggaagagccacaagcctrttggctgcctgggcgaagcaggtacgttttcacctgaaggacttctacatctaggtctacggtgtcagcagcgctttgcaaaccttgtcaaactgcgttt

SEQ ID NO: 37322 - DNA, 201 bp, Homo sapiens
cgggaaggcttgaatatccagtcaaaccaatgtaaactcaattcctccactttttagacttgaatgttgtggtgctagaattttaaggagaaatttcagcmgctctgagcacctgatgggacagccttgggtgaaagcatcaggaggacagagtttataatttctaacacctatggagttctatactattcagcccaagcc

SEQ ID NO: 37323 - DNA, 201 bp, Homo sapiens
aaaaaagaaagaaagaaaaaaaaaagaaagaaaggagacatttggagtgtatttcgtgaagtcacataaagcaaaggaagagtaagcatctcaggctttcktggggatcagccatatttggacaacttgtaaaacagctgactgctctccagccccaggagttttgattctacgagtgtaaggtatatcaccagaatttgc

SEQ ID NO: 37324 - DNA, 201 bp, Homo sapiens; identical to SEQ ID NO: 9600

SEQ ID NO: 37325 - DNA, 201 bp, Homo sapiens
ccatgtgttctcattgttcagctctcacttataagtgagaacatgcagggtttggttttctgctcctgtgttagtttgctgaggctcccagctccacccaygtccctgcaaaggacatgatctctttttatggctacatagtattctatggtgcatatgtactacattttctttatccagtttatcattgatgggcattgg

SEQ ID NO: 37326 - DNA, 201 bp, Homo sapiens; identical to SEQ ID NO: 9602

SEQ ID NO: 37327 - DNA, 201 bp, Homo sapiens
tttttccctctatgtgtatctctgtctatgtacaaatttttccttgttataaggagaccagtcattgggtgagggcccaccctaaacacctcatcttaagyaattacatttgcaaagactctatttctaaataaggtcacattccagggtactgggggcccaacatatcaattttggggggaacacagtccaatctatgac

SEQ ID NO: 37328 - DNA, 201 bp, Homo sapiens; identical to SEQ ID NO: 9604

SEQ ID NO: 37329 - DNA, 201 bp, Homo sapiens
agtgctgggattacagtgtttctctagttctgtatacaatacacttatttttgtgcaattgttttacatatttatctcccaaatcaaagttgggcacttttgaaggcagagaccaaaataaatcatagtactgagaataatgtgtttgtatgtacgcgagtggatagggggcacaaaaagtggtgtggcatgcctgttttt

SEQ ID NO: 37330 - DNA, 201 bp, Homo sapiens
tttcttgcagtttccccgagaggatgtgctcctgtttgatgtccgtcccttacagtatgttattgtagcacatgcactctggcagaagggctagttgaaaygcgatgctgttgtttttaagctcctagaagtaacagtgctaattgggattgtgatcaactgtgcttgcccaggaccatcagggggcaaggaccacatggg

SEQ ID NO: 37331 - DNA, 201 bp, Homo sapiens
aacttctttgagcaaataaaaaaggattatggtttgattggataagtgtgagcttaaggaaaggagcttgtcttctttttcttgttattttatagtttggraagacatcaaagaggaagagaaaaacaggaaaaggagagaaagagtgtggttgtacattcagattcagaataggaaagacatggtcataggaaggaacat

SEQ ID NO: 37332 - DNA, 201 bp, Homo sapiens; identical to SEQ ID NO: 9605

SEQ ID NO: 37333 - DNA, 201 bp, Homo sapiens
ctggcacaggtcctctggaaattgagccaggtgcctccccttcataggccagctgctcctgcccccagcagatgggcagctcccaggtttattgcatcctyctcagtggatgtgccattccagtgtctcagaatcgtgctggccacccaccaaacacaccatcatgctactagcatggaatggggacagacacaaccatac

SEQ ID NO: 37334 - DNA, 201 bp, Homo sapiens
tttttactggctatttctgatttaagatcctatctaaatccttgacattgatgtgtcctgatttaaatggacatcttctgccgtttgagtgagaggcacartagagtttggtctttgggcaccagtgttaaaggctgaagggattcactagctccatcacctgggccgagttacttactagtgctccccaaacctgtatat

SEQ ID NO: 37335 - DNA, 201 bp, Homo sapiens
agtattcctgtccttctagattcaactttttactggctatttctgatttaagatcctatctaaatccttgacattgatgtgtcctgatttaaatggacatyttctgccgtttgagtgagaggcacaatagagtttggtctttgggcaccagtgttaaaggctgaagggattcactagctccatcacctgggccgagttact

SEQ ID NO: 37336 - DNA, 201 bp, Homo sapiens
ccaactcaaaaatgctgattgcgaccttagaagtagcctgctttgatgaggaattattatgatactgtttaattctagaaggcatatcccgcagccatggsagtgtttcacaattgtcattaatcaaaatgtggacagtatgtgctttgtactttttataaaagccatattgcacacactatataggaaaacatccttgtt

SEQ ID NO: 37337 - DNA, 201 bp, Homo sapiens
gtcatgcattcgcagcagcagcataaatcaagccctaagatgatttaaagaatagaattgaagcctctctttcacaatcaccataatctaaaggaaatggrggcaatggcgttgctctctgatatttgggaggcagagcaagaattctatttttggccaaggaaatacctcttctttacttgccttgtttctgtaacacat

SEQ ID NO: 37338 - DNA, 201 bp, Homo sapiens
cttccctttctttccctggatgggacagcttttagaaatctcagcaactcctctgttcagtggcagaaaagagccattatcttccaattgcagctcctgtrttagggatgaccgagtgctgtcctgaaccattttttcctaaggaaaaataggcatttgataaatggctctttcacattactcaggctttttcaataatgc

SEQ ID NO: 37339 - DNA, 201 bp, Homo sapiens
taaacatatgtgtgaatgtgtctttatagtagaatgatttatattcctttgggtatatacccagtaatgggattgctgggtcaaatggtatttctggttckagatccttgaggaattgccacactgtcttccacaatggttgaactaatttacactcccaccaacagtgtaaaaggattcctatttctccacatcctctcc

SEQ ID NO: 37340 - DNA, 201 bp, Homo sapiens
gtgctttgggaggctgagatgggaggatcacttgagttcgggaatttgagaccagcctgggcatcagagtgagaccccatctctaccaaaaaaaaaaaaaagaaaaagaaaaaattagccaggcttggtggtgcatacctcttgtccttgctacttgggagtctgaggcagaaggattgcttgagcccaggatgttgaggc

SEQ ID NO: 37341 - DNA, 201 bp, Homo sapiens
tttcatgtaaatcactgtctgcataggtgctgaatctgtttctttctttaaaaagtactgatttatttgcatttccctgatcactagtgatgttgagcatktttttcatacgtttgttggccagttgtatatcttcttttgagaattgtttatttatgtccttagcctactttttgatgggattgcttgttttttcttctt

SEQ ID NO: 37342 - DNA, 201 bp, Homo sapiens
aattagcttcttctgctaccctctcaagtatgattataaacctttttctctcctttgagccacattgcacatggagtgcacagtccctaaatcccttcctstcagtaagccatgcggttccccataaatataaacatatctattacatggagtacacagtctagtctaaatcccttcctctcagtaagccatgcggttccc

SEQ ID NO: 37343 - DNA, 201 bp, Homo sapiens
cacagagggtcgaccacatgaggacacagggagaagacagcatctacaagccaaggagagaggcttctggaggaaccagccctgcccacaccttgattttsaacttccagcctccaggggtgtgggaaaataaatagtctgttgtttaggctgcccagtctatgggactttattgtggcatttctagaaaactgacccatc

SEQ ID NO: 37344 - DNA, 201 bp, Homo sapiens
tttttgtgtgtatggaacaagacagcgttgcccagagagctgcctcggaagtcattatcagggatgggtttcatgttatatgcaggaaggtagccccttcycctctatgctggctcccctgtgttcagtgggtgtcaagctgatgtctgctcttgttcatgttttccatgatgttctagtgcatttctgcctacatctgcc

SEQ ID NO: 37345 - DNA, 201 bp, Homo sapiens
ggaacagaacctgtacctgtctggatatgtctgtaaaatagttaaaggtcttgaaagaagctgatgagagctaaacgtgaaagtgatataatattccccayatgtgtgttggctggaaaaggagaagcacatagaatttgtaccatttagcaatgttttgctttaacatatcagaacaatagcttccccaattagaatata

SEQ ID NO: 37346 - DNA, 201 bp, Homo sapiens
caagtattaaattcattcatacattcagtcccagaatgaattcatccatccaacagatagatattcattgaacaattcgtaagtatctttggcatggaggwtaaaaaacagatgagtccaacctttaagcagtacatagtcttaggagggaaaacaagcaataaagaggaaattttaacagcttgaaaatgctataagtga

SEQ ID NO: 37347 - DNA, 201 bp, Homo sapiens
aagtattaaattcattcatacattcagtcccagaatgaattcatccatccaacagatagatattcattgaacaattcgtaagtatctttggcatggaggtwaaaaaacagatgagtccaacctttaagcagtacatagtcttaggagggaaaacaagcaataaagaggaaattttaacagcttgaaaatgctataagtgaa

SEQ ID NO: 37348 - DNA, 201 bp, Homo sapiens
aacacttacaacaattcacatctcccagaagttaagtatctgtcccatcttcctttagctcccacttgggaatactttcctctgaaatctatgtaattcawccggttttttttttctttatcgttggaaacacaccataagtcctatgtcttacattcaaaataatcaatgcttttctcttcttaccaagtgatgtttctt

SEQ ID NO: 37349 - DNA, 201 bp, Homo sapiens
ttttaataaacactgatgaacatcagctatgttctaggtccttgctgcactgtggggaggaggagataaattagaccaggggctggaaaattatttctctraagggccagatgacaagtgtcttgggcttcctgggacagagttgtctctgttgcaaccactcagtgtgacgatgtagcatgattgtggtgatgtgtctca

SEQ ID NO: 37350 - DNA, 201 bp, Homo sapiens
tcaggaacatttttgtctttttcttcagtcagactgattcaagtaagctctactaggtacactggaataaatcgatttaaatccttagaaaataggctggsagatgaagcacacttgaaaaatgcataacaaatatactggtattgtgctttttctgccgatatgacccaagaacattagtgtcgttgtacagatcttaaa

SEQ ID NO: 37351 - DNA, 201 bp, Homo sapiens
tatggactctggaccatagggtgaaaagacagacacataccatgcccacatgaaactcccttctagcgtgagacagacaaaaaacgcagtgagccaattcwagtactgtggttagtaaggagaaccagggagaaaaattgagccagataaggggaactagggtttgaggagggtgtttattttccgacaagtaaggtaaaa

SEQ ID NO: 37352 - DNA, 201 bp, Homo sapiens
aattcaagtactgtggttagtaaggagaaccagggagaaaaattgagccagataaggggaactagggtttgaggagggtgtttattttccgacaagtaagstaaaaaggtcatgtgtatttgtacacttgagcagaaatctggaggaagtaaggcagagattgtaggtatgtggggaagtactttcaaggtggagcctaca

SEQ ID NO: 37353 - DNA, 201 bp, Homo sapiens
tgagtgtgagtataataatactgaattatactcagtattctaagtaagcatgatggctgggcacagtggctcatgcctataataccagcattttgggaggytgaggcgggtggatcacttgagaccaggagtttgagaccagcctgtccaacgtggtgaaactctgtctctactaaaaatacaaaaattagccgagtgtgg

SEQ ID NO: 37354 - DNA, 201 bp, Homo sapiens
tcgcctatctcagtaaatggcaccaacattcacccttttgctcaagccaaacatgcagaagtcattcttcatttttctctgttttttctctccagaaattyaattcttcagaaagtccttttgtctctaattttaaattccatatggaatctgtccagttctttcgcttgttcacgctattgtcttttctttcctataaat

SEQ ID NO: 37355 - DNA, 201 bp, Homo sapiens
atcctcagcagtaaaaatgggactcttctcgctcttacttggggttaataaaccctgacattttgttttccctcaatgcttccatccatacctgcctctcwccatcagagatgtagacaatagatttgactttataatttatgaaacatcttggaggtcaggaccggcccttttgtgaatactctgggcactaaaggaatt

SEQ ID NO: 37356 - DNA, 201 bp, Homo sapiens
tcgggggagtatcaaattattctagactcagttgtaggagaattgatgagttttgaaaatttatgggaccaagactggagattattcagaatgatttaaaracctaagcctgaaaagaagggctaggcaaataggcacataaggagttaggggagtatcatgaaaattgcaaaagcactaaatttaagtaaaaaaattttt

SEQ ID NO: 37357 - DNA, 201 bp, Homo sapiens
aaaagaagggctaggcaaataggcacataaggagttaggggagtatcatgaaaattgcaaaagcactaaatttaagtaaaaaaattttttttgaatgcatytaaagcacttaatcagtatctgaagataacacacattacatatatattagctacttttattataaaagaggaagacaaggagacaaggtcaacacttttt

SEQ ID NO: 37358 - DNA, 201 bp, Homo sapiens
cagagagcccagattttgggaatgaccaatttggagtcagggttacaaatataaaaacacctttgggttccatgttgcagttgcttatctttttcagtaarttggtgtttaacctttccttgatattgctgatatttatcaaatgagtaaaaatagttattttacaaataaacattcgtatttttacaaataaagtaaata

SEQ ID NO: 37359 - DNA, 201 bp, Homo sapiens
  misc_feature (1)...(201): n = A,T,C or G, or insertion/deletion polymorphism (see Tables 1-2)
actttgtgacacagttatattattgtttttaaaatataactgcacttgaccaaagttacatcaagtatataccataagtataccttatgaggtgttcttangatgcgtttcagtgcgaagtttaatctatagacattattggtagaaatgaaataagtaaaatcaacattcattttcttgaaataggtattgttctccatg

SEQ ID NO: 37360 - DNA, 201 bp, Homo sapiens
agcactggtcttgtggtgtgcctcccatcctctcacttgaagaggtagtaaatcaaactctgctcttgaagtagtgaatcaaactgtgatcctcaatttcmccatctctaaaataagaacaataatgttaacatttaatagacaaaatgcagctgtatgtttgtaaaattagggataaacagtgctcatgtcgagtttcct

SEQ ID NO: 37361 - DNA, 201 bp, Homo sapiens
ggtgtgcctcccatcctctcacttgaagaggtagtaaatcaaactctgctcttgaagtagtgaatcaaactgtgatcctcaatttccccatctctaaaatragaacaataatgttaacatttaatagacaaaatgcagctgtatgtttgtaaaattagggataaacagtgctcatgtcgagtttcctaaacctaatggttt

SEQ ID NO: 37362 - DNA, 201 bp, Homo sapiens
aaacccccatcaaacacttggcatgatgttgggggacaagatgttaaatcacctgcaaaatggtgccatttggtgccatttcacactcctcggacacactygggtgattaataaacccgagactgtcaaggtctgctttcccacactcattgagttgcttgccgctattttatcttttttccccccactttattgtccaaa

SEQ ID NO: 37363 - DNA, 201 bp, Homo sapiens
  misc_feature (1)...(201): n = A,T,C or G, or insertion/deletion polymorphism (see Tables 1-2)
agggggtactgcttgtattaagtcagaaatggagaagttccaatggattacttggtattgctgtccagaaacctgactctcataccattttggggggaagngaggtttgggacagcaattaatgaagcatatccatattatcaaaaggcatttttatttatgaaataggaatagaaataactgaaaatgtctctttgcagt

SEQ ID NO: 37364 - DNA, 201 bp, Homo sapiens
  misc_feature (1)...(201): n = A,T,C or G, or insertion/deletion polymorphism (see Tables 1-2)
ctctcctcttatgttctcaacttctctagaagattaaagaagaaggaaaggagggaggtggtgcctgagataagccctgtctctttataggtgactcttgntgcatttgagagtgacttcatgccctatgcttcatcttggacactcctgctcctctgacctcctctgggtctgcccatgatggcacaggtgtagctgagt

SEQ ID NO: 37365 - DNA, 201 bp, Homo sapiens
ctggcaaaagaatgacatttggctgggtgcggtggctcacgcctgtaatcccagcactttgggaggccaaggcaggcagatcacttgaggtcaggagatcragaccatcctggccaacatgatgaaaccccatctctactaaaaatacaaaaattagctggacatggtggcgcatgcctgtaatcccagctacttgggagg

SEQ ID NO: 37366 - DNA, 201 bp, Homo sapiens
aaaactctcaaaatccagaccagtgagcacagatagaaatcaggagctgtgtgtgctgcaggggagttcttcagaactgcactgctgcccatgtcatgctraatctagaaggctgacgtcccaccaggctgttctggctctcttgttcaagccagggtacatttttttgagggcatttggaaaaactctccagttctgtct

SEQ ID NO: 37367 - DNA, 201 bp, Homo sapiens
tggcgcgatctcggttcactgcaagctccgcctaccaggttcacgccattctcctgcctcagcctcctgagtagctggggctacaggtgcctgccaccacrtccggctaatgttttgtatttttagtagagacggggtttcaccgtgttagccaggatggtctcgatctcccggcctcccaaagtgctgggattacaggcg

SEQ ID NO: 37368 - DNA, 201 bp, Homo sapiens
acttgatctgtgaacataattagacaggaggatgtacaaactagacaggtcaaacagataactcattcccacaaatcagctatggagtaatgacttgatgraagtggaaagcagaatggtcattatattcactcattcttttatccattcacaccattgcactgggagcttactctgttatccacatggagcaaaacctaa

SEQ ID NO: 37369 - DNA, 201 bp, Homo sapiens
aatatctccagatattacctaatgtcccctgggaaccagtcccttaacttatggaatttgtactttctcttacttgttcataacgaggaaactatgttctrtgtacattagtgtattggtctgttttcatactgctataaagaactgccagagactgggtaatttataaaggaaagaggtttaattgactcacttttcagc

SEQ ID NO: 37370 - DNA, 201 bp, Homo sapiens; identical to SEQ ID NO: 9606

SEQ ID NO: 37371 - DNA, 201 bp, Homo sapiens
gtgcctcccatcctctcacttgaagaggtagtaaatcaaactctgctcttgaagtagtgaatcaaactgtgatcctcaatttccccatctctaaaataagracaataatgttaacatttaatagacaaaatgcagctgtatgtttgtaaaattagggataaacagtgctcatgtcgagtttcctaaacctaatggtttcac

SEQ ID NO: 37372 - DNA, 201 bp, Homo sapiens
  misc_feature (1)...(201): n = A,T,C or G, or insertion/deletion polymorphism (see Tables 1-2)
tgtctacctttattataatgcaaactaaactgtttaatgatttttacctgtttgttagtaaacatgtaaactataagcatagtgggtcatcattttcacantttcacctgttcaccattaaattcctagtacctagaatgccggtttggtctataaatcagtatataaatggtttagtgggctgaacattgcattggcatt

SEQ ID NO: 37373 - DNA, 201 bp, Homo sapiens
acagggtctttctctattgcctaggctggtcttgagctcctggcctcaaacaatcctcctgcctcagcttcccaaagcactaagattacagacgtgggtcmccatgtctgacctggttttacagttttatggtgattattttgggggagaaagagatgggagtaccttatcttggtaatggaagtttgccattttggtatt

SEQ ID NO: 37374 - DNA, 201 bp, Homo sapiens
ggaaagacatggtcataggaaggaacatttgccagggtctcgtgctttttctacaaataaaggtaattctatcatttatttgatacatacaaatggatgtkactgacatattttgtcactttttaggatctcatcttaagcatcgtcatccacatcattacaagccttctccagaaagatactaaactgttcaaaaagatt

SEQ ID NO: 37375 - DNA, 201 bp, Homo sapiens
  misc_feature (1)...(201): n = A,T,C or G, or insertion/deletion polymorphism (see Tables 1-2)
tgtataacaatctgaatgagttggaaagaaactaataaaacatggaaaataattactcttccttctgtgtgttcttgtccagttaaactgttacatgtagnggcattaaattacattaagctgcctatttaaatttgtgggatttgtacactttattttaaatctccaaaatgatttcatgtgtgagtgagattcttttta

SEQ ID NO: 37376 - DNA, 201 bp, Homo sapiens
agtcaatgtgaagttaaattcttctctagacaaattcggatcatgggggtcaaggagatttggagaaagacatactaagtaccgtcttactagctgcaccygagggtcctacccctttatccatcatttcctcagcatactcttagggttctcctcccctgtggttggctttcatgaacttagattgtggcttacctggta

SEQ ID NO: 37377 - DNA, 201 bp, Homo sapiens
  misc_feature (1)...(201): n = A,T,C or G, or insertion/deletion polymorphism (see Tables 1-2)
catgctgtgggagtcttcctaaataaatgaagactccagtaaatggttaattctgtgtatttttatagtagctttgatgaagagtgaatactgatggaganatatgataggacaaaaagggtgtgatctagtgtagataaactggggaatttagcaaggcctgtttgttcaggttcctctctgtgacccttcatcttcaga

SEQ ID NO: 37378 - DNA, 201 bp, Homo sapiens
tgtgcaattgttttacatatttatctcccaaatcaaagttgggcacttttgaaggcagagaccaaaataaatcatagtactgagaataatgtgtttgtatrtacgcgagtggatagggggcacaaaaagtggtgtggcatgcctgtttttcctagtactacacagtggtcataattactgcttgaaaggttacttaatact

SEQ ID NO: 37379 - DNA, 201 bp, Homo sapiens
gtgcaattctttcattgtgcgcttcaggaacctgaggcctgaagcaatgatatatccagccaaagacagcctccagctcagaggaaatgcttattcttacmttctatttttcattgtatgtaatttccctaaaagcccacttaggaatgatttggagcatttgacaggaaattcaaattcatgggcaagatgccctggtgt

SEQ ID NO: 37380 - DNA, 201 bp, Homo sapiens
ttgatatgtctctaagtttttaatttttcaagtggtcattttcctctaggtcatcaacacctagaaaaaaatgtgtttcaattgactcataaaccttaagwtaatgtaattgctgtctaacagtttctagaattattgcttttgaatggttatgttgcatgaaaaattattattcaaaaactaacacgaaagaggaggcat

SEQ ID NO: 37381 - DNA, 201 bp, Homo sapiens
ttagcacctccccttggatggcttgcagatatttcaaataaaacgttcaaacacaagctctggattttcgcccatacctgttcctctcctgggctcgcctrtctcagtaaatggcaccaacattcacccttttgctcaagccaaacatgcagaagtcattcttcatttttctctgttttttctctccagaaattcaattct

SEQ ID NO: 37382 - DNA, 201 bp, Homo sapiens
cccagtgggggagagaagcacctgccctgcaagatgcaatcaggatgcaaaacatgttggggtgatgcaggtgatggtaatacagcagctagcactacccrgaagattactaaggagcagccactcttctgggtattttacaagtactactcttttaatccccacaacactcctaggaggcagctactaaattagggaaga

SEQ ID NO: 37383 - DNA, 201 bp, Homo sapiens
atgtaatttgaagtaattgctgctatatggctcatgactctcaaattcagcctgcatcaagatcacctggggtgcccatggatgcatttttctggctgcamcttcaaacctactcaatcctaatcttggtggagtgtgggagaggggaggaccaaacccacactttaagagataccgatccatgtgcttagtccattgaat

SEQ ID NO: 37384 - DNA, 201 bp, Homo sapiens
tggcggtgtaggcacccgagggaatctcctggtctgccaattgcgaagacagtgggaaaagcgtagttatctgtgctggatagcactgtccctcactcacrgcttcccttggctaggggagggagttctccaaccacttgtgcttcctgggtgaggcaacgccccaccctgcttctgctcgccctccatgggctgcaccca

SEQ ID NO: 37385 - DNA, 201 bp, Homo sapiens
tgagcagactacctaaacaccacacaattttaaatcattaccttggaatgactttactttcatgtgccaaactgactatggtgtgtatttaatatttgacrtaatattcccatgcgctttaagaaatccatgaagacttccaataagatagcctttgtatttgtgtgtgtatgcacaccagtgtaatttgcatttccatct

SEQ ID NO: 37386 - DNA, 201 bp, Homo sapiens
cctactacagaccaacattaagccatcatctaataagtacatatccatgctggccagagaacactctttgtggctggccaaaaccttgattccaaagatakaactgatttcaaatatatttctaaaagagaatgttctgtgcagtggccttcaacagttgacagtgtagcctccagtcaaaactattgtggttacagtgtt

SEQ ID NO: 37387 - DNA, 201 bp, Homo sapiens
tatgatgtctaactcattaatctggagcagacctaccacataatgccaaattgaatgagtttgctcagggatgcactaatgtcttagaggagctttcatgytgacaaagctggggtgatttgatctggcaagggagacaggaaacatgaaagtccccatgagatttggctccctggtcttttcaagagcacaccatgcctt

SEQ ID NO: 37388 - DNA, 201 bp, Homo sapiens
gattcaggttctctataatgggcaggaatcctgcctctgtgagatgctgagtccttgctagtgcatcctttcaggagacacctgagtttcgttttgctttyttcccccattcttggaggcaatatctttgatccttttgttaaggtgcgctctgctaggtttctacactggaaagttagcactttctcttcataattaata

SEQ ID NO: 37389 - DNA, 201 bp, Homo sapiens
aagaaccccaaggcttattctttatatccaggcaatactccagacaaaattaagtataaggcattatttgattttttaattattcaacagaaaatactttwgtgaaagaaaaggtactgggctatggtctcaggatatcccttctcattccatgttctggccacacacagaatattaccacaccattcaatcttagctttt

SEQ ID NO: 37390 - DNA, 201 bp, Homo sapiens
agacaaagtctcactatgttgctcagtctattcttgaacttctgggctcaagagatcatctcatctcagcctcccaaagtgctggggttacagacatgagycaccattcccagccaatagtgcataattttacatacttctatagatgtgttgtgatgaggctccactagacaaatagttttaaaagtggtctgtaatctg

SEQ ID NO: 37391 - DNA, 201 bp, Homo sapiens
cctgagttcaagcaattttcctgccttggcttcccaagtagctgggactacaggcgcccaccaccacacccagctaattttttgtatttttagtagagacrggttttcaccatgttagccaggatggtctcgatctcctgacctcatgatctgcccgcctcggcctcccaaagtgctgggactacaggtgtgagccaccgt

SEQ ID NO: 37392 - DNA, 201 bp, Homo sapiens
tagtgggctgaacattgcattggcattcttggtattcactactaacaaatgcagaagtaggagagggaaataaatcatagtttaaatgtggtacctgaacratccctaattctctagggatttgtgaacttctcgagctatttatgtgcctcatgatcttccagaaatattgcagcaagattctgaggtgttgctgactca

SEQ ID NO: 37393 - DNA, 201 bp, Homo sapiens; identical to SEQ ID NO: 9598

SEQ ID NO: 37394 - DNA, 201 bp, Homo sapiens; identical to SEQ ID NO: 9599

SEQ ID NO: 37395 - DNA, 201 bp, Homo sapiens; identical to SEQ ID NO: 9601

SEQ ID NO: 37396 - DNA, 201 bp, Homo sapiens
ctaacataatatctatcttatctatgtattgtatttattctctgttattattggccccattactatgtaaaattcaggagggcagcagccactcctgtgtkattatttcattgctgttgaatggaagaacatgaacacactcagtgattgacttcagcgttgtgcatagcctataattctttttttaaaaaataaactctt

SEQ ID NO: 37397 - DNA, 201 bp, Homo sapiens; identical to SEQ ID NO: 9603

SEQ ID NO: 37398 - DNA, 201 bp, Homo sapiens
catgcctgaaatcccagtactttgggaggctgagatgagagaatcacttgagccctggagttccagaccaacatgggcaacatagcaagatctcacctttwaaaaaaaaaaaaaaaaaaaaaaaaaaaaaaaaaaaaaagcttcggatttaataactcttctaacagctttaatatttaccttctcactgcagtcaatgct

SEQ ID NO: 37399 - DNA, 201 bp, Homo sapiens
gcggctcatgcctgaaatcccagtactttgggaggctgagatgagagaatcacttgagccctggagttccagaccaacatgggcaacatagcaagatctcmcctttaaaaaaaaaaaaaaaaaaaaaaaaaaaaaaaaaaaaaaagcttcggatttaataactcttctaacagctttaatatttaccttctcactgcagtc

SEQ ID NO: 37400 - DNA, 201 bp, Homo sapiens
gaaagagcaattcccatgtactgagatgggggtgtcagtggtgggctgtgtgtggtaggatatgtgttggtggtgggctgtgcatagggatcatgattttkctttgggacacattagttttgaaatgcctctgagacctccaagtggagctactggaaggtattttttgagtattgatatttgaatgattggatctgcatt

SEQ ID NO: 37401 - DNA, 201 bp, Homo sapiens
ctcaaactcctgacctagtgatctgcctgcctcggcctcccaaagtgctgggattacaggcgtgaaccaccgtgcccagccaccttctgtatttatatgtrgacttactacgttctaacataatatctatcttatctatgtattgtatttattctctgttattattggccccattactatgtaaaattcaggagggcagca

SEQ ID NO: 37402 - DNA, 201 bp, Homo sapiens
ttcatgcaggaaggaattcaagagcaaggctacagagtaaagtgaaagcaagtttattaagaaagtaaaggaataaaagggtggctgtgccataggcagarcaatggcatgggctgcttgattgagtaaacttatcattatttctagattatatgctaaataaggggtagattatttatgagttttctgggaaaagggtgg

SEQ ID NO: 37403 - DNA, 201 bp, Homo sapiens
ttaataattagaaggaagatgggccgggcgcagtggctcatgcctctaatccctgcactttgggaggccaaggcgggcagatcatttgaggtcaggagttygagaccagcctggccaacttgaaatcccgtctctacaaaaaatacaaaaattagcctggtgtagtggtgcatgctgtagtcccagctactcaggaggctg

SEQ ID NO: 37404 - DNA, 201 bp, Homo sapiens
caatccaccctactgcccttaccttctggttttttttttgttttatttttttgtttttttgtttttgggggggggtggtgggagacggagttttgctcttrttgcccaggctggagtgcagtggcgtgatctcggctcactgaaacatccgccttccggtttcaagagattctctggcctcagcctcccgagtagctggga

SEQ ID NO: 37405 - DNA, 201 bp, Homo sapiens
agagttttccagtgtatcttctaactgtatctgtattttaaaacatggaagagattactagaaaacagagtgcaaaagtagtattgcttcaccatatatcyggaattctacattatacatatctgaaatttaactgagaatttctactgtcatttgaaaactcatcaataatgaaatagaaataatatagataaaataacc

SEQ ID NO: 37406 - DNA, 201 bp, Homo sapiens
catctctctatcatccttattgggagaatgtgtaatattgtcctagaggaccactgtctaaaatcaccaatagtgcaaaaaaggagatctgctttactggrctgtcttccctatggaatacagggggcacaggccctgtaccagcctggattctgctgagaagtaaccagacacaaggccaagcagactgcctggttccaa

SEQ ID NO: 37407 - DNA, 201 bp, Homo sapiens
ctgtttcagcatttttaagcctagtcacttatggagacaggcctaaaacaatcccgttcatcctccccattctcacattatttgttaagaatgcacagaaktccatattgtcatgactctaagctttccctttgtaaaagttcagacccagaagggactctagattacattattcttcaacggaaacaattacactgttag

SEQ ID NO: 37408 - DNA, 201 bp, Homo sapiens
gagggagttggcatcaaacagaaagagaagtgagctgggggaaaatgcccagatttgagactcagaggaagggttaggagagcactggtcttgtggtgtgmctcccatcctctcacttgaagaggtagtaaatcaaactctgctcttgaagtagtgaatcaaactgtgatcctcaatttccccatctctaaaataagaaca

SEQ ID NO: 37409 - DNA, 201 bp, Homo sapiens
agaaatattccaacactactgaaaagagacctcagaaagtaaaagggttaacatgcctctcctgtggggatttcttgcactcaaaactttttatctcttcrctgctctataactggttttatgtcttaaaatttaaagtgataattaaatgcatacctgtagggattggaacagaacctgtacctgtctggatatgtctgt

SEQ ID NO: 37410 - DNA, 201 bp, Homo sapiens
  misc_feature (1)...(201): n = A,T,C or G, or insertion/deletion polymorphism (see Tables 1-2)
aacacacattacatatatattagctacttttattataaaagaggaagacaaggagacaaggtcaacactttttaattctattggaggtcagtgagatgcgnactaaaagggctcactgagttttgtagttaggaagtcactggaaatctgtgtgggagactttctgtggatcaatagtaggtaacagatacaactctgcgt

SEQ ID NO: 37411 - DNA, 201 bp, Homo sapiens
aaaatcagcactttttgtcaatccaccctactgcccttaccttctggttttttttttgttttatttttttgtttttttgtttttgggggggggtggtgggrgacggagttttgctcttgttgcccaggctggagtgcagtggcgtgatctcggctcactgaaacatccgccttccggtttcaagagattctctggcctcag

SEQ ID NO: 37412 - DNA, 201 bp, Homo sapiens
ccagccgccttatataaaatcagcactttttgtcaatccaccctactgcccttaccttctggttttttttttgttttatttttttgtttttttgtttttgrgggggggtggtgggagacggagttttgctcttgttgcccaggctggagtgcagtggcgtgatctcggctcactgaaacatccgccttccggtttcaagag

SEQ ID NO: 37413 - DNA, 201 bp, Homo sapiens
gactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctcactgaaacat

SEQ ID NO: 37414 - DNA, 201 bp, Homo sapiens
tgactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctcactgaaaca

SEQ ID NO: 37415 - DNA, 201 bp, Homo sapiens
tgttaaacagaggacatgtgaaatgctttataggcacaggtgactagtgtttaccacagacagaacatttccatcacacccgccagttctgttggacaggrctggctgagaacaccctcccacaggtctctgcagtgccactacccactgctacaccttcttcaagtcctgactcagaattgaacacacgccagccgcctt

SEQ ID NO: 37416 - DNA, 201 bp, Homo sapiens
ctgactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctcactgaaac

SEQ ID NO: 37417 - DNA, 201 bp, Homo sapiens
  misc_feature (1)...(201): n = A,T,C or G, or insertion/deletion polymorphism (see Tables 1-2)
aatttgtcacagcagctgtagaaaaccagtacatgaactgatttaaaacacaccaaacctattgcattggctgaattagtatccttattctcagatacagngaatgaggctcactgaggctgttggagttgcttgctgaagcccaccttcctcgaaggttatgtgtggggtcaaaattctgcatcctacagccagaaagaa

SEQ ID NO: 37418 - DNA, 201 bp, Homo sapiens
agttaaaaagagcagctgattctttggttttctaaactaactagaataaacaggcattgaaaaagcaacaatcacaggtgaattcttttttcctctcagcwttgtttgtttccatgttttatttatttttattgttcctctcttccagtgcctggagccctgcaaggaatcaggggacctgaggaaacaccagtgccaaag

SEQ ID NO: 37419 - DNA, 201 bp, Homo sapiens
cctgactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctcactgaaa

SEQ ID NO: 37420 - DNA, 201 bp, Homo sapiens
tattcccacagagggtatttcaactcaaggcaactggcctgaaaagaggcctctgctaaactgagagatgccatggatgcaggaaagcttccctcccattyatttctaccgaggaagttcacagaatgcaggggcatgccggctgttttgccttttatattttaggcagaagcatttgcatttagaccattgacctactcc

SEQ ID NO: 37421 - DNA, 201 bp, Homo sapiens
tcaagtcctgactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctca

SEQ ID NO: 37422 - DNA, 201 bp, Homo sapiens
acacacctgtcaagtacccaagactctgtacaaaggtaaggggcagcactgggggtgtgaagacacatgcagtgtcacatatatctgtgtgtgcctagggwagggtgtccatcataggtgtgaaaagtctaaaaaacataaaatctttagaaaatttattttataccacatacagacatcttaacataatcacagacccat

SEQ ID NO: 37423 - DNA, 201 bp, Homo sapiens
ttcaagtcctgactcagaattgaacacacgccagccgccttatataaaatcagcactttttgtcaatccaccctactgcccttaccttctggttttttttttgttttatttttttgtttttttgtttttgggggggggtggtgggagacggagttttgctcttgttgcccaggctggagtgcagtggcgtgatctcggctc

SEQ ID NO: 37424 - DNA, 201 bp, Homo sapiens
gacagggctggctgagaacaccctcccacaggtctctgcagtgccactacccactgctacaccttcttcaagtcctgactcagaattgaacacacgccagycgccttatataaaatcagcactttttgtcaatccaccctactgcccttaccttctggttttttttttgttttatttttttgtttttttgtttttgggggg

SEQ ID NO: 37425 - DNA, 201 bp, Homo sapiens
attcttagttttatcacagcaaattctccctcctatcattcttattttatttaattttagtttcatacttaggtacatagaaaaatgattaattttactgwttcttttttccactgtatgcttaattttgtaaatttaattcatatctttgtttttaaacaggggtctatggatggtgttttctttaagtttatgcatgat

SEQ ID NO: 37426 - DNA, 201 bp, Homo sapiens
ttatttgaaaattcttagttttatcacagcaaattctccctcctatcattcttattttatttaattttagtttcatacttaggtacatagaaaaatgattrattttactgattcttttttccactgtatgcttaattttgtaaatttaattcatatctttgtttttaaacaggggtctatggatggtgttttctttaagtt

SEQ ID NO: 37427 - DNA, 201 bp, Homo sapiens
tgtagggaaacaggcataggagtttggaatttaggtgagagttctaggctgaaagaacaaatgccatgcatgaaggtactgtttaaagtaatgaagctcaktgaggtgacagaaagaaaacaggtctatgagttaaactgaatcacagcaacataagaggaatagggagatgaagaaggagatttaagagaggccaataaa

SEQ ID NO: 37428 - DNA, 201 bp, Homo sapiens
tttatttatttacttattgagacttttatatgttatttccattttttagtagacataagactattcacgttgtctatttcttctttagtagcatttataamctatgtctttgtaggaagtgaactatttcatccaagttatcacattgataaaaatagcataggtcatattatcgcctaattcacctttatcgttagcatt

SEQ ID NO: 37429 - DNA, 201 bp, Homo sapiens
ttgtagtgatgaaccctttttgcaatactgacattggtaagttatgtattctctactttttcttgattcatcccaatagaattttgtcaattttagtgctkctttaaaaaaaaaaaaaaaaacttcttgttttattgtttttctttatttttttgtcatttcctatgctattgatttctgtcctttattatttccttactt

SEQ ID NO: 37430 - DNA, 201 bp, Homo sapiens
tggacatacaattttaatcaaatttttaatttattgttcaatattatttattgatttctcccatcttctctcttctcttgttctgagactctaattacacrcattagaccagcttattttgtctcatgggtcaatgagtctatgatcttttttttttccttttggtcatttcccaccctctgcttcattttaatagtttat

SEQ ID NO: 37431 - DNA, 201 bp, Homo sapiens
agaagaaaatgcctaattggcatgaatttcagataaatggttggaggaaacagagagggagtatagaaacatttcagtgagcattactgtaaaaaaaaaaagtgatcaggggcgcaaatgagattgtgggaagaggtgtgaacaaggtaatcaaacatttaattgtttttagagtagagaaataattatattttacaagca

SEQ ID NO: 37432 - DNA, 201 bp, Homo sapiens
tgactgttgtgctcttaactttaattttctaccctattccatacacaaactatacatctataggcacaaaaataaatatttatagaatcttttttttttttcggtttcccatgctggagtgcagtggcgtgatctcggctcactgcaccctccacctcctgggttcaagtgattctcgtgcctcagcctcccagataggtg

SEQ ID NO: 37433 - DNA, 201 bp, Homo sapiens
ttccatctcctgatgtgcaggtcttgaatttttgtgtgtgtgatagtgtaatggagcaatggtgacaattgctaaagaagctgattctccagtggatactytttttctttttaaaatattgatggaataatatcatccactttgctgaagaaaaaagggatcacagaaataaataatggtttaatgagaagatgaatgtga

SEQ ID NO: 37434 - DNA, 201 bp, Homo sapiens
cgagtcgggtggatcacaaggtcaggagatcgagaccatcctggctaacatggtgaaaccccatctctactaaaaatacaaaaaaaaaaaaaaaaaaaaaattagccgggcatggtggtgagcgcctgtagtcccagctactctggaggctgaggcaggagaatggcatgaactcgggaggcagagcttgcagtgagccga

SEQ ID NO: 37435 - DNA, 201 bp, Homo sapiens
ccgagtcgggtggatcacaaggtcaggagatcgagaccatcctggctaacatggtgaaaccccatctctactaaaaatacaaaaaaaaaaaaaaaaaaaaaattagccgggcatggtggtgagcgcctgtagtcccagctactctggaggctgaggcaggagaatggcatgaactcgggaggcagagcttgcagtgagccg

SEQ ID NO: 37436 - DNA, 201 bp, Homo sapiens
tgtagcttcagcagctttgctaagtttttttttttttttaagggagaaggaacactaccccaactgccaagtctggaaagaaaaaaaaaggtttaaatatyattagaagcaaacttctatttagttgaaaactttgtgacacagttatattattgtttttaaaatataactgcacttgaccaaagttacatcaagtatata

SEQ ID NO: 37437 - DNA, 201 bp, Homo sapiens
aattcacttttactcaaggtattgatgggccatgtgccataagcaatattggtgttggagtggttcctattccaggattttctttcaagctgctgaaatcsattctgcaagtaaaataatattattattaatattaacatattttatttctataatgttaattaaagtttattcaacatttattgcattaagattatatta

SEQ ID NO: 37438 - DNA, 201 bp, Homo sapiens
tatcagttgccagacaacttgcatgtacagaaggcgataaagaaatcagaatgattaactactttaaaatgaaacacctgtgagaaacttttgaagcagcrcactcactcatgccaaaaccaaacattataaattcattattttccaatgttaagccattaagactatatataggggaatgcttgagcaattgattgcgga

SEQ ID NO: 37439 - DNA, 201 bp, Homo sapiens
acaagcttgaaataaatgcatgtcatggcagaacaggagtcaaagactgacttggtgaagttccagatccaccaggaaagctgaggatcttagaataagartgtccaagggatttgcatatctatcaaaaccatctcttttctctatctctctatgtggccttttctaatatgaaatgtagaaagcagcagataattcaga

SEQ ID NO: 37440 - DNA, 201 bp, Homo sapiens
cgtcatgttgcataaaattgcttgtaagtctgtggaaaagaacaacaaaagcgtcattctagatgacatcagtaagcaaagaaaatagctaaattttagtwtggcctgccaatttaaaagctacattaaattagttgtttgccgtgcatggaacattcagtgctgtttaccaaaataatgccaaaaggtaaatttatggtg

SEQ ID NO: 37441 - DNA, 201 bp, Homo sapiens
cttcagtagtccctccaggaaggctggttttcatgtcctgggagctttgacagtgcctcttaatatgttagtgtgtgtaaaaggagggcaaatagagcctrcagcaactccttcatcatcttagctaatgaggcatttgaagtcccttttggcattcccaacctggagtccagctgcttcttcactctcaaaagaggagag

SEQ ID NO: 37442 - DNA, 201 bp, Homo sapiens
gttcccaggtatcgtccaggtgtaacccaggtgtttccagatgttaccagtaatgagccctggttagggatcactgtggagcatcaagcagcatgctggcrctgagctgcttgatgttcctattctccccctagacttctgttcaccaaagctaccacatttatttcttatattcctaaccctgttgtgacatcaaataaa

SEQ ID NO: 37443 - DNA, 201 bp, Homo sapiens
aagacattaacaggaaaacaaggcaaacaaagcttatttgatgataataatttcacatgcacagggacttcacagaaaagaaataaaaactcaaagaagtkgttagacctagaagtttatataccattttaatgaagggcaatacattgtggagaggagaatagacaaagaaaagggggttttgggctccgggcagtaaat

SEQ ID NO: 37444 - DNA, 201 bp, Homo sapiens
gtctcgctttggttgcccaggctggagtgcagtggtgcgatctcggctcactgcaagctccgcctcccaggttcatgccattctcctgcctcagcctcccragtagctgggactacaggcacctgccaccatgcccggctaattttttgtatttttttaagtagagacagggtttcactgtgttagccaggatggtctcga

SEQ ID NO: 37445 - DNA, 201 bp, Homo sapiens
  misc_feature (1)...(201): n = A,T,C or G, or insertion/deletion polymorphism (see Tables 1-2)
aaacgagatgtaactatattctcttgaaagcacgtaaatattcatcttcacattttactggtttgtattgatactagttttctttgtcatatataaaatanctaggtaaatacactagtatagcaatggaaaagctttccttttacccttgcagggttctgttattggggcctataaatttaatgcacaaaagacattaac

SEQ ID NO: 37446 - DNA, 201 bp, Homo sapiens
  misc_feature (1)...(201): n = A,T,C or G, or insertion/deletion polymorphism (see Tables 1-2)
cacattttgtttatatctagagtattaatattcacacagcattttctctgacctgtacacatttttctccttattccattcaatcaataaattctcattanactattattaatgacctggagagagaccttatgtacacataccatatgttctctaatttatattcaaacaaataatattttttcaacccaatccaagaga

SEQ ID NO: 37447 - DNA, 201 bp, Homo sapiens
caaacgagatgtaactatattctcttgaaagcacgtaaatattcatcttcacattttactggtttgtattgatactagttttctttgtcatatataaaatwtctaggtaaatacactagtatagcaatggaaaagctttccttttacccttgcagggttctgttattggggcctataaatttaatgcacaaaagacattaa

SEQ ID NO: 37448 - DNA, 201 bp, Homo sapiens
ttttgtatttttagtagagacagggtttcaccatcttggccaggctggtcttgaactcctgacctcgtgatccacccgcctcagcctcccaaagtgttggyattacaggcgtgagccaccgcactcagccacatagacaattttcaaaaagtttttagtatgataaataataggcttttatttttaaaaatgattaacatt

SEQ ID NO: 37449 - DNA, 201 bp, Homo sapiens; identical to SEQ ID NO: 9597

SEQ ID NO: 37450 - DNA, 201 bp, Homo sapiens
ttttcccattttatgtgccgcaatttcctgcttctttgcacactggattatttttgattggatgtcaaatttttgtgttttgaattttgctgtatctttcyagaaagtgttagactttgttctggcatgtagttaagttccttttgagattcattttcttatttttaaaagtttcttttaagctttcttgggggcgggttc

SEQ ID NO: 37451 - DNA, 201 bp, Homo sapiens
gttctggcatgtagttaagttccttttgagattcattttcttatttttaaaagtttcttttaagctttcttgggggcgggttcagagtagtagcctttagmctaggcccaatttatcccattactaggtgatatccttctgaggactctagccaatgcttcatgaattgtgcattctctgcactctgactggttgaaatgt

SEQ ID NO: 37452 - DNA, 201 bp, Homo sapiens
ctagccaatgcttcatgaattgtgcattctctgcactctgactggttgaaatgtgagtttttgctagaatggtttcctttattgctgtctgattattcttyccccagacttatgcagtttgaagccatgcacattcaagtcagtattcagccagaaatcaaagggtccctctgaatccctgtaggtttctctcttcatgca

SEQ ID NO: 37453 - DNA, 201 bp, Homo sapiens
ttaactttcttaaaataccctcgtaataacataacattcaatgttcactttggggcagggttttagcattaagatgaggtggaatttggctctttacatcraaaagtgaactacaggacacagaatttgtgcacagcctctataatctagctgaaactggcttgtggtctgcagttgcttatcagaaaataatctttataa

SEQ ID NO: 37454 - DNA, 201 bp, Homo sapiens
atttaaggcttagggtaatattttatcttcctttaatattttgaagaaagtgacacttgccaaattaattttgccccccaaattgtacagcagttatcttrcttgtgtatttgtcaagctctgaaggggacaggctgtatttgtttctgttccctctctctttttcttctgttttccacatcacttttacttgcctaaatc

SEQ ID NO: 37455 - DNA, 201 bp, Homo sapiens
agtgacacttgccaaattaattttgccccccaaattgtacagcagttatcttgcttgtgtatttgtcaagctctgaaggggacaggctgtatttgtttctkttccctctctctttttcttctgttttccacatcacttttacttgcctaaatcatcagtattgatgactggtctttaaagttttgtccttgtctaattatt

SEQ ID NO: 37456 - DNA, 201 bp, Homo sapiens
  misc_feature (1)...(201): n = A,T,C or G, or insertion/deletion polymorphism (see Tables 1-2)
tatcttgcttgtgtatttgtcaagctctgaaggggacaggctgtatttgtttctgttccctctctctttttcttctgttttccacatcacttttacttgcntaaatcatcagtattgatgactggtctttaaagttttgtccttgtctaattatttgttgatctcgtccttatatctgtaacttcctgtgtctacctttat

SEQ ID NO: 37457 - DNA, 201 bp, Homo sapiens
gtaatcccagctacttgggaggccgaggcaggggaatcgcttgagccagggagttggaggttgcagtgagccgagatcatgcaagtgtactctagcctggygacagagtgagactctctcaaaataataataataataataataataatttgagagtgacatttgtgtgattcgtgaaattaatcatatgaatagttttat

SEQ ID NO: 37458 - DNA, 201 bp, Homo sapiens
acaatttacttgtttaaatagttcattggtttttcatgtatttatagtcttgcaattatcagcagaattatagaatatttttatcactacccccaaaaaaatcccatagccattggcagtcgcttccctttccctccaattccttcagtcctacatatccactaatctattttctttccctacatagattgactcattcta

SEQ ID NO: 37459 - DNA, 201 bp, Homo sapiens
tttcttctataagtattactttattttatctgggtaccgaatattgtactagcccatttgttcttgttttctgtttatgataggatggctaggttttgccwttgcatggcacatcatgccccctgcccccaacacaacccccccacaaggcacatacactcacagagtttattttccttagaattatgtagacattgcttt

SEQ ID NO: 37460 - DNA, 201 bp, Homo sapiens
tttatgcatgataaattttacctacagttatatctaaagtacacttggattggacaacttttttttcttctataagtattactttattttatctgggtacygaatattgtactagcccatttgttcttgttttctgtttatgataggatggctaggttttgccattgcatggcacatcatgccccctgcccccaacacaac

SEQ ID NO: 37461 - DNA, 201 bp, Homo sapiens
  misc_feature (1)...(201): n = A,T,C or G, or insertion/deletion polymorphism (see Tables 1-2)
gggcaatctctcaaacgagatgtaactatattctcttgaaagcacgtaaatattcatcttcacattttactggtttgtattgatactagttttctttgtcntatataaaatatctaggtaaatacactagtatagcaatggaaaagctttccttttacccttgcagggttctgttattggggcctataaatttaatgcaca

SEQ ID NO: 37462 - DNA, 201 bp, Homo sapiens
ttgtaaatttaattcatatctttgtttttaaacaggggtctatggatggtgttttctttaagtttatgcatgataaattttacctacagttatatctaaaktacacttggattggacaacttttttttcttctataagtattactttattttatctgggtaccgaatattgtactagcccatttgttcttgttttctgttt

SEQ ID NO: 37463 - DNA, 201 bp, Homo sapiens
tggggtgagtgggaactggaggaaggattgttattcccacagagggtatttcaactcaaggcaactggcctgaaaagaggcctctgctaaactgagagatkccatggatgcaggaaagcttccctcccattcatttctaccgaggaagttcacagaatgcaggggcatgccggctgttttgccttttatattttaggcaga

SEQ ID NO: 37464 - DNA, 201 bp, Homo sapiens
attttgtctcatgggtcaatgagtctatgatcttttttttttccttttggtcatttcccaccctctgcttcattttaatagtttatttatttatttatttwttttaaatcattgtgtctttgctttccttttaagtaatcttatcttctatggtgtctaacattttaaaaatcctatttgacatatttttcatttcttcct

SEQ ID NO: 37465 - DNA, 201 bp, Homo sapiens
ggataagggttagcaaatgacttctaaaaaaacaccagatagtaaccatctttgtctttgcagcccataaagtatctgttgcaactactcaactctgttgytgcagcacaaaagcaatagtagaaaatacatagaccaagaagagtggctatgttccaataaaacattttttgtagatagtaaaatttcaatttcctgtaa

SEQ ID NO: 37466 - DNA, 201 bp, Homo sapiens
gtgcaacaggaatcagggtgaccagctgagagtaaggaccagacaaagggatggaggctggagtgactgacacatagacaattttcttttcttttcttttctttttttttttttttttgagacagggtcttgctctgtcgcccaggctggagtgcaatggcacgatctcggctcagtgcaacctccgccccccaggttcaa

SEQ ID NO: 37467 - DNA, 201 bp, Homo sapiens
acctgggaggtggaggttgcagtgagccgagatcgccccatcacactccagcctagggacaagaatgagactttgtctcaaaaaaaaaaaaaaaaaaaaaagaaaagaaaagaaaatatttcttactgaatagaaaatatgtcttaccccaattcctccagctgatggtgacgatcattacttttcctgtaagtcactgcc

SEQ ID NO: 37468 - DNA, 201 bp, Homo sapiens
aacctgggaggtggaggttgcagtgagccgagatcgccccatcacactccagcctagggacaagaatgagactttgtctcaaaaaaaaaaaaaaaaaaaaaagaaaagaaaagaaaatatttcttactgaatagaaaatatgtcttaccccaattcctccagctgatggtgacgatcattacttttcctgtaagtcactgc

SEQ ID NO: 37469 - DNA, 201 bp, Homo sapiens
gaacctgggaggtggaggttgcagtgagccgagatcgccccatcacactccagcctagggacaagaatgagactttgtctcaaaaaaaaaaaaaaaaaaaaaagaaaagaaaagaaaatatttcttactgaatagaaaatatgtcttaccccaattcctccagctgatggtgacgatcattacttttcctgtaagtcactg

SEQ ID NO: 37470 - DNA, 201 bp, Homo sapiens
gagtcttggtcttggagaaaaagaaaccagcacatgcaaagatcaacttactgctttacaaagagggttgttctttctcaatgacaagaatccaataagawacctgtaagagctgaataagggtctcagtcatttatttgggacacttggaagggagagaagagagacatttgggccggacacggtggctcatgcctgtaa

SEQ ID NO: 37471 - DNA, 201 bp, Homo sapiens
tgaacctgggaggtggaggttgcagtgagccgagatcgccccatcacactccagcctagggacaagaatgagactttgtctcaaaaaaaaaaaaaaaaaaaaaagaaaagaaaagaaaatatttcttactgaatagaaaatatgtcttaccccaattcctccagctgatggtgacgatcattacttttcctgtaagtcact

SEQ ID NO: 37472 - DNA, 201 bp, Homo sapiens
aaatttaaaaagaaaattgtcacctagattttcaaaacagcctcttgctgatttttaaattatgtacttcgtttactttattttctagcttaaattttttwaaaaagtgtctgatgactagtgtgtggacaaaacattgagaattagtcatagttttaactctgatttttttaaatgatagattggtatgcttataattga

SEQ ID NO: 37473 - DNA, 201 bp, Homo sapiens
catatgggaaaaaaatctgtagtctcatatctgaaatatttttaaatcaagattttcatatatcacaatataggaaataatattttgctaaggaacttatsttcttgttacatagatattactgtaataaatattatgaattttcttcatgatatgacccaagtccacctacttcatttattgctaaatcaagtaaaattt

SEQ ID NO: 37474 - DNA, 201 bp, Homo sapiens
tatcttgtatataagtgattgagccattttcttctatctttgttaacctcatgtctctctggtccaagtgaacatgccctgtttgaagtgttgaattgggragggcaggaatagctaaaagaagcttgttgtttgtccgtcttccccgcaacttcaaatttggctcgaggctgtaatgagttggcctgtcttccaggccac

SEQ ID NO: 37475 - DNA, 201 bp, Homo sapiens
tatgcacaatagtgcttaattctttgtgtgtgttacctcatgtaatattcataatgttacctgtattatttcaagattataaaccagtctagaaaccatgrgtgcaaagatgaacatatgtgtttctatgtccttaccaaaaaggaaaacattgaatatccatacagaataactctcatatcaactgaaagatctaaattg

SEQ ID NO: 37476 - DNA, 201 bp, Homo sapiens
aactaagtcactgtgatttccaagttaccaagcaggaaacacttgccagatttaatacaagtatttcttttttttttttttttttttgagacaaagtctckctttggttgcccaggctggagtgcagtggtgcgatctcggctcactgcaagctccgcctcccaggttcatgccattctcctgcctcagcctcccaagtag

SEQ ID NO: 37477 - DNA, 201 bp, Homo sapiens
agctaataaagaagaacacgggggcaccatcccccaccatctgcaagcctcggtccacagtggcacagaactttgctgattacgttccattcacaacaacrtagccacccccaggtaaaagagacagtgaaatttaacctggctatgcacaggcattccaggtgaaaatgcattttgataaaagaaaatgtcactttgata

SEQ ID NO: 37478 - DNA, 201 bp, Homo sapiens
acgtggttccattcaacacttttgttttttctgatcagacaactcggttcttatagaaatgacctgttcaagctagtaggtagaataagtaaaaatataasttagcttttacactctcagctaagacttcatttactatccttcaaaaaattgagagggtatacaaagtttaaacatcattttaaataaagaaacagattc

SEQ ID NO: 37479 - DNA, 201 bp, Homo sapiens
acatcattaacgacagtactacatggcaggtctaggaagaaggcaagggagccccaatagttcaggtatcagccaacattggatttactcagcatgcaacyagtggagctacaccccaaaaaagctacatcctccaggacctgcaatcctttgtatattttaaaaatgtaatttgtgtatggtttcaaagaggtgagggga

SEQ ID NO: 37480 - DNA, 201 bp, Homo sapiens
tgtctctctcttctcgctctctcctgatctctcttttctttccccctcttccctctccctttctattttgacatttggctgtaccattttgaaagcagtayagccaaacctagtggtcatcattccagaaatggcctacatctgggaagtatttttttttttcccattgggccagaatttaaaagaaagtagagaacatct

SEQ ID NO: 37481 - DNA, 201 bp, Homo sapiens
gtgtgtgttttgagcctggggtctgaggggccacacgagaagtatttcttcagaaaggtgaagttgagaatctttgtcaattcacattctgccgacacctscagaaagctctttggttcctctttctgctgagacatggccatttcccctcctgctggacaacaggatgcctggactcccttcgtcgatgttgcactcagc

SEQ ID NO: 37482 - DNA, 201 bp, Homo sapiens
cttttttacataacctcatgaaattagggctagaatttaatttccatatattcgtctgtgtgtatattatgcatgcgtttctagttcagggtttgtcaacyatgacactgtggacgttttggagcagattcttctttgttgagtggaggggctgtctggtgcattttaatggttccacagcatccctggcctctccctact

SEQ ID NO: 37483 - DNA, 201 bp, Homo sapiens
agtgtggtgttccgatagccaaacgatgaaagcttttcaacaaggaagaggtaatcagttgcgtcaagtgctgcaagagcatggagacttcaaatttattmatcggattctgcgacagggagctcactgtggactttgacaagagcagtgttattgggtggcagaagaaaatgcctaattggcatgaatttcagataaatg

SEQ ID NO: 37484 - DNA, 201 bp, Homo sapiens
tcacctgaggtcaggagttcaagaccagcctggccaatctggtgaaaccccgtctctactaaaaatacaaaaattagccaggcgtggtggtgggcgcctgyaatcccagctccttgggaggctgaggcaggagaatcacttgaacccgggaggcggaggttgcagtgagctgagatcgcgtcgttgcactccagcctgggt

SEQ ID NO: 37485 - DNA, 201 bp, Homo sapiens
ctctacagaatgcaaattttccccacaagagatggctttgcaaggctatctcagaatatgtcaaagaaatatattttgaggtaaaatacttttttttttttcagggcctgctatctgtcatgtgatgctatactacggtcaggttggagttgggtatcttattgctacaaagagtctgttttgtcagtcttaagatcccta

SEQ ID NO: 37486 - DNA, 201 bp, Homo sapiens
aaattgattttaaaaatggtgaacaatccgcaattagataaggtaaaagagacagactatccacggtaaaggaaaataaatggccagtcaggaaattaaartaaaaataccaataccattgcccactcatcctgttggcaaatgttgaaaaattgcttccacccaaggaaaaaacagaatggaaaggcatccttttactgc

SEQ ID NO: 37487 - DNA, 201 bp, Homo sapiens
tttaaaaatggtgaacaatccgcaattagataaggtaaaagagacagactatccacggtaaaggaaaataaatggccagtcaggaaattaaagtaaaaatrccaataccattgcccactcatcctgttggcaaatgttgaaaaattgcttccacccaaggaaaaaacagaatggaaaggcatccttttactgcaagtttta

SEQ ID NO: 37488 - DNA, 201 bp, Homo sapiens
aaaacagaatggaaaggcatccttttactgcaagttttatttgtattttagtattgctaaaatactgtatcttagtattttcaatactaaatacttttgartctcactataataagactgaatcagttagtctagggtgagtattatccgttgtgagctgggagatattaagtctaggattactcccaaactgctaaagac

SEQ ID NO: 37489 - DNA, 201 bp, Homo sapiens
ttaaaatattgatggaataatatcatccactttgctgaagaaaaaagggatcacagaaataaataatggtttaatgagaagatgaatgtgaggaatgctgktttatatcatgtgatacctccttttccctctttctgcacatctgattattccctcctttaccaagggtgagctagatagttggcaatttatgctttagtt

SEQ ID NO: 37490 - DNA, 201 bp, Homo sapiens
  misc_feature (1)...(201): n = A,T,C or G, or insertion/deletion polymorphism (see Tables 1-2)
aactttttttttttgcctaataacattcttgaaatataattcacatgctgtacaatttacttgtttaaatagttcattggtttttcatgtatttatagtcntgcaattatcagcagaattatagaatatttttatcactacccccaaaaaaatcccatagccattggcagtcgcttccctttccctccaattccttcagtc

SEQ ID NO: 37491 - DNA, 201 bp, Homo sapiens
aactagattcactaagtacctactatgtgtagacaccttaaaaggtggtctttataaatttcatttgaaaaaagtccacctgagcaaatattttttcactsttttatgtatcagaaacgtatagttgagagaggttaaaataaaacttgaatgggaaaaaatcatttagcttgaggtagatgagggattctcctctgggtc

SEQ ID NO: 37492 - DNA, 201 bp, Homo sapiens
ggaaggaaggaaggaaggaaggaaagagaaagaaagaaagaaaagcaagcaagcagggagggagagaaggaaggaaggaagagagcaagcaaggaaggagrgagggagggaggaaaggaaggaagaaagaaagaaaaagaaagagagagagagagaaagagtctcactctgtcgctcaggctggagtgcagtggcacaatt

SEQ ID NO: 37493 - DNA, 201 bp, Homo sapiens
tgacagagtgagaccctgaaaaaagagaaaagaaagaaagaaggaaggaaggaaggaaggaaggaaggaaggaaggaaggaaggcaagcaagcaagcaggraggaaggaaggaaggaaggaaggaaggaaagagaaagaaagaaagaaaagcaagcaagcagggagggagagaaggaaggaaggaagagagcaagcaagga

SEQ ID NO: 37494 - DNA, 201 bp, Homo sapiens
tgggtgacagagtgagaccctgaaaaaagagaaaagaaagaaagaaggaaggaaggaaggaaggaaggaaggaaggaaggaaggaaggcaagcaagcaagsagggaggaaggaaggaaggaaggaaggaaggaaagagaaagaaagaaagaaaagcaagcaagcagggagggagagaaggaaggaaggaagagagcaagca

SEQ ID NO: 37495 - DNA, 201 bp, Homo sapiens
tgcaccactgtactccagcctgggtgacagagtgagaccctgaaaaaagagaaaagaaagaaagaaggaaggaaggaaggaaggaaggaaggaaggaaggmaggaaggcaagcaagcaagcagggaggaaggaaggaaggaaggaaggaaggaaagagaaagaaagaaagaaaagcaagcaagcagggagggagagaagga

SEQ ID NO: 37496 - DNA, 201 bp, Homo sapiens
ggcatgtatgcataggaagcatgaagcagagtttgtattctcaacaagattatatcatagttttgggttaaagtctatatgcatttctcttttttaaaaawtttctttttaaaattatagacagggtctcactatgttgcccaggctggtctcgaactcctgggctcaagcaatcctcccaccttggcctcctagagggct

SEQ ID NO: 37497 - DNA, 201 bp, Homo sapiens
gggcatgtatgcataggaagcatgaagcagagtttgtattctcaacaagattatatcatagttttgggttaaagtctatatgcatttctcttttttaaaaattttctttttaaaattatagacagggtctcactatgttgcccaggctggtctcgaactcctgggctcaagcaatcctcccaccttggcctcctagagggc

SEQ ID NO: 37498 - DNA, 201 bp, Homo sapiens
aggagggttgcttaagcccaggagtttgagtccatgctggccaacatagcaaggctctgtctcaagaaaacaaccaactccccacccccatccccccgcaraaaacaaacaaacaaacaaacaaaagctttatggaaattagagaagagtttcatttgtccagtacgggaaggcttgaatatccagtcaaaccaatgtaaa

SEQ ID NO: 37499 - DNA, 201 bp, Homo sapiens
tccaccatgctctgctcttaaggggaagagccacaagcctattggctgcctgggcgaagcaggtacgttttcacctgaaggacttctacatctaggtctamggtgtcagcagcgctttgcaaaccttgtcaaactgcgtttcacaagaccgtgaaaaccaaaagtgcctctctttctaagttgtgttatgatggcccaatg

SEQ ID NO: 37500 - DNA, 201 bp, Homo sapiens
gcaagaaaaatttaagagaacacaacttaaattatgaaaacagggagtgcggtagaaacttgtcctgatgggaaatgtggtagtggaacaaaggtggggcrcttttgtttgtgtgggccatgggagccagaggggtttggccctgccttcacagatctcaagtcataaatagcagaggtcaaagaatcgtctttaaaacta

SEQ ID NO: 37501 - DNA, 201 bp, Homo sapiens
tgagagctatttttgagtgtatagttaagtagtgttaagtatattcacattgttgtgcaacagatctccggaactttttcatcttaccaaactaaaactcyatactcatgaaataacaacttctcatttccccctccctcagcccccggcaaccaccagtctactttcggtttttatgaatttgactgtagaaataacctt

SEQ ID NO: 37502 - DNA, 201 bp, Homo sapiens
acaacccctgaactgtgcaagcagagatcatttaagagttgagctgcctgcagatgcacccagattcagccttctgcagacttctcttgtggggctggaayggatccttgtggagaggagaagcgagttcccgagatcttccttggggacgcagctcctctggcttccgcttgctgaggaaggtgggtcttttgatggctg

SEQ ID NO: 37503 - DNA, 201 bp, Homo sapiens
cacccttccttctgcatgtggtggacttcaccatgcagtttctagacccattcctccccaactcagatacctgcatccactgaagtcaaatctcatctacrtcagagaccatggattatctacatatgtggtcacagtatccgtcataatccctggcatataaacacggcaacaaaaatatttttgaaaccaagttaatta

SEQ ID NO: 37504 - DNA, 201 bp, Homo sapiens
tgagtttctcattgtaaagaaagaagccaaaaggttgttacacttggtttataaggcccttcttgggagctggggaagtttcctttactagtgccatttgsaacatgatgacagagtgagtgtttgacaccttgggtagagagagacagtaaagcaaatctgggataaagagcttagtgtgggtggtaaattacttcttgc

SEQ ID NO: 37505 - DNA, 201 bp, Homo sapiens
tgcagaaagttaatgtctccatagcaaaccgtggggaactgtgggtcagagactctccagcatccttggaagtggcctcttcacagtcatctgagaacctrgaggaagatgctgtttacaagacccacgtggagaaggacttcattgctttctgctcttcaacgccacgtatgtatctttcagtggcagtaagggatttgt

SEQ ID NO: 37506 - DNA, 201 bp, Homo sapiens
cctcagccgccacaaacacatacatattcaagacacatccttctaataactacctagcttcaaagagctcaacaaggtttaacaacctttgggtgtgtgtgtgtgtgtgtgtgtgtgtgtgtgtgtatacaaaataagagtactagactggtaaatctatgtctctttggtcctccaaatatcctcaattctggaaaacta

SEQ ID NO: 37507 - DNA, 201 bp, Homo sapiens
tgcaattaaatgcatgcacattgggttggcagtgcctgccagtggagagagtaccagagccagcccccagtccaagagaactaggcggctacttgggctascttctggatccatcgctggagcgggggcaccaaaccacaagcaggtagccacaaaggctttcccagtctgatttcgttcattgttgtaatttcctcagtt

SEQ ID NO: 37508 - DNA, 201 bp, Homo sapiens
agcaatagaaaaacacatactgcatgatttcacttacatgaggtacctagggtataaaattcatagagacagaatgtagaatggtgatggccagggactgwggggaggaggaaatggggagttattagttaatgatatagaatttgagctttgccagacaaagaggaattctgaaggtaaatgggggtgacacttatatga

SEQ ID NO: 37509 - DNA, 201 bp, Homo sapiens
ccctcagccgccacaaacacatacatattcaagacacatccttctaataactacctagcttcaaagagctcaacaaggtttaacaacctttgggtgtgtgtgtgtgtgtgtgtgtgtgtgtgtgtgtatacaaaataagagtactagactggtaaatctatgtctctttggtcctccaaatatcctcaattctggaaaact

SEQ ID NO: 37510 - DNA, 201 bp, Homo sapiens
aaggatgttggcccgaatagaagtaatgaacaattagaattgagagaagtggtcagattctgaaaatgtttagcaaataaaatcgatgcaatgtgaattawgaagggaaataagacatagagaaggccaaagaggttgaatatcaccaggtattgctgctcttttgtacttggagtataggtattatttactagtatatgg

SEQ ID NO: 37511 - DNA, 201 bp, Homo sapiens
catagtttactttcatttttgactctgaggctctttccaacgctgtaaaaaaggacagaggctgttccctatggcaggtgagtccttttctgactaggagyttgggagtaggaacttagaaaacacttgatttattgctctgaaataaacacaagaaaggaagtgagccgatagcacacatgttgaattccttttcttact

SEQ ID NO: 37512 - DNA, 201 bp, Homo sapiens
gaatctttctatttctaacagaaggcaaccacagaaaaaagccacttaaggtgttggaatccctgggcaaagatttcctcactggtgttttggataacttrgtggaacaaaatgtactgaactggaaggaagaggaaaaaaagaaatattacgatgctaaaactgaagacaaagttcgggtcatggcagactctatgcaag

SEQ ID NO: 37513 - DNA, 201 bp, Homo sapiens
catcattccgtgactgcgtgtgagaagtatacttagcataaaatctactctcttaacaaatttcaagtacataacacaatgttggttactactggcaccaycctgtacaatagatttttatcacttttttcagcttctatcactgaaacttgtcatgtgttcatctatttctattatacggtgaaagacagtgtggcataa

SEQ ID NO: 37514 - DNA, 201 bp, Homo sapiens
ctggaagattaggaatcaggttactttcaattttaaattttcattgagaacaagatttgaaagaattataaatatggatgcactcatccatttattctttwtgtatttagcaagcatattaagtacttttaaacattttgaatacaaagatgtgggtataggatgtaagttaaaaaaatgcaaattcaaagatatagttct

SEQ ID NO: 37515 - DNA, 201 bp, Homo sapiens
tgtagtactttgtagtctattttgaactcagatagtgcgatgcctgcagctttgttccctttactcaaaattgctttgcctattcagggtttgtttttttktgtgtgattccatataaattttaggatttgtttctatttttgtaaaagctgccattagaattttgataggaattgcattgtatctttagatttctttggg

SEQ ID NO: 37516 - DNA, 201 bp, Homo sapiens
ttttccagtccatcaactcaaaatacatttctacttatttttgtcttcttcagttttccctatcaatattttatagttttgagatttgttattattgctgwtatttttgagacaggatctcattctgtagccaagactggagtatagtgtcacaattatagctcactataatctcaaattcctgggcttaagcaatcctcc

SEQ ID NO: 37517 - DNA, 201 bp, Homo sapiens
gcattttattgcaaggcaacctaaagccaatcaacccattttgaaatcagcccatcccccatggaagtctcatctctcagtcaggcatggggatgtttccrtatcttccaggtggcccagagcatgcttctctgacccaagtgtgcgaagagccaagtttccctctgaaaatactattagccatcccttaaagtatatttc

SEQ ID NO: 37518 - DNA, 201 bp, Homo sapiens
cctacctcagacttccaagaagcaaggactatagacacatgctactatggccagccaactttttaaatttcttgtagagacatagtctcaccatgttgatygggttgaagttttatacttttacgtgtacttgttttttacctactcggttaaattgatttctaagtatttttgcagcaattttaaatggaaatttattta

SEQ ID NO: 37519 - DNA, 201 bp, Homo sapiens
tagagaggttgatcatttttcatatacatattctctgtatgtcttcttttgaaaagtgtttattctggtcctttgcttatttctaaatcagtttattttcyttctattgaattgtttgtgttctttgtattttgcatattaattctttatcagatgtatggtttgcaaatcttctctaccatactgttgattatctcttta

SEQ ID NO: 37520 - DNA, 201 bp, Homo sapiens
caaagtgctgggattacagtcgtgagccactgcgcagggcctaatttacgttttaccaacagtgtacaagagtttctttttttctacatcctctccaccayttgttatcttttgtctttttggtaatagccattccaacaggtgcaaagtgatatttcattgtgacttcaatttccctggtggctagagaggttgatcatt

SEQ ID NO: 37521 - DNA, 201 bp, Homo sapiens
gatgatccctaaacaggaactccaagagtatcccttccaaactatcctcctattctctgtctgagaaatctcaaaattgtcctgattgaggacaagtctcstgaaccaagactcttcctactagttagagccaaccaagaccccagtggagccgaacagataccccgtggtggagctacaaacagacaccctgcaatgggg

SEQ ID NO: 37522 - DNA, 201 bp, Homo sapiens
tgctcttaacaaaatccttttaaatttcgtattacccaactttagccatgcggccaacatttctggcttttgaactttatcaaaagtaacttcccaggtgyttcaaaggtgtggtaagcagtttctttttacaagatttagaatttccccaaggtagtccagagaaaggaaaattcaagagaggaaatcagaagctatcca

SEQ ID NO: 37523 - DNA, 201 bp, Homo sapiens
tgcaaggcaacctaaagccaatcaacccattttgaaatcagcccatcccccatggaagtctcatctctcagtcaggcatggggatgtttccgtatcttccwggtggcccagagcatgcttctctgacccaagtgtgcgaagagccaagtttccctctgaaaatactattagccatcccttaaagtatatttcctacctagt

SEQ ID NO: 37524 - DNA, 201 bp, Homo sapiens
cgggagctgctggactatgtaaaaactcctgcagctcagtgcctgcccaaaaagctggaaatatgaactattgggttaattcttatcaggaaatgaaaaasagttgttagattaaacttcttcagtcattgtcgttctttgtaatcagagaaagaaaaactgagagatcaggaagagaagagacagatggatagaagaagt

SEQ ID NO: 37525 - DNA, 201 bp, Homo sapiens
agaagccagatcgcgtggttctatgttatcacatggtaaacctttaaaaattattatctgagcgagacaggaagcctttctagtgctttagaaaaaagaartaatatgctttaaattaggttttacaaagatcacattttggtgaatagactaagatgtcacagatggaagtcaagggaagtggcaagagcacatggaaga

SEQ ID NO: 37526 - DNA, 201 bp, Homo sapiens
gagaaacaaccgcacacgcctggctctcatcatatgcaatacagagtttgaccatctgcctccgaggaatggagctgactttgacatcacagggatgaagragctacttgagggtctggactatagtgtagatgtagaagagaatctgacagccagggtaagaatccctcagccgccacaaacacatacatattcaagaca

SEQ ID NO: 37527 - DNA, 201 bp, Homo sapiens
atagatttcttacactctgaaagcttatattctagtgagtagaaacagactctgaagacataaagtggtaaatatatcacaggccagagagcaaaaaaagrtaaaaggaaaaataaaggaagacaaaggaaaacacagaatgatggatgctgtactcctatagatatttcactcaaaagcttttcttgaaataatgaaatc

SEQ ID NO: 37528 - DNA, 201 bp, Homo sapiens
caattaacaacgtaaatagatttcttacactctgaaagcttatattctagtgagtagaaacagactctgaagacataaagtggtaaatatatcacaggccrgagagcaaaaaaaggtaaaaggaaaaataaaggaagacaaaggaaaacacagaatgatggatgctgtactcctatagatatttcactcaaaagcttttct

SEQ ID NO: 37529 - DNA, 201 bp, Homo sapiens
tgataatgagtctggaattctgagcagcagtttcacaatctgtaattacacgtttccgccctttgcaataaggaaatacatagtttactttcatttttgastctgaggctctttccaacgctgtaaaaaaggacagaggctgttccctatggcaggtgagtccttttctgactaggagtttgggagtaggaacttagaaaa

SEQ ID NO: 37530 - DNA, 201 bp, Homo sapiens
aatctttctatttctaacagaaggcaaccacagaaaaaagccacttaaggtgttggaatccctgggcaaagatttcctcactggtgttttggataacttgrtggaacaaaatgtactgaactggaaggaagaggaaaaaaagaaatattacgatgctaaaactgaagacaaagttcgggtcatggcagactctatgcaaga

SEQ ID NO: 37531 - DNA, 201 bp, Homo sapiens
gcagtgtgcagaaagttaatgtctccatagcaaaccgtggggaactgtgggtcagagactctccagcatccttggaagtggcctcttcacagtcatctgakaacctggaggaagatgctgtttacaagacccacgtggagaaggacttcattgctttctgctcttcaacgccacgtatgtatctttcagtggcagtaaggg

SEQ ID NO: 37532 - DNA, 201 bp, Homo sapiens
tagaaaatggtaaattcaagatgatttcactatcagtaggcacattgttgaatgacactggagagaaagaaaagtggtgtgtgtgtgtgtgtgtgtgtgtstgtttctctgtgtgtgtttgtatgtgtgtgggtctgtatgtatgaaactagtaagaatgaacattcaaaaagaacaaggtgggcaactgtgacagccatt

SEQ ID NO: 37533 - DNA, 201 bp, Homo sapiens
atgaaaatattaattcaagataacccagacaatgaggctggtgcttctgtgccaaagcttttgtgcaatgtcctgacatgatttctttagatgtcattttstgtcagcactatccttacacctacatggattgtataattatctttgtagcattgattgagaattgataagatatccagcatttctgtgtacaatctgccg

SEQ ID NO: 37534 - DNA, 201 bp, Homo sapiens
taacccagacaatgaggctggtgcttctgtgccaaagcttttgtgcaatgtcctgacatgatttctttagatgtcattttgtgtcagcactatccttacayctacatggattgtataattatctttgtagcattgattgagaattgataagatatccagcatttctgtgtacaatctgccgaaatcatatctgttgtattg

SEQ ID NO: 37535 - DNA, 201 bp, Homo sapiens
ttctattatacggtgaaagacagtgtggcataatctgcaaacaactttggagcctggtggcaattttttgttgcttactcactgtgtgaacatggggaagytccttcatctttctgtgcttctatttcttcctctgtaaagtgggataattctagttatttctcaagcccctataaaagctgagagaatgaacatgagttt

SEQ ID NO: 37536 - DNA, 201 bp, Homo sapiens
taagctttatgttatggagcgtaagttcttaagttttagagaaggaaaaatattttgaaataatttttatttcttaatttattaaatgaataaaatctggrtggtctgctaggtcatggatttcctcctggtgacagaggggtaaatgaggcctacatgacgtaatcctatctaggactcacattttcgtgggagatatgg

SEQ ID NO: 37537 - DNA, 201 bp, Homo sapiens
ctcctctgtagttttgctataatatttaagccaacagcctcctgtaaggtaaataacaaatcctaggatgaggagtacaattctcaattttaaaagcaaarattggaaagcattaatttggggacttctaatccacaaagaatttaggatttagtccaaactgtaggaaaaaactcaaacaaaactaacaatgggtatatt

SEQ ID NO: 37538 - DNA, 201 bp, Homo sapiens
gaaaagtctagacatgaaggatacttgggaaatataattaaagcttgaaaaacattataaatttatgtgttaaaaatagtaacaaaatagctatgcttccraaggcaaagacttttgctgtattcatttttcactggagtcaacgacaacatctcgttttgtatgaaatttgacctgaactttgaatgctaagaaagattg

SEQ ID NO: 37539 - DNA, 201 bp, Homo sapiens
agtattccagcaggtcataacgcttctttggcttcattctcctcacaggaaaaggaagaaattggactagatcagtgaattctaaaccttataacatatcrcagcaatctgtagtcatataaaaaaagtcagatgactacccccttcctcaccgcgaatagctcaatcttaaataccctgcaggcatttattacctttgaa

SEQ ID NO: 37540 - DNA, 201 bp, Homo sapiens
gtaacctcagctacttgggaggctgaggcaggagaattgcttgaactctggaggcggaggttgcagtgagccgaggttgcaccattgcactccagcctagrcaacagtgcaagactccatcttaaaaaaaaaaaaaaagaaagataagatactgggattaaattctccttcaattgaggaatcagccttggtgagtgttga

SEQ ID NO: 37541 - DNA, 201 bp, Homo sapiens
acaacatctcgttttgtatgaaatttgacctgaactttgaatgctaagaaagattggagtaggtgaagaagaaaagggagaagaaaaggcataggaattayctagtttcctcaagattcttaataacaatttcagatatgtccggttctttccctgggttcttgagagagagaaagtcagtgtcttttgatacaagttaga

SEQ ID NO: 37542 - DNA, 201 bp, Homo sapiens
caattagttgatgcaaaaaaactacaagatcagcttggtggtggagatatgaaagttgttcagtgtttgggtcttaaagataagatactggggctgggcayggtggctcacgcctgtaatcccagcactttgggaggcagaggcaggaggatcatgaggtcaggagtttgagaccagcctggacaacatagtgaaaccacg

SEQ ID NO: 37543 - DNA, 201 bp, Homo sapiens
ctagaaaatggtaaattcaagatgatttcactatcagtaggcacattgttgaatgacactggagagaaagaaaagtggtgtgtgtgtgtgtgtgtgtgtgkctgtttctctgtgtgtgtttgtatgtgtgtgggtctgtatgtatgaaactagtaagaatgaacattcaaaaagaacaaggtgggcaactgtgacagccat

SEQ ID NO: 37544 - DNA, 201 bp, Homo sapiens
caatcacagtccagaagttccttcaagctcccatgtaacttttgttattattttgaccaaaatattatagaatgggtacattgagtctggactaaatgatkactttcttcactcataatagctttatttaacactagactataagactattatcaatctccctctaagatacatacttaaaattatattttatagtgaaat

SEQ ID NO: 37545 - DNA, 201 bp, Homo sapiens
gactgaagttagacattgctcttttacaggatatggagtcagcgctgagggcatttgctaccagaccagagcacaagtcctctgacagcacattcttggtmctcatgtctcatggcatcctggagggaatctgcggaactgtgcatgatgagaaaaaaccagatgtgctgctttatgacaccatcttccagatattcaaca

SEQ ID NO: 37546 - DNA, 201 bp, Homo sapiens
ctgactttgacatcacagggatgaaggagctacttgagggtctggactatagtgtagatgtagaagagaatctgacagccagggtaagaatccctcagccrccacaaacacatacatattcaagacacatccttctaataactacctagcttcaaagagctcaacaaggtttaacaacctttgggtgtgtgtgtgtgtgtg

SEQ ID NO: 37547 - DNA, 201 bp, Homo sapiens
gtggagaaaatggcagagacaaattaggagaagcagtgagaagccagatcgcgtggttctatgttatcacatggtaaacctttaaaaattattatctgagygagacaggaagcctttctagtgctttagaaaaaagaaataatatgctttaaattaggttttacaaagatcacattttggtgaatagactaagatgtcaca

SEQ ID NO: 37548 - DNA, 201 bp, Homo sapiens
agttgaccagttagttaacactctctgcttatctgctagtgatctattaatgtaattaactttgctcagggacatacagtggctccctattgccttttctyttttttactatctgaactttcagacaattttttctaccttttgaaacatgtgtatccagtttttccattaatctttgtaaagcatgatttcaacttcata

SEQ ID NO: 37549 - DNA, 201 bp, Homo sapiens
taggagcatatatctctgatgctgtctcctctggaagaatcagagaggattcccttaagaaaataccatctaatctgatacttgaaggatagacagatagmcagatagacagagaacagttcaaaaaccagaagaaattagaagcgggggtgctgaaactatacagatccctaagtagagacttgattccctgagaaaggt

SEQ ID NO: 37550 - DNA, 201 bp, Homo sapiens
aatgtctgttttccactggaagagaattctaaatattctaaatatcaaggggcaggggaatgtggaatacattaccattttcttttttttttttaattaarctacatttttagtccaacttataacaggttatagtgagataagtaccacaaagcctgtttgattttgtgaaaggtctgagatacctagaagcatttcttt

SEQ ID NO: 37551 - DNA, 201 bp, Homo sapiens
tatgaagtttttggattcaaaagagaccgggaagcttggccccacactgttatgaggtgtgatctgctggtggtggggttctggctgggttttttttcctygcttttctctgcttattctaaaatttccacaataggcatgcattgcttttattttgaaaaatatatagatacctgtatacatggttttaaaatatatatg

SEQ ID NO: 37552 - DNA, 201 bp, Homo sapiens
cacacacacttgccgtcctgtggaagcgtggctctgcctgtcacgcacgtctgcgcttgccgtcctgtggaagcgtggctctgcctgtcacgcacgtctgygcttgccgtcctgtggaagcgtggctctgcctgtcacgcacgtgtgcgcttagtgcacatcactaagactctcctattcatgttgacaaaaaaatgccgg

SEQ ID NO: 37553 - DNA, 201 bp, Homo sapiens
  misc_feature (1)...(201): n = A,T,C or G, or insertion/deletion polymorphism (see Tables 1-2)
ttttgggtcaacaactgaaacacctttatcagtgcctaggagtgttcagggaccaacttgggtccaagcctacaaaggaaaacctgcagctggttgggtcncagtgagaggaaaaagggggagacctgaggagtctacagagggatgcaagggcggaaggaagggccgactttggagttgggcagcaggagggggtgtgag

SEQ ID NO: 37554 - DNA, 201 bp, Homo sapiens
ggctctgcctgtcacgcacgtctgcgcttgccgtcctgtggaagcgtggctctgcctgtcacgcacgtctgcgcttgccgtcctgtggaagcgtggctctscctgtcacgcacgtgtgcgcttagtgcacatcactaagactctcctattcatgttgacaaaaaaatgccggatcatggaaacacaagctggtgacagggc

SEQ ID NO: 37555 - DNA, 201 bp, Homo sapiens
caccctaacagcggtggcagggagttcccaccagggagcgccccaaaccatcccaagatggggctggttgggattccaaagaacaaagcactaaatgctgrgtgatcaatttaaagcatgtattaggggaacttacatactgagggctgcagtgtatggtcgcaacacacagcgggacagggcgttccacctaggtctgtc

SEQ ID NO: 37556 - DNA, 201 bp, Homo sapiens
aagaatgctgtctgtcagtgccccggcagggagactgacatgcagagcccttgggagtcactctgtcttcatgtggataagtttgagatgttttatcttgmgaaagatttgaccacttaggggttggagggtgtgtcctccagctgaagccccagctgcagtcaccctaacagcggtggcagggagttcccaccagggagc

SEQ ID NO: 37557 - DNA, 201 bp, Homo sapiens
aggtattgtgctgtgatggcggctaaagactgttaagtctgttccctgctgtgaagctggagactttttaccacccccctcgaggctgttttagtgaggcrctaagcatcccttatgccaccaggtccccagacagctctagaagataagacaccaaagagggtagctgtttagtgaatcgcattgctgttcagaaggatc

SEQ ID NO: 37558 - DNA, 201 bp, Homo sapiens
atctagtggctagaaaccagggtgctgctaaacatcctacaacacacaggacagcccctaacaccacagaattaccggagccaaagtatcaatagtgctgrggttcagaaagcctgctttaagtaaataaactggtttcttgttgcttatttacggtaaagataattcttatgcaacttgtcagtaaggttattaaaacaa

SEQ ID NO: 37559 - DNA, 201 bp, Homo sapiens
  misc_feature (1)...(201): n = A,T,C or G, or insertion/deletion polymorphism (see Tables 1-2)
tgccagaccttctccactttgaggtcaaatgtttatattccccacactgcagtcttactgaacacaaataatctgtggtataaaaagacccaaagtgggantgtgtttttctcagttactggaaaactgcatttaaatctggttctcagctgggggcagttttgtctcctaggggacatttagtaatgtctagagacattt

SEQ ID NO: 37560 - DNA, 201 bp, Homo sapiens
  misc_feature (1)...(201): n = A,T,C or G, or insertion/deletion polymorphism (see Tables 1-2)
gtggttggtgcccaggcaggcagtgtctgctgttggaggagagtgcatagctctccctttattgaacgtgtgtatttgcctcctgctgcagaacttgtctnagtgaacaaatgaataataaagatttggaatcccagagtgtgtggtgtgcagcagaccaggagcctagctggagagtgtggtgtgtacctggggcttcct

SEQ ID NO: 37561 - DNA, 201 bp, Homo sapiens
cctgagacctgcccagagtgtaggatcatcaagacctgggcccccctaccccgctcagagccctggtgggtggttggtgcccaggcaggcagtgtctgctrttggaggagagtgcatagctctccctttattgaacgtgtgtatttgcctcctgctgcagaacttgtctaagtgaacaaatgaataataaagatttggaat

SEQ ID NO: 37562 - DNA, 201 bp, Homo sapiens
tagcagtgagcagggcatacaaaacagacacagcacaggggtgacgttgctttatagcaaccagctctcacctctcacaatagctcatcagtcctgagagmgcggccactcactcctgcggattcattccttcgtcaaggcggatccctcatgacccaaatgcccttcaaagctccctgtacctctcaacacagttatact

SEQ ID NO: 37563 - DNA, 201 bp, Homo sapiens
  misc_feature (1)...(201): n = A,T,C or G, or insertion/deletion polymorphism (see Tables 1-2)
aatcacaacattaaaaatgtagatgcgcagctgggagaagcaaccccttatcccagggactctcggaaacgctgcctttctttgtcctgtgtaggacgccnccttaggtaattattgattcaggttgttggtggcgccatttgaagtctcttcccaggccacaagcaggacaggttctccagggtagggagatgtgcctag

SEQ ID NO: 37564 - DNA, 201 bp, Homo sapiens
gactgcagtctgcaattcggtctgactctgctgtgaaaccctgttcttaaagctaacttggcgctctactggcaaccccgattgctgttttaaaagcagargatcagcataaaaaaagagaaggaaatcatgaactaggtgaaaaaacacatttttcttcatattctcaaaatgagagggaagcagaagtctgtggctaag

SEQ ID NO: 37565 - DNA, 201 bp, Homo sapiens
ttttcttttttttttttaattaaactacatttttagtccaacttataacaggttatagtgagataagtaccacaaagcctgtttgattttgtgaaaggtcygagatacctagaagcatttctttgtaagaccttgaacctcatagctcactcatgaagaatatttttattttattttcattcttttttgagacagggtctt

SEQ ID NO: 37566 - DNA, 201 bp, Homo sapiens
gtgagataagtaccacaaagcctgtttgattttgtgaaaggtctgagatacctagaagcatttctttgtaagaccttgaacctcatagctcactcatgaaraatatttttattttattttcattcttttttgagacagggtcttgcccgggctgaaggacagccgcacaatcacagctcactgcagcctccacctcctggg

SEQ ID NO: 37567 - DNA, 201 bp, Homo sapiens
  misc_feature (1)...(201): n = A,T,C or G, or insertion/deletion polymorphism (see Tables 1-2)
tgctgggtttaagtaaaaagatttgtttttaattgtgtccttaatgctagtgaccttttctgctgtaccttcctctgtagctacccccaaatacttgtacnaaaagtagggtgcacactagcataaaaatacaggtttttatatagtggaggtatagacagtatgggcttcagaggtcccgctcaagcctccccctgccac

SEQ ID NO: 37568 - DNA, 201 bp, Homo sapiens
  misc_feature (1)...(201): n = A,T,C or G, or insertion/deletion polymorphism (see Tables 1-2)
aggatgaagtgaggtcatttaatgacaactaagcacaatgccaggcccatgaaaggcatacggtaaattacacgtacacatcctcatcaactgtgaagacntcaactcgtttcattttagaatgacttggcaaagtagagcgctgggttcccccggcccccattctgattgatttccagtgcacagacggctgggggattc

SEQ ID NO: 37569 - DNA, 201 bp, Homo sapiens
  misc_feature (1)...(201): n = A,T,C or G, or insertion/deletion polymorphism (see Tables 1-2)
ttcattttagaatgacttggcaaagtagagcgctgggttcccccggcccccattctgattgatttccagtgcacagacggctgggggattcagtgccacantgttactggatttctcactctgaattttcagatggcatctggaatttttatctcacaagtgccacctctttctaaaagtagacataaaacaaacacaaac

SEQ ID NO: 37570 - DNA, 201 bp, Homo sapiens
  misc_feature (1)...(201): n = A,T,C or G, or insertion/deletion polymorphism (see Tables 1-2)
atgcggtagcctgtacgcctgtgtgctgacacaatggtcggaattgtttcatctgtgtgtttccaggtggcttgataatgtacaatgatttcagttccagngaagaagaaggagccattcgatactcagtccactgcacccggctatacgagaactcttttaatagctaagttttccaggcgatgtagtatgaaaatcaaa

SEQ ID NO: 37571 - DNA, 201 bp, Homo sapiens
acctcatggagggcaccctgagctggtgccgggaggcctctgtgtcctcatctgcagttctaaagccgtgtgacaggatgatcgagcatccaggcgccttscacacctccacttctgtcctgtgttaatctaactttatggcggaggggcccctgggggggtctctgaaccaaaggtgggataattagactgagcagagga

SEQ ID NO: 37572 - DNA, 201 bp, Homo sapiens
  misc_feature (1)...(201): n = A,T,C or G, or insertion/deletion polymorphism (see Tables 1-2)
tcctgccaatcctgggacgtggtcattcaggaacagaggactagtttcctgttcagcagagcccaacctctcctgtggttcagaggttgccatctgtttanatgccccaaataacgaatttcacctgatgatcgaaacagttgacacaggatgtgctgaacagctctacctggatgcccagcttggccccagaactctgag

SEQ ID NO: 37573 - DNA, 201 bp, Homo sapiens
accaccttgcagtgggttagaaacaatgcacatggttactgtttttatcatcgtaacattagaggtaacaggcttgtcagtggacgctgtagctctgcgcrtctgcccctccgctagccccagaacaaggcctggctttcagccatcttggggttctggacatggcccaacacagaacatgaaagaatgctgagtgaagaa

SEQ ID NO: 37574 - DNA, 201 bp, Homo sapiens
ctgcctcccgacacatgagctttcctctctgcccagggtttgtttcacaagggccgtgtcatcctaagctctgtgcaaaaagcctggtgttcagcgtcacrggtcccagtgacttctgtaactgggcagcagccttgtctgcagagggggagaccgaggcaggggcagcaagtaacatgctcacacagccagtcaccaaac

SEQ ID NO: 37575 - DNA, 201 bp, Homo sapiens
ctgggggtgtaaggtgggagcaccctgcagacttccccaggtcgcctggggtgcttggtccaaagccctcgtggtggggacaaggctcagtacctgagacrggagggggcgtggccgtcacgcttttttaggggtttccactcttgggatggctgcctgagaatcacccgccgggtttttgagaagtagatttccagcaat

SEQ ID NO: 37576 - DNA, 201 bp, Homo sapiens
gtgttgttcctcttcccaaggaatgccctgaggaagagcccacttaggcccctctgcctcccaacgagaagcacccactcaggcccctctgcctcccaacragaagcacccactcaggcccctctgcctcccgacacatgagctttcctctctgcccagggtttgtttcacaagggccgtgtcatcctaagctctgtgcaa

SEQ ID NO: 37577 - DNA, 201 bp, Homo sapiens
cagagcacattctgtcttcctcagtttcccccgcaacaagacgagcccctgccacatgtggcgctgtcctggaagtgttgttcctcttcccaaggaatgcsctgaggaagagcccacttaggcccctctgcctcccaacgagaagcacccactcaggcccctctgcctcccaacgagaagcacccactcaggcccctctgc

SEQ ID NO: 37578 - DNA, 201 bp, Homo sapiens
tctgcaccaggttaatgttagaaacttcagcttctccctgcacatgattctccctcagccggggaatgtcctgtattcctgccctagctgtggctttcttyagtcagaggtgaattgtagtggcgatgcttaggccctttgggcgtggccagattgacttccatgggaggcagcagggaaaggtgggcagaaacacctggc

SEQ ID NO: 37579 - DNA, 201 bp, Homo sapiens
tttatgaaaaaaagggaacatttctaatcggatatgttttccacaggtggttcctccccagaaatattaaatcacaaaggatataaaattctgttttaagyggcggcctgcagaatctctttttcctttcttctgcaccaggttaatgttagaaacttcagcttctccctgcacatgattctccctcagccggggaatgtc

SEQ ID NO: 37580 - DNA, 201 bp, Homo sapiens
  misc_feature (1)...(201): n = A,T,C or G, or insertion/deletion polymorphism (see Tables 1-2)
ccagagaggcgcccggactcacagtggccctttcctggacccttcccaggggcggagggccagagaggcacactccgattatggtccatctttatagtaangctgggacacaggcattgtcatgccaactccataactgatggccagggagtgtaagtgatgtcaccaaggccagaagccacagagaggcaccaagatccc

SEQ ID NO: 37581 - DNA, 201 bp, Homo sapiens
atagcaatgttgttgaaaacctgtggttatgtaaatatcctcagaactctttgtgctggagtaatatgaaatctcgatggctttggcagcagccttccaayaggtctgcggggtgcgggtgaaggtgacctttccaacatcaaggagaagggccagagaggcgcccggactcacagtggccctttcctggacccttcccag

SEQ ID NO: 37582 - DNA, 201 bp, Homo sapiens
ttgtctctggaacgccacgtttgggggataaaactcatagaaatactgaaatatagcaatgttgttgaaaacctgtggttatgtaaatatcctcagaactstttgtgctggagtaatatgaaatctcgatggctttggcagcagccttccaacaggtctgcggggtgcgggtgaaggtgacctttccaacatcaaggagaa

SEQ ID NO: 37583 - DNA, 201 bp, Homo sapiens
ggcacttgtgtaaaaaggtgtaaagaaagctgcttttatgaaagcagacgtttcccaaaggacttgaccccctccccaagtatttccgcagggatggtgtrgctatgcagaggtgagggtgcttccctgaagtgctttggtgagaatttgctcacctggcgaggggtttgcttaccagttcatcttaacctaattaagttt

SEQ ID NO: 37584 - DNA, 201 bp, Homo sapiens
cttcttgagtacagaatgcgctcagagcaagaggtagaatgggtgatggcacagcctgaggccacataaacacatcagctctcgtgagcatcgcgagtccygcatggcacagaagcagggtctgcatggccccccgttgattctgcgccgactccctactttgcaggcactgctgcgccctgcactgctggactcgtttca

SEQ ID NO: 37585 - DNA, 201 bp, Homo sapiens
  misc_feature (1)...(201): n = A,T,C or G, or insertion/deletion polymorphism (see Tables 1-2)
ttctagaggcagccaatttcagctgcctctctctgcttacctacgtatttccatgtttcttggttcatcatctgaacgtcatcagctgtgctcctcttacngaagaggggacctggctcccttccaccccgacattgcccacccctcctcctcctcagttataccagccatgcttctgcccttcactttccagccaagaaa

SEQ ID NO: 37586 - DNA, 201 bp, Homo sapiens
  misc_feature (1)...(201): n = A,T,C or G, or insertion/deletion polymorphism (see Tables 1-2)
ttccagccaagaaacaaactttaattatgcaccctcaatagatacatcttgttttttcccgggtaagtaaacatctcttttcctctttttcacatttccgncaaagttcttccttccctgcaccgtggtcgccatcctgccctgccccacccctttcacgccatcagcctcactccgcccactgcgcggcttggccccaga

SEQ ID NO: 37587 - DNA, 201 bp, Homo sapiens
gtctttccccagatcccctgtcgcctgttaggtgagcatccctgtcctgcactgggcttagtgtccccacgggttaagctgcgctgtcctgcacgggggcytcaggaggagtctctttatcagtgaggatgagaaaagagacctgggatccgaggtgcggcagagggaatgtagctaacagtttgtgataaaagactcaac

SEQ ID NO: 37588 - DNA, 201 bp, Homo sapiens
gatatttgcattacactggttgagcatctcaaatcccaattctgaaatgccccagtgagcatttcctttgagtgtcagcactcaaaaagttacaaattctrgagattttggatttcaggttttcagatttggaaggctcaacctatactaggccttgtacccgctcccaatctgataggccaggatgaggtagtgtagttc

SEQ ID NO: 37589 - DNA, 201 bp, Homo sapiens
ccccagaaggctgcgggaaaggtgcaagggtttatccagcatccagcacccctgcaggagaggaatccctgctgggccgggagggcagctggctccccatrggatttgcacatggtgtgtgaagttcagcatctcttgctgagccactgctggctgttagagcagctcttctttcaacctttctttcagatttaaggaaca

SEQ ID NO: 37590 - DNA, 201 bp, Homo sapiens
ccttctgcacctggctttcctgaaagaaagaaaacgcgtggcttatcttttcacggcacgccaccttcactctcactttttcttttctaataaatacctcyggatgggttagtggtaatctctcctcaaaccctgagtggaaaatgtgagggaattgccgtctttggcattctgttggagctgcagccccccgagctctcc

SEQ ID NO: 37591 - DNA, 201 bp, Homo sapiens
cttctgtcctatctgccttctgcacctggctttcctgaaagaaagaaaacgcgtggcttatcttttcacggcacgccaccttcactctcactttttctttkctaataaatacctctggatgggttagtggtaatctctcctcaaaccctgagtggaaaatgtgagggaattgccgtctttggcattctgttggagctgcag

SEQ ID NO: 37592 - DNA, 201 bp, Homo sapiens
ctccaaagtgccttctgtcctatctgccttctgcacctggctttcctgaaagaaagaaaacgcgtggcttatcttttcacggcacgccaccttcactctcrctttttcttttctaataaatacctctggatgggttagtggtaatctctcctcaaaccctgagtggaaaatgtgagggaattgccgtctttggcattctgt

SEQ ID NO: 37593 - DNA, 201 bp, Homo sapiens
cagggtcagctacgggggaccaagttccgtaagtcccactcgggccctgtctccgtgcgtgaaagccggctccaaagtgccttctgtcctatctgccttcygcacctggctttcctgaaagaaagaaaacgcgtggcttatcttttcacggcacgccaccttcactctcactttttcttttctaataaatacctctggatg

SEQ ID NO: 37594 - DNA, 201 bp, Homo sapiens
caagcacctaagaaaatagaagagtttctgccttctagagctctggcctgaggcttggtggtggggccatgtgtttggtttttaagtagcccctcgagacyctccagcaccccttccctgcctcccctggaccagtgatccaccctgggtctgagggcatctgctgccctctaagaacgaggggccacgtccagggagagc

SEQ ID NO: 37595 - DNA, 201 bp, Homo sapiens
aatagacaagtgtttcctcccgagtctggagctgagaacctccatgatctgagcaggtgtcctggggggccagagggcaccatgcttcctgcctcacaacrcacactgatggccagctccagggcctgcaggactgcctggcgcacgaccgaaggcctcaggtctccagtgcgtgtcgcctgggctcctggagttggtagg

SEQ ID NO: 37596 - DNA, 201 bp, Homo sapiens
tttcagaaatatcaactcactcaattaaatgaaagtcttatattttaattccaggaaattctaaaactcaacttccccaccacatacaaaatcaaataccractctcaacctatgaacttactaggtttaaatggctgttctttggatcatctgtgggttcttttaatgcctgaatgttctaatgaagcctccagatggat

SEQ ID NO: 37597 - DNA, 201 bp, Homo sapiens
cagtgctagcttcaggactgaatatggctgcagtgatatttgttcgcctcataccatgtttaaattttttttgaaattcgttttctccatttagaaattcrggttcatagaaaaatggggctccctgccttcactggaaaaacggaaagcctggcaccctgggcctgcccccatgtgacaggttggggaactgaggccctg

SEQ ID NO: 37598 - DNA, 201 bp, Homo sapiens
ccccccatgtcatgtgtgaacacaggacagacaagaggagatgaacagtgcttaagggaaggagccgttgagtggggaaattggaaccctggctgagaggmagcggggatggtccaggagcacgtggagggctcttcgccccgggagccagagagagcgagaggaaggagaagacacacgctgggccgtcagggaggggca

SEQ ID NO: 37599 - DNA, 201 bp, Homo sapiens
ggagatgaacagtgcttaagggaaggagccgttgagtggggaaattggaaccctggctgagaggaagcggggatggtccaggagcacgtggagggctcttygccccgggagccagagagagcgagaggaaggagaagacacacgctgggccgtcagggaggggcagaatccggcaatgtctcaaagaggaggcctttgaga

SEQ ID NO: 37600 - DNA, 201 bp, Homo sapiens
cccctgtgcatggcttcatgccaaaggtgatatattccaaccaattagaacagtgccaggcacagagttgatgcttaataattatttgttgaatgagtgaytgaatgattggtcagtggctgctggagctccagccattacatctgtattccagccagcaggaaggagggaaaggacattagggacaggccccttcccttt

SEQ ID NO: 37601 - DNA, 201 bp, Homo sapiens
gcatgccagctggactcaggggctcatgcctgttatccagcactgtgggatgctgagttgggaggatcgcttgaggtcttcttgttatgaagaccaacccrggcaacataacaagacccctctctacaaaaaaaaaaaaaaaagcatagctgggtgtggtggctcgagcctgtggttccagccttgggaggctaggatggg

SEQ ID NO: 37602 - DNA, 201 bp, Homo sapiens
gggcaagggggatgaacaagcagtttacagacacggaattcagatcgccaggaaatatgtgaatggtgttcgagtctgccggtattccatatgcaaattakggcaacactgtgctcagtggctggcacagcattgcccagggcagtaagcgctattcactggtcgtgaggggagaggagttttcatgcgttcttgatggga

SEQ ID NO: 37603 - DNA, 201 bp, Homo sapiens
ccagcatgccagcaacacagtgacaataaatggacttaaactcatcagttaggagcagagattgtcaggttgcttttaaaaatacaggcactggttatttrcaagaaacacacctgctacactggaattccgaaaagacaaaagtaaaagaatgggaaactacacgacaggtaaataataaccagaggaagccggatttgc

SEQ ID NO: 37604 - DNA, 201 bp, Homo sapiens; identical to SEQ ID NO: 9659

SEQ ID NO: 37605 - DNA, 201 bp, Homo sapiens
gcctgtccccgctccccatcttccgggctgggagggaggcgggaccggccgcgtctccatggcgacgcgggacgcggcggtggaggcggttgctacccacytgctagaggcgctgcggctgtgatccaggctggggcgagaccatgtcggacctgggctcggaggagttggaggaggagggagagaatgatattggggtga

SEQ ID NO: 37606 - DNA, 201 bp, Homo sapiens
  misc_feature (1)...(201): n = A,T,C or G, or insertion/deletion polymorphism (see Tables 1-2)
tgtttccaggtcagcctccctaagcacctcccaaggcctccaccccacagtgtcgcacagaacttgacacataccagatgctccaattattaaatattacngagtacttttagaaaattgggaacatacaataaagtataatgaagaaaataaagaaaaccaataatctcacttcccaaagataataactactgccatttt

SEQ ID NO: 37607 - DNA, 201 bp, Homo sapiens
accttcttttcttctttcttcctcacactcatgctgactctttcggctgcttttctcccagccaaactgagcgaggggctttgtaccagtgtttctgtcaytggcctattgagagcctgccagcgtcactgcctttttctctttgagggccgtgaaatatttatatgtctgccttgcttgtgtgcttctgaaaagttgcat

SEQ ID NO: 37608 - DNA, 201 bp, Homo sapiens
aagccgagtgtttggtagatgaaggtggctcggtagacccaggtcagccagaacctggtgctggagccttcccactggctcgtgcagggagctgatgttgytcttggctgcccctggccttggtgccagcaggctggaaacatcacagcacgtttctgggtgcccactgctgtctcagtgatgcagaatgcaaagccctcc

SEQ ID NO: 37609 - DNA, 201 bp, Homo sapiens
cccagacagttagaatcgcagccggggcccaggcggctgactgcacagtgaggagccaggccggacaggccccaggcgcccccgcccagccctgggtggcrggaaccccagctccacgctgctgctgctgcgtttccttgttctgcgtttccttgttctggccttgttctgagaagcggcgggcagggtggccgttgccat

SEQ ID NO: 37610 - DNA, 201 bp, Homo sapiens
gggagcctttcttcatccaccgtcctggggcacctggtggcaccttcagtctggaaacacctgcccttcactttaggggaattgggcccctgttcgtttgmtaagttttcctaccattttctgatttgttttttctttctggaaaatgtattagtcagatgtaggcttttctggattaatccttcaactttcctttctttc

SEQ ID NO: 37611 - DNA, 201 bp, Homo sapiens
  misc_feature (1)...(201): n = A,T,C or G, or insertion/deletion polymorphism (see Tables 1-2)
gaagttctgagaattaaaaaaaaaaacatacaattgctcctgggattataaaatagtaagtgcactttgtgaacacttgaaaaaaacaagtgcctagggcntgaaagaccctggttatcttacctctcagagttgaatatgtcagttcataggttggtggaaattcttcatgctttttcccatgcatctaccaaaacaggc

SEQ ID NO: 37612 - DNA, 201 bp, Homo sapiens
  misc_feature (1)...(201): n = A,T,C or G, or insertion/deletion polymorphism (see Tables 1-2)
acactggaggctgtgttagctgtcagcccttctgtgtccatcttccaaaactacgtgcccttcggtgggaggatttatcatctttagaagtcagtgatggngcagttcatgttgcttgggggtgtggagataacacatgagtagccgaccatgtttacctggaagttctgagaattaaaaaaaaaaacatacaattgctcc

SEQ ID NO: 37613 - DNA, 201 bp, Homo sapiens
cctctgaggatgctcagtggagcagggaacactggaggctgtgttagctgtcagcccttctgtgtccatcttccaaaactacgtgcccttcggtgggaggwtttatcatctttagaagtcagtgatggcgcagttcatgttgcttgggggtgtggagataacacatgagtagccgaccatgtttacctggaagttctgaga

SEQ ID NO: 37614 - DNA, 201 bp, Homo sapiens
gatcaggagggtccttcctacatgggggacgttatggggggctgcctggtgtggctgtcacagctaataaggaggacctggggtgccaacctgtgtgtcasttgctgcgtgggggtctccagtaaagccgagtgtttggtagatgaaggtggctcggtagacccaggtcagccagaacctggtgctggagccttcccactg

SEQ ID NO: 37615 - DNA, 201 bp, Homo sapiens
aactgcatctataacattgggtgggccggcttcttactatacgagcagatgagcaggggacatcggcacacagagatggtcacgcatgcctgggtggcttsagagagacgggcgtgtgactagctgtgcgtgtccaggttttcacccgaggcagtggttggcaaactacagcccgtgggctaactcaggtccactcattat

SEQ ID NO: 37616 - DNA, 201 bp, Homo sapiens
accctcacgatgagttgttttgcagagcagtttgagtaaatggtcatacagaggcttaggtttacttctcatgctgtggcgataactgcacgtctgttttycctctcttctaggggactcataaaagtctgaaaggcaacgcgcacgccctctccaccgtgacggccatcattgacgggacgggctctgtaggtgcgcaga

SEQ ID NO: 37617 - DNA, 201 bp, Homo sapiens
aaaagtggcctccattactgttagtaaaactgcatttgcagaagcacgtttttggcagctcacctacacctgtggtctccagccttcccgcacctgccccsctgctcacccttctcctaaaatcatgggcaggttggtgcaaaactcaccgttcagcacaacaaaaggctcttgggcgccatcctcatgactcaggcgcct

SEQ ID NO: 37618 - DNA, 201 bp, Homo sapiens
  misc_feature (1)...(201): n = A,T,C or G, or insertion/deletion polymorphism (see Tables 1-2)
gagcgagaggaaggagaagacacacgctgggccgtcagggaggggcagaatccggcaatgtctcaaagaggaggcctttgagaatgggggaggctgaggancacagaccacctattctggggatgcagatcccaccagaggaggatgctggcagcacgaggctggagactgaataccctgggagggaagttgaggaggcgg

SEQ ID NO: 37619 - DNA, 201 bp, Homo sapiens
taaagtagagcccttggctagtttttggggacagtgtttaattatagcagaacagcccagtgatgacggcagagtcacgtgaccgtggagcagctgcatckcgtgtgacatgccgggactcagtgacgtggcccacgtgctgccagctgtaaatcagggtgtctagctccgattcaaaagccctggccttttgaaagtggc

SEQ ID NO: 37620 - DNA, 201 bp, Homo sapiens
ctaggttaagggatggaccctttctggctcccagacagctccccatcccctgtcccacattgtccccctttaggtaaccgtgactctcacctctagccgcrtggattcgttgcccatgcttggacttcctatgagtggaatgctgcagtctgtactctttcatgtctgcctccttctgcttcatgttatgtttgtgaggtt

SEQ ID NO: 37621 - DNA, 201 bp, Homo sapiens
tgtaccccttcttccttgtggacaggtggtcaaggatgacaggcagtcggctttcagcttggagctcttagaactaaaactgctcccgaggctcgtcttcyggtggcatatgaagatggcttatgttcgtcacgtgctcaggagtggggttgctggagagtcctgctgaaacgtcaccagcaggcattcttgtgggtcctg

SEQ ID NO: 37622 - DNA, 201 bp, Homo sapiens
tgcacaatggggattttatctcatctgaatgacgcctgtattatatttagtgattatttgaaactgcggtgacttcattttcctttgcaagaaactgaacygaaaatgcaccgccttgttttctatgtggaaaaccacgcgtttcactaagtacaccccgatttcgggaacagatgctttgtgttttatagccgtgctcta

SEQ ID NO: 37623 - DNA, 201 bp, Homo sapiens
gtagaagaggctgtagcactggctgccaaggcaggggcagctgccaggcccaccagagaccacgggcagtaggcaggtcacttcccagggtggggggggggctgaggtgggagcacaacctaggcccctcctggggaggtggtggagtcagaatcacgtaagagccaaagttccagtccctcagtgccggctccattgtcc

SEQ ID NO: 37624 - DNA, 201 bp, Homo sapiens
catttgagcatagctgaggtattttccatctgcaaacagccagctctgagacacacacacttgccgtcctgtggaagcgtggctctgcctgtcacgcacgkctgcgcttgccgtcctgtggaagcgtggctctgcctgtcacgcacgtctgcgcttgccgtcctgtggaagcgtggctctgcctgtcacgcacgtgtgcgc

SEQ ID NO: 37625 - DNA, 201 bp, Homo sapiens
tgacaaaagtggcctccattactgttagtaaaactgcatttgcagaagcacgtttttggcagctcacctacacctgtggtctccagccttcccgcacctgycccgctgctcacccttctcctaaaatcatgggcaggttggtgcaaaactcaccgttcagcacaacaaaaggctcttgggcgccatcctcatgactcaggc

SEQ ID NO: 37626 - DNA, 201 bp, Homo sapiens
  misc_feature (1)...(201): n = A,T,C or G, or insertion/deletion polymorphism (see Tables 1-2)
cctgggagggaagttgaggaggcggtctggggactgtcccacagcctagcagggacagggcctgccccaagggccagtgactggggaggcagcaaggagcncccttggatcctgaggttccttccctgccttgtgacccccgcctcactttggccagtgagctgcacacagctgggccttctttctcccttcttcccctgt

SEQ ID NO: 37627 - DNA, 201 bp, Homo sapiens
tcatttgagcatagctgaggtattttccatctgcaaacagccagctctgagacacacacacttgccgtcctgtggaagcgtggctctgcctgtcacgcacstctgcgcttgccgtcctgtggaagcgtggctctgcctgtcacgcacgtctgcgcttgccgtcctgtggaagcgtggctctgcctgtcacgcacgtgtgcg

SEQ ID NO: 37628 - DNA, 201 bp, Homo sapiens
  misc_feature (1)...(201): n = A,T,C or G, or insertion/deletion polymorphism (see Tables 1-2)
attgagctggtttaactggagcacatggtgtggctaaaattgtccgtgtcctcctttgggcaagaccatctggagaggccggggtctcctctccccagtgngaggcttgccattctgtgggtttcactgtgagctggaagtgtgcaagcctggtctggggcagtggccctgggcactcagtggagaagccagatgtgacct

SEQ ID NO: 37629 - DNA, 201 bp, Homo sapiens
ttcatttgagcatagctgaggtattttccatctgcaaacagccagctctgagacacacacacttgccgtcctgtggaagcgtggctctgcctgtcacgcaygtctgcgcttgccgtcctgtggaagcgtggctctgcctgtcacgcacgtctgcgcttgccgtcctgtggaagcgtggctctgcctgtcacgcacgtgtgc

SEQ ID NO: 37630 - DNA, 201 bp, Homo sapiens
ggtttttgagaagtagatttccagcaatctcgcactgcttgcagccagccatggctttgaccttgtgtcttgatgtccacagctctacatcttctccaccrtcagcaagatggggcttgaggccaccatcggtgagtatggaggccttcctgcttttcttccacacacgtttttaaagttcacacagctggcaagatgaaa

SEQ ID NO: 37631 - DNA, 201 bp, Homo sapiens
aagatgctcccagcaaaaattgctaaacaatgtatttagagaaggaagatagatccagaaggaaagtctgagatgcaaggagaaatgcaagcaaaaaaaaagtgatattcctaaggatgaatctaaaggagtattgaccatataaaataggggccagctaactgtggcctatttttgtgtgatcctccagctgggaatggt

SEQ ID NO: 37632 - DNA, 201 bp, Homo sapiens
tgagttccttggttcctttttatccaccatcagaacattatttgaaattcatttccaggttctcagaacaaaccgcctcaagggtagatactccacctcaytccccctcttcctagtaacactgctggtgggggcccctgcttgtatcagacgtgcagctttgatcaggactgggtactgctactgtacgtgtgtggttac

SEQ ID NO: 37633 - DNA, 201 bp, Homo sapiens
ccaaagatgctcccagcaaaaattgctaaacaatgtatttagagaaggaagatagatccagaaggaaagtctgagatgcaaggagaaatgcaagcaaaaamaaagtgatattcctaaggatgaatctaaaggagtattgaccatataaaataggggccagctaactgtggcctatttttgtgtgatcctccagctgggaat

SEQ ID NO: 37634 - DNA, 201 bp, Homo sapiens
  misc_feature (1)...(201): n = A,T,C or G, or insertion/deletion polymorphism (see Tables 1-2)
gcctgaggacttggcagtcagactcgcaaatcaggagctcaagaaggcagccccttggctgggtaggagctcaggaaggctgcccttggctgggggtgtanggtgggagcaccctgcagacttccccaggtcgcctggggtgcttggtccaaagccctcgtggtggggacaaggctcagtacctgagacgggagggggcgt

SEQ ID NO: 37635 - DNA, 201 bp, Homo sapiens
catttaaaaacacatcttgacataatttcagactttgagaaagttgcagaaatagtacaaagaattcagacattttagtacatgtggttcatcatgcaccygtgtttttacacacacacatgcacacacacatatatgcacacacacatgcataatttttctgaaccacttaagagtaagatgcacacatgctgccccttt

SEQ ID NO: 37636 - DNA, 201 bp, Homo sapiens
  misc_feature (1)...(201): n = A,T,C or G, or insertion/deletion polymorphism (see Tables 1-2)
cccaacacagaacatgaaagaatgctgagtgaagaaatgcttgggtgggccccttgctgccactggggggtgggcagcctgaggacttggcagtcagactngcaaatcaggagctcaagaaggcagccccttggctgggtaggagctcaggaaggctgcccttggctgggggtgtaaggtgggagcaccctgcagacttcc

SEQ ID NO: 37637 - DNA, 201 bp, Homo sapiens
ccatgcttctgcccttcactttccagccaagaaacaaactttaattatgcaccctcaatagatacatcttgttttttcccgggtaagtaaacatctcttttcctctttttcacatttccgacaaagttcttccttccctgcaccgtggtcgccatcctgccctgccccacccctttcacgccatcagcctcactccgccca

SEQ ID NO: 37638 - DNA, 201 bp, Homo sapiens
cctctcatgcctcctgtcccccgacccctcccttggcacctgcaggcctccaccaggctccctctgccacgtgcacagctgctgctggtttagcatgggcygcgcgcaagctgctcctctctttggggtgcccccttgccccagacaagctcctgcccatcctttgggatccgcaacacctccccaacctcttaggcatcg

SEQ ID NO: 37639 - DNA, 201 bp, Homo sapiens
acacgtttttaaagttcacacagctggcaagatgaaatactaaaatcaacaggcgcattgagctggtttaactggagcacatggtgtggctaaaattgtccgtgtcctcctttgggcaagaccatctggagaggccggggtctcctctccccagtgcgaggcttgccattctgtgggtttcactgtgagctggaagtgtgc

SEQ ID NO: 37640 - DNA, 201 bp, Homo sapiens
  misc_feature (1)...(201): n = A,T,C or G, or insertion/deletion polymorphism (see Tables 1-2)
gccttccctgggccccaaagcctgcagacagtcccccactgtcctcctcgccagccagcatccttccatctggcccgtgctccactttcctgacaagcccncttcattccctctcatgcctcctgtcccccgacccctcccttggcacctgcaggcctccaccaggctccctctgccacgtgcacagctgctgctggttta

SEQ ID NO: 37641 - DNA, 201 bp, Homo sapiens
tgggatgctgagttgggaggatcgcttgaggtcttcttgttatgaagaccaacccaggcaacataacaagacccctctctacaaaaaaaaaaaaaaaagcwtagctgggtgtggtggctcgagcctgtggttccagccttgggaggctaggatgggagaatggcttgagtctgggaggttgaggctgcagtgagccatgat

SEQ ID NO: 37642 - DNA, 201 bp, Homo sapiens
tcgcaaggcgcatgatctctgagttgattcactgctcaggggaacagggttccccaaggtctcatatcccctgagtgggcccagcccaagagggtcaggcygtcacctgggggtggttttattgtctcccgtccctccccagggccctgactctgcacttgaacagcttccctcagaaatagcatgccagctggactcagg

SEQ ID NO: 37643 - DNA, 201 bp, Homo sapiens
  misc_feature (1)...(201): n = A,T,C or G, or insertion/deletion polymorphism (see Tables 1-2)
aaaggatactgatttgtttctgaatcatgacgtttcactgattgtcttgtgcatatgcagaaaacattttagcctgtatgttgtcatctgtagccaatgantgtaacctctatattgtccctccaatgaaaaaagacaactgcaatatgaggagtccccttcccattcctcaactttcttataaaagcactgcaacttgta

SEQ ID NO: 37644 - DNA, 201 bp, Homo sapiens
gtcagggtcagctgacgtaacaaagtccttccctttctcttctgcttagaaattccagcaaccaggaggttttccttaatttcaggagttgcctcgtaaaraatgctgtctgtcagtgccccggcagggagactgacatgcagagcccttgggagtcactctgtcttcatgtggataagtttgagatgttttatcttgcga

SEQ ID NO: 37645 - DNA, 201 bp, Homo sapiens
ccctttctcttctgcttagaaattccagcaaccaggaggttttccttaatttcaggagttgcctcgtaaagaatgctgtctgtcagtgccccggcagggaractgacatgcagagcccttgggagtcactctgtcttcatgtggataagtttgagatgttttatcttgcgaaagatttgaccacttaggggttggagggtg

SEQ ID NO: 37646 - DNA, 201 bp, Homo sapiens
ggccggggaaactgttgaaaccaccctggggctgccttctgtattttccacaaccttccaggcccacctcccagctggaggccctgcagcttggcagttgycatggcgactgagtccctaagtgtgtctcttctgagctctcctggacagtgtggagaaaaggccttaagaactgaggggcttcagtaaaatgcaaacaga

SEQ ID NO: 37647 - DNA, 201 bp, Homo sapiens
tagaaaaagttctatctacatgtagaatcgaaaactttttaaaatagtgttggtagtatcacacattgccatttagtggatagagacagacccgagattgsagccctagctccgtatacttctttctgaagtcagtctactcatctgtaaaatgggctgttgtgaggtcaaaattagatattcataatgagagtagcatag

SEQ ID NO: 37648 - DNA, 201 bp, Homo sapiens
acctgggaatacaggtgcctaccaccacacctggctgattttttgtattttttttgtagagacagggttttgccatgtcgcccaggctcaacaacatgtgratcaagagatccactcacctcagcctcccaaagtgctggaattacaggtgtgagccaccacacccagcctccattttgtttttaagaaaacaatgtgtcg

SEQ ID NO: 37649 - DNA, 201 bp, Homo sapiens
cctagaggaacccagggcatgcgccttctgatggccacagtgagtgctgaggtcttcagtgtaggctgtgagggggactggctgcctaaactgtcagcctstggtaagtagggtagattaagctgatggagcagaaagcctcaccatccaaagccatcctttcccagactccatgtctggtgggaatagataggcaacccg

SEQ ID NO: 37650 - DNA, 201 bp, Homo sapiens
ttcccctgatgctgtaggacagacaggtctgtcccacccacggtgactcagtcattgttgttcatggccgctgcccgttcttcacgatcaaggaggagaawtctttggaggaaacagagctttcatacgtgaatcgactgggaagcgagtcaaaagtactgcaactggaagtgtggcatggggagggggccgtggccagtc

SEQ ID NO: 37651 - DNA, 201 bp, Homo sapiens
  misc_feature (1)...(201): n = A,T,C or G, or insertion/deletion polymorphism (see Tables 1-2)
cagagcatgcttaataatcagaggcttttcattgtatttcttatcaacaacactagtaactgaatataaatcacccttcctcgccagtcagtgcaccatancattagaattcttgctttttgatcagtggagataaaatgagtttcttttctccatgttaagtaatcaggttctgattttcccttttctttctctctaata

SEQ ID NO: 37652 - DNA, 201 bp, Homo sapiens
atcaggttctgattttcccttttctttctctctaatagtgtttaatgctctaatgctttctaagcatgaggtattttcttgagctctgaagcccagtatcytcaaagcccccttcagggaaacctcagttccctgtcagtcaaggcctgtcactggctttgccttggccttctctgggagaatgtctgctccttaagttga

SEQ ID NO: 37653 - DNA, 201 bp, Homo sapiens
atgcctctcctcctccttgtagagagcagagccactgccagaaggaaggggacaagacccagcaggacaccttctttccacgctttccagcctgtgggagyggcaggggcaacagagagaggatctggagccaggattaatgactcatttatgaagcatcttattctgcgaccgaggctcagtggtcagtggcgacgtaaa

SEQ ID NO: 37654 - DNA, 201 bp, Homo sapiens
tggcagggccgacagtttgctttatgtttcagaagccccgcagtggctgcagctatagattatcagaaaacgtgccagtgaaatagtaacatgccccccccatgtcatgtgtgaacacaggacagacaagaggagatgaacagtgcttaagggaaggagccgttgagtggggaaattggaaccctggctgagaggaagcgg

SEQ ID NO: 37655 - DNA, 201 bp, Homo sapiens
cttgaacccgggaggcagaagttgcagtgagccaagattgtgccactgcactccagcctgggtgacagagcaagactctgtctcaaaaaaaaaaaaaaacmcaaaaagtgccttcagtgccacagcccgtggtctgattgcccgtgtgtgtgagcagaggatgccaagagtgagggggaggatgcagggaccaagggaaga

SEQ ID NO: 37656 - DNA, 201 bp, Homo sapiens
gacttgaacccagaagtagttcaggctgcatctctcccaaaagccttgttttcagggcagctcctggttcttcgtgggccttcatcagacagccctgcccwcatcagacagccctgcccacaggagcccaggcctccggctgagcatgcaagccccgctgctcttgcagggaggccaccccagggaaggtgctgtggggag

SEQ ID NO: 37657 - DNA, 201 bp, Homo sapiens
cttcacttgaaaagtagaaaatctggccacgctgggcctgcaccccatgtgacagtggccgaggagctgcagctggggccccacccttctcagaggccccrcccctccctggtgcccctgctcggggtgagcgctccactgttcccgcgtcctcactacaccacacagcggtgcagcaccctccccagtacgtgtctggag

SEQ ID NO: 37658 - DNA, 201 bp, Homo sapiens
ctgtagtcctagctactcaggaggctgaggcgggagaatcgcttgaacccgggaggcagaagttgcagtgagccaagattgtgccactgcactccagcctrggtgacagagcaagactctgtctcaaaaaaaaaaaaaaacccaaaaagtgccttcagtgccacagcccgtggtctgattgcccgtgtgtgtgagcagagg

SEQ ID NO: 37659 - DNA, 201 bp, Homo sapiens
  misc_feature (1)...(201): n = A,T,C or G, or insertion/deletion polymorphism (see Tables 1-2)
gtccagaagccaccaggccacagcaggggccccggcagacaggccacggtccagaagccaccaggccacagcaggggccctggcaggcaggccacggtccngaagccaccaggccacaggaggggccccggcaggcaggccacggtcggaagccaccaggccacagcaggggcccccggcaggcaggccatggttggggct

SEQ ID NO: 37660 - DNA, 201 bp, Homo sapiens
actccccgctggcattcgcttcatcatctcattctccagggatcagtggtgagtcctggtggggcaggcccttggcatggagctgtgtataggtgagggcractgtgcaggtagttgtgttgccccagtttcattataaaacacataaaacttgaatcactgacctcacccataaccgttgaattgctttttggtggtgga

SEQ ID NO: 37661 - DNA, 201 bp, Homo sapiens
ctgtcttcacttgaaaagtagaaaatctggccacgctgggcctgcaccccatgtgacagtggccgaggagctgcagctggggccccacccttctcagaggycccgcccctccctggtgcccctgctcggggtgagcgctccactgttcccgcgtcctcactacaccacacagcggtgcagcaccctccccagtacgtgtct

SEQ ID NO: 37662 - DNA, 201 bp, Homo sapiens
agagaattctaaatattctaaatatcaaggggcaggggaatgtggaatacattaccattttcttttttttttttaattaaactacatttttagtccaacttataacaggttatagtgagataagtaccacaaagcctgtttgattttgtgaaaggtctgagatacctagaagcatttctttgtaagaccttgaacctcata

SEQ ID NO: 37663 - DNA, 201 bp, Homo sapiens
  misc_feature (1)...(201): n = A,T,C or G, or insertion/deletion polymorphism (see Tables 1-2)
agataaacagggcttcctgtcttcacttgaaaagtagaaaatctggccacgctgggcctgcaccccatgtgacagtggccgaggagctgcagctggggccncacccttctcagaggccccgcccctccctggtgcccctgctcggggtgagcgctccactgttcccgcgtcctcactacaccacacagcggtgcagcaccc

SEQ ID NO: 37664 - DNA, 201 bp, Homo sapiens
gtttccaaatgtctgttttccactggaagagaattctaaatattctaaatatcaaggggcaggggaatgtggaatacattaccattttcttttttttttttaattaaactacatttttagtccaacttataacaggttatagtgagataagtaccacaaagcctgtttgattttgtgaaaggtctgagatacctagaagca

SEQ ID NO: 37665 - DNA, 201 bp, Homo sapiens
  misc_feature (1)...(201): n = A,T,C or G, or insertion/deletion polymorphism (see Tables 1-2)
ttcagttccagggaagaagaaggagccattcgatactcagtccactgcacccggctatacgagaactcttttaatagctaagttttccaggcgatgtagtntgaaaatcaaacccgtccatgtttgcattgactcgactctgatgtaaagacactgggttttgatcctgaactccatttcgaaattcagaaacgccgtaga

SEQ ID NO: 37666 - DNA, 201 bp, Homo sapiens
caccaagctgcagcgggcattttaaatttgagtttaatcattgaagttataagctgttctctttctagatcaggtttttgtttgtttggttggttggttgkttttttttttttttttttttgagacaagatcttactctgtcgcccagtctggagtgcagtggcatgatctcggctcactgcaacctccgcctcctgggtt

SEQ ID NO: 37667 - DNA, 201 bp, Homo sapiens
acagcctaatgagccacgtaaagttgactagacagatcgtcaaatgcagatgatacacacacacacacacacacacacacacacacacacacacacacacacacacaccccctctgtgttggctgaaggtggagtgaaactggcctaaccccactgtcctccagggggattcagtgaggcctgaatcccctgctcctgtcc

SEQ ID NO: 37668 - DNA, 201 bp, Homo sapiens
acacagcctaatgagccacgtaaagttgactagacagatcgtcaaatgcagatgatacacacacacacacacacacacacacacacacacacacacacacacacacacaccccctctgtgttggctgaaggtggagtgaaactggcctaaccccactgtcctccagggggattcagtgaggcctgaatcccctgctcctgt

SEQ ID NO: 37669 - DNA, 201 bp, Homo sapiens
  misc_feature (1)...(201): n = A,T,C or G, or insertion/deletion polymorphism (see Tables 1-2)
tggcgagggagtctgtagacagaagacattgccagctcccagccccaccgccttccccgcacactcgtcgcgctgtgactcccggccccgccgccttcccngcacactcgtcgcgctgtgactcctggcggttttctgtgttcttccagaagattggcacctttcttctcccacccccaccctccacccgcgatggcatct

SEQ ID NO: 37670 - DNA, 201 bp, Homo sapiens
  misc_feature (1)...(201): n = A,T,C or G, or insertion/deletion polymorphism (see Tables 1-2)
tttagtagagggaacccttttctctttgaaagtgtaagccctaagcgtggagtgcactggccacagaagcccccacacccaccgggggctccacagatccnatttggggctcttgggacacagactggaaactgcttgtttagaggcagaggtgcctcttggcctccagccttgtcttggtccacccagtggcttcttgtt

SEQ ID NO: 37671 - DNA, 201 bp, Homo sapiens
gttatgtaagtaaaggcactggcaggccttatttcaggctgagggtgacgaccacaaccgggcgcatgctgacctcgcttacgtggcatcccctttcggcyggcctgccattgctcttgggtcagggtaggcggggagagtccccatgaggttggctggacaccctggatgtcccctttcccagagtgaccgctgggctca

SEQ ID NO: 37672 - DNA, 201 bp, Homo sapiens
cctttcggcgggcctgccattgctcttgggtcagggtaggcggggagagtccccatgaggttggctggacaccctggatgtcccctttcccagagtgacckctgggctcagtggggtgtcacccagcccctgacctccactccttttcagacagagctgctacactatgtcacgtagcaggcagtttctcagtggcctctt

SEQ ID NO: 37673 - DNA, 201 bp, Homo sapiens
ggagttgcctcgtaaagaatgctgtctgtcagtgccccggcagggagactgacatgcagagcccttgggagtcactctgtcttcatgtggataagtttgaratgttttatcttgcgaaagatttgaccacttaggggttggagggtgtgtcctccagctgaagccccagctgcagtcaccctaacagcggtggcagggagt

SEQ ID NO: 37674 - DNA, 201 bp, Homo sapiens
agctgaagccccagctgcagtcaccctaacagcggtggcagggagttcccaccagggagcgccccaaaccatcccaagatggggctggttgggattccaamgaacaaagcactaaatgctgagtgatcaatttaaagcatgtattaggggaacttacatactgagggctgcagtgtatggtcgcaacacacagcgggacag

SEQ ID NO: 37675 - DNA, 201 bp, Homo sapiens
  misc_feature (1)...(201): n = A,T,C or G, or insertion/deletion polymorphism (see Tables 1-2)
cagtcagtggagagaacaggagagatcatgaaggtgctagaaggggagaaggcctgaggacagcgcgcgctggctttgcccttggagctggagcccttccngaatctcctggcttctgcccttcccagcagtcctgtggatcaatattcagcagccgagggaagctgctgaaataatgatgctcatctcgggctttgtgat

SEQ ID NO: 37676 - DNA, 201 bp, Homo sapiens
aataaagggcttgacgcgccggaaagtcccctcgccgctggccaccagccttccagcccttacggcccacgccgtaatcctggtgaccgagaaggtacgtwcagtctaaggatttgcatttgaacgaaggatactggccaagccccttaccacccccactccccgctaacaccccagcccgcggccccaggtttgaatttc

SEQ ID NO: 37677 - DNA, 201 bp, Homo sapiens
ttaatacatagcaacagactgggttatttatttaagatgtgtattgtgtcatatgaagtttaagagacataaatggcattttgttatttattaagacaaaytccaattgttctctggctgtttttttcagttgtgtctagcaaaatacttatctgccctttgaaataaaatgtttttgtttaaaaaatctcagaacactca

SEQ ID NO: 37678 - DNA, 201 bp, Homo sapiens
aatattttagacttcccccgttgtttttttattaatcccctttgagagcaagcttgaaaacacctggccccagacctgtgattcaccaagtcattttggamctgcatttacacgttctgtttcatgcagcccacctgtgatgttctctttgttgggggttggaggcaggtaagggaggtggtgcaaatggaattcaggttc

SEQ ID NO: 37679 - DNA, 201 bp, Homo sapiens
ccctgctctagagagctggcttactgcagtgaggtagtcggagctgccaggctggccctggtttcgtgcagtcttgtagagccacccccgagtctcaagaygctagagcgtcctcagcaatacattccccaagtcccttcatgaaactcaagtcagggattcttcaaaagtgcagagatactttgtccaggcgcgaagtca

SEQ ID NO: 37680 - DNA, 201 bp, Homo sapiens
aggaggtggctcagagaaacaggacaaactggaatctgccccacttatccagctgacccaggcgagccgcctagcctcatttttctcccttgtgaaaagarcgccctgcctcttcagggtggtcacggggctcaaatgagagcatgtcagtcatggttcgtgcttccagaggtcttgacccactcaaaatgaagtggtctt

SEQ ID NO: 37681 - DNA, 201 bp, Homo sapiens
ctggagccatcgtggcagccatggggatagtgtgctttctcttcctcattgaacgtaagtgcacgtggccttggagaccacccaccaagggaggcctcggytttccctgcctgggtgggccttgggggcgagtgtgagagctgcgtggcctagcgccctgtttgcccgtggctgcctcagcgctcttcttaccagggagac

SEQ ID NO: 37682 - DNA, 201 bp, Homo sapiens
  misc_feature (1)...(201): n = A,T,C or G, or insertion/deletion polymorphism (see Tables 1-2)
gattggctttggaggacgcagtgactcaggaatgtcatgagtttgacattgggatgggagaccaggcctgcctgctgtgctgggccccttctcagttctcnggcctccctccccattccttcctatattgctctgccttcagccctgacttcataatcaggtcattttctgtgacctctgaggtgaccacaggagatgaaa

SEQ ID NO: 37683 - DNA, 201 bp, Homo sapiens
ccaccatcagaacattatttgaaattcatttccaggttctcagaacaaaccgcctcaagggtagatactccacctcactccccctcttcctagtaacactsctggtgggggcccctgcttgtatcagacgtgcagctttgatcaggactgggtactgctactgtacgtgtgtggttacttctgccagtaacgctgaaggtg

SEQ ID NO: 37684 - DNA, 201 bp, Homo sapiens
catcacattagaaaggaagatagtaagggagtaacaaagcaacaaaggaactacaaaccgccagaaagcaattttttaaatggcagtagtaagtccttathaataattaatgtaaatggattaaattctgcaatcaaaagatagaagtggctgaatggatattaaaaaaaaaaaatctaggtgctgcctgcaggagactca

SEQ ID NO: 37685 - DNA, 201 bp, Homo sapiens
  misc_feature (1)...(201): n = A,T,C or G, or insertion/deletion polymorphism (see Tables 1-2)
atcagaacattatttgaaattcatttccaggttctcagaacaaaccgcctcaagggtagatactccacctcactccccctcttcctagtaacactgctggngggggcccctgcttgtatcagacgtgcagctttgatcaggactgggtactgctactgtacgtgtgtggttacttctgccagtaacgctgaaggtgtgaat

SEQ ID NO: 37686 - DNA, 201 bp, Homo sapiens
agatgtgcctaggacacagaagagctgcccctcgccttccactcctgtcaaatacttctttctcccaacccattttgttgccccaaaaagtatttttctatgcggtggttgagactcttagactggagttgccctttgtcttctttctaaggcaccttcttttcttctttcttcctcacactcatgctgactctttcggct

SEQ ID NO: 37687 - DNA, 201 bp, Homo sapiens
aataagacattctcttataaaaccacagcaaaaagatcaaaatcaggaaatttaacaccgataagatactgttatctaacccacagtccatgttaaaaacratatcaaatgtcaaatatctgtgatagcatttcttcttctgttcaggatctagttcgggttcatacattgcgtttaattatcctatgggtctcgtctctt

SEQ ID NO: 37688 - DNA, 201 bp, Homo sapiens
aacttactaacatctgtaagaatgttcctgtagaaccgctgtatgtcaaagattaacatttagcctcatctgcttctctccctgcccctccacagtgtgtktgtgtgtgtgtgtgtgtgtgcatgtgtgtagatgtatgtttgtacacacacacttttctgaaccacttgagagtaagttgcagacatcataccctcttat

SEQ ID NO: 37689 - DNA, 201 bp, Homo sapiens
ctaaaggtatataacaacaaacagtcgggcctggctttatcccttcaactcctctgtctcattcccctaccattttctactcttttacccatttcttctggtagttccctatatttctaaataatatgagtaaactatgatttttatgtccaattttaaagcttttctatggacctctggttttagagacaacatctagtt

SEQ ID NO: 37690 - DNA, 201 bp, Homo sapiens
  misc_feature (1)...(201): n = A,T,C or G, or insertion/deletion polymorphism (see Tables 1-2)
ggtcagaagtccaaagtcaaagtgtcagcagggccacacttcctctgcaggctccggggacagacccttccttgcctcttccagctcctgctgctgccgcngttcttggctggtggctgcatcacaccagtctctgcctgtgtggccacgtggcctcccttcctgtctctgagtctttgcgtggccttctggtgaggacgc

SEQ ID NO: 37691 - DNA, 201 bp, Homo sapiens
acatgtgcaggttttacaggttgtaataaagatgctctaatgggctgtttcctaagttactatctttttatatttttttaagacagggtctcgctctgtcrcccaggctggagtgtagtggtgcaatctcagctcactgcaacctccgcttcccaggttcaagtgattttcatgcctcagccacccgagtagctggaatta

SEQ ID NO: 37692 - DNA, 201 bp, Homo sapiens
aagttaatctgccttgtcatccgcggtagcagggaggcctcagtgcaggtctggcccacccctagcacctgagcctcctgtgccctacccttcccatcatygatccttgtagaggctcctcacattgctgctgcttagctgaccacaccaagctgcagcgggcattttaaatttgagtttaatcattgaagttataagctg

SEQ ID NO: 37693 - DNA, 201 bp, Homo sapiens
tgagtgtagatgcaaaactcaatagcagcaaccagaattcagccacctacaaaaggattatttaccatgatcaagtgggatttatcccaggaatacacagytggcttaacaggtaatgttaatgtaatacaccatttgaatggataaaggacaaaagctgcatgatcatctcagtagaagcaggcaaagcactggacaaaa

SEQ ID NO: 37694 - DNA, 201 bp, Homo sapiens
caggcgtgcagggggttttggggaggagcagctcttcctcacacacagcttttaggaatatgagagctcatctaggcgagaggcattgcttctgctcctcstgtgtatgagtttggggctgaagcctgtgtttcattctccccgttcaaatcctctccgagcagttcactgagatctactggtgcccaggtgtccccgacg

SEQ ID NO: 37695 - DNA, 201 bp, Homo sapiens
gaaacaaaatgaagtttgaaaaccagtgccttcaggaaggtcaaacaccatatgatgttcttaaaactatggttgatattttaaaatgttttaaaaagccrtgttcctgccctgagcatgaatttcagtttccaagcttgtacagtcgtgccgtgaagtagcttaaagctgcccggaccagccgtcttgagactggggaga

SEQ ID NO: 37696 - DNA, 201 bp, Homo sapiens
  misc_feature (1)...(201): n = A,T,C or G, or insertion/deletion polymorphism (see Tables 1-2)
gaatctcttcttcacaccgcacttgcagagactgtattgatacagacgccagagcacatcagcccttgcacaacacagtccagtggctccatgtcgccccntgtgaaatcctcaccagtccatctggttggtctctgtcaccctcacagaagggtgcgagcccctcgggcctggatcatcactgggtcccggcacctgggg

SEQ ID NO: 37697 - DNA, 201 bp, Homo sapiens
cgtctgacccaatgcttccctccctctgggggtcagctctcttccctccctctgggaaaggctcccctacccgggctaacatgttagtcacgtctgtgcckagtgtcagaccccagatgtgggggtgcccccaggctgccctgcggcctcctctctccttgtctgcccgctcactgcaggagagcgcgctcgggcctttca

SEQ ID NO: 37698 - DNA, 201 bp, Homo sapiens
gaaacgaatgccaatttagtaaaggtataagatggcatcttgtgttttattaaattttattgtgtatatttaaggtatgcaacatggtgttacagatacayagagatagtaaaaaggttactagtaaagcgaagcaagttaacatagccatcgcaactcacagctgcccgcttttgtttttgtggcaagagcagctcaaat

SEQ ID NO: 37699 - DNA, 201 bp, Homo sapiens
ttatcaacaaaacccagacaagaggtttgatgctggcctcgaggccagcaggagtgtgctcggcagctgcatgtccctctatgatgtcaccctgtgttgtrtgggaatggacttggctgtggggagcctgcagccctgtagctcagtttgggttgcaaggcagtaaccagtttcatccaaggtgataaagagaccaaggtg

SEQ ID NO: 37700 - DNA, 201 bp, Homo sapiens
gcatcacactgtgagtggataccgatggggtgagttggctgatgtcctttaaattggtgaccatacatcacaggtggaccattgggactgcccaacatgcmgaccatgtgtccttggtcagtggcctcgccctatgggctgtgcccaggacaggagggcgacgcaccccacagccagccacggacctctgggtgcagaccc

SEQ ID NO: 37701 - DNA, 201 bp, Homo sapiens
  misc_feature (1)...(201): n = A,T,C or G, or insertion/deletion polymorphism (see Tables 1-2)
cctggttttgctggatttcctactctcccctgattctggagtgacccatgtccccattccttcctcccgtcctcctgtcctcccttgccccggcatcaggngttcatgcatgggagtcttccatcttcccacaggctgttccttctcatgcccatcttgccaccacagcctgaattggacccagtcagctctttgccttct

SEQ ID NO: 37702 - DNA, 201 bp, Homo sapiens
  misc_feature (1)...(201): n = A,T,C or G, or insertion/deletion polymorphism (see Tables 1-2)
ggtccaggagcacgtggagggctcttcgccccgggagccagagagagcgagaggaaggagaagacacacgctgggccgtcagggaggggcagaatccggcnatgtctcaaagaggaggcctttgagaatgggggaggctgaggagcacagaccacctattctggggatgcagatcccaccagaggaggatgctggcagcac

SEQ ID NO: 37703 - DNA, 201 bp, Homo sapiens
  misc_feature (1)...(201): n = A,T,C or G, or insertion/deletion polymorphism (see Tables 1-2)
ggctgcatcacaccagtctctgcctgtgtggccacgtggcctcccttcctgtctctgagtctttgcgtggccttctggtgaggacgccagtcattggaatnagggctcactctatctaatatgacctcacctgagctaatcatgtctacatgaccctatttccaaataaggtcacgttctgaggttttgggtggacatgaa

SEQ ID NO: 37704 - DNA, 201 bp, Homo sapiens
  misc_feature (1)...(201): n = A,T,C or G, or insertion/deletion polymorphism (see Tables 1-2)
cattggaatgagggctcactctatctaatatgacctcacctgagctaatcatgtctacatgaccctatttccaaataaggtcacgttctgaggttttgggnggacatgaaattatgggggatgatattcaacccagtacaaaatgaacaaaaggaaacatatcatccaaaacatctgctttataaatgataaagaaaacgt

SEQ ID NO: 37705 - DNA, 201 bp, Homo sapiens
  misc_feature (1)...(201): n = A,T,C or G, or insertion/deletion polymorphism (see Tables 1-2)
tatctaatatgacctcacctgagctaatcatgtctacatgaccctatttccaaataaggtcacgttctgaggttttgggtggacatgaaattatgggggangatattcaacccagtacaaaatgaacaaaaggaaacatatcatccaaaacatctgctttataaatgataaagaaaacgtagatagaattacgaaataaga

SEQ ID NO: 37706 - DNA, 201 bp, Homo sapiens
  misc_feature (1)...(201): n = A,T,C or G, or insertion/deletion polymorphism (see Tables 1-2)
agatgaagaaatgagagaggaaagacgaatttggaaatagaagtagagttggcctgacaccagctaaataaatacagcgttttcctcttcagtctttaggnacattccagtttgctgtgtaaatggacccttcacccaattctacaggacggcttctgtcagcctggctacaccgtggcagtgactcttcccaaagggtct

SEQ ID NO: 37707 - DNA, 201 bp, Homo sapiens
  misc_feature (1)...(201): n = A,T,C or G, or insertion/deletion polymorphism (see Tables 1-2)
tggcctgacaccagctaaataaatacagcgttttcctcttcagtctttaggaacattccagtttgctgtgtaaatggacccttcacccaattctacagganggcttctgtcagcctggctacaccgtggcagtgactcttcccaaagggtctcattcattaaggtgtctccctccacacaaggctgaactaaaggttccag

SEQ ID NO: 37708 - DNA, 201 bp, Homo sapiens
  misc_feature (1)...(201): n = A,T,C or G, or insertion/deletion polymorphism (see Tables 1-2)
gcactcttcagacctcagcccgacaaagggagacagccttccttctgggctgtctgggtggagagtggagatgtgaacccacagcccataggacagagctnctcttctcaaaatccttcctagctgggtgataacacctgtagaactggcactgtggttggagaatcctcctgcatggagcaggagagatggtccatggac

SEQ ID NO: 37709 - DNA, 201 bp, Homo sapiens
gtggagagtggagatgtgaacccacagcccataggacagagctgctcttctcaaaatccttcctagctgggtgataacacctgtagaactggcactgtggwtggagaatcctcctgcatggagcaggagagatggtccatggacttgtctgagactggggaggtgctggaggcaacttggcctgagaactttgttcacctg

SEQ ID NO: 37710 - DNA, 201 bp, Homo sapiens
aatcttcctgcaccagcagtcgaaggcgtgagaagcagtggtggcctaacagagagcttcatccaaagcgctgagactttctttccttgccagaaaggatrgttttcagaaacacgaggacagaggccggggcttctggagcaaatccactgtacccacatagcctttgttctttgggctttgggataaatgataggctcg

SEQ ID NO: 37711 - DNA, 201 bp, Homo sapiens
  misc_feature (1)...(201): n = A,T,C or G, or insertion/deletion polymorphism (see Tables 1-2)
cacgtagtgttagaagtatggtatgttgtgtgttgtgcatgagggtaggaaaagcagtctggtttttcctgtctcttacagtgttcagtttccatttgganaaagcaaacgtggcaatattttttaatgttccaatattatagtgacataagtaatattgataatggctgtagaactgaatgaataatacacagcataaga

SEQ ID NO: 37712 - DNA, 201 bp, Homo sapiens
tagggcttctgaggaggcggcgtcagggtcagctcttagttcagtgtcataagtaacaatataaataactgccgcttacagagccctggggtatgacaaastgccacatacattacccctgtgatcctcacagcaaccctgcgagtgcccctgtgaggaaattgaggctcgggtcttcgttccccaggcagggctgccaca

SEQ ID NO: 37713 - DNA, 201 bp, Homo sapiens
gttcacgttcacagtgttggcactggctggcggtgatctgccataccccccttgcacacaagtgggctgccaggccgagtgactggggacaggccggggcrtgtgcgggagtcactggtgggacagccaagctgtgcccttgccctcacctggcatgctatggcgatggcttttttctgaaacgaatgccaatttagtaaa

SEQ ID NO: 37714 - DNA, 201 bp, Homo sapiens
  misc_feature (1)...(201): n = A,T,C or G, or insertion/deletion polymorphism (see Tables 1-2)
actcacagctgcccgcttttgtttttgtggcaagagcagctcaaatccactcatttaatgtgaatcctgcatacagtccagtttcacacccggtgctcccntgttgccctgtcctcgggttacgtagcttacttggcattgccatggtggtggacctgctcagcctcactcatgtttgctctttcagatccgaacgacgtc

SEQ ID NO: 37715 - DNA, 201 bp, Homo sapiens
gccccgctccccatgtccactggcatgacacccctcctgtctgcaggccaccgccacctcacgggaacagcccatcagatcccagcaacgtcacccggacrcatagggtggtcagctctctggcctcaccctgctgggcccgtcgcccgcgtctgacccaatgcttccctccctctgggggtcagctctcttccctccctc

SEQ ID NO: 37716 - DNA, 201 bp, Homo sapiens
atttgagcatagctgaggtattttccatctgcaaacagccagctctgagacacacacacttgccgtcctgtggaagcgtggctctgcctgtcacgcacgtstgcgcttgccgtcctgtggaagcgtggctctgcctgtcacgcacgtctgcgcttgccgtcctgtggaagcgtggctctgcctgtcacgcacgtgtgcgct

SEQ ID NO: 37717 - DNA, 201 bp, Homo sapiens
ccccatctcagtcaggaagctgctgtccaccctgtggacaggccagacccgaggagccagcccaacaccccctcccttcagccccgcaccccatccttggscatgttctgtcagttctgctctgttctgtgaggggatgtggaatggaaaccctctcacctcctccgcctctaccaccctggtccccgtcaccaccgtcag

SEQ ID NO: 37718 - DNA, 201 bp, Homo sapiens
cgtttctgtacatttcatgcagagcaattaaatagggcactgcatttttcttcaagttaatttttatttattaaagtaaaacataatgtaccttagaagcragacagtcctacaagcttattatgttgtacagcggcgttccgtccccctccccagccctctctttctagaggcagccaatttcagctgcctctctctgct

SEQ ID NO: 37719 - DNA, 201 bp, Homo sapiens
  misc_feature (1)...(201): n = A,T,C or G, or insertion/deletion polymorphism (see Tables 1-2)
gctccgcacctttcaatgtcccaggcactattccaggtgttgggggcggtgctggtgtagacggaacgcaggcagagacatcccccaagcggtgccaagcngcaggaagacaggctgagcaggctctattttcagctggccttgggaggcttccctaggcaggcagtgttgaaacagagctgtgagggactggagggagag

SEQ ID NO: 37720 - DNA, 201 bp, Homo sapiens
gagcatagctgaggtattttccatctgcaaacagccagctctgagacacacacacttgccgtcctgtggaagcgtggctctgcctgtcacgcacgtctgckcttgccgtcctgtggaagcgtggctctgcctgtcacgcacgtctgcgcttgccgtcctgtggaagcgtggctctgcctgtcacgcacgtgtgcgcttagt

SEQ ID NO: 37721 - DNA, 201 bp, Homo sapiens; identical to SEQ ID NO: 9679
  misc_feature (1)...(201): n = A,T,C or G, or insertion/deletion polymorphism (see Tables 1-2)

SEQ ID NO: 37722 - DNA, 201 bp, Homo sapiens
aggaggggacctcccctgcaagcctctctggccagcatgtgttgcgtcctggtgctgggtttccaggcctgcctctttctgatgaagatttcctgtttgtygcctgcagtctgttcctgagagcaccgtgttaaagaaagtctctggtgttcttcgtgggaactgggccatgctggaaggtgagagcacgggtgcaggctg

SEQ ID NO: 37723 - DNA, 201 bp, Homo sapiens; identical to SEQ ID NO: 9684

SEQ ID NO: 37724 - DNA, 201 bp, Homo sapiens; identical to SEQ ID NO: 9685
  misc_feature (1)...(201): n = A,T,C or G, or insertion/deletion polymorphism (see Tables 1-2)

SEQ ID NO: 37725 - DNA, 201 bp, Homo sapiens
ccgtggggagccgtcccagaaggcgccccccacggtccaccgaggactctgggagtcacgaggtaactccctgctgcagggggcccgctgtggtggccgastcccatgttcctgccccacctggcacctgtccttgttcccccatcacaggctctgccggcgcagacgccagcttcagcagtctctacaaggccacgttcg

SEQ ID NO: 37726 - DNA, 201 bp, Homo sapiens
ttggtgccctggtttccattacattctttcatctttgccccgttctgttagtagccagtcctcaggtccagccagggtgtgggtcccaggaggtgggcacygtggggagccgtcccagaaggcgccccccacggtccaccgaggactctgggagtcacgaggtaactccctgctgcagggggcccgctgtggtggccgagt

SEQ ID NO: 37727 - DNA, 201 bp, Homo sapiens
  misc_feature (1)...(201): n = A,T,C or G, or insertion/deletion polymorphism (see Tables 1-2)
agggaggagctggacgaacattttctaccctgccttctggggacacgacacactgtagttctgggtgcgtcgttgtgccagcaccttgcagtcttggaggngatggtgtctgcaggatggattagcccagcatggaatccaggtgcctcattcacgacaagaagttgctgctctgaagtcttgcaaagctaaaccccactg

SEQ ID NO: 37728 - DNA, 201 bp, Homo sapiens
  misc_feature (1)...(201): n = A,T,C or G, or insertion/deletion polymorphism (see Tables 1-2)
cccagggcagggctggcagctggtggctcccagagggagctggtgctgtgctgcctcatgcctggtccatggtgttgagggaattgatcccactgcagtgngcgtcagtaagtgcagggcctcactgggaggtttagtgggggtctagccagaggccccgggggtcttcaggaggctgagcaggggcaggatggtcactgt

SEQ ID NO: 37729 - DNA, 201 bp, Homo sapiens
  misc_feature (1)...(201): n = A,T,C or G, or insertion/deletion polymorphism (see Tables 1-2)
agtggctggggcttccaccgtgggtgaagggagccgggtgccaggccggcgtggctggcttgtcccatgtggtgatgtctgcaacagttctttttttgggngagtgtgtggccccccacaccacacttagcgatgaagttggcactcagtgtggcaagggtgtgtgggactaacacttggaggctggattagcacagcctc

SEQ ID NO: 37730 - DNA, 201 bp, Homo sapiens
ctttcagtgccacatgtgtgttggctgatctgatcctcacggcagttctgggagggtgcaggggtgctgttctgtcccacgctgggtggtgaacagttagrtagcagactccgatcagtgggctcggaagacagagccgggccctgctgctggtccctccacctacagtgttggtgcccctgttttccagggcagtcctct

SEQ ID NO: 37731 - DNA, 201 bp, Homo sapiens
tgttctttttcaaggtgcccagatttcatattgttcaaacacacatgctctacaatttgtgcagtcaacgcaattatcacagggtcccgaggtgacatacrtcctcctcggctgacaggattaagagattaaagtaaagacaggcataggaaatcacaagggtattgactggggaagtgataagtgtctatgaaatcttca

SEQ ID NO: 37732 - DNA, 201 bp, Homo sapiens
ggcagcaccctgtggctggtccgcaaacatgggggctgctccccacacctggaggctttttatgcctcttagatctcagactcttagatctgatgcacccmctccccagaaaaccgcccacgcttagcacatccacctccattcagttttagaggttccatgtactcctagcctctctgcatttcactgaggccctgcacc

SEQ ID NO: 37733 - DNA, 201 bp, Homo sapiens
  misc_feature (1)...(201): n = A,T,C or G, or insertion/deletion polymorphism (see Tables 1-2)
tgaccaaaatttattaggcgggaatctcctcatcctagtaagcctgggagcgctatgggagactggggcttatttcatccctacagtctcaaccagaaganggccacacccaagggggccatttcagaggcccaccctcaggggcgcattctctttctcagggatgttccttgctgagaaaaagaattcagctatatatct

SEQ ID NO: 37734 - DNA, 201 bp, Homo sapiens
  misc_feature (1)...(201): n = A,T,C or G, or insertion/deletion polymorphism (see Tables 1-2)
gtaaccggtctgaccaaaatttattaggcgggaatctcctcatcctagtaagcctgggagcgctatgggagactggggcttatttcatccctacagtctcnaccagaagatggccacacccaagggggccatttcagaggcccaccctcaggggcgcattctctttctcagggatgttccttgctgagaaaaagaattcag

SEQ ID NO: 37735 - DNA, 201 bp, Homo sapiens
  misc_feature (1)...(201): n = A,T,C or G, or insertion/deletion polymorphism (see Tables 1-2)
ccctctgcagatttgggagcaggggagtggtgggaacaggatttaggaaggtggagcagacagcagggagaatgaagaaggcaagtgagacaggaggtggncagtaggtggccccaggttggaagtgaaggtgtgggaggagcaggtgcagccacgagcctctggctccgcctccttggccgggagctgtgccaggtgctg

SEQ ID NO: 37736 - DNA, 201 bp, Homo sapiens
  misc_feature (1)...(201): n = A,T,C or G, or insertion/deletion polymorphism (see Tables 1-2)
acaaggtaatagaatatcacgaggcaaatggaggcagggcgagattgcaggaccacaggaccggggcaaaattaaaattgctaataagtttcgggcaccantgtcattgataacatcttatcaggagacagggtttgagagtaaccggtctgaccaaaatttattaggcgggaatctcctcatcctagtaagcctgggagc

SEQ ID NO: 37737 - DNA, 201 bp, Homo sapiens
  misc_feature (1)...(201): n = A,T,C or G, or insertion/deletion polymorphism (see Tables 1-2)
tggcggtgctgacaaggtgggtttaggggtggagtgcagttctgctgcttcttcccgagtgacttgtgtgtgtcaggaaaggtattctatttggtgctttnggcacttttcatcttgtccttatgacagcctggggaggtctcttagctcgttctggaagtacgcaggtgtgagaggagagctgcgcctgagcccagggcc

SEQ ID NO: 37738 - DNA, 201 bp, Homo sapiens
ccccacacctggaggctttttatgcctcttagatctcagactcttagatctgatgcacccgctccccagaaaaccgcccacgcttagcacatccacctccrttcagttttagaggttccatgtactcctagcctctctgcatttcactgaggccctgcaccgctgcaggatgcccctgagctgggcgagaccctaggctct

SEQ ID NO: 37739 - DNA, 201 bp, Homo sapiens
atctacctgtctcagtcccccaaagtgctaggattacaggagtgagccactgcgcctggcctggtaattcttttcctaaagtaaaggccctggctgagctytggcataggcatagtgcacaagagccgcttgggtgtcttgtgaaagcacagactttgtgattcatttcatctgggctaggccatatgctctgtgatttct

SEQ ID NO: 37740 - DNA, 201 bp, Homo sapiens
  misc_feature (1)...(201): n = A,T,C or G, or insertion/deletion polymorphism (see Tables 1-2)
cagagcatatggccaggtaccggtgcctgccaccgcccacgtggcctgccaggctgtcgaggaccctgcgctgctcctggaagctaatgggggtgtctttntggccttctaggaccgtggcaaggaggtgtacagccctgactttcatagcctcggaggagaaggtcttggtggccgacaagtctggagacgtctactcct

SEQ ID NO: 37741 - DNA, 201 bp, Homo sapiens
gtaggtgagatatgtttctaaatagtaatggctctttgaaatttgtatacagaatcccactgaacgctcaacagtatcagaacataatttcttttttttctttttttttttttttgaggagtctcgctttgtcgcccaggctggagtgcagtggcgcgatcttggctcactgcaagctccgcctcccgggttcacgccatt

SEQ ID NO: 37742 - DNA, 201 bp, Homo sapiens
ccctgaaatattgtatctagacagttttcttgtcaagtatacaacttttaatttaatgagtgtgcaaatattttttgttccacagagaaaaaaaatcaactttttttttttttttttaacaaagtgctcttttaaaaatcattgttaggctgggcgcagtggctctgcctataatctcagcactttgggaggctgaggcgg

SEQ ID NO: 37743 - DNA, 201 bp, Homo sapiens
gcgtggtggcagatacctgtaattccagctaccgggaaggctgaggcgggagaattgcttgaatccaggagggggaggttgcagtgacctgagatcatgcmcttgcactccagcctgagtgatagagcgagactccaactcaaaaaaaaaaaaaaaaaaaaaaattagggccaggcgcagtggctcacacgggccaggcgc

SEQ ID NO: 37744 - DNA, 201 bp, Homo sapiens
tgagatcatgcccttgcactccagcctgagtgatagagcgagactccaactcaaaaaaaaaaaaaaaaaaaaaaattagggccaggcgcagtggctcacaygggccaggcgcagtggctcacacctgtgagcactttgggaggctgaggttggtggatcacctgaggttggggatttgagatcaccctgatcaacatggag

SEQ ID NO: 37745 - DNA, 201 bp, Homo sapiens
tgtaggagcatcacctcagcactgctcccagcagcccctgtcaccccactctgtgtgccccgtgtgtcacagacacacacctggagccccagagggcgcaggcccacagcccgggtggtggagctgggattggacgcacacagggacagtcaggaacaatggcgagtgtggggtatcaaagggaacctcactgggacttgg

SEQ ID NO: 37746 - DNA, 201 bp, Homo sapiens
tggccgagtcccatgttcctgccccacctggcacctgtccttgttcccccatcacaggctctgccggcgcagacgccagcttcagcagtctctacaaggcyacgttcgacaacgtgacctcctacctgaagaagaaagaggagagactgcagcagcagctagagaagaagcagcggcgccggagtcccccgcctgggcccg

SEQ ID NO: 37747 - DNA, 201 bp, Homo sapiens
tggccaggctggtctcaaacttttgacctcaagcgatccacccacttccgcccactgggattataggcgagagccaccatgctgggccataattctctggttttttttctttcctgttcaatctcgtatttctactcctttaggaatagtcttacttcttgggagattgcctcaactttactttccagccttctgtggaga

SEQ ID NO: 37748 - DNA, 201 bp, Homo sapiens
caacccggagggcggtcacagcacctttcacgcatgctcaaggcaggctcgtccttgagcatgcgcggtacgtggggtatacgtcatctctcggcgtctgsgcctggcgtcaccgaccggtgcggacaggaagaggctctgggctggcacatgtgtatggcggtgaggcgggcgggtacatggcgggctctgtgggactgg

SEQ ID NO: 37749 - DNA, 201 bp, Homo sapiens
agccacgaagagaggaggtcactgaggtggacagtgggacagagagagggacggggagaggaacaggagtttcagaaacgtcctggacacattgggcagcygtcagcattgctttccattcatggacaaagcgtgggtgcccagaagaggccagaagccagtgcagaagcccaggcctccctgccatcacccggtgctggc

SEQ ID NO: 37750 - DNA, 201 bp, Homo sapiens
  misc_feature (1)...(201): n = A,T,C or G, or insertion/deletion polymorphism (see Tables 1-2)
ggcagagggcggagggtggggagggcgctctggggaggtcaaggccagggctaggctttcagggccatgtcctggctccccgcccctcggggagacggggncggggagcgctgtgagcagaggggcccgggtggagaaggtgctgccggccagcgggagggagggcagcgggggtgcagcagaagcccaggtggggacttg

SEQ ID NO: 37751 - DNA, 201 bp, Homo sapiens
  misc_feature (1)...(201): n = A,T,C or G, or insertion/deletion polymorphism (see Tables 1-2)
caggacccccacgcacagcccagtctgcggggcgcgaccccaaggccagcagcagaggacaaggacggggccagggcaggggccggggttggcagagggcngagggtggggagggcgctctggggaggtcaaggccagggctaggctttcagggccatgtcctggctccccgcccctcggggagacgggggcggggagcgc

SEQ ID NO: 37752 - DNA, 201 bp, Homo sapiens
  misc_feature (1)...(201): n = A,T,C or G, or insertion/deletion polymorphism (see Tables 1-2)
gcaccggcgagggctgcaccgtctggggtgctggctgcagagcggagcccgtgggcctgcagtcctagtaatcatgctctctttcttcgtggcaagcactnctgtggtctacatcttccagctggacgcccgcagacagcagttggtgtacaggcagcagctggcgttccagcaccaagtgtgggacgtggctttcgagga

SEQ ID NO: 37753 - DNA, 201 bp, Homo sapiens
ttttagaagtttgccgcgtccaggattgcattctggtgccaggagaactgcgtggcgctcctgtgcgacgggtaagctgcggcggcacctctatggcctcyggttctgcagacctgcagggggaagagttagcgggttggccactggcccacgtcctcaatgaagaggtcctgaacggtggtggtattggtctagcacctc

SEQ ID NO: 37754 - DNA, 201 bp, Homo sapiens
ccactgtgcacggcctcttcttcatttttaatatttcctctgccaggaactgtgggagctcacagggcagttgtatgtgtagctctcatctcttcctttcmcctgtgtcctccgctccctcttctcctcactgtctgacctatcttgttggctttggaggctgtcgcaggccctgcagggagtgccagaaccactgggggg

SEQ ID NO: 37755 - DNA, 201 bp, Homo sapiens
tcttgcccaggctggagtgcagtggtgctatctcgactcacagcaacctccgcctcaggctcctgagtagctgggattaaaggcgtgagccactgtgcacrgcctcttcttcatttttaatatttcctctgccaggaactgtgggagctcacagggcagttgtatgtgtagctctcatctcttcctttcccctgtgtcctc

SEQ ID NO: 37756 - DNA, 201 bp, Homo sapiens
gcactcctgtggtctacatcttccagctggacgcccgcagacagcagttggtgtacaggcagcagctggcgttccagcaccaagtgtgggacgtggctttygaggagacccaggggctgtgggtgctccaggactgccaggaagcccccctggtgctctacaggcctgtgggcgaccagtggcaggtgagactcggcacct

SEQ ID NO: 37757 - DNA, 201 bp, Homo sapiens
actcttgcccaggctggagtgcagtggtgctatctcgactcacagcaacctccgcctcaggctcctgagtagctgggattaaaggcgtgagccactgtgcmcggcctcttcttcatttttaatatttcctctgccaggaactgtgggagctcacagggcagttgtatgtgtagctctcatctcttcctttcccctgtgtcc

SEQ ID NO: 37758 - DNA, 201 bp, Homo sapiens
  misc_feature (1)...(201): n = A,T,C or G, or insertion/deletion polymorphism (see Tables 1-2)
gcacctggcggggactggccctggggtcgaggcatgggctcagccactgccctgcagggacacagccaggacctcttcccggcagagggactcccccactnatccccagaatactgaggggcacgctgggtgccaggctggcagggaccctggggattctgcagcgagctgaatggggtgggagttccttcttaaaatgtg

SEQ ID NO: 37759 - DNA, 201 bp, Homo sapiens
accttcacagccacccctccttctcccaactgaggcacctgcagaggagaggggccccagacggggacagcagggcagaatcccagctcccagatccgggygaggggggattgggtgtggcggcagtttcgggggtagggggccaggtgggtgtgggacccaggggcgtggtttcaatcctccccccaggaccttgggaat

SEQ ID NO: 37760 - DNA, 201 bp, Homo sapiens
  misc_feature (1)...(201): n = A,T,C or G, or insertion/deletion polymorphism (see Tables 1-2)
gcagtggccacgagctcatgagcccacacgtgtctccccgtgggaatgcatgattgctgaagtgtctgcgcagacctgtgtgcatgcccgtgtctatgccnggcccgggcacagcagatgtggtctggcctcctggcggatgacaacctggccatctagcggccttggcttattttgctaggatctgcctcattggctttg

SEQ ID NO: 37761 - DNA, 201 bp, Homo sapiens
gaagggttgtaccagttgtcgtgggacggttgctgatggccatgtccttcctgtcattcttagtgaagtggagcagtggccacgagctcatgagcccacaygtgtctccccgtgggaatgcatgattgctgaagtgtctgcgcagacctgtgtgcatgcccgtgtctatgcccggcccgggcacagcagatgtggtctggc

SEQ ID NO: 37762 - DNA, 201 bp, Homo sapiens
atcgtttgaacctgggaggcggaggttgcggtgagccaagattgtgccattgtactggagcctggacaacgagagcgaaactccgtctcaaaaaaaaaaawtttgttatttctctctaatgataactccttttaaaattattgttatttctctttagtgatgatgacagcctcttcatctatgactgcagtgctgcagaaa

SEQ ID NO: 37763 - DNA, 201 bp, Homo sapiens
  misc_feature (1)...(201): n = A,T,C or G, or insertion/deletion polymorphism (see Tables 1-2)
aagaaaaaaaagagaaacgcttttttccattgatgatggttttagagcgtggagcctcttggttcctgtgtcggcttcctgaagggttgtaccagttgtcntgggacggttgctgatggccatgtccttcctgtcattcttagtgaagtggagcagtggccacgagctcatgagcccacacgtgtctccccgtgggaatgc

SEQ ID NO: 37764 - DNA, 201 bp, Homo sapiens
  misc_feature (1)...(201): n = A,T,C or G, or insertion/deletion polymorphism (see Tables 1-2)
ttcagaaggggagggagtgtacgaataggtgtgggtcacagagatcacgtgcttcacaaggtaatagaatatcacgaggcaaatggaggcagggcgagatngcaggaccacaggaccggggcaaaattaaaattgctaataagtttcgggcaccattgtcattgataacatcttatcaggagacagggtttgagagtaacc

SEQ ID NO: 37765 - DNA, 201 bp, Homo sapiens
gcattggctttgttccagttgttagcattgcttaatttttttggcaccaccttcagcagctggaaaacagagcatatggccaggtaccggtgcctgccacygcccacgtggcctgccaggctgtcgaggaccctgcgctgctcctggaagctaatgggggtgtctttctggccttctaggaccgtggcaaggaggtgtaca

SEQ ID NO: 37766 - DNA, 201 bp, Homo sapiens
gctactggggaggctgaggcaggagaatcgtttgaacctgggaggcggaggttgcggtgagccaagattgtgccattgtactggagcctggacaacgagarcgaaactccgtctcaaaaaaaaaaattttgttatttctctctaatgataactccttttaaaattattgttatttctctttagtgatgatgacagcctctt

SEQ ID NO: 37767 - DNA, 201 bp, Homo sapiens
ggatagtgcacgtgtctcttatctcactgagatgagcgtggacttttctttcttcaatttcttcctggccttgtgtttgattgccttctctggagtgtgtygtctgcctttctcattggaggttttcctcggatgtctggcgatgccatctgcctgtgtgtgatgggagtcagcaccagccggcctcagaggctgggtgtg

SEQ ID NO: 37768 - DNA, 201 bp, Homo sapiens
gctgggagtgctggtgcatgcctgtaatctcagctactggggaggctgaggcaggagaatcgtttgaacctgggaggcggaggttgcggtgagccaagatygtgccattgtactggagcctggacaacgagagcgaaactccgtctcaaaaaaaaaaattttgttatttctctctaatgataactccttttaaaattattg

SEQ ID NO: 37769 - DNA, 201 bp, Homo sapiens
  misc_feature (1)...(201): n = A,T,C or G, or insertion/deletion polymorphism (see Tables 1-2)
ggttccgtgatgcctcctgagccgtaaaaccagcaagtttttattagggattttcagaaggggagggagtgtacgaataggtgtgggtcacagagatcacntgcttcacaaggtaatagaatatcacgaggcaaatggaggcagggcgagattgcaggaccacaggaccggggcaaaattaaaattgctaataagtttcgg

SEQ ID NO: 37770 - DNA, 201 bp, Homo sapiens
caccctgatcaacatggagaaaccccgtttctacaaaaagtaaaaattagctgggagtgctggtgcatgcctgtaatctcagctactggggaggctgaggyaggagaatcgtttgaacctgggaggcggaggttgcggtgagccaagattgtgccattgtactggagcctggacaacgagagcgaaactccgtctcaaaaa

SEQ ID NO: 37771 - DNA, 201 bp, Homo sapiens
tattgggcaaaattcacccccgatatttcacgtaggttcttttcaattttccctaagcgtcggccggtttgagaaataaagggacagagtacaaaagagaraaattttaaagctgggcgtccgggggagacatcacatgtcggtaggttccgtgatgcctcctgagccgtaaaaccagcaagtttttattagggattttca

SEQ ID NO: 37772 - DNA, 201 bp, Homo sapiens
cagaaagaaggtctgtttgaaaacagcgtcagcttgcggctcagcaggtgccgttgtagctggcgaggccccacgcgggtgacagcagcccccgtgcttgrtgtttggtcactgcaggcgccgtggtgctgcctgcagaagccctgaaagggtggggttcactctgcgctgttacccggagtctgtgccagtaacttggca

SEQ ID NO: 37773 - DNA, 201 bp, Homo sapiens
tcatagcctcggaggagaaggtcttggtggccgacaagtctggagacgtctactccttttcggtgctggagccacacgggtgtggccgtctagagctgggrcacctgtctatgctgttagatgtggtaggtgggggacgtggtaggtgggggacatggcaggtgtgggacacggtacatgggggacgtggcacgtggggca

SEQ ID NO: 37774 - DNA, 201 bp, Homo sapiens
tgctatctcgactcacagcaacctccgcctcaggctcctgagtagctgggattaaaggcgtgagccactgtgcacggcctcttcttcatttttaatatttyctctgccaggaactgtgggagctcacagggcagttgtatgtgtagctctcatctcttcctttcccctgtgtcctccgctccctcttctcctcactgtctg

SEQ ID NO: 37775 - DNA, 201 bp, Homo sapiens
  misc_feature (1)...(201): n = A,T,C or G, or insertion/deletion polymorphism (see Tables 1-2)
aaccactggggggcttttgtcatctgcttgggaaacagggaatcagctaccctcctttccccactgattccagaatgttccagtgctgtttcctcttcctngatatgtgggggcgtgagcgtccttcggtcttgctcttgttggatcagagcgcccggcgtcgggcccctgcaggtggcgtgaagttaatgggcttcttct

SEQ ID NO: 37776 - DNA, 201 bp, Homo sapiens
taacgctggattcttaagatgtcgaatgcacaccttatccttgcatgcctgtagcaatagtgaccataacatggtgataagggtgataagtggttgacacrgagccgcagttcagtgccagacaccactttcagtgccacatgtgtgttggctgatctgatcctcacggcagttctgggagggtgcaggggtgctgttctg

SEQ ID NO: 37777 - DNA, 201 bp, Homo sapiens
cccactctggggtgaccccggggaactccgctccagcccacgagtcctccgccgcagtctcggcctggccgcgtctctgcgcctggagggtccgctttcgscgtccgctctcggcgtccgctccccggctccggcgcgctccttgcactagatggctggtctgcggtgttcttgcccggttagcgccgccgggtcgcttcc

SEQ ID NO: 37778 - DNA, 201 bp, Homo sapiens
gaggcaggagaatcgtttgaacctgggaggcggaggttgcggtgagccaagattgtgccattgtactggagcctggacaacgagagcgaaactccgtctcaaaaaaaaaaattttgttatttctctctaatgataactccttttaaaattattgttatttctctttagtgatgatgacagcctcttcatctatgactgcag

SEQ ID NO: 37779 - DNA, 201 bp, Homo sapiens
tacaaaaccatggcaatgtctgagtgtcaggtatgagatgctaacgctggattcttaagatgtcgaatgcacaccttatccttgcatgcctgtagcaatartgaccataacatggtgataagggtgataagtggttgacacggagccgcagttcagtgccagacaccactttcagtgccacatgtgtgttggctgatctga

SEQ ID NO: 37780 - DNA, 201 bp, Homo sapiens
ctacacccggcctgtctttaagatttttatttcatcttttttttttttttttttggagaagggtctcattctgtcacccaggctggagtgcggtggtgtgrtcttggctcactacagcctccgcctcccagtttcaagcaattctcccatctcagcctctcgagtagctgggactataggtgcacaccaccatgcctgact

SEQ ID NO: 37781 - DNA, 201 bp, Homo sapiens
tctgccccctgccaggcagctgtgtaagagaggaccaggccttttccttcatgcttcacgtggactcaggttcctggaagtttccttcatttaaaaaaaattttttttttttttttgagatggagtcccactcttgcccaggctggagtgcagtggtgctatctcgactcacagcaacctccgcctcaggctcctgagtag

SEQ ID NO: 37782 - DNA, 201 bp, Homo sapiens
tttgtggtgcctaaaagaatagcatattaattcctgttgagtatttatccctcatttgttttactgaacttttttttcccacagaactatgcagtatgacrtactccaataagagattaagcaaataaagtttgttaactgttccctgaaatattgtatctagacagttttcttgtcaagtatacaacttttaatttaatg

SEQ ID NO: 37783 - DNA, 201 bp, Homo sapiens
caccatgttagccaggccagctcttgaactcctgacctcaggtgatccgctggcctcggcctcccaaactgctgggattacaagtgtgagccactacaccyggcctgtctttaagatttttatttcatcttttttttttttttttttggagaagggtctcattctgtcacccaggctggagtgcggtggtgtgatcttggc

SEQ ID NO: 37784 - DNA, 201 bp, Homo sapiens
aagtagttggggctacagtcgcacgccaccacgcccaacaaatttttgtacttttagtagaaacggggtttcaccatattggtcaggctgctctcgaactkctgacttcatgtgagccacggcccccggttcattcacttcttgaaggatcatttaccaggcatctagtagccatcatcaggtcctacgtctctccagcta

SEQ ID NO: 37785 - DNA, 201 bp, Homo sapiens
  misc_feature (1)...(201): n = A,T,C or G, or insertion/deletion polymorphism (see Tables 1-2)
tgacctccaagcgcgctccctctttttgcagggttgtctgttccctcttcccggcctgcatccactcacctggccttaattgctccttagggctccaagtnatctccgacacttacccaacccaagggtgcacgtggagctcgcagtgcgcacctccctagtggcccttcgcacggctcgggttttgctttccgtaatttt

SEQ ID NO: 37786 - DNA, 201 bp, Homo sapiens
aatcccgtctacttgggaggctgaggcacaagaatcacttgaacctgggaggcggaggttgcagagagctgagattgcggcattgcactccagcctggggratagagcaagactctgtctcccaaaaaaaaaaagagtacagtgttagtgccgggtgcggtggctcatgcctataatctcagcactttgggaagccagggt

SEQ ID NO: 37787 - DNA, 201 bp, Homo sapiens
agactccgtctcaaaaaaaaaaaaaaaaaaagcacagtgttaggacttttctaaatacttttagtttctgtcagtaatcacatcttactggctccttgaartaatggttgaaggcgggtgtaggaagttaacttcagctaattgagatataaaagtagagcatgtgagtgtttcgtatggtggctttctttagttatcatt

SEQ ID NO: 37788 - DNA, 201 bp, Homo sapiens
aagtaatggttgaaggcgggtgtaggaagttaacttcagctaattgagatataaaagtagagcatgtgagtgtttcgtatggtggctttctttagttatcrttggtattgtggctcagtttgttttatcgttattattattttttgagacagggtctctctgttaccccggttggagtgcagttgcacaaacataactccc

SEQ ID NO: 37789 - DNA, 201 bp, Homo sapiens
gagcaatgcccctgcccgccctgcgtctcacagggttgctgtggagttgagtggagtaggtacccatttgccaaagctcagttgagcactttggaagcactttttttttttttttgagacggagttttgctcgtgttgcccaggctggagtacaatggcgctatctcggctcaccgcgacctccgcctcccgggttcaagt

SEQ ID NO: 37790 - DNA, 201 bp, Homo sapiens
cctgcgtctcacagggttgctgtggagttgagtggagtaggtacccatttgccaaagctcagttgagcactttggaagcactttttttttttttttgagayggagttttgctcgtgttgcccaggctggagtacaatggcgctatctcggctcaccgcgacctccgcctcccgggttcaagtgattctcctgcctcagcct

SEQ ID NO: 37791 - DNA, 201 bp, Homo sapiens
  misc_feature (1)...(201): n = A,T,C or G, or insertion/deletion polymorphism (see Tables 1-2)
tatcaaagggaacctcactgggacttggtgacagatgggtgtggggacatgtgtgacaggaaggcaacccagtgttgggcaggagggtgcagcaggcctgnggcgggtggaaatgggcgtggggcctggatttgccaaggtgcgggagacaggcaggcaggggtggcactgccccaccccagaagcctgctctagcactga

SEQ ID NO: 37792 - DNA, 201 bp, Homo sapiens
cctcccgggttcaagtgattctcctgcctcagcctcccgagtagctgggattacaggcatgcgccaccacacccggctaattttgtatttttagtagagayggggtttctccatgttggtcaggctggtcttgaactcccaccctcaggtgatccgcccgccttggcctcccaaagtgctgggattacaggtatgagccac

SEQ ID NO: 37793 - DNA, 201 bp, Homo sapiens
  misc_feature (1)...(201): n = A,T,C or G, or insertion/deletion polymorphism (see Tables 1-2)
ttttgagacagagtcttgctctgtctcccagtctggagtgcagtggcgtgatctcggttcactgcagcctctgcctcccgggctcaagcaatcctcccacntcaggcctcccgagtagctaggattacaggcacacaccaccatgccccgctaattttttatacttttgtagtgatggggttttgccagcttggccaggct

SEQ ID NO: 37794 - DNA, 201 bp, Homo sapiens
ggaatcagctaccctcctttccccactgattccagaatgttccagtgctgtttcctcttccttgatatgtgggggcgtgagcgtccttcggtcttgctctygttggatcagagcgcccggcgtcgggcccctgcaggtggcgtgaagttaatgggcttcttctccttttagaagtttgccgcgtccaggattgcattctgg

SEQ ID NO: 37795 - DNA, 201 bp, Homo sapiens
  misc_feature (1)...(201): n = A,T,C or G, or insertion/deletion polymorphism (see Tables 1-2)
tgcagcctctgcctcccgggctcaagcaatcctcccacttcaggcctcccgagtagctaggattacaggcacacaccaccatgccccgctaattttttatncttttgtagtgatggggttttgccagcttggccaggctggtctcaaacttttgacctcaagcgatccacccacttccgcccactgggattataggcgaga

SEQ ID NO: 37796 - DNA, 201 bp, Homo sapiens
ccttctagggaaatgcttcatcacttagaagtattgagtaaaaacatagtattaaaattaacttcaactgctccctccctccctcccttccttcccccctycccaccccacccttcccctcccttcctttcttttctctttcttagctgtgtcgcccaggctggagtgcagtggcgtgatcttggctcactgcaacctctg

SEQ ID NO: 37797 - DNA, 201 bp, Homo sapiens
  misc_feature (1)...(201): n = A,T,C or G, or insertion/deletion polymorphism (see Tables 1-2)
ctgagagcaccgtgttaaagaaagtctctggtgttcttcgtgggaactgggccatgctggaaggtgagagcacgggtgcaggctgcccttgggggtcacanccagcgcggtccccagagaaagcagaagcacacactgtgacctgcccggggtacctggtgtgcagataaagagggagagtaagcgtgtgtccccatccag

SEQ ID NO: 37798 - DNA, 201 bp, Homo sapiens
ggtaccggtgcctgccaccgcccacgtggcctgccaggctgtcgaggaccctgcgctgctcctggaagctaatgggggtgtctttctggccttctaggacygtggcaaggaggtgtacagccctgactttcatagcctcggaggagaaggtcttggtggccgacaagtctggagacgtctactccttttcggtgctggagc

SEQ ID NO: 37799 - DNA, 201 bp, Homo sapiens
  misc_feature (1)...(201): n = A,T,C or G, or insertion/deletion polymorphism (see Tables 1-2)
ctgtccatgctgttagacgcagtacgtgggggacatggtatgtggggtacaggctgaatcaacgtctgcccggtctgtgccccagcgtttggtggggagantggggctcccccgtagcagggacagccctctgcagatttgggagcaggggagtggtgggaacaggatttaggaaggtggagcagacagcagggagaatga

SEQ ID NO: 37800 - DNA, 201 bp, Homo sapiens
ttactgtgctgctgctgggaagcttcctgttgaagggttttgaggcgtagccaagatggaagttgtgggcagcaacgattctttcccaggtagcagtttaraaccgcaagggacggagggcctgccacctgggcagtcaggagactcttggcccgagggactgaggccaggttttccaagccgaagatgaggacacagggt

SEQ ID NO: 37801 - DNA, 201 bp, Homo sapiens
caggctgagctgctttcctctggggagacagtggggtctctgggcgagggcggcgggccgagctgcttccttgctgggggacggggcgaaccctgtacctkgtctgcatcgctcctggtaacggagcaatgcccctgcccgccctgcgtctcacagggttgctgtggagttgagtggagtaggtacccatttgccaaagct

SEQ ID NO: 37802 - DNA, 201 bp, Homo sapiens
tagtagagatggggtttccccatgttggccaggctggtctcaaacttctgacctcaattgattctcctaccttggcctcccaaagtgctgggattacaggygtgagtcaccgtgcctggcctttttgcccatttttctattgtgctaatggaaggattctcaggttcctaataccttttgctcaggacaggactagaaata

SEQ ID NO: 37803 - DNA, 201 bp, Homo sapiens
cttggcttattttgctaggatctgcctcattggctttgtcatctgcctgggcatattggcactcgagaaacagggaatcggtcaccttccgttccccaccrttgtccttgatgatttgcatgagcgatttacacagtcagagcagagagcctttaattcctgagggtgggtggcatggctgtcacggagtggaaccccgac

SEQ ID NO: 37804 - DNA, 201 bp, Homo sapiens
ttccttaggtgaagcttaaccgtcttcctcctctcttcctcagggaggacgcgcccttggaccaggggagcggtgcgattctggcgtccaccttctccaastctggcagctattttgctttaaccgatgacagtaagcgtctgattcttttccgtacaaaaccatggcaatgtctgagtgtcaggtatgagatgctaacgc

SEQ ID NO: 37805 - DNA, 201 bp, Homo sapiens
  misc_feature (1)...(201): n = A,T,C or G, or insertion/deletion polymorphism (see Tables 1-2)
ccccaccgttgtccttgatgatttgcatgagcgatttacacagtcagagcagagagcctttaattcctgagggtgggtggcatggctgtcacggagtgganccccgaccacacgcagctgtcctctctgtcaccctacctgacggaagccccacaaccatgtgctaacctgtgtgtttggtttgtgcaggacggcaccctg

SEQ ID NO: 37806 - DNA, 201 bp, Homo sapiens
catctagcggccttggcttattttgctaggatctgcctcattggctttgtcatctgcctgggcatattggcactcgagaaacagggaatcggtcaccttcygttccccaccgttgtccttgatgatttgcatgagcgatttacacagtcagagcagagagcctttaattcctgagggtgggtggcatggctgtcacggagt

SEQ ID NO: 37807 - DNA, 201 bp, Homo sapiens
tccgctgaccttggcctcccaaaatgttgggattacaggcgtgagccactgagcccagctacagcagttttcttgactatccctctactggtggtcagcatttttttttttttttgagatggagtttcgctgttgttgcccaggctggagggcaatggcacgatctaggctcactgcaacctccgcctcctgggttcaagt

SEQ ID NO: 37808 - DNA, 201 bp, Homo sapiens
tgggattacaggcgtgagccactgagcccagctacagcagttttcttgactatccctctactggtggtcagcatttttttttttttttgagatggagtttygctgttgttgcccaggctggagggcaatggcacgatctaggctcactgcaacctccgcctcctgggttcaagtgattctcctgcctcagcctcccgagta

SEQ ID NO: 37809 - DNA, 201 bp, Homo sapiens
acatacagatacataccatcccacttacaccatacatgtacatacataccccacacatgcacacattcacacagcatcacagacaccacatacagctgtgcacacactgtaccactcacatcatacatgcacacacactacactatatagacaccatacacacacaccacatagatacgcatacacaaatacatcatacta

SEQ ID NO: 37810 - DNA, 201 bp, Homo sapiens
  misc_feature (1)...(201): n = A,T,C or G, or insertion/deletion polymorphism (see Tables 1-2)
gtctcccagtctggagtgcagtggcgtgatctcggttcactgcagcctctgcctcccgggctcaagcaatcctcccacttcaggcctcccgagtagctagnattacaggcacacaccaccatgccccgctaattttttatacttttgtagtgatggggttttgccagcttggccaggctggtctcaaacttttgacctcaa

SEQ ID NO: 37811 - DNA, 201 bp, Homo sapiens
catacagatacataccatcccacttacaccatacatgtacatacataccccacacatgcacacattcacacagcatcacagacaccacatacagctgtgcacacactgtaccactcacatcatacatgcacacacactacactatatagacaccatacacacacaccacatagatacgcatacacaaatacatcatactat

SEQ ID NO: 37812 - DNA, 201 bp, Homo sapiens
ttggccaggctggtctcaaacttttgacctcaagcgatccacccacttccgcccactgggattataggcgagagccaccatgctgggccataattctctgkttttttttctttcctgttcaatctcgtatttctactcctttaggaatagtcttacttcttgggagattgcctcaactttactttccagccttctgtggag

SEQ ID NO: 37813 - DNA, 201 bp, Homo sapiens
cttcaaagccctggggtcaagaacaagtgcagagctgagatccacgtgccgatgtgtacacggatctcagacgtgatccagttacttagacaacagtggaytgtgtgggttcccgttcagctatggtgagtggggttgtagaagttgggagtgaattctcacttgtctgcttcccctggagtacagttcggtgtcctctca

SEQ ID NO: 37814 - DNA, 201 bp, Homo sapiens
cccaggttcattcaccacggtgggaaggattcctgctaagcttccttgcctctgtccagctcccagggcgtctgcctccctcctgccccagggagagcttytgggtgagtctcgctggcactcctgccccgggcttcctgctctcaggccttggcctgctgcaccttggccaactgcaccacccggcacatcatagcccca

SEQ ID NO: 37815 - DNA, 201 bp, Homo sapiens
gcacatttcttagaagatcctgccagtccttcatcccagaccccgaccccagcgtggaaaacgcagtgcatcctcaacgcctagtgtttgcggctgtggcrgctcatgatcgacttggaaggcccacagtgtgtggtgtggagttttgcagggagccagtgacactgcccaccttcgatccagacctaaccttgatcctgt

SEQ ID NO: 37816 - DNA, 201 bp, Homo sapiens
ggcactgcacaggcatgctggccggcctgacctcagtttccctcttgctgtggccgcttctgctccactctctgtgaggctcatccaccttgttgcctgtrgttgtggattgttcattctcagtgctctgtatgccaagtactccattgtgtgaaaatcccacagcacgttcattctattatcaatgggcatttgggtagt

SEQ ID NO: 37817 - DNA, 201 bp, Homo sapiens
tcagcaactgaatgcacgtgtgtgactacccacgagaagcaggacacttagcacctgctgagaagcccccacgcccatgttcccttctaggcactgcacakgcatgctggccggcctgacctcagtttccctcttgctgtggccgcttctgctccactctctgtgaggctcatccaccttgttgcctgtggttgtggattg

SEQ ID NO: 37818 - DNA, 201 bp, Homo sapiens
tctttcttcattttgattacagtgtgcgtactgtacatccgagaagtgcatgtgaaatgctggaactgggatttcagcaactgaatgcacgtgtgtgactwcccacgagaagcaggacacttagcacctgctgagaagcccccacgcccatgttcccttctaggcactgcacaggcatgctggccggcctgacctcagttt

SEQ ID NO: 37819 - DNA, 201 bp, Homo sapiens
tgggatgaactagcacgggtgtgtggaaggctcccttctgagggcggctgctgcatctacgatggtatcggggatcaggatctcaggtagaaacagtagamgggggcttctctgactcttggaggggtctcagtccatcccattatgggctgcattttttttccttttctttcctttttttctttctttctttttttttaa

SEQ ID NO: 37820 - DNA, 201 bp, Homo sapiens
agtcctcccaccttggcctcccagagtgctgggattacaggcacgagccattatgcccagcccgtctttcttcattttgattacagtgtgcgtactgtacmtccgagaagtgcatgtgaaatgctggaactgggatttcagcaactgaatgcacgtgtgtgactacccacgagaagcaggacacttagcacctgctgagaa

SEQ ID NO: 37821 - DNA, 201 bp, Homo sapiens; identical to SEQ ID NO: 9690

SEQ ID NO: 37822 - DNA, 201 bp, Homo sapiens
ggttaacagctacttcccatgttggctgtttttattggatcagggggtttagggcagaggcttctcttccttagatgaacaggcggcctccccaggcctcycggtccctgcgggcgctgggctcgctgactctgccgctctctctcgccctcacaggtttgtgagccgtatctccgtggtgccaactcagcccgggctgct

SEQ ID NO: 37823 - DNA, 201 bp, Homo sapiens
  misc_feature (1)...(201): n = A,T,C or G, or insertion/deletion polymorphism (see Tables 1-2)
ccactcgtgccctctgcacggggcgtcctgtgccctatctgtcctgggctgtgggctgctgttggtgctgtggtgccgtgcagggcggtggctgcgggacngggcccggctcacgcgatggctagcccaaggtagcagaggccatgactggtggagatggagtgaggctcacgggccaccccattccagggtccccgggaa

SEQ ID NO: 37824 - DNA, 201 bp, Homo sapiens
ctggcaaattgaaaacaaagccccgtggcccctgtgtgtggctggaggtgtgtttctgctggatgtgctgttctgtgccctttgctgacattgcagtatcrgttggttcactggccgtctcccgctgcgtctgagtggttctgtgggtctgttgggcctgttggtgtgtgcagccctcagcgtggtgcctggcatgagtag

SEQ ID NO: 37825 - DNA, 201 bp, Homo sapiens
tttacacagtcagagcagagagcctttaattcctgagggtgggtggcatggctgtcacggagtggaaccccgaccacacgcagctgtcctctctgtcaccytacctgacggaagccccacaaccatgtgctaacctgtgtgtttggtttgtgcaggacggcaccctgaggctctgggagtacaggagcggccgccagctgc

SEQ ID NO: 37826 - DNA, 201 bp, Homo sapiens
  misc_feature (1)...(201): n = A,T,C or G, or insertion/deletion polymorphism (see Tables 1-2)
cctcagctagggtgacaggccggcttgccattggtccagtgacctgccccattctgtgacctcccttggatcctagcacccaagcctgcgagtaaggctcngctgcgtcctagaatcggtgccaggataagcccagctggagaggctgggagcctccggctggggcaggacaaagggacgcggagcagtgccctctgctga

SEQ ID NO: 37827 - DNA, 201 bp, Homo sapiens
  misc_feature (1)...(201): n = A,T,C or G, or insertion/deletion polymorphism (see Tables 1-2)
ctgtgtttccgaaaacaactgtgagagccacggcagcacgtgggaaaggcagagccagagaaccatctgattcgctctgcccagggggtggagagagagcncctggctgctggagtgtgggtgtggatggtgcctggtgtcctcagtgccctgttggggctgcccaggcggctctctggaggggggcttggggcagtgcca

SEQ ID NO: 37828 - DNA, 201 bp, Homo sapiens
  misc_feature (1)...(201): n = A,T,C or G, or insertion/deletion polymorphism (see Tables 1-2)
tgacgagtgatacattgattttgacatgtgtgtttatgagggagaaatcctcccagtggagtctgtgtttccgaaaacaactgtgagagccacggcagcangtgggaaaggcagagccagagaaccatctgattcgctctgcccagggggtggagagagagcacctggctgctggagtgtgggtgtggatggtgcctggtg

SEQ ID NO: 37829 - DNA, 201 bp, Homo sapiens
  misc_feature (1)...(201): n = A,T,C or G, or insertion/deletion polymorphism (see Tables 1-2)
agccgaagatgaggacacagggtgacgagtgatacattgattttgacatgtgtgtttatgagggagaaatcctcccagtggagtctgtgtttccgaaaacnactgtgagagccacggcagcacgtgggaaaggcagagccagagaaccatctgattcgctctgcccagggggtggagagagagcacctggctgctggagtg

SEQ ID NO: 37830 - DNA, 201 bp, Homo sapiens
ttgttgcccgcacaccaccaccttcctcttcgctgtccttccctgtgttgtctgtgttggtcctttgtgtggtgtggcaggatggctgatggaccttctgrccgcttctatgtttcttctctgattgggcttcattcacagcctcctgttcctgctcttcaaattaacacacagccacgcgacctgagagaagaagaaaag

SEQ ID NO: 37831 - DNA, 201 bp, Homo sapiens
tgagccaggagcaagcctgtgaatagccactgcagtgcagtgggcagtgtggaatagaccccatttcaattaaacaacaaaaaaataacaacagataaaascaagaaaaaaaagagaaacgcttttttccattgatgatggttttagagcgtggagcctcttggttcctgtgtcggcttcctgaagggttgtaccagttgt

SEQ ID NO: 37832 - DNA, 201 bp, Homo sapiens
cgaggggcttcagagcaggtgtctgtgggcagcagccccttgcctgtggactccgtagaacgtgtgggtcagtcggtctcttctgggtggtcagtgtcccrgccttcactcttgcccaggtctgtcccctggggctctgggaggtgagtgcgaaggggctaggtgactctcttctcagtgagtatttggcatccccgagac

SEQ ID NO: 37833 - DNA, 201 bp, Homo sapiens; identical to SEQ ID NO: 9689

SEQ ID NO: 37834 - DNA, 201 bp, Homo sapiens
tggctgagcatcccctctcccagcactcggaggcacctgcagttgctcagctgttcattgagtgctgggagtggaaactcatacgctgagcggcagtgacrctgcggagctgacaaaccccacagcccgcccggtcacctgcttcaccgagggccacagcccccccggggtcaggtggccacaggggtcctggccatgtgg

SEQ ID NO: 37835 - DNA, 201 bp, Homo sapiens
tgagtggagaggtggcaatttttcagaacccacagacccccaagcccgtcccccaccctggggtgtatcaggtaatgggggggtgagcaggaatcaatggsggggtggtcagggggtcccctctgtgattcatctctgcctcccagtggccaagtgtgagttcttcaacgcgggcgggagcgtgaaggaccgcatcagcct

SEQ ID NO: 37836 - DNA, 201 bp, Homo sapiens
tttcagggcaaaatctccaaaaatcttgccagatattctgaagaaaatcggggacacccctatggtcagaatcaacaagattgggaagaagttcggcctgmagtgtgagctctgtgagtgccctggctttggagaggggcttcctccatctacactgggctccgtgggcctggggggtcctggggggtcctgggatggatc

SEQ ID NO: 37837 - DNA, 201 bp, Homo sapiens; identical to SEQ ID NO: 9714

SEQ ID NO: 37838 - DNA, 201 bp, Homo sapiens
cctccatctacactgggctccgtgggcctggggggtcctggggggtcctgggatggatcccttaggcaaggccctgggatcagaaaactcgctggttaatragtggccaagaacatatcagcttaagtttgggaaaaacacacaacagggcattgtgtcagagggtgaccaaagtgactccccagcagatggaccagggaa

SEQ ID NO: 37839 - DNA, 201 bp, Homo sapiens
  misc_feature (1)...(201): n = A,T,C or G, or insertion/deletion polymorphism (see Tables 1-2)
gcacgcgtggctggctcactgtgctccgtacaggatgacgtctaaacttggcggttgcccttgaagtaggttttggaatgcccgttttacagacagacacnccgagggtcaggttggtcacgtggcttgccggaggccaccagctctgatttctgcttcggagctggcccccaggcgctagtgagaatgatctaactgagg

SEQ ID NO: 37840 - DNA, 201 bp, Homo sapiens
taggtctgcaacatgtcagttttgaggggacacaatctagcccatagcactccccacccccaacacacacacaccgtgcacagagtgcctgttaggccggrtgtgatggctcacgcctgtaatcctagcactttgggaggccgaggcaggtggatcacctgagtcaggagttcgagaccagcctggccaacatggagtgcc

SEQ ID NO: 37841 - DNA, 201 bp, Homo sapiens
cggctctgtgctcatttgtcagacaatagggacccttaactcgtacgcagcacgcgtggctggctcactgtgctccgtacaggatgacgtctaaacttggyggttgcccttgaagtaggttttggaatgcccgttttacagacagacacaccgagggtcaggttggtcacgtggcttgccggaggccaccagctctgattt

SEQ ID NO: 37842 - DNA, 201 bp, Homo sapiens; identical to SEQ ID NO: 9721

SEQ ID NO: 37843 - DNA, 201 bp, Homo sapiens
ccggctctgtgctcatttgtcagacaatagggacccttaactcgtacgcagcacgcgtggctggctcactgtgctccgtacaggatgacgtctaaacttgrcggttgcccttgaagtaggttttggaatgcccgttttacagacagacacaccgagggtcaggttggtcacgtggcttgccggaggccaccagctctgatt

SEQ ID NO: 37844 - DNA, 201 bp, Homo sapiens
ggtgttaggggagtgggtggtgccgaccttcagtgacacccagtctttatgcccgggcctcccacatgccctgggctggtgggctgtacctgtgattcctrcagggacccctcatcaggccacactgggtagggccctttgtccagcatgcagaggctcaggagtccaggccccttgcctccggggaggccagcagtcttg

SEQ ID NO: 37845 - DNA, 201 bp, Homo sapiens
agagccctggtagacctcagcatcgtcacagagaaagctgtgggtgcagaggccttggggacaaggcggggacggaatttcgtatttcagatgaccaaggycaagtgagttcggagggaggcaggaagggtgccgcggagaaccccgcgacagggccagatggagggggtggagttcgagtgggaaggagagggaaccagt

SEQ ID NO: 37846 - DNA, 201 bp, Homo sapiens
caccgaggcccagtgctgagtcagcacacctgctgcagggaggcgggactcttcccgcctggctggccagatgcccgaactgaattaatgaactaatcccmggcgctgtcaccctggggcttggctttccacctggccctggctctctacacctgccaagcctggttcccttctgccgagaactgcttctgagggaacctc

SEQ ID NO: 37847 - DNA, 201 bp, Homo sapiens
aaatgtcatctccagtaaagcctttctgaaaaggtggacctaaacctttgttttggagtcagtatttgcttattttaacttttttatttggaaataatttrctactcacaataagtggcaaaaataatagatcctttgtacccttctcccagcttcccactaacaacatctgccacgactgtaggttcattttcaaacctg

SEQ ID NO: 37848 - DNA, 201 bp, Homo sapiens
aatacttggagcctgggttcttgggtttctcatcctgcctctgaggctgggaacaggccaccacccacaggcagatcattaacaggcagttgttaacggcrgtattggccactcccataatagaatatcgaggcatgtccaggcggggcttttgctggccttgagccctgaagccgcgccctctgcagatcattggggtgg

SEQ ID NO: 37849 - DNA, 201 bp, Homo sapiens; identical to SEQ ID NO: 9758

SEQ ID NO: 37850 - DNA, 201 bp, Homo sapiens; identical to SEQ ID NO: 9806

SEQ ID NO: 37851 - DNA, 201 bp, Homo sapiens; identical to SEQ ID NO: 9759

SEQ ID NO: 37852 - DNA, 201 bp, Homo sapiens
acgtgctgcgggcactgggggctgagattgtgaggacgcccaccaatgccaggttcgactccccggagtcacacgtgggggtggcctggcggctgaagaaygaaatccccaattctcacatcctagaccaggtgaggcacctggggcctggagacaggcattccctaggagggtctcggtcagggatgtgggggtgactga

SEQ ID NO: 37853 - DNA, 201 bp, Homo sapiens; identical to SEQ ID NO: 9720

SEQ ID NO: 37854 - DNA, 201 bp, Homo sapiens; identical to SEQ ID NO: 9724

SEQ ID NO: 37855 - DNA, 201 bp, Homo sapiens
  misc_feature (1)...(201): n = A,T,C or G, or insertion/deletion polymorphism (see Tables 1-2)
gtaggctcgtggcagaggacttccatgtgtggccagagagcgctcctccctggggcagctgagcgtgtgccccaccgtcctgggaggggtgaggtatgagngctgacccctgcctgcccccgtcccacagggtaatcctgggaatggtgacgcttgggaacatgctctcgtccctgcttgccgggaaggtgcagccgtcag

SEQ ID NO: 37856 - DNA, 201 bp, Homo sapiens
gggggccgggtcagcagggttcgctggaaccccacagcatccgagcctgaaccgacgcctctctccttgctttgccaggtcccagcatgccttctgagacyccccaggcagaagtggggcccacaggctgcccccaccgctcagggccacactcggcgaaggggagcctggagaaggggtccccagaggataaggaagcca

SEQ ID NO: 37857 - DNA, 201 bp, Homo sapiens
ctcatcctgcctctgaggctgggaacaggccaccacccacaggcagatcattaacaggcagttgttaacggcggtattggccactcccataatagaatatygaggcatgtccaggcggggcttttgctggccttgagccctgaagccgcgccctctgcagatcattggggtggatcccgaagggtccatcctcgcagagcc

SEQ ID NO: 37858 - DNA, 201 bp, Homo sapiens
cttgccgggaaggtgcagccgtcagaccaagttggcaaagtcatctacaagcagttcaaacaggtacccagtcacctacaggcagctcaaacagatgcgcrgtcacctacaggcagctcaaacaggtgcccggtcacctacacgcagctcaaacaggtgcgcggtcacctacaggcagctcaaacaggtgagcggtcacct

SEQ ID NO: 37859 - DNA, 201 bp, Homo sapiens
aacaggtgcccggtcacctacacgcagctcaaacaggtgcgcggtcacctacaggcagctcaaacaggtgagcggtcacctacaggcagctcaaacaggtrcccggtcacctacaggcagctcaaacaggtgcgcggtcagctacaggcagctcaagcgggtgcgcggtcacctacaggcagctcaaacgggtgcccagtc

SEQ ID NO: 37860 - DNA, 201 bp, Homo sapiens
caggtgcccggtcacctacacgcagctcaaacaggtgcgcggtcacctacaggcagctcaaacaggtgagcggtcacctacaggcagctcaaacaggtacscggtcacctacaggcagctcaaacaggtgcgcggtcagctacaggcagctcaagcgggtgcgcggtcacctacaggcagctcaaacgggtgcccagtcac

SEQ ID NO: 37861 - DNA, 201 bp, Homo sapiens; identical to SEQ ID NO: 9713

SEQ ID NO: 37862 - DNA, 201 bp, Homo sapiens
gggcccagactggttcctgccgcgtgtaggctcgtggcagaggacttccatgtgtggccagagagcgctcctccctggggcagctgagcgtgtgccccacygtcctgggaggggtgaggtatgagcgctgacccctgcctgcccccgtcccacagggtaatcctgggaatggtgacgcttgggaacatgctctcgtccctg

SEQ ID NO: 37863 - DNA, 201 bp, Homo sapiens
caccacccagataaagccagttctttttttttttttttttttttttccagttcttcgagtgttgatttgtgtaagacaatgtctgccagggctggtactatttttttttttttttcctgaataattgtggactcctctgtttcagggcaaaatctccaaaaatcttgccagatattctgaagaaaatcggggacaccccta

SEQ ID NO: 37864 - DNA, 201 bp, Homo sapiens; identical to SEQ ID NO: 9717

SEQ ID NO: 37865 - DNA, 201 bp, Homo sapiens
tctgccagggctggtactatttttttttttttttcctgaataattgtggactcctctgtttcagggcaaaatctccaaaaatcttgccagatattctgaaraaaatcggggacacccctatggtcagaatcaacaagattgggaagaagttcggcctgaagtgtgagctctgtgagtgccctggctttggagaggggcttc

SEQ ID NO: 37866 - DNA, 201 bp, Homo sapiens
cgtgcacgtgcacaattcatgcatacgtgtgcacccacgcacgctcaccctggcgcgtctgactcgtggccctctctgcaggtggcagtgctggcagcacrgtggcggtggccgtgaaggccgcgcaggagctgcaggagggccagcgctgcgtggtcattctgcccgactcagtgcggaactacatgtaagacacggctt

SEQ ID NO: 37867 - DNA, 201 bp, Homo sapiens; identical to SEQ ID NO: 9784

SEQ ID NO: 37868 - DNA, 201 bp, Homo sapiens
gctcagtggggctggcgggcagttttgctgtctgcaaaacgtgttggaactggaaagtctgcagacgtgccgatcccagggggagaggctggggtgagacmtctggggtcctaccgcctagacacggggtccaccatgaggctgttcaccctcttggtcacgtgggagcggctcccacgctgacgggctgtggtggggtcc

SEQ ID NO: 37869 - DNA, 201 bp, Homo sapiens
tttttttttttttttcctgaataattgtggactcctctgtttcagggcaaaatctccaaaaatcttgccagatattctgaagaaaatcggggacacccctwtggtcagaatcaacaagattgggaagaagttcggcctgaagtgtgagctctgtgagtgccctggctttggagaggggcttcctccatctacactgggctc

SEQ ID NO: 37870 - DNA, 201 bp, Homo sapiens; identical to SEQ ID NO: 9786

SEQ ID NO: 37871 - DNA, 201 bp, Homo sapiens
attaacaggcagttgttaacggcggtattggccactcccataatagaatatcgaggcatgtccaggcggggcttttgctggccttgagccctgaagccgckccctctgcagatcattggggtggatcccgaagggtccatcctcgcagagccggaggagctgaaccagacggagcagacaacctacgaggtggaagggatc

SEQ ID NO: 37872 - DNA, 201 bp, Homo sapiens
gagctccgagaaggtgggtgggcgtggccaggggcggggtcatagggcaggggatgagggtgcctgggccaggcggaaggtgcaggccaccgctttccctcctgcaggtggacgtgctgcgggcactgggggctgagattgtgaggacgcccaccaatgccaggttcgactccccggagtcacacgtgggggtggcctggc

SEQ ID NO: 37873 - DNA, 201 bp, Homo sapiens; identical to SEQ ID NO: 9789
  misc_feature (1)...(201): n = A,T,C or G, or insertion/deletion polymorphism (see Tables 1-2)

SEQ ID NO: 37874 - DNA, 201 bp, Homo sapiens
cccagcactttgggaggtcgaggcgggtggatcacctgaggtcaggagttcaagaccagcctggccaacagggagaaaccccgtctctactaaaaataccaaaaaaaaaaaaaaaagtagccgatgtaatggtgcatgcctgtaatcccagctactcgggaggctgaggcaagagaattgcttgaacctgggaggtggagg

SEQ ID NO: 37875 - DNA, 201 bp, Homo sapiens
ctggtggcttcagtgggcacgggcggcaccatcacgggcattgccaggaagctgaaggagaagtgtcctggatgcagggtgagtggtgtggccgggccggrgaggggcagtgcggagtggccccggcttctgagctgaaagctgtcattcctcacggtctgctcagcacgctgtctcccgcggtatttctgcgctgcctgg

SEQ ID NO: 37876 - DNA, 201 bp, Homo sapiens
aggcaagagaattgcttgaacctgggaggtggaggttgcagtgagccgagatcacgccattgcactccagcctgggtgataagagcaaaaactccatctcaaaaaaaaaaaaaagaaaagaaaagcattttccagatgaatctgtcacgaaaggtgacttggtgcccataatcgttgggctctccctgtctcagtctccct

SEQ ID NO: 37877 - DNA, 201 bp, Homo sapiens
ctccagggctatccctgcaagtcacatcctttttcttgctaagcgctctgggcctggccctgatcacctctgcaaacttctcaggtaacttcacagccacygaggcccagtgctgagtcagcacacctgctgcagggaggcgggactcttcccgcctggctggccagatgcccgaactgaattaatgaactaatccccggc

SEQ ID NO: 37878 - DNA, 201 bp, Homo sapiens
  misc_feature (1)...(201): n = A,T,C or G, or insertion/deletion polymorphism (see Tables 1-2)
tcggagggcccctgagaatagtggcgttgcggggaggtgctgcagaggtgggtcaggagttggaggttcattctaggacagtggcgtgtcctcccaggagnctcttgggctgtggaagtgggagtccttgagataaggggctccagggctatccctgcaagtcacatcctttttcttgctaagcgctctgggcctggccct

SEQ ID NO: 37879 - DNA, 201 bp, Homo sapiens
atccacgtatttcccacgttcggctgccactgcctcccgggtgggctttgcaggacccaccatcgcatcccctctcactccacagaaaactcgtggggccrtgttccccctgccactgaccacgcttcccttgcagatccgcctcacggacacgctgggcaggctctcgcacatcctggagatggaccacttcgccctggt

SEQ ID NO: 37880 - DNA, 201 bp, Homo sapiens
tggatcccgaagggtccatcctcgcagagccggaggagctgaaccagacggagcagacaacctacgaggtggaagggatcggctacgacttcatccccacrgtgctggacaggacggtaggtcgagtccagagcccggccacagtgccggtgcagcctgtaactcaccctcacactggggagcctggctgaccctgggccc

SEQ ID NO: 37881 - DNA, 201 bp, Homo sapiens
  misc_feature (1)...(201): n = A,T,C or G, or insertion/deletion polymorphism (see Tables 1-2)
tatcgagccgacatccgggaacaccggtgggtgccaggcccagagggggtggccagggctggctgtcccctacccatgccgagcctgccgggacccggggnggatggctgagctgcagccgcatgtgctggcccgcctggccgcctgctccctggcatcttgcacccgctgccggcctgtgtcccaacctagcttcctttg

SEQ ID NO: 37882 - DNA, 201 bp, Homo sapiens; identical to SEQ ID NO: 9793
  misc_feature (1)...(201): n = A,T,C or G, or insertion/deletion polymorphism (see Tables 1-2)

SEQ ID NO: 37883 - DNA, 201 bp, Homo sapiens; identical to SEQ ID NO: 9774
  misc_feature (1)...(201): n = A,T,C or G, or insertion/deletion polymorphism (see Tables 1-2)

SEQ ID NO: 37884 - DNA, 201 bp, Homo sapiens; identical to SEQ ID NO: 9775
  misc_feature (1)...(201): n = A,T,C or G, or insertion/deletion polymorphism (see Tables 1-2)

SEQ ID NO: 37885 - DNA, 201 bp, Homo sapiens; identical to SEQ ID NO: 9778
  misc_feature (1)...(201): n = A,T,C or G, or insertion/deletion polymorphism (see Tables 1-2)

SEQ ID NO: 37886 - DNA, 201 bp, Homo sapiens
tcacatctggtgcccagggtcaagatgccctgtgcagggctcctgcccacccccgtcagtgcaagaacaccatctccccacatacttggccagcctgccaygtgtacctgtgcgtgtgagtgtgtgaggggcagagagcgagcatgagaggacgtgtttatctgagtgcctgagcgatggctgtgtgcatgctcacacacg

SEQ ID NO: 37887 - DNA, 201 bp, Homo sapiens
gccctggccacatggactgacgtcctcttgggccgggccctgtgccacctcctatccaccctgactccctctgctgcttcccccaaactccagattgggamcgagtgctgcccaggtggccccctaggacttgctgtgactgttttgcccagaggcccctcggacagtaacgccacagacctcgctggtcaccgggcagcc

SEQ ID NO: 37888 - DNA, 201 bp, Homo sapiens
acatggagataagatctacctcatgcagatgaatggagaagcaaaatgtggactatccgggcaacggacaatgattcagcttaaaaaggaatgaaaccacrccacgtgctacaacagcacaaaccctgcatgaccccacgaatcctgcgtgaccccacttatgtaaagaatctagaacagctgaactcagagaggcaacga

SEQ ID NO: 37889 - DNA, 201 bp, Homo sapiens
ccctggcgcgtctgactcgtggccctctctgcaggtggcagtgctggcagcacggtggcggtggccgtgaaggccgcgcaggagctgcaggagggccagcrctgcgtggtcattctgcccgactcagtgcggaactacatgtaagacacggcttccctcccaggtccctgctcctctccatcctgccacccttccctggat

SEQ ID NO: 37890 - DNA, 201 bp, Homo sapiens
catacgtgtgcacccacgcacgctcaccctggcgcgtctgactcgtggccctctctgcaggtggcagtgctggcagcacggtggcggtggccgtgaaggcygcgcaggagctgcaggagggccagcgctgcgtggtcattctgcccgactcagtgcggaactacatgtaagacacggcttccctcccaggtccctgctcct

SEQ ID NO: 37891 - DNA, 201 bp, Homo sapiens
  misc_feature (1)...(201): n = A,T,C or G, or insertion/deletion polymorphism (see Tables 1-2)
caaacctaggagtgaattcgacttctttcccatctcacacacacacccgagacgtcacccgaatccacgtatttcccacgttcggctgccactgcctcccnggtgggctttgcaggacccaccatcgcatcccctctcactccacagaaaactcgtggggccatgttccccctgccactgaccacgcttcccttgcagatc

SEQ ID NO: 37892 - DNA, 201 bp, Homo sapiens
tctatcagtggaaaagacaaatcaacaaaaatccctaccccagcatgaaactgaaatcaagctcactaagccttaggattatctttatttccttagtgtamtcttggaggagaacaaatagatcaaagaatgtgcttcttagatgtttgattccttttttttttttttttttttttgagacagagtctcgctgtcacccag

SEQ ID NO: 37893 - DNA, 201 bp, Homo sapiens
ttttctggtggcacagactgttcggtgaagaagccatcattttgtaagccctctacggggtagatagatgtttgcagttacctcattttacataactgcartagaagatacgacacattcatttagccaacaagtctttcctcagcgccatgtgcatttcgtgccctgctcaaggcgcagaagatctatcagtggaaaaga

SEQ ID NO: 37894 - DNA, 201 bp, Homo sapiens
ccgtgcccctctgcccacctgcttgggggtggacagaccaggtggccgctggcaatgccactgactagccacacaggcagcagaggccctgtagggaccayagttgatctagacctctggggactcggagagcacacaccagcttctaaaacgcaggcagggacatgtgaggtttctacatgtgcattccgtgtgtcatgt

SEQ ID NO: 37895 - DNA, 201 bp, Homo sapiens
tcactgcccagcaatgccctttgtccccaaaggctctgctgctccgccgcagggtggtctgtctggactgtcctgggggccccgctccgagaagcaccccrgggaggtcagttcctcccaggcacctgcctttacttctgagcgccctgcactgaacatttaggtcattaccgctttaatacttggagcctgggttcttgg

SEQ ID NO: 37896 - DNA, 201 bp, Homo sapiens
cggagcagacaacctacgaggtggaagggatcggctacgacttcatccccacggtgctggacaggacggtaggtcgagtccagagcccggccacagtgccrgtgcagcctgtaactcaccctcacactggggagcctggctgaccctgggccccaaccagcttctccactgaaacagaagggcaagccccgcacgcatggt

SEQ ID NO: 37897 - DNA, 201 bp, Homo sapiens
  misc_feature (1)...(201): n = A,T,C or G, or insertion/deletion polymorphism (see Tables 1-2)
gacaagggtgcttgacacataagggaccagcagctcgtgacccgaaggagctggggctgggtgctcgctcaccggccagtgtcttggagaaccttcctgcnctgagtggggggtcggagttccaactgggggcctctgaggatcagccaggagctctaagtcctctggtcctgagtctgcccctcaactggggcttgtggg

SEQ ID NO: 37898 - DNA, 201 bp, Homo sapiens
ggtcagggatgtgggggtgactgaggtgtcaggggtcagctcacgggctctgctctctttctatgcagtaccgcaacgccagcaaccccctggctcactaygacaccaccgctgatgagatcctgcagcagtgtgatggtgcgtccctctgtccatcttgattgcatttatccctggctgcctgggagtgtacacatctct

SEQ ID NO: 37899 - DNA, 201 bp, Homo sapiens; identical to SEQ ID NO: 9722

SEQ ID NO: 37900 - DNA, 201 bp, Homo sapiens
ccgacatccgggaacaccggtgggtgccaggcccagagggggtggccagggctggctgtcccctacccatgccgagcctgccgggacccgggggggatggmtgagctgcagccgcatgtgctggcccgcctggccgcctgctccctggcatcttgcacccgctgccggcctgtgtcccaacctagcttcctttgaccagca

SEQ ID NO: 37901 - DNA, 201 bp, Homo sapiens
  misc_feature (1)...(201): n = A,T,C or G, or insertion/deletion polymorphism (see Tables 1-2)
ttgaggatgctgagcgcgacgggacgctgaagcccggggacacgattatcgagccgacatccgggaacaccggtgggtgccaggcccagagggggtggccngggctggctgtcccctacccatgccgagcctgccgggacccgggggggatggctgagctgcagccgcatgtgctggcccgcctggccgcctgctccctgg

SEQ ID NO: 37902 - DNA, 201 bp, Homo sapiens
  misc_feature (1)...(201): n = A,T,C or G, or insertion/deletion polymorphism (see Tables 1-2)
agaggacttgcagtaaggaaggaagtgcaagtgaaggccttggccttgtgcgggaaccgcgcagggagcccttccccgggcaggtgacgccccacaggggnaggaggacaatgggaggctgtagggagagtatgcgagtccccatccgatggggaagccagtgctgtggcttcaggacatcaagctgctttggcaggggcc

SEQ ID NO: 37903 - DNA, 201 bp, Homo sapiens
ctcgctcttaaaaactaaatatttttaagagctggagagggagagaggacttgcagtaaggaaggaagtgcaagtgaaggccttggccttgtgcgggaacygcgcagggagcccttccccgggcaggtgacgccccacagggggaggaggacaatgggaggctgtagggagagtatgcgagtccccatccgatggggaagc

SEQ ID NO: 37904 - DNA, 201 bp, Homo sapiens
cctggttctaggggcaacacctgtctggtggttgctttcagaaattttgaggtgctgcaggctggtcccaggtccctcaaatcacatttcatgcagcccaktctctcgctcttaaaaactaaatatttttaagagctggagagggagagaggacttgcagtaaggaaggaagtgcaagtgaaggccttggccttgtgcggg

SEQ ID NO: 37905 - DNA, 201 bp, Homo sapiens
tgtgtttttgtgcagttcttcctgggcttctctgagggagcagagcacgcctcccagagggggccgggtcagcagggttcgctggaaccccacagcatccragcctgaaccgacgcctctctccttgctttgccaggtcccagcatgccttctgagaccccccaggcagaagtggggcccacaggctgcccccaccgctca

SEQ ID NO: 37906 - DNA, 201 bp, Homo sapiens
  misc_feature (1)...(201): n = A,T,C or G, or insertion/deletion polymorphism (see Tables 1-2)
cccatgttggtggagaaacaagcccctgcctttggggctggaaagcaggtccatgggccccgttacagaggagggtgcctctcttcctgtgggggctcctnctgcagacttagaccttcccgactgctgtgtgcaccctcaaactaagcccagagaagacgcctctgactctgacttcagggctcctagggacagctggtg

SEQ ID NO: 37907 - DNA, 201 bp, Homo sapiens
agtgccggtgcagcctgtaactcaccctcacactggggagcctggctgaccctgggccccaaccagcttctccactgaaacagaagggcaagccccgcacrcatggtgagaagctggtctcgaaggtcgagacaaagtagactgggggacgatgtccgcacacgtggcctgacctcaccaagggatgtagcccaggtggca

SEQ ID NO: 37908 - DNA, 201 bp, Homo sapiens
ccccctcttaatctcacatttacttgtgtttgaacatctcagaaaaaaaaaaagatgcaaattccaatgtcagggtccccaaatcaagtcttcctggagcytgtccacgcttgtcaccaccgtctgtggctgctttcaagcacgtcagggctgcgtgctcataacagagacggcacggcccccaagacctaaaataccacc

SEQ ID NO: 37909 - DNA, 201 bp, Homo sapiens
  misc_feature (1)...(201): n = A,T,C or G, or insertion/deletion polymorphism (see Tables 1-2)
gcctggcctctgccatgggcagcagctgggccccccatcccctgcggggtgttaggggagtgggtggtgccgaccttcagtgacacccagtctttatgccngggcctcccacatgccctgggctggtgggctgtacctgtgattcctgcagggacccctcatcaggccacactgggtagggccctttgtccagcatgcaga

SEQ ID NO: 37910 - DNA, 201 bp, Homo sapiens
ttaacggcggtattggccactcccataatagaatatcgaggcatgtccaggcggggcttttgctggccttgagccctgaagccgcgccctctgcagatcaytggggtggatcccgaagggtccatcctcgcagagccggaggagctgaaccagacggagcagacaacctacgaggtggaagggatcggctacgacttcatc

SEQ ID NO: 37911 - DNA, 201 bp, Homo sapiens
ctgatgtcgtatatttgttactttatttattttcttttatttttatttttatttttattttttgagacggagtctcgctctgttgccaggctggagtgcartggcgcgatctcggctcactgacctccccctcccgggttcaagcgattctcctgcctcagcttcccgagtagctgggactacaggtgtgcgccaccatgc

SEQ ID NO: 37912 - DNA, 201 bp, Homo sapiens
tgagacggagtctcgctctgttgccaggctggagtgcagtggcgcgatctcggctcactgacctccccctcccgggttcaagcgattctcctgcctcagcytcccgagtagctgggactacaggtgtgcgccaccatgcttggctaatttttgtagttttagtagaaacggggtttcaccatgttggccaggatggtctcg

SEQ ID NO: 37913 - DNA, 201 bp, Homo sapiens
cactgacctccccctcccgggttcaagcgattctcctgcctcagcttcccgagtagctgggactacaggtgtgcgccaccatgcttggctaatttttgtakttttagtagaaacggggtttcaccatgttggccaggatggtctcgatctcttgacctcatgatccgcccgcctcggcctcccaaagtgctgggattacag

SEQ ID NO: 37914 - DNA, 201 bp, Homo sapiens
gtgcgccaccatgcttggctaatttttgtagttttagtagaaacggggtttcaccatgttggccaggatggtctcgatctcttgacctcatgatccgcccrcctcggcctcccaaagtgctgggattacaggcgtgagccaccgcgcccggcctatttgttacaattaatgagccaattccacgatcacataaccattgtt

SEQ ID NO: 37915 - DNA, 201 bp, Homo sapiens
gtgccctcagggatcgggctggccctggctgcggcagtgaggggctatcgctgcatcatcgtgatgccagagaagatgagctccgagaaggtgggtgggcrtggccaggggcggggtcatagggcaggggatgagggtgcctgggccaggcggaaggtgcaggccaccgctttccctcctgcaggtggacgtgctgcgggc

SEQ ID NO: 37916 - DNA, 201 bp, Homo sapiens
aggcaggggcggggcagggcttggggggtcactgggcccctctcaccctctgtgtgccctcagggatcgggctggccctggctgcggcagtgaggggctaycgctgcatcatcgtgatgccagagaagatgagctccgagaaggtgggtgggcgtggccaggggcggggtcatagggcaggggatgagggtgcctgggcca

SEQ ID NO: 37917 - DNA, 201 bp, Homo sapiens
gcgcgacgggacgctgaagcccggggacacgattatcgagccgacatccgggaacaccggtgggtgccaggcccagagggggtggccagggctggctgtcmcctacccatgccgagcctgccgggacccgggggggatggctgagctgcagccgcatgtgctggcccgcctggccgcctgctccctggcatcttgcacccg

SEQ ID NO: 37918 - DNA, 201 bp, Homo sapiens
cccagagaactctctaatcagaatccacatttccttcactctagcccagtctccagtggcgctagatcccaaagagagagaaagacaggcaagctgagggyggcattctcctagttgctggcatggtgtggtccctcccctgggggaagggggagagcaagctgcaaccctccatctgcctggggttgggggttcccaggc

SEQ ID NO: 37919 - DNA, 201 bp, Homo sapiens
tccccacactgatgcctcaaatgtcatcaaagccagacagcccttggggttaagcattgctcccaccttgctctcctccagggaggttgtcttcctgagcrgtccctttcatccataccattcactccagaccttgagtggcagccagtctggggtagatacaccgtctagtggcccagtttcctccaatcattcctgaac

SEQ ID NO: 37920 - DNA, 201 bp, Homo sapiens; identical to SEQ ID NO: 9832

SEQ ID NO: 37921 - DNA, 201 bp, Homo sapiens
agaccttgagtggcagccagtctggggtagatacaccgtctagtggcccagtttcctccaatcattcctgaacctaaggtttctgagtacctgggccattrttcccacccagggcaacctccccaacagagcctgaagtccccccagcccccgtgactgccgtccccctcttccacactttccctccctcagatcagccag

SEQ ID NO: 37922 - DNA, 201 bp, Homo sapiens; identical to SEQ ID NO: 9833

SEQ ID NO: 37923 - DNA, 201 bp, Homo sapiens; identical to SEQ ID NO: 9834

SEQ ID NO: 37924 - DNA, 201 bp, Homo sapiens
gggctctcctgcttgctctgaggaaatggagctgcagaacaggatgggggagagaagaagggcctctgtcctttcccagatatctgggctttttcctgatytctccgtagagttagacagttctgggtcttttcaatctgagagggcctagagcatgtctggggcttaggggtaaacttacggagtccccttattcccctg

SEQ ID NO: 37925 - DNA, 201 bp, Homo sapiens
gggcagagcctgtagcattgtagatatgaggcctttgtttttctgcgttgagcagggcatggggataactggggagagtgagacctggggagaaatgacamcctctctgtcacagacatggctgggctccctgctgttgttggtctgtctcctggcgagcaggagtatcaccgaggaggtgtcggagtactgtagccacat

SEQ ID NO: 37926 - DNA, 201 bp, Homo sapiens; identical to SEQ ID NO: 9843

SEQ ID NO: 37927 - DNA, 201 bp, Homo sapiens
actatataagcagaggccacggccaaaccccaaaccactatccggccagaggcaggaaagtgaatcagaggagacgaggaagaagcctgaggttaacctcrtgcagactgtgggccgtggcaagaaaggagttggtgacaggactagatgcagggcctgggtgggtgtccaaagaccccttgaataaggcactaaagtcat

SEQ ID NO: 37928 - DNA, 201 bp, Homo sapiens
acacaggccatgagaggcagtccgagggatcctccagcccgcagctccaggagtctgtcttccacctgctggtgcccagtgtcatcctggtcttgctggcygtcggaggcctcttgttctacaggtggaggcggcgggtgagtagatccccatgaggaagaagagcacgtcccttagggcaggggcagagcctggcggggg

SEQ ID NO: 37929 - DNA, 201 bp, Homo sapiens; identical to SEQ ID NO: 9838

SEQ ID NO: 37930 - DNA, 201 bp, Homo sapiens; identical to SEQ ID NO: 9839
  misc_feature (1)...(201): n = A,T,C or G, or insertion/deletion polymorphism (see Tables 1-2)

SEQ ID NO: 37931 - DNA, 201 bp, Homo sapiens
ccctatatacatccatcgtgattaaagcctcatattccagaaacccagagaactctctaatcagaatccacatttccttcactctagcccagtctccagtrgcgctagatcccaaagagagagaaagacaggcaagctgagggcggcattctcctagttgctggcatggtgtggtccctcccctgggggaagggggagagc

SEQ ID NO: 37932 - DNA, 201 bp, Homo sapiens
tgggttctgtctcctccatccccaccttcacccctcaatcagttgcttggacaatttcaagagcctcctaactggtgtctccctgctttctagttcactcstcatcttaccactgggggaaattttctgaaacgccaacctgctgcctttacctccttctcccaaaaacatcagggcccccatcactccagaagaaagcca

SEQ ID NO: 37933 - DNA, 201 bp, Homo sapiens
tgaaactatcctttggctcttccttccatggctcccacccctctcctgccatcaccttctccccatctttcaaggcctcactgaggtccctgctctctgcmgtctccctggtcacccagccagagctgccttctcctccccagaagagctggcaagcatttgggcttttggtgatatgtagattagcacattgttgtgggc

SEQ ID NO: 37934 - DNA, 201 bp, Homo sapiens
ttggcagggatgaagttcaaaccccaatccactcagaagctaaggtccccgttttgaagaaggctgaaggctgagttgagctgtaggttaccctgcaatcrttggcctgctctctcttacagattgacagtcagatggagacctcgtgccaaattacatttgagtttgtagaccaggaacagttggtgagtgatggctttt

SEQ ID NO: 37935 - DNA, 201 bp, Homo sapiens
cagcccgcagctccaggagtctgtcttccacctgctggtgcccagtgtcatcctggtcttgctggccgtcggaggcctcttgttctacaggtggaggcggmgggtgagtagatccccatgaggaagaagagcacgtcccttagggcaggggcagagcctggcgggggtgcaggtggggggacagcttgggtgcggcctgag

SEQ ID NO: 37936 - DNA, 201 bp, Homo sapiens; identical to SEQ ID NO: 9842

SEQ ID NO: 37937 - DNA, 201 bp, Homo sapiens
cctgaggcccccacactgactcccatgcctctctccagttccctttccatacatcgccagccaggtccagccaccctctcctttccaggtcctcagctatmcccctgcccctccattccatccacccccgctgaggccagggactattacctctgcattgggcttctagtgttgctgccacctgtgacctcagagcaacta

SEQ ID NO: 37938 - DNA, 201 bp, Homo sapiens
ggtggctcagtgccacaacacccttcccactggtcgtctgtccccaaacccctcgccgtggtcttggccctctgtcccacccctctacacgcccaccctcytttccccacttgcttattctcaggcccgtcccaagctttcctcttccccctcaagatttcacttggagagggaatccagggcaggggctacatccagatc

SEQ ID NO: 37939 - DNA, 201 bp, Homo sapiens
ggccaggcaccagtggccttggagagattgagtgccagcccctagagtgactgctgctgtgatttgagaagtgagagagagaaacatagaggcagagactragatagggactcagagccacagaaaatgcagacaccagcacctcagccctaagcagctagaagatggggcagcaggctggaactcgctcactgggtcctt

SEQ ID NO: 37940 - DNA, 201 bp, Homo sapiens; identical to SEQ ID NO: 9831

SEQ ID NO: 37941 - DNA, 201 bp, Homo sapiens
gggggttcccaggccacaatggccaggccataagctccaggttcctgtttttcagaaagatccagtgtgctaccttaagaaggcatttctcctggtacaakacataatggaggacaccatgcgcttcagagataacacccccaatgccatcgccattgtgcagctgcaggaactctctttgaggctgaagagctgcttcac

SEQ ID NO: 37942 - DNA, 201 bp, Homo sapiens; identical to SEQ ID NO: 9837

SEQ ID NO: 37943 - DNA, 201 bp, Homo sapiens
cagaggatgggggacctggcaaggggcagcctgaaggtgggaggaaaagagggagagtgcagagtcgaggcactgcattccaagatggataagggatggarattcataaaaaagcgttgagaaatcaagcaaggtgagggctaaaattgtccattggatttggcaacgtgtcacacatgctggatcagggtgaacagaaag

SEQ ID NO: 37944 - DNA, 201 bp, Homo sapiens
tacaaatgtgagttactgtgcctggccaggaaaacatttttaataagagaggtattaaatctgcggttttccaacattaagattcctaagaatcacttggrgaatgtgttgaaaatgcatattcctaggacacacccctagagagtctgatacactgggtttaagagtggctccagggccgggcgcggtggttcatgcctc

SEQ ID NO: 37945 - DNA, 201 bp, Homo sapiens
  misc_feature (1)...(201): n = A,T,C or G, or insertion/deletion polymorphism (see Tables 1-2)
gtgtctgttgtgtaccagacactgttctagacaccaggaaacagctgtgatgaaaacagacaaaaatccccacattcctggaacttacatttgggggtganggtagtggtggtgagacagttaacaaaatatgtaagtaaaatatacaacatgtagcatggcaataacagcactggagaagagtaaaccagggatgagacg

SEQ ID NO: 37946 - DNA, 201 bp, Homo sapiens
cccacttcctgccatccatctccatttccctctgttcaatctctcttctccctccagtggttcattcctctggcaaatagcatctctcctatgctcccttytactctcctctggggtcagctgagcactgctttcttgatgatgctacgttaggaaattatcaaaaccccaaatctcagttgcttccaattcccctatacc

SEQ ID NO: 37947 - DNA, 201 bp, Homo sapiens
ggccccccagactcacattcccctcttgccccgctctgggaaagctgtgctggaggctagtgactctatctcctccccatctttctctctccttctctctrtggttctttcagatgtggtgaccaagcctgattgcaactgcctgtaccccaaagccatccctagcagtgacccggcctctgtctcccctcatcagcccct

SEQ ID NO: 37948 - DNA, 201 bp, Homo sapiens; identical to SEQ ID NO: 9844

SEQ ID NO: 37949 - DNA, 201 bp, Homo sapiens; identical to SEQ ID NO: 9845

SEQ ID NO: 37950 - DNA, 201 bp, Homo sapiens
  misc_feature (1)...(201): n = A,T,C or G, or insertion/deletion polymorphism (see Tables 1-2)
gttctgggtcttttcaatctgagagggcctagagcatgtctggggcttaggggtaaacttacggagtccccttattcccctgctcctgctgatgtctaatnccagccctgtgctctgcctgcagccccctgactcaggatgacagacaggtggaactgccagtgtagagggaattctaaggtaagattctgactttgatct

SEQ ID NO: 37951 - DNA, 201 bp, Homo sapiens
  misc_feature (1)...(201): n = A,T,C or G, or insertion/deletion polymorphism (see Tables 1-2)
agtcatgcccctcctgctcttttgtatttggctaatagtatatcaatttgcacttatttggatgttgttttcatattttttaaaatcttattttatatgtnttgtacattccacatccctaagattgtaagccccttgagggcagggactgtcttccacttttttttgtgtttctttttccatcctgggttctactaagag

SEQ ID NO: 37952 - DNA, 201 bp, Homo sapiens
  misc_feature (1)...(201): n = A,T,C or G, or insertion/deletion polymorphism (see Tables 1-2)
tgggtgagtgggtcagctggggcactggcaagactgtgaaatgacccaggcctcctcagaactggttgctggtggctcagtgccacaacacccttcccacnggtcgtctgtccccaaacccctcgccgtggtcttggccctctgtcccacccctctacacgcccaccctcctttccccacttgcttattctcaggcccgtc

SEQ ID NO: 37953 - DNA, 201 bp, Homo sapiens
  misc_feature (1)...(201): n = A,T,C or G, or insertion/deletion polymorphism (see Tables 1-2)
ggcagcaggctggaactcgctcactgggtccttctcccctcctgggccctagctgggcctgtggcctggctgtacccagcatggctcatgtccagtttatngttccccttctttccctctagagcatgggaatgggcagggagccagaggctgtggttccatcttccctccttacccagtagggcctatggatgttaggga

SEQ ID NO: 37954 - DNA, 201 bp, Homo sapiens
tacccagtagggcctatggatgttagggagggaggctccacacaaggtccaaagtcaaactgttggatggggtccaggggatttctgctctgggaacaaarcgtcctgaggatgctgggcaagaggacaaggatgggggtggaaggcgagaggacaaggccctgactcccatggatgatgcgggaggcaaggccctcggcc

SEQ ID NO: 37955 - DNA, 201 bp, Homo sapiens
agagcatgacaaggtaggaagccctgaggcctggagcactgagtgagggcagagggtggctgtggaggcgccgctctatccacaggcacagagtacattcsctcacctcgcctcacgccattgcttgctcactctcatttatttgtcatcccaccaacctttaccaggcaggaggcaggagggatcatgctgggccctgac

SEQ ID NO: 37956 - DNA, 201 bp, Homo sapiens
ctgttgttggtctgtctcctggcgagcaggagtatcaccgaggaggtgtcggagtactgtagccacatgattgggagtggacacctgcagtctctgcagcrgctggtgagtgtgtggccatgctgtattctaccttctccccactggggaaatgaaggcaggagccagggagcaggtcaaagagagcagttgcaggcagga

SEQ ID NO: 37957 - DNA, 201 bp, Homo sapiens
cagtgtcatcctggtcttgctggccgtcggaggcctcttgttctacaggtggaggcggcgggtgagtagatccccatgaggaagaagagcacgtcccttagggcaggggcagagcctggcgggggtgcaggtggggggacagcttgggtgcggcctgagttcttcagacacagagagataggggctggctcagcacagagg

SEQ ID NO: 37958 - DNA, 201 bp, Homo sapiens
tatcccaaccacctggttaattattgagccaggtgacacctggccgttgatcactccagctggcagcagctttgtcatcattcttattttgcctgattacratttcccggaagaaagggctagaaatttgttctcccacacccagccagatctccaggggaggttgtccaggcctgggctggggttgcatgggcaaggctg

SEQ ID NO: 37959 - DNA, 201 bp, Homo sapiens
tgggaatttaccattcctctggccagccaggcagggtggggcatcactggctaacgccagctccagggccctgagcttggggcctgtgggctgtgccttcygcctctcttgccccagcactacttctcctgtatgtagttgctgtagcaatccaaggtagaccaagagccccagcattctctgaggcttaaaatccagaac

SEQ ID NO: 37960 - DNA, 201 bp, Homo sapiens
tcactggctaacgccagctccagggccctgagcttggggcctgtgggctgtgccttccgcctctcttgccccagcactacttctcctgtatgtagttgctrtagcaatccaaggtagaccaagagccccagcattctctgaggcttaaaatccagaactgctgctctggggctaaagagggctttaagggcatccagctcc

SEQ ID NO: 37961 - DNA, 201 bp, Homo sapiens
ttcaagcacttccttagcatctactttgccaggcacgttactaagcgggggaattataaattaagcaggaattgccagcccttaaagggttaatgccccctccgtgttctttcttccaggtgaaagatcctcaaatccttcaacctgccctcatttgacctgatttccaggtgcccaccaccaaactagccccttctcgag

SEQ ID NO: 37962 - DNA, 201 bp, Homo sapiens
gatacagaaatggcatgttaagtttgaggggtgcccacagacatccaggaaagggtatccaggagaaggtaaatgtgtttttttacttatttattgcttaytttcctacgcatgtgtgcatatacccccacactcacatacacacatacatacctcagaatgtaatctgcatgaaggcaaggctttgtctgtcctgtttcc

SEQ ID NO: 37963 - DNA, 201 bp, Homo sapiens
  misc_feature (1)...(201): n = A,T,C or G, or insertion/deletion polymorphism (see Tables 1-2)
aggagaattggttgggagagtgtagacagagtgaacaggagactgcttaacagctcagaggtccatgctgggatcaggcagcaggatttttgggcagactngggaatttcagataaagaatcccagcaggctgaagaagagctacttagagccacagggatgtaagcattgagaagactcagtggtgagtagaggtacttt

SEQ ID NO: 37964 - DNA, 201 bp, Homo sapiens; identical to SEQ ID NO: 9885

SEQ ID NO: 37965 - DNA, 201 bp, Homo sapiens; identical to SEQ ID NO: 9892

SEQ ID NO: 37966 - DNA, 201 bp, Homo sapiens
ctggagtgcagtggtgcaatctcggctcactgcaacctccagcttctgggttcaagcgattctcctgcctcagcctcccaagtagttgggattacaggccygcatcaccatgcccagctaatttttgtatttttagtagaggcggggtttcaccgtgttagccaggatggtcttgatctcctgaccttgtgatctgcccgc

SEQ ID NO: 37967 - DNA, 201 bp, Homo sapiens
aagtataaagtgagtaatagtaaatgcaagatgtacatgaggaaaacagagagaagtggtgtatgactgaggcaagagtcacctggcaaaggtgttgcaasggcttccatggctccagagcccatgctgggcccagaggcaggaatgtctccaggccccaccacagcctccggggcagtcctcaccctggggagggcaaag

SEQ ID NO: 37968 - DNA, 201 bp, Homo sapiens
  misc_feature (1)...(201): n = A,T,C or G, or insertion/deletion polymorphism (see Tables 1-2)
gtgacgaggatgggttcaccaatggcctctgactggtgggggggtctcctgctttaaggcctctgctgtgatcgtgtgtgaagggataagttctccctcantggaacaaaatcacatttctgcagctcttgttgccccttccttggaaggaagccatccccttagaaggagaagccatctccactctgacataccttgatg

SEQ ID NO: 37969 - DNA, 201 bp, Homo sapiens
taatatggcatttcctctgaaaataaaattgtgatctttttaaaaaggcaaatcaatttaaagagaaatactaagtaagtgatagggcagaaatcatgaakgtggcacaggaatgactgaaatttgggggaaattgagagaatctatgtaaacaccaatcacagtgtctgtcacttaagaagggctcaaaaagttagttct

SEQ ID NO: 37970 - DNA, 201 bp, Homo sapiens
cgtgtgattgattgatgctgtacaagatgactttagctggtatacagatgaacatttattattttaatagctcgcaagtgatgcgtgttagaaatatatarccagcacactaaactgtgatttatgaaaataatatggcatttcctctgaaaataaaattgtgatctttttaaaaaggcaaatcaatttaaagagaaatac

SEQ ID NO: 37971 - DNA, 201 bp, Homo sapiens
  misc_feature (1)...(201): n = A,T,C or G, or insertion/deletion polymorphism (see Tables 1-2)
cggccccgcttcctgattgtgccttcctcctcgagttcactgggaagacacatggtaccgtggtgacccacatcaccatctctgcagagtccagcaccccntggaaggacggccatggggcctgcactccagggttcccctaatcctcctcccctggccccagccaggccctctacctctgaggcccttctcacccacctg

SEQ ID NO: 37972 - DNA, 201 bp, Homo sapiens
  misc_feature (1)...(201): n = A,T,C or G, or insertion/deletion polymorphism (see Tables 1-2)
aaaaaataacatagacccagaagctgcccctcaggaatttggctcatggaaaaataatgcactaaatggagccaagggacagggtggtgcaatgtgagctngaaataatgttcctcagcatcctgggcttctaagaaggttctcagggcccattatgggatgggtttggggaagagaaggcctcaaagaagaagccctaga

SEQ ID NO: 37973 - DNA, 201 bp, Homo sapiens
ctgctcacacgcttactgcacttgaccagtgtctgtctctcacacgggtctgggaacccaccaaaggaaatatgttgcgttcctatcatcccctttgtacyccctaaaaatctgggtacagattttagacatcagtgtttgatgagtgaataatcaggtcagagtaagatttagaaagccagtggaagatttcaagatggc

SEQ ID NO: 37974 - DNA, 201 bp, Homo sapiens
gctctggggaaaccactgggctcagccccaagaagctcctattccagcaaaggaagaggggagggaagtgggggtctgaggattgtgttaggaggtaaccrtgcctggagtgggctgatccctgtgggaatccctgattcactctatactgtctccctgatctgggccaaccgttcatgcctctcatccttagtcctcacc

SEQ ID NO: 37975 - DNA, 201 bp, Homo sapiens
agtcattcacccacttactcattcattcattcattcattcactcaacatatacttatcaagtcctgctaaatgccaggctctggggaaaccactgggctcrgccccaagaagctcctattccagcaaaggaagaggggagggaagtgggggtctgaggattgtgttaggaggtaaccatgcctggagtgggctgatccctg

SEQ ID NO: 37976 - DNA, 201 bp, Homo sapiens
  misc_feature (1)...(201): n = A,T,C or G, or insertion/deletion polymorphism (see Tables 1-2)
gggtgtgtggggaaagccaggatgagactgatctttggacagacagaatttgagattatccatgtgacaacatccagcagagagttaaatgtgcaggtgtnggggaggggaggcagagagagggaggtatctgtggctaaagaagtgcactaaaccaataggggtggacgagattcccaagggagacagaggggcaggaga

SEQ ID NO: 37977 - DNA, 201 bp, Homo sapiens
  misc_feature (1)...(201): n = A,T,C or G, or insertion/deletion polymorphism (see Tables 1-2)
cagctgggagtttattagaaatgcacgatctcagctgcatctcagaggcattgaatcagaacctgtgttttaacaagaccccccggtgattgacgcacccnggtgattgacacacacgtttaagtctgaaagcctggtcaactcttggcacataaaagatgctcattaaatgttagtgctactcccctgactacccaaccc

SEQ ID NO: 37978 - DNA, 201 bp, Homo sapiens
caagattgcaggatagaaaccaagtgagcaaggaggagagtcacagacggtgacagcggaaaggctgtaaggcttgggttaggcaggaccttgaaggctgygggagtctctttgggagacagaggggtggcgtgatctaaattgtgatgaagtcacttccctcagtcactcagccagtaaggggtggatggggtgaagccc

SEQ ID NO: 37979 - DNA, 201 bp, Homo sapiens
ttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctctcc

SEQ ID NO: 37980 - DNA, 201 bp, Homo sapiens
  misc_feature (1)...(201): n = A,T,C or G, or insertion/deletion polymorphism (see Tables 1-2)
cctgctggggctcccctggatcccagctctcaccttcgccctagttctgagcctcactcttctcatcagcaaaacgggtatcacaaggtcacctccctcangggatccttttggggattaaataagagaatgcgcgtagtaggtactccaagagggtggaccctacggtccaccatttcgtactgcagatctttgggacca

SEQ ID NO: 37981 - DNA, 201 bp, Homo sapiens
ctggagtcttcgggaacgaccccttctgtgctctcgttctcgtcggcctcaatctgcccccttccccagcaaagtttgaaaccgggccgggtcttggggtkggagctatgtgtgttgggggaaggggcgctctccgtggcccaccgggagatccaggacagagctgctgggggtgtgggtctccgcgggggtccgggagag

SEQ ID NO: 37982 - DNA, 201 bp, Homo sapiens
cttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctctc

SEQ ID NO: 37983 - DNA, 201 bp, Homo sapiens
ctcgaggccttggggcagctcgggaagctggggagcacggctttcggggggacagctccccaaggctgcctgggcaccggatggggactgagaggcggtaraggggacactcccgggtgcgctctccgtggtgctgaaaggacagctccttgcgaggggccgcgagcaggcagctagctgcgaactaagaggaagcgtggg

SEQ ID NO: 37984 - DNA, 201 bp, Homo sapiens
ccttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctct

SEQ ID NO: 37985 - DNA, 201 bp, Homo sapiens
aagccattttcctacacatcgggctggagtaattgggagccgaaagatggcaggcagaataaaaaggctcattaggtgagagtaataaaacaaaacaaaamaaaaatgagtgcaaggggaagaggaaaggctgggggtgggagcagatgttgtcctgcctcttggaagtccttttactttcttgggcataggaggaaaaga

SEQ ID NO: 37986 - DNA, 201 bp, Homo sapiens
cccttctaggccatggtcaggattgaggcttttattctaaatgtaatagatagtagccagatggctttaagcagaggagtgttaaaaaaaaaaaaaaaaaaaaactgggttttaaaaaaatgcctctgttgctgtgtggagagtggatgatatgggggtgctgggctgagcactgaggcaggaagggtgagacacagcctc

SEQ ID NO: 37987 - DNA, 201 bp, Homo sapiens
aatttctctcttcatcactgatttctttaatgcatgcctcattgcctcccttcatccaaccctcccccaaccacatactcacatgcacgcatgtgcgcacrcacacacacacacacactcgtctattaatctccagtagcattcctctgccccttggcactctttctctttctttcatttcctcgaccagaggccccataa

SEQ ID NO: 37988 - DNA, 201 bp, Homo sapiens
atttctctcttcatcactgatttctttaatgcatgcctcattgcctcccttcatccaaccctcccccaaccacatactcacatgcacgcatgtgcgcacavacacacacacacacactcgtctattaatctccagtagcattcctctgccccttggcactctttctctttctttcatttcctcgaccagaggccccataag

SEQ ID NO: 37989 - DNA, 201 bp, Homo sapiens; identical to SEQ ID NO: 9893

SEQ ID NO: 37990 - DNA, 201 bp, Homo sapiens
gccttgggaataggtgttgttgtctccatttcatagatgagaaaacattgagtcatttgctcaaggttacttagtaagtgatggagccaggatttgaactrgcagagatgagggtaagaggttccaaggctgtgggaatagcatgcacaaatgcccaggcattctcagaaagattatctgttgggaaataatacgtgctaa

SEQ ID NO: 37991 - DNA, 201 bp, Homo sapiens
atacctaaaaaagaatacttacctagagtgagaagtttcattaacttgttatgtgaccttgagaaagtcctttcccctttctcaccctctgtttccccatycgtaaactgaggacactgggttagatgaccagaaatttctctcttcatcactgatttctttaatgcatgcctcattgcctcccttcatccaaccctcccc

SEQ ID NO: 37992 - DNA, 201 bp, Homo sapiens
aagtccttagggcacagctctgagccctgacctacagctccgtcacttttggtcaccttgagacctagaacacccagccccatcaaggatcagcccatggygaggtcgccatatagggtgccctagcaagatcacccaaactctgggactagttgccttgaagctgcagacccagggtcagcttctagaaacccccaatct

SEQ ID NO: 37993 - DNA, 201 bp, Homo sapiens
agtcgaaatgtgtggagtctaatcccagctctaccatgtgctagccgtgacctctcagccaatataagacacctcttttagccctagttccttcatctgcrtaatgatcacaatgtcagtaccccactggattaagtgaaataacacatgtgaactacttagcacaatgccagtcaatcctattttagatgcaagtgatag

SEQ ID NO: 37994 - DNA, 201 bp, Homo sapiens
accataaggcagagcagtcgaggttcagtccagagtcgaaatgtgtggagtctaatcccagctctaccatgtgctagccgtgacctctcagccaatataakacacctcttttagccctagttccttcatctgcgtaatgatcacaatgtcagtaccccactggattaagtgaaataacacatgtgaactacttagcacaat

SEQ ID NO: 37995 - DNA, 201 bp, Homo sapiens
gcatgctcagctcaaagagcttcctctgtgctgggcacacaggtgtcctctgcaagccacacagcagcctgactatcctcatctcacagaggaaaccaggrcccaggaaagtgggtaattcaccagcctcccacaccacagttggggaaactgagatttgaactgagaactctctaactatgaagggctgtgccaggaatg

SEQ ID NO: 37996 - DNA, 201 bp, Homo sapiens
  misc_feature (1)...(201): n = A,T,C or G, or insertion/deletion polymorphism (see Tables 1-2)
cagagaggcgcagtgccttgctctagatcacacagccagaaagtgctggggctgggtaggagcccaggttctccagcttcatgcccggtgccctgtccccngcacccctgagcccctacccatgtgtccttgtcctgaggcccccacttctcacagctcctccttcctttgaccagctcttttctccttttatcttccaca

SEQ ID NO: 37997 - DNA, 201 bp, Homo sapiens
gccacatgcattaaaagaaactgtttcagaaataaacaagggatgcatcaacactcaacaggttttaccatgccagaattgttcatgtccactacctacastgggctttagaccaattactaaagacaaatcaaactctacagagaaaaagcaagagcttctctttcaaagtaatctgaatcgtgagttcctaaggctaga

SEQ ID NO: 37998 - DNA, 201 bp, Homo sapiens
gttagataatatgtacctactttgtgccaacactgggctgagcactttatttgcatcacctcattcaatgctcactacaagccttgggaataggtgttgtygtctccatttcatagatgagaaaacattgagtcatttgctcaaggttacttagtaagtgatggagccaggatttgaactggcagagatgagggtaagagg

SEQ ID NO: 37999 - DNA, 201 bp, Homo sapiens
ggcaagcagggtcttgcagttcaagcagcaaatggcaaaaggctccgaggaactcagccctggctctcacatcaggaacacctctgcagagtagggcatgrggccaggtgcttctccaacaggagagagcctcagccctgacccttcctagctggacgatcttgagcaagtcccaccatctataaaatgggggtaataccg

SEQ ID NO: 38000 - DNA, 201 bp, Homo sapiens
cagagaaggcctgtgtgaactagtgacatggaattgaggcctgaatgacaagagtcagtcatgtgacaacgtggggcagcacactccaggcagaggaaatygctctggcagaggccctaatgtgagcctggactgcatggggacagatgggaggtggagtgagtgaggggagagcagcagccgccaggggcagggaggggg

SEQ ID NO: 38001 - DNA, 201 bp, Homo sapiens
aataccagttgtggaaaaactccaattgtaaccagagtgctgccagccaggtcccatttactgagaatattcttgaagcacatgaagaaagaggggacggrgaggactgtgcacttgaaatgacatgatgtcagatctccctgcccagaattcccctcaggcattagtggaaagtctaagtcactctaatcaaagagcctc

SEQ ID NO: 38002 - DNA, 201 bp, Homo sapiens
catccccttagaaggagaagccatctccactctgacataccttgatggatgtgaaactcctgcagatctttcacaggccttgtgcaaggcccctcctctcygaagccattttcctacacatcgggctggagtaattgggagccgaaagatggcaggcagaataaaaaggctcattaggtgagagtaataaaacaaaacaaa

SEQ ID NO: 38003 - DNA, 201 bp, Homo sapiens
  misc_feature (1)...(201): n = A,T,C or G, or insertion/deletion polymorphism (see Tables 1-2)
cgctctgagtttcagctttatcgcctgtctaatgggtacaaggataacacctacctccctgaacaactgcgcatagtctctgacatcacgtgtctaatgcntaatgtcctaacgcacagtatgacctcaactgatgtcactgtttttccttttcccccactggggtcagagggactgagtccaacctcccctgactgcagc

SEQ ID NO: 38004 - DNA, 201 bp, Homo sapiens
gaaatttctctcttcatcactgatttctttaatgcatgcctcattgcctcccttcatccaaccctcccccaaccacatactcacatgcacgcatgtgcgcrcacacacacacacacacactcgtctattaatctccagtagcattcctctgccccttggcactctttctctttctttcatttcctcgaccagaggccccat

SEQ ID NO: 38005 - DNA, 201 bp, Homo sapiens
atttatgtgcattgttaccttctgttaataacaagtgatactagttttctggtttaaagtgcccatgtgaggtttcttttttaaataaatgcaccaaagcrttttatttttgcaagtgaatgaaatgagagaaatgttaagtaaatagcataggtggtttggagacgtggcaaataccatagaggtgctactccaccagtc

SEQ ID NO: 38006 - DNA, 201 bp, Homo sapiens
gatgtcccctctacacttgaaaagagatctgtgtctgttaaagaacagtggaactgaatggttaaaatacaaagaaaatctcaagttagagcactagggtwcagcttctcagggatgtagggggaagatggtaaggaggccaagggggaaggctcttcctcccccaccacctccactggaagagttccacttttacatatt

SEQ ID NO: 38007 - DNA, 201 bp, Homo sapiens
atcgctctcttccatctcctttctcctccagcagggcattgggtcttgacctcagagcgatgggtgcctggtgtctgaaccagggtgaggctgctgtctgyctagctcccccgccctgcctgtgcagaggcctctcccatctgactcccaattctcttctgcaggttgtcacatcttcccaagccaggccagccaggagcg

SEQ ID NO: 38008 - DNA, 201 bp, Homo sapiens
ccagaaaaggaaacaaacagttgcaatatgttatgataagtatcaaggcaactgggctgtgggatctcagaagcaggagtcacgaactgtaaggaaagacsaggaaaatgaccccaggcagacagagctgtgtgtcaaggccaagagatgtgaagtcccagccaccaaggcaatgtcactgtgccagagggtcctcaggat

SEQ ID NO: 38009 - DNA, 201 bp, Homo sapiens
gcccacacagaagggcagtttgtgcaagctcccagcaggtgcacacacaggcttacgtgggcaccagcacacaacaaagcacaaaggtgcacctgggagagtcacgcttgtgaagaggacattacacacaggagaagtgcacatcagaaacagcctgaagctagaatagaggcaaccagagcagggaacgtggggtacacc

SEQ ID NO: 38010 - DNA, 201 bp, Homo sapiens; identical to SEQ ID NO: 9889

SEQ ID NO: 38011 - DNA, 201 bp, Homo sapiens
  misc_feature (1)...(201): n = A,T,C or G, or insertion/deletion polymorphism (see Tables 1-2)
gagagccatgtaatgagcttagtggcacatagtaaatgctcaaaaaatggtagatcccatgactgctatcatactttctgtaaacttgtactggggacctnttatataccaggcactggctgtgcactggggaggcagagaagtagcttgaggaggtcacaggccagaaaaggaaacaaacagttgcaatatgttatgata

SEQ ID NO: 38012 - DNA, 201 bp, Homo sapiens
gggaagcctcacgaacgggacagctccaggctccctctctccctcactccccgggttccgcccccacctccagagaaatcccagacggcagagaaggcagsggggagggggcgacccagacagcaggttgcgaactcggcttagacctgggaggttgcaattagcaagaaaaaaggttgagggcgtctgtgaagccgggag

SEQ ID NO: 38013 - DNA, 201 bp, Homo sapiens
tgcccacacagaagggcagtttgtgcaagctcccagcaggtgcacacacaggcttacgtgggcaccagcacacaacaaagcacaaaggtgcacctgggagagtcacgcttgtgaagaggacattacacacaggagaagtgcacatcagaaacagcctgaagctagaatagaggcaaccagagcagggaacgtggggtacac

SEQ ID NO: 38014 - DNA, 201 bp, Homo sapiens; identical to SEQ ID NO: 9891

SEQ ID NO: 38015 - DNA, 201 bp, Homo sapiens
agacctgggaggttgcaattagcaagaaaaaaggttgagggcgtctgtgaagccgggaggttcccaaacagggaagccagttccgcggcaggaaagcatakgtggaagagaaaccttttctctgagagctgaggctgggagggccctcggatcacgtgacactctagatcactgattgtctccgcggaagacaaggcctag

SEQ ID NO: 38016 - DNA, 201 bp, Homo sapiens
  misc_feature (1)...(201): n = A,T,C or G, or insertion/deletion polymorphism (see Tables 1-2)
ggctctggggctctgattctgccagtcaggctttccacttttcagggaagcccctgcctatcaaatggggagggcagtgtctcacaagtttccccaagtcntaggtagaaaattcagagcacacgcaaagagctcttagcatccttggtgaagggaagtcagccattaaaagccaataagagccaataaaagtccccttga

SEQ ID NO: 38017 - DNA, 201 bp, Homo sapiens
tcactaaaatgccaacctcagcaactaaaaattagtgattcactatactgaaattaaaatagctttaacaagctagttataggtgttttacagataacagrtgtgataaaacaagagttggagaagttttaatttgcgtcttttcttcaggtatttaacaagatagaatagagctgggttgcaatatcttaactccaccac

SEQ ID NO: 38018 - DNA, 201 bp, Homo sapiens
  misc_feature (1)...(201): n = A,T,C or G, or insertion/deletion polymorphism (see Tables 1-2)
aggcacagtcattgataacaattgaaaagcaaatgtgaaaatagacagacagagaaggcctgtgtgaactagtgacatggaattgaggcctgaatgacaanagtcagtcatgtgacaacgtggggcagcacactccaggcagaggaaatcgctctggcagaggccctaatgtgagcctggactgcatggggacagatggga

SEQ ID NO: 38019 - DNA, 201 bp, Homo sapiens
cacccctggcccatggcaccccattcatggtacctgttcctccatggcaggcactggctagcaattcccagatgttatctcaagcctggcatcagcctggsaaagtgggctcagagaggcgcagtgccttgctctagatcacacagccagaaagtgctggggctgggtaggagcccaggttctccagcttcatgcccggtg

SEQ ID NO: 38020 - DNA, 201 bp, Homo sapiens
aagtaaaaactgccacaccatcacatacgtttagatcatattacagttaccggagcctggagcagctaaaacaagaaaaaggttggaaaacacaacattgrgaaatagttcaatcaatgcataagacaggaatagtcagcaaaacagctccctttttaaaaaagtaatttatagcatcaaaaatctgaatcatgcctcact

SEQ ID NO: 38021 - DNA, 201 bp, Homo sapiens
  misc_feature (1)...(201): n = A,T,C or G, or insertion/deletion polymorphism (see Tables 1-2)
ggcacaaatggcaagtacactattaaatgacatttactgtcaaaattaggaacttcattggaattactctgaaaaacttaagccactgtaacttgacacantgacacatttttccattttaggacatccaattatatataaatctctggactattacattcaaactcatttgtactgccaaatgtggcattttaaagaagt

SEQ ID NO: 38022 - DNA, 201 bp, Homo sapiens
  misc_feature (1)...(201): n = A,T,C or G, or insertion/deletion polymorphism (see Tables 1-2)
agtcacacagccagttactggcaggagtctctgtcctccagctcctccactgagttaacatctgtaggagaacaaaggcagtatatattttgtcccatcantgcatcctcagagtctagaataatgcctagggtattctcagaaaatatttgtggggtacattgctgaattggtagccagttgggccaggaaacatcagaa

SEQ ID NO: 38023 - DNA, 201 bp, Homo sapiens
  misc_feature (1)...(201): n = A,T,C or G, or insertion/deletion polymorphism (see Tables 1-2)
gaggtcctgcttagctgcagactcaacaactcctgcagggggcatgagaaggcggctgcagaacctgcccagaccacacacaggctccactacatggtgcnagtcacaacagagttaaccctggcttccccgattctgctagtcaggcagccaccatggcagaggcaccaagagacactgcctgggacccccagcccctct

SEQ ID NO: 38024 - DNA, 201 bp, Homo sapiens
agaacgggaggtcctgcttagctgcagactcaacaactcctgcagggggcatgagaaggcggctgcagaacctgcccagaccacacacaggctccactacrtggtgccagtcacaacagagttaaccctggcttccccgattctgctagtcaggcagccaccatggcagaggcaccaagagacactgcctgggacccccag

SEQ ID NO: 38025 - DNA, 201 bp, Homo sapiens
cagtccctgctgccatctctagagcaggtcagccaaggggcaggccaagtgatgcatctgcaggactcacctgctgggaaataaatccattggcgctggcrgccgtgtgggcgctgcagtgccttgcgggcagcatcctaatgccgggaggatgcagggggagggagacgacataaggccaccaggactggggtgaggcca

SEQ ID NO: 38026 - DNA, 201 bp, Homo sapiens
tggttgtcattcattctcattgctggagtaaatctcatcgtgggactagaccaaaatgcagttctagtgttgatagccacttgggttgttttcagctttaractcttgggagaagcgctgccatgaagattcttgcacgtgtctttggaaaaacacatgtacacatttctagggggtttatgccaaggagtggagttgctg

SEQ ID NO: 38027 - DNA, 201 bp, Homo sapiens
tctcacccccgacacaggttgcatctacaacctcagggccatcagcatccccagagcaactcagacaggctcctagtccatcacgacgtgccttcgctcamagcatgcgtggcccactcagagccgccgctaaagctaggatttgaagctgggtctgtaggacatcaagtccagcgctcttccatcagagttacacatact

SEQ ID NO: 38028 - DNA, 201 bp, Homo sapiens
  misc_feature (1)...(201): n = A,T,C or G, or insertion/deletion polymorphism (see Tables 1-2)
aaaccgtgatgaataaaatatcaaaattttaaatcaagacaggatacaaaagagcagggattagggtgaggaaggtgaaatgaattgtgcataagcagganctaatcttggcccgaagacatttgcttaactgcagggacactgcctgggccaagcactgttcccactaggagccagtatcaagagccagtctgctcatgg

SEQ ID NO: 38029 - DNA, 201 bp, Homo sapiens
acacacacacccgcacccccctgcctggccaagtcctccccaagggtgggggtgaggcccagcactagccattctgcaccccctgattcctggtctgtgastccacaggacaggcatggcagatcagttctccctgccctgtaggttcccagggctcaagggcacctgtggtcagccccgcagtaggatgaagagtcaaga

SEQ ID NO: 38030 - DNA, 201 bp, Homo sapiens
cctgttgcataacattcatagagaagtcttttaaaatcccagatgcaaggagaatagcagagtggtttacttactagcatatgaccttgggcaagtgactmtctgagactatcttcagctattaaagaggaatgagaagattaataatacccacttcgatgagaatttaatgagagagccatgtaatgagcttagtggcac

SEQ ID NO: 38031 - DNA, 201 bp, Homo sapiens
aagggccggaggctggcggagcttgctgcaactccacgaacagagggatcctgtgaagtggaaataacgtgaatgagttttaaaaagcagggcgtggattyaaaaagtgcctttgcagggggaggaagggaccagatgatgtaggacattgtgaggacgaccaaacagcacgtttgtaaactccaagggctgggaagatga

SEQ ID NO: 38032 - DNA, 201 bp, Homo sapiens
ggaaaatcagtgcctaccacacagaattggtcacgcattcattcaacaaacctttactgagctgctactgtgtaccaggcactgcggttagaggggccaayagggacagacaagagcctgctctcttgaggcttctgtctggtgggagaagacagacagtcaacaaggggacagatggaaaaaataaaacagagattgtca

SEQ ID NO: 38033 - DNA, 201 bp, Homo sapiens
aatttttcctcaaaaaagaatgatacaacttttattttccatgaatttttgtttttttgttttgtttgtttgtttgtttgtttttttgagaaggagtctcrctctgtcacccaggctagagtacagtggcgtgatctcggctcactgcaacctccgtctcccaggttcaagcgattctcctgcctcagcctcccaagtagc

SEQ ID NO: 38034 - DNA, 201 bp, Homo sapiens
acggatgcaaaaatcctcacaaaatattagcaaatggaatccaaccatctgcaccttatttccagatgctcacagctgagctcttcccagtgctgaaatcraagtttttgttgaaatcaaattatttatttaagtgagttagtaagagaagtcttggttgtaagtggtttttatttatttatttatttatttctttttttt

SEQ ID NO: 38035 - DNA, 201 bp, Homo sapiens
gggatcatgcctgcccttttcactgcagttgtcaccagcatttagaacacagcctggcagagtcattcacccacttactcattcattcattcattcattchctcaacatatacttatcaagtcctgctaaatgccaggctctggggaaaccactgggctcagccccaagaagctcctattccagcaaaggaagaggggagg

SEQ ID NO: 38036 - DNA, 201 bp, Homo sapiens
  misc_feature (1)...(201): n = A,T,C or G, or insertion/deletion polymorphism (see Tables 1-2)
gatgcaaggagaatagcagagtggtttacttactagcatatgaccttgggcaagtgactgtctgagactatcttcagctattaaagaggaatgagaagatnaataatacccacttcgatgagaatttaatgagagagccatgtaatgagcttagtggcacatagtaaatgctcaaaaaatggtagatcccatgactgctat

SEQ ID NO: 38037 - DNA, 201 bp, Homo sapiens
attcttcctttgataggatgggggcaaggagactgcagactgatttgcagacatgaaaatgcaaggtttcaggaaagcacaggatgaggggagctaaccawgtggggatatacagggctacagtgtgggctgggagacgactgctttgacatgctaatgagtgcctgaatctgggagggtgggacgggatgaaggctggca

SEQ ID NO: 38038 - DNA, 201 bp, Homo sapiens; identical to SEQ ID NO: 9882

SEQ ID NO: 38039 - DNA, 201 bp, Homo sapiens
gtcactcagcaatttagtagcaaagctgggcctaaaacccgggctctctaactcctgggcctgttgcataacattcatagagaagtcttttaaaatcccasatgcaaggagaatagcagagtggtttacttactagcatatgaccttgggcaagtgactgtctgagactatcttcagctattaaagaggaatgagaagatt

SEQ ID NO: 38040 - DNA, 201 bp, Homo sapiens
ggccccacggtccccaggaggacgcttcctggccaaagccccaagcctttggtgagaagccaattcccacttgacagaaggcgtccatccattcatctcaytggccaaggacaaactctcctctgggacgtctgggactggcatttgtcccccactcaaattatcaaagctttctgctcagtcagttgtgtggggatggtg

SEQ ID NO: 38041 - DNA, 201 bp, Homo sapiens
tgggcaagagggtagaggggaaacaggcacagaacggtcccggctccgctaggcgggctgggcctaggctgaggtcccggcggggaggaaggagtgcgccrccccgtcttccctccagacccccaccccatcccagctcagaatcgcggacttccaagagccctgcacagaagcccgcggctggcagctgcaatcactgac

SEQ ID NO: 38042 - DNA, 201 bp, Homo sapiens; identical to SEQ ID NO: 9884

SEQ ID NO: 38043 - DNA, 201 bp, Homo sapiens; identical to SEQ ID NO: 9886

SEQ ID NO: 38044 - DNA, 201 bp, Homo sapiens; identical to SEQ ID NO: 9887

SEQ ID NO: 38045 - DNA, 201 bp, Homo sapiens
ggcagagcaagtgccaatgtcacacccactttacagataaagaacatgaggcccagagtgcaggcagtggcacaagtggtgcagccgaagctgtgttcagwtcagagctgcaagatgccacatcccagggcagtttcagttctcaagaaaacctctctagaagaaactagaccctaacttgggtatcccaaaggagtcagg

SEQ ID NO: 38046 - DNA, 201 bp, Homo sapiens; identical to SEQ ID NO: 9888

SEQ ID NO: 38047 - DNA, 201 bp, Homo sapiens
  misc_feature (1)...(201): n = A,T,C or G, or insertion/deletion polymorphism (see Tables 1-2)
caacatcagctgggagtttattagaaatgcacgatctcagctgcatctcagaggcattgaatcagaacctgtgttttaacaagaccccccggtgattgacncaccccggtgattgacacacacgtttaagtctgaaagcctggtcaactcttggcacataaaagatgctcattaaatgttagtgctactcccctgactacc

SEQ ID NO: 38048 - DNA, 201 bp, Homo sapiens; identical to SEQ ID NO: 9890

SEQ ID NO: 38049 - DNA, 201 bp, Homo sapiens
gatggtttccccatccccaggggcaagggcaactgaaccccacacagggccagcagagaccctcagctctacgcaagcaggacactctttctcccttctcrggcctccaccttctctccctccttcacccccttcctgactcagtctctctgtctctgtgcctcatctcgcttttcccctctccaacttcctgttactctc

SEQ ID NO: 38050 - DNA, 201 bp, Homo sapiens
ccttcaccgctctgagtttcagctttatcgcctgtctaatgggtacaaggataacacctacctccctgaacaactgcgcatagtctctgacatcacgtgtstaatgcgtaatgtcctaacgcacagtatgacctcaactgatgtcactgtttttccttttcccccactggggtcagagggactgagtccaacctcccctga

SEQ ID NO: 38051 - DNA, 201 bp, Homo sapiens
  misc_feature (1)...(201): n = A,T,C or G, or insertion/deletion polymorphism (see Tables 1-2)
agacaaaggatgtggaaacgcttcctactgtaaatgagagtctttaccgttaacgaggctctttagacttaagtgacagaaacccaactcaagatggcctnaagggaaaagggaaagtctgatgttgctaggtcagacacacatggccccagggcttcagacagtgaccacaacactctatctttctacatctctccactg

SEQ ID NO: 38052 - DNA, 201 bp, Homo sapiens
ttgggatggaatcacaggatcttagatggctctagaaagagcagaagcttaggagccagaaagatctgggttcaaattccagttctttcctagtaagtcaycttcctacctagcaagacccttcaccgctctgagtttcagctttatcgcctgtctaatgggtacaaggataacacctacctccctgaacaactgcgcata

SEQ ID NO: 38053 - DNA, 201 bp, Homo sapiens
gccaggtgatccagaagagaagcagtgagagctggaagggcacatgaagggcagtgtgggcagagggacaggcagggagggcactgccgccacagagctgscctggttccctgcccccgggggagcacagcccagcaagagggaaatgatggcatcttttgtggctgaattttcacaactcatgagagaggaagagatgat

SEQ ID NO: 38054 - DNA, 201 bp, Homo sapiens
  misc_feature (1)...(201): n = A,T,C or G, or insertion/deletion polymorphism (see Tables 1-2)
gacccaagagcgactgcagctgttggaagggctcagacgccagtgcactcggggataccgaccctcactgctctgacagccttggccagaccatggccganagcaagtcagtgggccccactccagggggctccaagacacttgccatgctttcttcaggctatatcacaacagcagatgtttctttgggatggaatcaca

SEQ ID NO: 38055 - DNA, 201 bp, Homo sapiens
taatctaccttgtgattaggaattgccaccctgattttgcagatgagaagggctggctgcttgggatacagagatgaagagagtacagtccctgaccccaragaactcgtggtgaagaaacacaaacgcacagaaggcctctagggtgctcaagtctgtaatacaaagaagcatggggggctgtacaagggacacagggga

SEQ ID NO: 38056 - DNA, 201 bp, Homo sapiens
ctgggcaggtatggtttggaagaatttagcagttaggatctggggtggggatgggaggctggagagggattccacagccaaaatcagtcagtccccagackgaggggactctctccgccccttcctgccatagccaggccccttctttgaaaactttgcccagaccgcaggctcggctgctacctaccttctgttgcctgc

SEQ ID NO: 38057 - DNA, 201 bp, Homo sapiens
ctcagcgttcctccctgaaacatcctctctggctgctgttttagcgcaagattttgcttcagggtaaatcctacgtttcccaaaccaacggcatcttggcrtgtaactgagatgcacagggaatccctggatttgaagtcaggaaggcctgcctctggatgccagctctgccactgatgtagcttggcaagttcctacgtg

SEQ ID NO: 38058 - DNA, 201 bp, Homo sapiens
ccatgcatggctccagcccccatgggctcagcgttcctccctgaaacatcctctctggctgctgttttagcgcaagattttgcttcagggtaaatcctacrtttcccaaaccaacggcatcttggcgtgtaactgagatgcacagggaatccctggatttgaagtcaggaaggcctgcctctggatgccagctctgccact

SEQ ID NO: 38059 - DNA, 201 bp, Homo sapiens
  misc_feature (1)...(201): n = A,T,C or G, or insertion/deletion polymorphism (see Tables 1-2)
agacactcagatgcatagtcagaactcatgcccacacagaagggcagtttgtgcaagctcccagcaggtgcacacacaggcttacgtgggcaccagcacanaacaaagcacaaaggtgcacctgggagagtcacgcttgtgaagaggacattacacacaggagaagtgcacatcagaaacagcctgaagctagaatagagg

SEQ ID NO: 38060 - DNA, 201 bp, Homo sapiens
  misc_feature (1)...(201): n = A,T,C or G, or insertion/deletion polymorphism (see Tables 1-2)
ttcctttagcaaatatgtcctagccaccaaaaaggttcctggccctgaaagtggtacaggagataaagctgtaattttgagcatagtctccatgtctgacngcaggagatgggggtagttaatcatcaaccagtcacagctcctcatttcctatgtgcctggccctgtgctcagtgccatgaggaatggagaagaccatga

SEQ ID NO: 38061 - DNA, 201 bp, Homo sapiens
  misc_feature (1)...(201): n = A,T,C or G, or insertion/deletion polymorphism (see Tables 1-2)
gtgcacctgggagagtcacgcttgtgaagaggacattacacacaggagaagtgcacatcagaaacagcctgaagctagaatagaggcaaccagagcagggnacgtggggtacacctgccccactcctcaactaccctaaaacatgcactcctgctgctagcaagaaccctatgtctgagacctagattccagggacccccc

SEQ ID NO: 38062 - DNA, 201 bp, Homo sapiens
  misc_feature (1)...(201): n = A,T,C or G, or insertion/deletion polymorphism (see Tables 1-2)
aggacagtcatccagagccacacctgaccccagttcctgctgtcactctttgctaaaagatggaggggactaggtgggcctcgagctccaccttccctcgnacttctgctgggtcttttggagaagccacttgccctctctgagcctctgcttcctacctaaggattccatcaatctaagtctctgcacccctatatctcc

SEQ ID NO: 38063 - DNA, 201 bp, Homo sapiens
cagctggaagtcaaagcagcaaggctaactccatcctgcaggcctagccaagctcaggggccctgaaagtttccaggggcagttagaccaagctgggcaaycttgggcacgttgatcaagctctctgaacctcggcctcctcatatgtagtgcagggaggctacttctcctatttaggaggcgttgagatgaatcaacaag

SEQ ID NO: 38064 - DNA, 201 bp, Homo sapiens
ctttcagttaaagggactgttttcctctggtccagtaattctaagacaagggttgagagtgggacgagagtctctgcctgtagcttgaatgctctcctggycaccaccatctgcttccacatctggttttattgctgggcgggagatagcttgaccattcccatcacactcctggaaactccgttgatttccccaaggcag

SEQ ID NO: 38065 - DNA, 201 bp, Homo sapiens
cgccagcccccgcctcctttctcgggaagcttgggtctccctgggagcgggtctgcccttagggggaggcctctgggctctgtgccctgcagctcggcagycattcgaggcggacagaaacggggcttggcgccccccgcgtgcacgtgtgctagcccaggcaggagggagcgcctcggcggaggagtcaaggaagagggg

SEQ ID NO: 38066 - DNA, 201 bp, Homo sapiens
  misc_feature (1)...(201): n = A,T,C or G, or insertion/deletion polymorphism (see Tables 1-2)
aggaaaccaaggcccagaaaggcaaatggacttgcccaaggccacaggatcagtgagacctaaaggccaaggtctggcctctgcagtttcaaatgacctanaacttggcagtgaaacaggccaagcaggggacctgaaagtcaagaggagggcaggagaaagagaagccatgagagccagcaccttcattgtgctcctact

SEQ ID NO: 38067 - DNA, 201 bp, Homo sapiens
gaaacagaggtttaggagctattaatacagagactataatggagtggatcaaggttacaggggaggcagcaaagtggggggagccaaaatcagacagcacytaagtgacacttgaacccagggctgtgtgatgatgtcagagcttgctttccttccttcattttatggcagcttggccactacttgaggtgacagcacaga

SEQ ID NO: 38068 - DNA, 201 bp, Homo sapiens
ctgatgcagtgcccagcagggcgcctggcgtcatgagcccttagtttacttggcacacactcattccttcccccgacacttctgtgactagcggggctccrtgttctgcccaggccccctctccctgggtagcagggtcagcctcttcacgtctcatgcagccacaacaggccactggtgggttcctcactgcctgaaagc

SEQ ID NO: 38069 - DNA, 201 bp, Homo sapiens
ggaaagaattcactgagttcacgttcttgcagcacaagccctgacctgccgctggcagtgctggggagccaggggtccaaaaggaggacttgggctatgcrtggggcagaggcagccaggaaccagaggtgctcgagacacagaaacttgccagcatcactgagaaccagaggtgcctcatggctggtacatgaaagcacc

SEQ ID NO: 38070 - DNA, 201 bp, Homo sapiens
accaaaatattcttcctttgataggatgggggcaaggagactgcagactgatttgcagacatgaaaatgcaaggtttcaggaaagcacaggatgaggggarctaaccaagtggggatatacagggctacagtgtgggctgggagacgactgctttgacatgctaatgagtgcctgaatctgggagggtgggacgggatgaa

SEQ ID NO: 38071 - DNA, 201 bp, Homo sapiens
ctagaaagcttagcattatggaaatcattgatttggaaatcatcaagcccaatagccacattttacaaatgaggaagagggggtaaaaaatggggagaaawtggcccaaagttccatggtgcagagaccagaaccgagatctttgaactcataaacttaagatcccattttcttctctagctcaaagaggctggaaggtgg

SEQ ID NO: 38072 - DNA, 201 bp, Homo sapiens
gacccccagccagtaagtatagctgcctggattttgaaccaggtgtgtctgatgccaaagcccctgggctgttttgtgttttgctttttttttttttttttcctacacatcatgactttctcttcccaaaacaacctatcagatgagatggtctgatcacgtagataagctcttgggccccatatcatgaaataatctcag

SEQ ID NO: 38073 - DNA, 201 bp, Homo sapiens
ccaagctgggcaaccttgggcacgttgatcaagctctctgaacctcggcctcctcatatgtagtgcagggaggctacttctcctatttaggaggcgttgaratgaatcaacaaggtggtggcaccaaggaagcaaaagggagacccccgcctggagtctgggtgtgtaaataaagaggcgtggggccaaggagggctttag

SEQ ID NO: 38074 - DNA, 201 bp, Homo sapiens
  misc_feature (1)...(201): n = A,T,C or G, or insertion/deletion polymorphism (see Tables 1-2)
atcctgagtcaaaataagcccttctcttgggcagcccctgggacgggctatttctgcaccgtgtttcttttttctacacagggggctgaacagcaatgatnccagctaaaaacagaagctgccccagctggagcccacaatattcccctcaatgacagaaacctcagcgcacagcctgtcaggaactcaggaagtctttcg

SEQ ID NO: 38075 - DNA, 201 bp, Homo sapiens
  misc_feature (1)...(201): n = A,T,C or G, or insertion/deletion polymorphism (see Tables 1-2)
ctagcctcagactgagggcccaggcccaacagcgtggggcaagacagtacacgggtttccttttcactgcatttatgtgcattgttaccttctgttaatancaagtgatactagttttctggtttaaagtgcccatgtgaggtttcttttttaaataaatgcaccaaagcattttatttttgcaagtgaatgaaatgagag

SEQ ID NO: 38076 - DNA, 201 bp, Homo sapiens
cagtacctctttgataaaacccaagaaagctgaagaccaagggagcctgttgattggtctatgtggggcagcctcctggccacagggcagcagtggaaggraaagggcagaaccggagaaagaaacaagatagtccgaaggatcactttccagcatggaaaccttggtgacacacagctccctcttgctaccagagaagcc

SEQ ID NO: 38077 - DNA, 201 bp, Homo sapiens
agaccaagggagcctgttgattggtctatgtggggcagcctcctggccacagggcagcagtggaagggaaagggcagaaccggagaaagaaacaagatagyccgaaggatcactttccagcatggaaaccttggtgacacacagctccctcttgctaccagagaagccacgtgatctgatggcatcacaagacgatggagc

SEQ ID NO: 38078 - DNA, 201 bp, Homo sapiens
agacaagaggaaaaacccaagacgtaagaagagatcctgaggtggacacctcatgcattttaaaccagcaagttttgaagcgagggaccctggccaagctstttctatacttaactgtatgagccctccattttgttcacatgtaaaatggggataataattataggtagcttctatggttgttgtaatattaggaaaaca

SEQ ID NO: 38079 - DNA, 201 bp, Homo sapiens
  misc_feature (1)...(201): n = A,T,C or G, or insertion/deletion polymorphism (see Tables 1-2)
gcaaagaaaaaagcatctttgggaaaacatttaaaacttgatgacttggaatcaggaggcgtagccagggcagagaggccttgaaattatgcagtccaaanacactctgaaagtcaccttgggaaggcctgtgggaccaagaataagaggcctttcaaatgcatcaaatggaaagaggccagataaagaactggcaagatg

SEQ ID NO: 38080 - DNA, 201 bp, Homo sapiens
gccctggaccccaccctggctccatctccccttggaagcaccttccttgccttgctccagccattggggtcatggcatgtggcctctcaccaggtgggctktcagcaaacatgagtcccttcctcaaatattaatggaattgtccctttgggggaacgaccgtgtgactctgagcatgagaagtgtggttttgggtaccat

SEQ ID NO: 38081 - DNA, 201 bp, Homo sapiens
cctgagtctccaccagttggagaagtcagggaggcatctcaggtgtgaataaccttcccattctgtcccctcagttccgatgcctcaaccgctcagccgcyggaatcgcagccactgccggcttcacagacgcctgcctccaaccagccgaaacgacccccagcagcccccgaggtacctggagaactggaggggtgggga

SEQ ID NO: 38082 - DNA, 201 bp, Homo sapiens
ggagctagtactgctagctactcaggaggctgaggtgggagaactgtttgagcccaggagttcaaggttacagtgagctttaactcactggattgcaccaytgcactccagtctgggtgacagagcaagactctgtaacttaaaaaaaaaagaaaaaagctggccgggcacgatggctcaagcctgtaatcccagcacttt

SEQ ID NO: 38083 - DNA, 201 bp, Homo sapiens
ccccatcactttcagctgtgttcacttgtcctccaatcattgatacctctctctaccttttccaaaatacagattctacaacttggagggacggaggtggkcgtggccctgatgagctggagggcccggactccaaacttcatcatggtcatgatccccggggtgggctacagccttcaggcccaccccagttccctccct

SEQ ID NO: 38084 - DNA, 201 bp, Homo sapiens
cctcagttctggtaagctggaggggttatgggtgggaatatctccatccccagagaaggtcaagtgctggagggagcgggtggagaacctggcctaggggrcctgctgctgggtgcgtttctgcagggagcaagggtagaagaattgggaggtggagtagagaggaaaagttagggtcagtggcagagccaggcagatgct

SEQ ID NO: 38085 - DNA, 201 bp, Homo sapiens
aaacagaaaaatagtaaaagagagtctgcatcataataaagtgttcttttcccacctagttctggttttcctgagatacttatttccattctttctgtctktctcttcaggagcgagactcctccagtacctcccccaccaccctatctggccagttatccaggctttcctgagaatggagcccctgggcccccaatctct

SEQ ID NO: 38086 - DNA, 201 bp, Homo sapiens
aatactcatatttcccctcaggggcccatgaagaggttgactacactgaaaagctcaagttcagcgatgaggaagatgggcgagactctgatgaggagggwgctgagggccagtgagttagggccatcaggggagaagaggagggggtcttggtttgtattttggtaatatactcttagaggagtatattagttgcagctg

SEQ ID NO: 38087 - DNA, 201 bp, Homo sapiens
ttatttccattctttctgtctgtctcttcaggagcgagactcctccagtacctcccccaccaccctatctggccagttatccaggctttcctgagaatggrgcccctgggcccccaatctctcgctttcctctggaggaaccagggccccgtccactcccctggcccccaggcagtgatgaagtggccaagatacaaactc

SEQ ID NO: 38088 - DNA, 201 bp, Homo sapiens
tctcgcatgtggttatacaacatgccatatttcattttcttttttgtgtacagccgttttccccgtgtggcgggcccccgaggctcagggccaccaatgcrcttagtagagcctgtgggtcgtccctctattctcaaagaggataatctcaaagagtttgatcagttggatcaggagaatgatgatggttgggcaggtaag

SEQ ID NO: 38089 - DNA, 201 bp, Homo sapiens
tatttccattctttctgtctgtctcttcaggagcgagactcctccagtacctcccccaccaccctatctggccagttatccaggctttcctgagaatggarcccctgggcccccaatctctcgctttcctctggaggaaccagggccccgtccactcccctggcccccaggcagtgatgaagtggccaagatacaaactcc

SEQ ID NO: 38090 - DNA, 201 bp, Homo sapiens
acacgccaacacacccagctaattttttgtgtgtttttagtagagatggggtttcacatgttggccaggatggtctcgatctcttgacctcgtgatccgcycgcctcagcctcccagagtgctgggattacaggcgtgagccaccgcgcccagccagagtcttccacttttatagcatgtcctcaggaaatgtcttctgtc

SEQ ID NO: 38091 - DNA, 201 bp, Homo sapiens
tcttccgcacccagcgcgtcgacctttaccagcaggtgaaggagaaacccttgtggccccaactctaaattcgagttgccacctgatttcctgtccttccrtctcatcgctgacctctcactgtgactcactctttaacacatgcctgtcccctaggcctccccaccagatgccctgcgctggatacctaagccttgggag

SEQ ID NO: 38092 - DNA, 201 bp, Homo sapiens
gaaggcgggaaacctgatggtctggtacctgtcagagccttccactttttttttttttgagacggagtctcattctgtcacccaggctggagtgcagtggygcaatctcggctcactgcaacctctgcctcctgggttcaagcgattttcctgcctcagcctccagagtagcgggactacaggcacacgccaacacaccca

SEQ ID NO: 38093 - DNA, 201 bp, Homo sapiens
ttcatggaggcacatgagcaagtttaagtctcagtcttatatgatggagtgtagtggtgccagaactgacctccttggggaataagcagttattctgtagsggggtgagtttgaaggcgggaaacctgatggtctggtacctgtcagagccttccactttttttttttttgagacggagtctcattctgtcacccaggctg

SEQ ID NO: 38094 - DNA, 201 bp, Homo sapiens
cttcctctgtatttccctctgcattaagttctatccatgtggaggacagaacaaaatcagcctcactcacaaaacatcagaaaacgttctactggaatacraacaaagggatcaataaaaagaaaatctgaggccaggtgcggtggctcatgcctgtaataccagcactttgggaggccgaggagggcacatcacctgagg

SEQ ID NO: 38095 - DNA, 201 bp, Homo sapiens
ccttgttaaatgactaaggaatggtactaaactttagctttttgtcttggagagagagcatgaaaaaatagacaacagcctacaaaggatgacaaaattawtttgtccttatatttgtaaatggtagcaatgggcatgatttcagtcctgagtctccaccagttggagaagtcagggaggcatctcaggtgtgaataacct

SEQ ID NO: 38096 - DNA, 201 bp, Homo sapiens
taaagggggtgtgggctctgggtgaacaccagttatcctcctacaaaggcgtgtctgtggttccctgtctttggacacgtaagaattggaggaaaataaakgtggatttgggaaactttgaggccagcttgcttcttgcaggctcatgatcaaccaatctcacataaaagtattgaatgttacatatctcagccttcttga

SEQ ID NO: 38097 - DNA, 201 bp, Homo sapiens
tgctggatttttacttagatttccttgacaaaggtgtctgggggaaaggagggaacatggcatttgagctatgagggagctaagtagatcatggttgcttragaagagtgggcagtttacatagactggaggaaaagacaccagagggcctcatatctgagtccctaatgataatgcaatggagtttttaagtttctgtta

SEQ ID NO: 38098 - DNA, 201 bp, Homo sapiens
gctgatcctgctcttctcgccagcaactattctcaccttgaatgttcatgtgcatcatgaccacgggttccacactctggtgggaaatccggatgaccctygggtggctggtggctggcgggggagctggacctggcgggggagccccctcagctgaggactcgacattggtagaagacggagccacggatgaggcctgcc

SEQ ID NO: 38099 - DNA, 201 bp, Homo sapiens
ctccacattatctggcccctcaacctccccctctctagagtacctgaggctcaggggaagctctttctgctccctgaacttccattggctcctcaggaagyggctgtgaaattaaagaacaccatacttcctctcagatctctccagttctctcaagtaccctgaccccatcgcccaacaggtcccttacctgggggggat

SEQ ID NO: 38100 - DNA, 201 bp, Homo sapiens
ccacacctggctgaacctgcaccaaggactgagagacaagataacacaaagatcccaaaatcaagaatcataagactgggagtggaggaggcagctgcctygaccagacccaggagaggaaaggaatagagaagggttactcacaaaactctcccgcacatactcttctagccccgtgatcaatgtgtgggttgccatctg

SEQ ID NO: 38101 - DNA, 201 bp, Homo sapiens
gcccccaccccgctgagggagttcctcttgccccctacccccggggcttgtatatagattataaatatataagggggaaaggggtgggcggggaggggttstggggctggggcctcacttcccctcctcccccttcccctggtcccctgtccctggggctgtttgttaaaaaagagtaataaaaggatttaaaaaaaaaaa

SEQ ID NO: 38102 - DNA, 201 bp, Homo sapiens
taccacaacctccacctcctgggtttaagcgattatcctgcctcagcctcctgagtagctgggattacaggcatgcgccaccacacccggctaattttgtrtttttagtagagacagggtttctccattttggtcaagctggtcttgaactcctgacctcaggtgatccgcctgcctcggcctgccaaagtgctgggattg

SEQ ID NO: 38103 - DNA, 201 bp, Homo sapiens
atggcaagccagccactcacctgcaagaagtcagtcatgccttggagaaaggcagggacaccaggcatcgccacagtgatggtgggagaagccacaccagrccctccagcccctggccctgcaggccctagcaggttccccagaagctgagagaactgaagatcagccatggagggttgaggggtgggtggaggctgggca

SEQ ID NO: 38104 - DNA, 201 bp, Homo sapiens
gaaaaagtttcctcattaaacgaggggaggggagactgaataacaagagctcccaccatctctacatagtttgattccaggcatgacggggaaacctggayagagagagaggcttagggaagaggaaaaccaaccttgcgtctcttggcaggcataccactgaggtaggcatcactcagagggggctgcggtttcaccttc

SEQ ID NO: 38105 - DNA, 201 bp, Homo sapiens
gcacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgag

SEQ ID NO: 38106 - DNA, 201 bp, Homo sapiens
cacttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgaga

SEQ ID NO: 38107 - DNA, 201 bp, Homo sapiens
agaaaaccagagctgctacaggaggtaagggatgggtttgagattgtgcttcactgcactcttactcgtgaaaattcttctgggttatgttttctctgttytctttcctgtttctttcactgtgtttttactccagaattctcagtattagtctcccatgtgtctcccttgttgtccccacaccctgtgtcaccccactct

SEQ ID NO: 38108 - DNA, 201 bp, Homo sapiens
acttagggaggccgaggtgggcagatcaactgagttcaggagttcgagaccaccatggctaacgtggtgaaaccccatttctactaaaaatacaaaaaagtagccggcgtggtggcgctcgcctgtagtcccagctactcgggagactgaggcaggagaaacgcttgaacccaggaggtggaggttgtagtgagccgagat

SEQ ID NO: 38109 - DNA, 201 bp, Homo sapiens
tactctgtctcaaaaaaaaaaaaaaacaaacatcaaaactggcttgtacaatttagcgtgctgagtagaacacaacagtgttccaaggaagtattaatttwaaaaagttcacacaagattaagggacacactacctaatggagacaatgtagagagaaagcagccagaaaaatccgacttttatttcttaaatactgtgaa

SEQ ID NO: 38110 - DNA, 201 bp, Homo sapiens
caggtgaaggagaaacccttgtggccccaactctaaattcgagttgccacctgatttcctgtccttccgtctcatcgctgacctctcactgtgactcactstttaacacatgcctgtcccctaggcctccccaccagatgccctgcgctggatacctaagccttgggagcggacagggccgccacctcgagaagggccctc

SEQ ID NO: 38111 - DNA, 201 bp, Homo sapiens
cccaaatttcttgttacagatgcttctacccatggtagactcacagctgcctgtggtgaactttggctccctgccgccagcaccacctcctgccccacctyccctttctctgttacctgtgggccctgctctgcagccccccagcctggctgtgcggcccccacctgctcctgctactcgggtgctgccttcacctgccag

SEQ ID NO: 38112 - DNA, 201 bp, Homo sapiens
tcctaagacggcctgggcagaaacctctcggcctccagagacagagccgggacctcctgccccaaagcctcccctacccccacctcaccggggccccgccrggaactggggcccccctggggactacccagtgagtgtctccaataagggattgagagggtcagctgtgggaaattggtgtcagctgagtaattgaagcgg

SEQ ID NO: 38113 - DNA, 201 bp, Homo sapiens
ggtctcaaagaagaccaggataatgagtttgtcaccacccagagagatcaaccccaaagcctgggtcgttgcatcctgcaagtagcgacagttgatttgtygtaaaagagatgatagaaagcatagtaactgattcccctggccctgctgggtcttgccaattgacaggatcgtgggggtcctccctgcaagcccccagca

SEQ ID NO: 38114 - DNA, 201 bp, Homo sapiens
tactgttgttctaatggtttcatagaaagttaatgccaccaccataggctcatgagaggccatgaagtgctttaatgggtcttaaatgggaggggcttcartagaatagatgttgaatagaatattttagtcttaagggagctagagatgagacgtgagattcctggggtgttcatggagtgtctattgttggactagatc

SEQ ID NO: 38115 - DNA, 201 bp, Homo sapiens
cagacagtgggggctcaagctcagagccatttgaccgtcatgcacctgctatgttacgggaacggggcactccaccggtggatccaaagttggcctgggtrggagatgtcttcaccgccacacccgctgaaccccgcccacttacctcacctctgcgccaggctgcggatgaggatgacaaggggatgaggtgagtcttgg

SEQ ID NO: 38116 - DNA, 201 bp, Homo sapiens
acctcattttcttcatctttaaaatgaaaggttcagagtcaatgaattcccagggccccttcccctaacatgtcactaggggctcttacccagtggttatrtaatggcaagaaggtaccactgcctggctgggccgggggacaggaagatgaggtgaatggcaagccagccactcacctgcaagaagtcagtcatgccttg

SEQ ID NO: 38117 - DNA, 201 bp, Homo sapiens
tggctgcataagaagctgccccacaaggccgctcaccatctgggccaacgaggcattggtacccagaccggcgccctgctggatagagagcaagggagaayttcagacctgcccttccatgcaccaccacaggagtctctccctagactgttacgcactagaactccccgacccttgctcaccagtgtcccagagactggg

SEQ ID NO: 38118 - DNA, 201 bp, Homo sapiens
tcccaactttacactgggtcctttaaagggggtgtgggctctgggtgaacaccagttatcctcctacaaaggcgtgtctgtggttccctgtctttggacaygtaagaattggaggaaaataaatgtggatttgggaaactttgaggccagcttgcttcttgcaggctcatgatcaaccaatctcacataaaagtattgaat

SEQ ID NO: 38119 - DNA, 201 bp, Homo sapiens
tgactaaggaatggtactaaactttagctttttgtcttggagagagagcatgaaaaaatagacaacagcctacaaaggatgacaaaattaatttgtccttrtatttgtaaatggtagcaatgggcatgatttcagtcctgagtctccaccagttggagaagtcagggaggcatctcaggtgtgaataaccttcccattctg

SEQ ID NO: 38120 - DNA, 201 bp, Homo sapiens
gggttgatatatttctccctgtttcccgacaggtacgccaggatctgccatccccttcggatttttattctactcctctgcagcctggtggccaaagtggmtttctcccttcaggggctcctgcccagcaggtatattgtatcttcacacttccccttcatttgatttctctgtccagttgctggctttgattttccctgg

SEQ ID NO: 38121 - DNA, 201 bp, Homo sapiens; identical to SEQ ID NO: 9915

SEQ ID NO: 38122 - DNA, 201 bp, Homo sapiens
acggagcttctcaagtcagcggccaggcatggaacggcagaatcggcgccctggcccagggggcaaggctggcagcagtggcagcagcagtggaggaggcrgtgggggtcctggaggaaggaccgggccaggacgaggcgacaagaggagctggccctctcccaagaaccgaaggtgggtaggaacaaacaaatttattgt

SEQ ID NO: 38123 - DNA, 201 bp, Homo sapiens
agccagagagccaaggatttgagtaaacggagcttctcaagtcagcggccaggcatggaacggcagaatcggcgccctggcccagggggcaaggctggcarcagtggcagcagcagtggaggaggcggtgggggtcctggaggaaggaccgggccaggacgaggcgacaagaggagctggccctctcccaagaaccgaagg

SEQ ID NO: 38124 - DNA, 201 bp, Homo sapiens; identical to SEQ ID NO: 9919

SEQ ID NO: 38125 - DNA, 201 bp, Homo sapiens
atggagtggctcatgcctgtaatcccagcattttgggaggctgaggcaagaagattgcttgagcccagcagttcgagactagcctcggcaactggatgccrtctctgccaaaacaaacagaaaaatagtaaaagagagtctgcatcataataaagtgttcttttcccacctagttctggttttcctgagatacttatttcc

SEQ ID NO: 38126 - DNA, 201 bp, Homo sapiens; identical to SEQ ID NO: 9923

SEQ ID NO: 38127 - DNA, 201 bp, Homo sapiens; identical to SEQ ID NO: 9921

SEQ ID NO: 38128 - DNA, 201 bp, Homo sapiens
atgcataggaacccttagaaggactcaaaaacacctggactttaatagggaagagaataggttgtaagcagaagttgggaaacataacttgtgggaaaaartaacgatttagtggatactggagctaatgctctgttttctccagtcgtcctccagaggagcgtcccccggggcttcccctgcctcccccacctcccagca

SEQ ID NO: 38129 - DNA, 201 bp, Homo sapiens
tatgtattcattgctggttctttgctttccagtctgtgcatctgtatgcataggaacccttagaaggactcaaaaacacctggactttaatagggaagagrataggttgtaagcagaagttgggaaacataacttgtgggaaaaagtaacgatttagtggatactggagctaatgctctgttttctccagtcgtcctccag

SEQ ID NO: 38130 - DNA, 201 bp, Homo sapiens
ctatgggtgggatggtgatcttttttcttgaccacagatactaaagctgtttcaaccgtgctcctctcctgcagatctctgggggagccatggactctcarttacatccaaacagtggaggcttccgccctgggacaccctcactgcacccttacaggtaagactcgatgcctgtggatcacagaagtacttggagatgtg

SEQ ID NO: 38131 - DNA, 201 bp, Homo sapiens
gttttctatggcagtgctgggccttccagttctcaggtaggccccgcttcccattgcatgaccccttcagtgaataataatttttttctgcctggtatgtrtttataatcaagcctttctacgttgcagagttgtgagataccactttgtcacatcatttttctccctactttttgcttctatgggtgggatggtgatctt

SEQ ID NO: 38132 - DNA, 201 bp, Homo sapiens
gacccccactttgaggagccggggccaatggtgagaggggtgggtgggactcctcgggactctgccggggttagtccctttccccctaaacgtcgggagcrgcctcccagaaaaccagagctgctacaggaggtaagggatgggtttgagattgtgcttcactgcactcttactcgtgaaaattcttctgggttatgtttt

SEQ ID NO: 38133 - DNA, 201 bp, Homo sapiens
ctagaagctagtggacttaaggcattgctaggactctggcttcctaacagcttttctccccacaatttattttcagatcacagcccctatacctacccccsggcccagcccctccctcagcactgctctctggggtagctctcaagggccagtttctggatttctccacaatgcaagctacagagctggggaagttgccgg

SEQ ID NO: 38134 - DNA, 201 bp, Homo sapiens
  misc_feature (1)...(201): n = A,T,C or G, or insertion/deletion polymorphism (see Tables 1-2)
cctttccctcccccaatgcactttactgtgtgcccaatccaggagctgccccgggagcagcctctgccccctggccccattggcacagaacgatcacagcntacagaccgaggcacagagcctggccccattcggccatcccatcgacctggtcccccagtccagtttggcactagtgacaaggtctgtgtgggctggatc

SEQ ID NO: 38135 - DNA, 201 bp, Homo sapiens
gacctctcactgtgactcactctttaacacatgcctgtcccctaggcctccccaccagatgccctgcgctggatacctaagccttgggagcggacagggcygccacctcgagaagggccctcccgacgggcagaggagcctgggtcccgaggggacaaggagcctgggttgcccccaccccgctgagggagttcctcttgc

SEQ ID NO: 38136 - DNA, 201 bp, Homo sapiens
actggaaagcggttggtagggtgttagagtcaagaacacccacctatgtattcattgctggttctttgctttccagtctgtgcatctgtatgcataggaayccttagaaggactcaaaaacacctggactttaatagggaagagaataggttgtaagcagaagttgggaaacataacttgtgggaaaaagtaacgatttag

SEQ ID NO: 38137 - DNA, 201 bp, Homo sapiens
ggctaaggcaactggaaagcggttggtagggtgttagagtcaagaacacccacctatgtattcattgctggttctttgctttccagtctgtgcatctgtaygcataggaacccttagaaggactcaaaaacacctggactttaatagggaagagaataggttgtaagcagaagttgggaaacataacttgtgggaaaaagt

SEQ ID NO: 38138 - DNA, 201 bp, Homo sapiens
gcctcagttctggtaagctggaggggttatgggtgggaatatctccatccccagagaaggtcaagtgctggagggagcgggtggagaacctggcctagggrccctgctgctgggtgcgtttctgcagggagcaagggtagaagaattgggaggtggagtagagaggaaaagttagggtcagtggcagagccaggcagatgc

SEQ ID NO: 38139 - DNA, 201 bp, Homo sapiens
tggggagttacattctgatcttcactgcttaaagcagaagtatggtaggtatttaacagagtcaggcagcacaacttacctacctcttcctctgaacaggytgtcagaaagcagtgacactaattactatactttctttttctaaacctcattttcttcatctttaaaatgaaaggttcagagtcaatgaattcccagggc

SEQ ID NO: 38140 - DNA, 201 bp, Homo sapiens
ccaaagaatcctgggggacaagggcagatgttagcaatggcctttaccacctggcctgcccacccacaaccagatcatcaacctcatcccaccttggcaayacccctaaaccaaggccatctacattcctctggctgccccttcctggagcaagccaaagcatcctttttgctcaccaagggccccatcagctccaggctc

SEQ ID NO: 38141 - DNA, 201 bp, Homo sapiens
gaaaaagtaagcaggttggagaaacgctggccaagtccctatgatcccagcaagcacacaaggccatccctcagaagctaacatttccccccccaagcacrctgtcaaatagcccggggtggcactgtcaagccttcccagatgccaaaggggaaaacaaatggtagcaccaggctgaccagttcatcgctgaagggatcc

SEQ ID NO: 38142 - DNA, 201 bp, Homo sapiens
taccccccacctgctctgggttgagtctggagctgttctctcacttggctgtcccctttctgcagtttgtatgtgtgcatcagtcaggtattggggtgctytctaccctgacttaactagctccttctccactcctctcagatgagtcagtctgacagtggggtggacctgagtggggattctcaggtgtcatcaggtccc

SEQ ID NO: 38143 - DNA, 201 bp, Homo sapiens; identical to SEQ ID NO: 9936

SEQ ID NO: 38144 - DNA, 201 bp, Homo sapiens
gattctcttgtagggaatctgagtggataaccttgttatataagagcaggcaaggcccggacctactgggaacaagagatggaagagctgacttgaccgcraggggagatgctttttgggctggagggcttgtgacatgaataggattatttttctttttctttggtttcttcaggcctagttccccgagagcgttcagac

SEQ ID NO: 38145 - DNA, 201 bp, Homo sapiens
gatgccgcctttcgtgagtcttggtgtcttgtcttggaacgattacactggaagctggagagctaggaatcaggacttagtctttgacctatgagatagargggagggtgggaggatgattgatagcaggcttaaggagctagaagggtatatgactgtccctctgagcagctactgttggacccttttacagatgtatcc

SEQ ID NO: 38146 - DNA, 201 bp, Homo sapiens
ctggggactgtagttggggtcttcctgcagtcgtttttgtatatcagaccggagctaaagagaaaaagtaagcaggttggagaaacgctggccaagtcccyatgatcccagcaagcacacaaggccatccctcagaagctaacatttccccccccaagcacactgtcaaatagcccggggtggcactgtcaagccttccca

SEQ ID NO: 38147 - DNA, 201 bp, Homo sapiens
ctagagtgatgggtattttaacttgaacttcagggagcattggggcttggtttagtccagccacgtctgagccagagacgaagaggtccctttcttacctrttgcaggttccttgttaaatgactaaggaatggtactaaactttagctttttgtcttggagagagagcatgaaaaaatagacaacagcctacaaaggatg

SEQ ID NO: 38148 - DNA, 201 bp, Homo sapiens
tctgccatccccttcggatttttattctactcctctgcagcctggtggccaaagtggctttctcccttcaggggctcctgcccagcaggtatattgtatcktcacacttccccttcatttgatttctctgtccagttgctggctttgattttccctggttttctgacattcctccctgcccccaacatgcacacccaaatt

SEQ ID NO: 38149 - DNA, 201 bp, Homo sapiens
cagctcatgatttttttcccctcagctgcatccagtggaactaaagccgttccaggattatcaaaaactgagcagcaaccttgggggacctggatcatcayggactcccccaactggaaggtgaaacggaatagggatgtggactttccaagtgcttccttactttggaaccagggtctggatcctaggcttgccttagac

SEQ ID NO: 38150 - DNA, 201 bp, Homo sapiens
tttccaagtgcttccttactttggaaccagggtctggatcctaggcttgccttagacgcccttcttcccttaggtccttctctggcctcaattcccgtctsaaggccacgccttccacctacagtggagtcttccgcacccagcgcgtcgacctttaccagcaggtgaaggagaaacccttgtggccccaactctaaattc

SEQ ID NO: 38151 - DNA, 201 bp, Homo sapiens
gactgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccga

SEQ ID NO: 38152 - DNA, 201 bp, Homo sapiens
actgcccgcgtctactgccttcccacggtgttccagcagaacggcacaactaacccacagccaaacacacacacacacacacacacacacacacacacacacacacccaccaccccgcggctccgcccccgacttccccacggaccgtcacttccggtctcccccaaacctgccaccgacggccacttccgtttccccgat

SEQ ID NO: 38153 - DNA, 201 bp, Homo sapiens
ccccccaggtccccaagctttacttttgtggggcacgacgagaaagtccgcagccccaaacagtgagtttctgagggcgagtcgggccggggccggcctakgtgggagggagccgagcaccccgaggagccgccaccgctgtcgcccgggggaccgtactacgcctgcgtgcgtcgcactacggatgcgtggacacttaag

SEQ ID NO: 38154 - DNA, 201 bp, Homo sapiens
cttccacctacagtggagtcttccgcacccagcgcgtcgacctttaccagcaggtgaaggagaaacccttgtggccccaactctaaattcgagttgccacytgatttcctgtccttccgtctcatcgctgacctctcactgtgactcactctttaacacatgcctgtcccctaggcctccccaccagatgccctgcgctgg

SEQ ID NO: 38155 - DNA, 201 bp, Homo sapiens
cctctcccaagaaccgaaggtgggtaggaacaaacaaatttattgtggtttaaaaattggaggagggggaaaaagcctgagggaaagataagtttgggtgkagtggagattgtggcctgaggggccatgggctctagaatgtcagtaggatttccatgtctggctaaggcaactggaaagcggttggtagggtgttagagt

SEQ ID NO: 38156 - DNA, 201 bp, Homo sapiens
gggccaggacgaggcgacaagaggagctggccctctcccaagaaccgaaggtgggtaggaacaaacaaatttattgtggtttaaaaattggaggagggggraaaagcctgagggaaagataagtttgggtggagtggagattgtggcctgaggggccatgggctctagaatgtcagtaggatttccatgtctggctaaggc

SEQ ID NO: 38157 - DNA, 201 bp, Homo sapiens
gagaaacgcttgaacccaggaggtggaggttgtagtgagccgagattgtgccatcgcactccagcttaggcaacgagcgaaactccgtctcaaaaatgaatgaatgaatagcacaactccatctcaaaaatgaatgaatgaatgaaagaagcagtggtccttcatttgccaggatttatttggggtgggttgattctcttg

SEQ ID NO: 38158 - DNA, 201 bp, Homo sapiens
tacaaaaaagtagccggcgtggtggcgctcgcctgtagtcccagctactcgggagactgaggcaggagaaacgcttgaacccaggaggtggaggttgtagwgagccgagattgtgccatcgcactccagcttaggcaacgagcgaaactccgtctcaaaaatgaatgaatgaatagcacaactccatctcaaaaatgaatg

SEQ ID NO: 38159 - DNA, 201 bp, Homo sapiens
tgcaaaaatgggcttagttaagaaataagcagtggttggccaggcattgtggctcacgcctgtaatcccagcacttagggaggccgaggtgggcagatcarctgagttcaggagttcgagaccaccatggctaacgtggtgaaaccccatttctactaaaaatacaaaaaagtagccggcgtggtggcgctcgcctgtagt

SEQ ID NO: 38160 - DNA, 201 bp, Homo sapiens
gaaagtcccctcagtcttaggcattggatattagggtcttactgtgactctggtacgataggttttgcccatcatagtgatgagggaagggcatatgcttrgcactgctgagatagctctgttgcaaaaatgggcttagttaagaaataagcagtggttggccaggcattgtggctcacgcctgtaatcccagcacttagg

SEQ ID NO: 38161 - DNA, 201 bp, Homo sapiens
aactgtttgagcccaggagttcaaggttacagtgagctttaactcactggattgcaccactgcactccagtctgggtgacagagcaagactctgtaacttaaaaaaaaaagaaaaaagctggccgggcacgatggctcaagcctgtaatcccagcactttgggaggccaaggtgggtggatcacaaggtcaagagttcgag

SEQ ID NO: 38162 - DNA, 201 bp, Homo sapiens
ttgcactccagcctgggtgacagagcaagactctgtctcaaaaaaaaatcctgtctcacaagaaatacataaataaaaatgaaaactatttcctataggcyaagactgaagaaagtactgttgttctaatggtttcatagaaagttaatgccaccaccataggctcatgagaggccatgaagtgctttaatgggtcttaaa

SEQ ID NO: 38163 - DNA, 201 bp, Homo sapiens
gaggcgggcagaacatgaggtcaggagttcaagatcagcctggccaacatagtgaaacccgtctctactaaaaatacaaaaattagccaagtgtggtggcwtgtgcttgtagtcccagctgcttgggaggctgaggtagtagaatcgctttaacccgggaggcagagatttctgtgagccaagaccatgccattgcactcc

SEQ ID NO: 38164 - DNA, 201 bp, Homo sapiens
accaggataatgagtttgtcaccacccagagagatcaaccccaaagcctgggtcgttgcatcctgcaagtagcgacagttgatttgttgtaaaagagatgrtagaaagcatagtaactgattcccctggccctgctgggtcttgccaattgacaggatcgtgggggtcctccctgcaagcccccagcacctgaagatgagg

SEQ ID NO: 38165 - DNA, 201 bp, Homo sapiens
gaaaagttagggtcagtggcagagccaggcagatgctgaccctttttctctttcccagacccccactttgaggagccggggccaatggtgagaggggtggrtgggactcctcgggactctgccggggttagtccctttccccctaaacgtcgggagcggcctcccagaaaaccagagctgctacaggaggtaagggatggg

SEQ ID NO: 38166 - DNA, 201 bp, Homo sapiens
ccccctaaacgtcgggagcggcctcccagaaaaccagagctgctacaggaggtaagggatgggtttgagattgtgcttcactgcactcttactcgtgaaawttcttctgggttatgttttctctgttttctttcctgtttctttcactgtgtttttactccagaattctcagtattagtctcccatgtgtctcccttgttg

SEQ ID NO: 38167 - DNA, 201 bp, Homo sapiens
ggcacagaagtgagtgagggtgggagggtgtgtctgagctgggacttttttgagcactggtcataccccccacctgctctgggttgagtctggagctgttytctcacttggctgtcccctttctgcagtttgtatgtgtgcatcagtcaggtattggggtgctttctaccctgacttaactagctccttctccactcctct

SEQ ID NO: 38168 - DNA, 201 bp, Homo sapiens
cacagcaaccctgctggcatccaacaggctctggcccagcttagtagccgtcaagggagtgtaactgcaccagggggtcatccaaggcacaagcctgggcytccccaagcccctcagggcccctctcctaggcccccaacccgatacgagccccagagggtcaacagcggcctcagttctggtaagctggaggggttatgg

SEQ ID NO: 38169 - DNA, 201 bp, Homo sapiens
ggccaggagtgagctccgggttctgggctggggcacgctcctccacttcttctgcctccatgggctcccggggaggtgcttcactttcaactggttctgaygtttgagagctcaaggctactggctccggggtcacagccggtggctgcgggggcggctgactgtgctgcggttggggccctcctcgacactgaaggtagg

SEQ ID NO: 38170 - DNA, 201 bp, Homo sapiens
attggcacagaacgatcacagcgtacagaccgaggcacagagcctggccccattcggccatcccatcgacctggtcccccagtccagtttggcactagtgrcaaggtctgtgtgggctggatctgggtatcctgagttgggtggagagaagggaaggactaaaggtgggacatagaggacacatgtctgtcacgggacaat

SEQ ID NO: 38171 - DNA, 201 bp, Homo sapiens
cgggatagtaaggtctgtatatccctgatcatgtgctgagccatcaccagccgtacccggggctcactctacaatgagagaaggtttatcagggtaggttrcagatgaagccatgagttctaccacctactaaatcaggtcccagccatctctcagccaggtccaccccacctcccagcctccttctcccagatccccttc

SEQ ID NO: 38172 - DNA, 201 bp, Homo sapiens
atccgcccaccttggcctcccaaagtgctgggattacaggcgtgagccactgcacctggccctgttgcaatgtttttccagggagggaaagagttatctgyatttcagcctgttctgttttgggagtactggggctgaggagaaagggcagggccatcaaagggctcacattgttattgtagtccgtggtggcagcagcac

SEQ ID NO: 38173 - DNA, 201 bp, Homo sapiens
agagaagggaaggactaaaggtgggacatagaggacacatgtctgtcacgggacaatgtctcctgccttcttgtgatcacaggactcagacttacgcctartggtaggagacagcttgaaagcagagaaggagctaacagcatcagtcactgaggtaagtgggagtaagagtttggtggaaaggcccaagatttctgggga

SEQ ID NO: 38174 - DNA, 201 bp, Homo sapiens
agggcaagtccttagagatccagaaacccgctggtgagagtcctgcaaagatgcttctgatggttgaaagctaggcatgcatggggcatacgttttagagytctttaaagggaagtggctgtagtagaaataccaaaagactagaggagatttcccaactttacactgggtcctttaaagggggtgtgggctctgggtgaa

SEQ ID NO: 38175 - DNA, 201 bp, Homo sapiens
ccctgatgaggaagggccatagagcaaagagctaaggatcatcagcaaaggcccgctgggcattggggaagcgctggggactgtagttggggtcttcctgyagtcgtttttgtatatcagaccggagctaaagagaaaaagtaagcaggttggagaaacgctggccaagtccctatgatcccagcaagcacacaaggccat

SEQ ID NO: 38176 - DNA, 201 bp, Homo sapiens
tcaggggcacaaggggtacgatacgaggacagtgcttacagcaaagattatcaccttctctgtaagggaggacaaaatcacttacaggtttagagagaaaytgttttgttgcaatgtgtgtttttttgttttgttttgttttttgagacagtctcgctctgtcacccaggctagagtgcagtagtgcaatctcggctcact

SEQ ID NO: 38177 - DNA, 201 bp, Homo sapiens
tcagcaaaggcccgctgggcattggggaagcgctggggactgtagttggggtcttcctgcagtcgtttttgtatatcagaccggagctaaagagaaaaagyaagcaggttggagaaacgctggccaagtccctatgatcccagcaagcacacaaggccatccctcagaagctaacatttccccccccaagcacactgtcaa

SEQ ID NO: 38178 - DNA, 201 bp, Homo sapiens
gtgcatgaactcagggggcagggagggcagctggatgagggtggagcctggggggcgggtctgatgtaaccttgaacctggaccccttcaacccacccacwcagcccttccctttctctacccagagctcagcctgccctgatgccctcactcttacccagggtttggccatgaccagggggtcccagggggccagtggga

SEQ ID NO: 38179 - DNA, 201 bp, Homo sapiens
ggcattggggaagcgctggggactgtagttggggtcttcctgcagtcgtttttgtatatcagaccggagctaaagagaaaaagtaagcaggttggagaaasgctggccaagtccctatgatcccagcaagcacacaaggccatccctcagaagctaacatttccccccccaagcacactgtcaaatagcccggggtggcac

SEQ ID NO: 38180 - DNA, 201 bp, Homo sapiens
aatgtctcctgccttcttgtgatcacaggactcagacttacgcctagtggtaggagacagcttgaaagcagagaaggagctaacagcatcagtcactgagrtaagtgggagtaagagtttggtggaaaggcccaagatttctggggaagattgctgggagtgaccagggcgtccaggatgccagacatccctctccacgag

SEQ ID NO: 38181 - DNA, 201 bp, Homo sapiens
cagaccggcgccctgctggatagagagcaagggagaacttcagacctgcccttccatgcaccaccacaggagtctctccctagactgttacgcactagaamtccccgacccttgctcaccagtgtcccagagactgggggccctccaggatgggaaggccgagcctgtggaggagtgggccgggcaatcaccacccgggtt

SEQ ID NO: 38182 - DNA, 201 bp, Homo sapiens
tctggcttcctaacagcttttctccccacaatttattttcagatcacagcccctatacctaccccccggcccagcccctccctcagcactgctctctgggktagctctcaagggccagtttctggatttctccacaatgcaagctacagagctggggaagttgccggctggaggagttctctaccctccaccttccttcct

SEQ ID NO: 38183 - DNA, 201 bp, Homo sapiens
cagttgagcccaggagttggaggtcacagtgagctatgatcgtgccactgaactccatcctgggcaacagagcgagacttttaaaaggaaaaaaaaaaaaragtaggggaggatggatggggaataccaagtccttgcaaagtggtgagaggagtaagaatgacaagacttcattggtggatctagacttcggagggaagg

SEQ ID NO: 38184 - DNA, 201 bp, Homo sapiens
tggggaagaatgaaaactcacccacaaggactggctgcataagaagctgccccacaaggccgctcaccatctgggccaacgaggcattggtacccagaccrgcgccctgctggatagagagcaagggagaacttcagacctgcccttccatgcaccaccacaggagtctctccctagactgttacgcactagaactccccg

SEQ ID NO: 38185 - DNA, 201 bp, Homo sapiens
gaaacggaatagggatgtggactttccaagtgcttccttactttggaaccagggtctggatcctaggcttgccttagacgcccttcttcccttaggtcctyctctggcctcaattcccgtctcaaggccacgccttccacctacagtggagtcttccgcacccagcgcgtcgacctttaccagcaggtgaaggagaaaccc

SEQ ID NO: 38186 - DNA, 201 bp, Homo sapiens
cactgcactccagtctgggtgacagagcaagactctgtaacttaaaaaaaaaagaaaaaagctggccgggcacgatggctcaagcctgtaatcccagcacyttgggaggccaaggtgggtggatcacaaggtcaagagttcgagaccatcctggccaacatggtgaaacccccttctctactaaaaacataaaaaattagc

SEQ ID NO: 38187 - DNA, 201 bp, Homo sapiens
caaggccacgccttccacctacagtggagtcttccgcacccagcgcgtcgacctttaccagcaggtgaaggagaaacccttgtggccccaactctaaattygagttgccacctgatttcctgtccttccgtctcatcgctgacctctcactgtgactcactctttaacacatgcctgtcccctaggcctccccaccagatg

SEQ ID NO: 38188 - DNA, 201 bp, Homo sapiens; identical to SEQ ID NO: 10039

SEQ ID NO: 38189 - DNA, 201 bp, Homo sapiens; identical to SEQ ID NO: 3720

SEQ ID NO: 38190 - DNA, 201 bp, Homo sapiens
acagaggctggctgagcagcagcgggcagaggagcgcgagcggctggccgaggtggaggccgcgctggagaagcagcggcagctggccgaggcgcacgccyaggcaaaggcacaggcggagcgggaggcgaaggagctgcagcagcgcatgcaggaggaggtggtgcggcgggaggaggcggcggtggacgcgcagcagca

SEQ ID NO: 38191 - DNA, 201 bp, Homo sapiens; identical to SEQ ID NO: 3721

SEQ ID NO: 38192 - DNA, 201 bp, Homo sapiens; identical to SEQ ID NO: 10044

SEQ ID NO: 38193 - DNA, 201 bp, Homo sapiens; identical to SEQ ID NO: 3722

SEQ ID NO: 38194 - DNA, 201 bp, Homo sapiens; identical to SEQ ID NO: 23089

SEQ ID NO: 38195 - DNA, 201 bp, Homo sapiens; identical to SEQ ID NO: 3723

SEQ ID NO: 38196 - DNA, 201 bp, Homo sapiens; identical to SEQ ID NO: 23091

SEQ ID NO: 38197 - DNA, 201 bp, Homo sapiens; identical to SEQ ID NO: 10046

SEQ ID NO: 38198 - DNA, 201 bp, Homo sapiens
gctggagcgtgagaaggagaagctccaacaggaggccaaactgctgcagctcaagtctgaggaggtaccgccccctctacgtgcgacgggcgggtgggccyggggatctgctttggtgggtgatgggtgctcctgggctggcggtccctgatcacaccctcttcttctgcagatgcagacggtgcagcaggagcagctgct

SEQ ID NO: 38199 - DNA, 201 bp, Homo sapiens; identical to SEQ ID NO: 10047

SEQ ID NO: 38200 - DNA, 201 bp, Homo sapiens
aaactgctgcagctcaagtctgaggaggtaccgccccctctacgtgcgacgggcgggtgggcccggggatctgctttggtgggtgatgggtgctcctgggytggcggtccctgatcacaccctcttcttctgcagatgcagacggtgcagcaggagcagctgctgcaggagacgcaggccctgcagcaaagcttcctctct

SEQ ID NO: 38201 - DNA, 201 bp, Homo sapiens; identical to SEQ ID NO: 3746

SEQ ID NO: 38202 - DNA, 201 bp, Homo sapiens; identical to SEQ ID NO: 10049

SEQ ID NO: 38203 - DNA, 201 bp, Homo sapiens; identical to SEQ ID NO: 3796

SEQ ID NO: 38204 - DNA, 201 bp, Homo sapiens; identical to SEQ ID NO: 10051

SEQ ID NO: 38205 - DNA, 201 bp, Homo sapiens; identical to SEQ ID NO: 10052

SEQ ID NO: 38206 - DNA, 201 bp, Homo sapiens; identical to SEQ ID NO: 10053

SEQ ID NO: 38207 - DNA, 201 bp, Homo sapiens; identical to SEQ ID NO: 3748

SEQ ID NO: 38208 - DNA, 201 bp, Homo sapiens; identical to SEQ ID NO: 3749

SEQ ID NO: 38209 - DNA, 201 bp, Homo sapiens; identical to SEQ ID NO: 3750

SEQ ID NO: 38210 - DNA, 201 bp, Homo sapiens; identical to SEQ ID NO: 3731

SEQ ID NO: 38211 - DNA, 201 bp, Homo sapiens; identical to SEQ ID NO: 3751

SEQ ID NO: 38212 - DNA, 201 bp, Homo sapiens; identical to SEQ ID NO: 3752

SEQ ID NO: 38213 - DNA, 201 bp, Homo sapiens; identical to SEQ ID NO: 3753

SEQ ID NO: 38214 - DNA, 201 bp, Homo sapiens; identical to SEQ ID NO: 3754

SEQ ID NO: 38215 - DNA, 201 bp, Homo sapiens; identical to SEQ ID NO: 3755

SEQ ID NO: 38216 - DNA, 201 bp, Homo sapiens; identical to SEQ ID NO: 3758

SEQ ID NO: 38217 - DNA, 201 bp, Homo sapiens; identical to SEQ ID NO: 3732

SEQ ID NO: 38218 - DNA, 201 bp, Homo sapiens; identical to SEQ ID NO: 3759

SEQ ID NO: 38219 - DNA, 201 bp, Homo sapiens; identical to SEQ ID NO: 3733

SEQ ID NO: 38220 - DNA, 201 bp, Homo sapiens; identical to SEQ ID NO: 3735

SEQ ID NO: 38221 - DNA, 201 bp, Homo sapiens; identical to SEQ ID NO: 3734

SEQ ID NO: 38222 - DNA, 201 bp, Homo sapiens; identical to SEQ ID NO: 10070

SEQ ID NO: 38223 - DNA, 201 bp, Homo sapiens; identical to SEQ ID NO: 3736

SEQ ID NO: 38224 - DNA, 201 bp, Homo sapiens; identical to SEQ ID NO: 10072

SEQ ID NO: 38225 - DNA, 201 bp, Homo sapiens; identical to SEQ ID NO: 3737

SEQ ID NO: 38226 - DNA, 201 bp, Homo sapiens; identical to SEQ ID NO: 10073

SEQ ID NO: 38227 - DNA, 201 bp, Homo sapiens; identical to SEQ ID NO: 3739

SEQ ID NO: 38228 - DNA, 201 bp, Homo sapiens; identical to SEQ ID NO: 3740

SEQ ID NO: 38229 - DNA, 201 bp, Homo sapiens; identical to SEQ ID NO: 3741

SEQ ID NO: 38230 - DNA, 201 bp, Homo sapiens; identical to SEQ ID NO: 3742

SEQ ID NO: 38231 - DNA, 201 bp, Homo sapiens; identical to SEQ ID NO: 10077

SEQ ID NO: 38232 - DNA, 201 bp, Homo sapiens; identical to SEQ ID NO: 3743

SEQ ID NO: 38233 - DNA, 201 bp, Homo sapiens; identical to SEQ ID NO: 10079

SEQ ID NO: 38234 - DNA, 201 bp, Homo sapiens; identical to SEQ ID NO: 3744

SEQ ID NO: 38235 - DNA, 201 bp, Homo sapiens; identical to SEQ ID NO: 3745

SEQ ID NO: 38236 - DNA, 201 bp, Homo sapiens; identical to SEQ ID NO: 10083

SEQ ID NO: 38237 - DNA, 201 bp, Homo sapiens; identical to SEQ ID NO: 10084

SEQ ID NO: 38238 - DNA, 201 bp, Homo sapiens; identical to SEQ ID NO: 3747

SEQ ID NO: 38239 - DNA, 201 bp, Homo sapiens; identical to SEQ ID NO: 3773

SEQ ID NO: 38240 - DNA, 201 bp, Homo sapiens; identical to SEQ ID NO: 3730

SEQ ID NO: 38241 - DNA, 201 bp, Homo sapiens; identical to SEQ ID NO: 3774

SEQ ID NO: 38242 - DNA, 201 bp, Homo sapiens; identical to SEQ ID NO: 10089

SEQ ID NO: 38243 - DNA, 201 bp, Homo sapiens; identical to SEQ ID NO: 10090

SEQ ID NO: 38244 - DNA, 201 bp, Homo sapiens; identical to SEQ ID NO: 23049

SEQ ID NO: 38245 - DNA, 201 bp, Homo sapiens; identical to SEQ ID NO: 3775

SEQ ID NO: 38246 - DNA, 201 bp, Homo sapiens; identical to SEQ ID NO: 3756

SEQ ID NO: 38247 - DNA, 201 bp, Homo sapiens; identical to SEQ ID NO: 3757

SEQ ID NO: 38248 - DNA, 201 bp, Homo sapiens; identical to SEQ ID NO: 3776

SEQ ID NO: 38249 - DNA, 201 bp, Homo sapiens; identical to SEQ ID NO: 3760

SEQ ID NO: 38250 - DNA, 201 bp, Homo sapiens; identical to SEQ ID NO: 10096

SEQ ID NO: 38251 - DNA, 201 bp, Homo sapiens; identical to SEQ ID NO: 3761

SEQ ID NO: 38252 - DNA, 201 bp, Homo sapiens; identical to SEQ ID NO: 3762

SEQ ID NO: 38253 - DNA, 201 bp, Homo sapiens; identical to SEQ ID NO: 3763

SEQ ID NO: 38254 - DNA, 201 bp, Homo sapiens; identical to SEQ ID NO: 10100

SEQ ID NO: 38255 - DNA, 201 bp, Homo sapiens; identical to SEQ ID NO: 3764

SEQ ID NO: 38256 - DNA, 201 bp, Homo sapiens; identical to SEQ ID NO: 3765

SEQ ID NO: 38257 - DNA, 201 bp, Homo sapiens; identical to SEQ ID NO: 3767

SEQ ID NO: 38258 - DNA, 201 bp, Homo sapiens; identical to SEQ ID NO: 3768

SEQ ID NO: 38259 - DNA, 201 bp, Homo sapiens; identical to SEQ ID NO: 10106

SEQ ID NO: 38260 - DNA, 201 bp, Homo sapiens; identical to SEQ ID NO: 3989

SEQ ID NO: 38261 - DNA, 201 bp, Homo sapiens; identical to SEQ ID NO: 10107

SEQ ID NO: 38262 - DNA, 201 bp, Homo sapiens; identical to SEQ ID NO: 10109

SEQ ID NO: 38263 - DNA, 201 bp, Homo sapiens; identical to SEQ ID NO: 3771

SEQ ID NO: 38264 - DNA, 201 bp, Homo sapiens; identical to SEQ ID NO: 10110

SEQ ID NO: 38265 - DNA, 201 bp, Homo sapiens; identical to SEQ ID NO: 10111

SEQ ID NO: 38266 - DNA, 201 bp, Homo sapiens; identical to SEQ ID NO: 10112

SEQ ID NO: 38267 - DNA, 201 bp, Homo sapiens; identical to SEQ ID NO: 10113

SEQ ID NO: 38268 - DNA, 201 bp, Homo sapiens; identical to SEQ ID NO: 10114

SEQ ID NO: 38269 - DNA, 201 bp, Homo sapiens; identical to SEQ ID NO: 10115

SEQ ID NO: 38270 - DNA, 201 bp, Homo sapiens; identical to SEQ ID NO: 3777

SEQ ID NO: 38271 - DNA, 201 bp, Homo sapiens; identical to SEQ ID NO: 10117

SEQ ID NO: 38272 - DNA, 201 bp, Homo sapiens; identical to SEQ ID NO: 3779

SEQ ID NO: 38273 - DNA, 201 bp, Homo sapiens; identical to SEQ ID NO: 3778

SEQ ID NO: 38274 - DNA, 201 bp, Homo sapiens; identical to SEQ ID NO: 3780

SEQ ID NO: 38275 - DNA, 201 bp, Homo sapiens; identical to SEQ ID NO: 3781

SEQ ID NO: 38276 - DNA, 201 bp, Homo sapiens; identical to SEQ ID NO: 3782

SEQ ID NO: 38277 - DNA, 201 bp, Homo sapiens; identical to SEQ ID NO: 3783

SEQ ID NO: 38278 - DNA, 201 bp, Homo sapiens; identical to SEQ ID NO: 3784

SEQ ID NO: 38279 - DNA, 201 bp, Homo sapiens; identical to SEQ ID NO: 3785

SEQ ID NO: 38280 - DNA, 201 bp, Homo sapiens; identical to SEQ ID NO: 10126

SEQ ID NO: 38281 - DNA, 201 bp, Homo sapiens; identical to SEQ ID NO: 10127

SEQ ID NO: 38282 - DNA, 201 bp, Homo sapiens; identical to SEQ ID NO: 10128

SEQ ID NO: 38283 - DNA, 201 bp, Homo sapiens; identical to SEQ ID NO: 3787

SEQ ID NO: 38284 - DNA, 201 bp, Homo sapiens; identical to SEQ ID NO: 3788

SEQ ID NO: 38285 - DNA, 201 bp, Homo sapiens; identical to SEQ ID NO: 23076

SEQ ID NO: 38286 - DNA, 201 bp, Homo sapiens; identical to SEQ ID NO: 10130

SEQ ID NO: 38287 - DNA, 201 bp, Homo sapiens; identical to SEQ ID NO: 3728

SEQ ID NO: 38288 - DNA, 201 bp, Homo sapiens; identical to SEQ ID NO: 23061

SEQ ID NO: 38289 - DNA, 201 bp, Homo sapiens; identical to SEQ ID NO: 23078

SEQ ID NO: 38290 - DNA, 201 bp, Homo sapiens; identical to SEQ ID NO: 3789

SEQ ID NO: 38291 - DNA, 201 bp, Homo sapiens; identical to SEQ ID NO: 10136

SEQ ID NO: 38292 - DNA, 201 bp, Homo sapiens; identical to SEQ ID NO: 3790

SEQ ID NO: 38293 - DNA, 201 bp, Homo sapiens; identical to SEQ ID NO: 10138

SEQ ID NO: 38294 - DNA, 201 bp, Homo sapiens; identical to SEQ ID NO: 10139

SEQ ID NO: 38295 - DNA, 201 bp, Homo sapiens; identical to SEQ ID NO: 3714

SEQ ID NO: 38296 - DNA, 201 bp, Homo sapiens; identical to SEQ ID NO: 10142

SEQ ID NO: 38297 - DNA, 201 bp, Homo sapiens; identical to SEQ ID NO: 10143

SEQ ID NO: 38298 - DNA, 201 bp, Homo sapiens; identical to SEQ ID NO: 3716

SEQ ID NO: 38299 - DNA, 201 bp, Homo sapiens; identical to SEQ ID NO: 10145

SEQ ID NO: 38300 - DNA, 201 bp, Homo sapiens; identical to SEQ ID NO: 3717

SEQ ID NO: 38301 - DNA, 201 bp, Homo sapiens; identical to SEQ ID NO: 10147

SEQ ID NO: 38302 - DNA, 201 bp, Homo sapiens; identical to SEQ ID NO: 3718

SEQ ID NO: 38303 - DNA, 201 bp, Homo sapiens
agagggaaaaagggctcctttttctgtgggtccctgtgctgtgcacctccagacagttgggagcccaattgcaggttcaggccctggctttgctacttgtrggctgtgtgacctcaggcaattcacttaaccactccgggcctctgtactgtgaatggggttgatgttttgggtcttcctgattcttggggctggaagaat

SEQ ID NO: 38304 - DNA, 201 bp, Homo sapiens
cattgcccaggctggtctcgaactcctgggctcaagcaatcctcctgccttggtctcccgaagtgctgggattacaggcgtgaacaaccgtgcctggcatratcagattttttaaaattaaaaaacctaaaatattgatccaatgttcttctacttaatgcacacactacttctaaaatgtcccttatccagctggtgaga

SEQ ID NO: 38305 - DNA, 201 bp, Homo sapiens
agtagagatgaggtatcaccatgttggccaggctggtcacaagctcctgacctcaagtgatccgcttacttcggcctcccaaagtgctgggattacaggcrtgagccactgtgcccggcaatatgagtcttcttttattgagcactgatttgggagccaggaggggccctaccctctgctgtgaccttggccccggcatcc

SEQ ID NO: 38306 - DNA, 201 bp, Homo sapiens
agattaagagaaacattttaaaacataattccttctaacattaatgtattacatacacaaacacacacacatatatgtatatgtattttttttttttttttaagagacaagttctcactatgttgtccaggctgatcttgaactcctggcctcaagcaatcctcctgccttggccccacaaggtgccgggattacaggtgt

SEQ ID NO: 38307 - DNA, 201 bp, Homo sapiens
ctataccaacatggatagaaaagttgaaaactcagatgctgtgagtttcaggcagacgaggcgcaagaacaaagcaagcagcgcgtggggtggtagggagwcatgaagactgtggccaactgaagcccccagatcttgtctaaagggggcagctccaggggatcactgccatataggaatggaagcccagtactgccagat

SEQ ID NO: 38308 - DNA, 201 bp, Homo sapiens
ttcccctttgggaatgaaaacccaacccttccagaaggaaagtggaaaacaggctagcaggcattcacaccttagtatgaattagatcatcatttgcaaarggcaacaacttgagattctgcatgagagtaccatggtaggactgagcagttcttggggaggatctgggctcgggagggaacagaataaggttagtgggga

SEQ ID NO: 38309 - DNA, 201 bp, Homo sapiens
ggcacgggggcgctgcacaccacctacctccagtgcaaggtgagaccccaccgcgatggggagcggggggcgtccctctgttcccacccgccccctgatckcctcccacccgctgcagaatgtgaatgagctcaaccagtggctctcggccttgcgcaaggccagcgcccccaacccgaacaagctggccgcctgccaccc

SEQ ID NO: 38310 - DNA, 201 bp, Homo sapiens
actttagccagggaaaaaagcatggtaggagcagagctgggaggccagacccacagaagacccaaagaacacccgaagaaacccaagtctgaaacaccacygttagcattccatcccaagggtgaaggcagtcatcatgcactccaatttcccctttgggaatgaaaacccaacccttccagaaggaaagtggaaaacagg

SEQ ID NO: 38311 - DNA, 201 bp, Homo sapiens
cgagggaggggagaggcctgcaatattccagagggtgaggacaggggcagcctcgcaggggaggggacatctaagcaaagacttgcagggggtgaggaagrgagtgttgcggagatttaacatttaacgggagagtgttctgggcacggagataagccagtgcaaaggctgcaggatgggaatgagctcatcgtgtttaag

SEQ ID NO: 38312 - DNA, 201 bp, Homo sapiens
aatggaataaacgagggaggggagaggcctgcaatattccagagggtgaggacaggggcagcctcgcaggggaggggacatctaagcaaagacttgcaggsggtgaggaagggagtgttgcggagatttaacatttaacgggagagtgttctgggcacggagataagccagtgcaaaggctgcaggatgggaatgagctca

SEQ ID NO: 38313 - DNA, 201 bp, Homo sapiens
tcatggagtctgtgcaggggccagcagaggtgggtgcgtcaggcaagcaatgctatcaggcgggtgccgggggtctggatcctggcctccccctgcctcayggagccctatctaggcccatctgctttggggtcccaggggccgaggtcatctttgtctcccgcccccacccaggaggacactgctagccccttggctttg

SEQ ID NO: 38314 - DNA, 201 bp, Homo sapiens
gaggaaggggaaacagacatcacccaaggaaggtgttgagtcttcttattgatttatttttttccttgagacaagtctcgctctgtcacccaggctggagygcagtggcacgatcttggcttactgcaacctctgcctcctcggttcaagtgatcttcccacctcagcttctggagtagctggatttacaggcgtgagcca

SEQ ID NO: 38315 - DNA, 201 bp, Homo sapiens
atatttatggactcagtgatgtaggttcatcataaccctgagaggcaggtgctctaattattaatgcccactttataggtgaataaactgaggcacagaargttaaatgacttgctcaagatcacattattaagtgaggcagccaggatttgaaccaaagttgtctagttccagagtctatgccttttgtgtgtgtgtgtg

SEQ ID NO: 38316 - DNA, 201 bp, Homo sapiens
agatgaactcttacgtagtgctgatgtatcagaccaggattcactttgcagaaagacctaagacctgttacattttggcaatgtcgtaacccacttcctayagcctcatttgagagcttttgatttatgccacatctctctccacttcctgtttacagatggggaaactgaggcccagagaggcaaaacacttggccaagg

SEQ ID NO: 38317 - DNA, 201 bp, Homo sapiens
ggagttcacagtttggaagtggcagggaggtggggagacaatactaaacgcatagagaaataagggaggccggctgtggtggctcacgcctgtaatcccarcactttgggaggccgaggcgggtggattactggaggccaggagttggagtccagcctggccagcatggtgaaaccctgtctctactaaaaatgcaaaaaa

SEQ ID NO: 38318 - DNA, 201 bp, Homo sapiens
tgggagggtggaggacctgttaggagttcccctgtggcccaggtgagcaggagcatggattgggagccttcacctgtgtcaagattcagtcttagctctgygctgattccccaaggtgtgggctcccagagaggactttcctgcctgattttatgacattcccaacccccaaaacactgcagctgcgtcaagggggcagct

SEQ ID NO: 38319 - DNA, 201 bp, Homo sapiens
agacttgtctttctccctcttaccttccaggctgaaattactggaggattctaacatggatacaactctggaggcagacacaggtaagggctcctgtaccwcagaaggtaaaggctgggtgcagtggctcacacctgtaatcccagcactttgggaggccgaggtgggtggatcacttgaggtcaggagttcgagatcagc

SEQ ID NO: 38320 - DNA, 201 bp, Homo sapiens
ggattcgaacccctggaaggcaaatcagttactgactgtgagacctctgccaagttatttaatccctctgaacctcagtttctttatccataaactgcggrtaatggggtaacagtggagtagtgtgtagtgcacatctggagacaaaaatgagctaatcccagtaaagcgcttagaacagtgcctggcacccatgaagtg

SEQ ID NO: 38321 - DNA, 201 bp, Homo sapiens
gcaggtggtacatgtggccacagcggcccaggcggcccacgagctcaggccgcacgcccttgtgccgaagcacgccctcgtagcctgatgctgtgaccagycgctccatgcagatggtgcagtcctgcaggtggcagcaggggagactgaggactggggagggcagggcacctactgggtcagcactgccccttggtgggt

SEQ ID NO: 38322 - DNA, 201 bp, Homo sapiens
agacgatgcggatggtctgggtatcagggaagccgggcagcgagtgggggatgaggtggaactccatcttcccaggcggctgcgtacccgtcttctccccrtagatggccttgcaggtggggcactgcaggctgccatcctgggcaggggaggctggcagtgagttcccagcacccccccaaaccccactccgttccctgc

SEQ ID NO: 38323 - DNA, 201 bp, Homo sapiens
atttatatactgtatatataaatataaacatataacatatttatatataataaatataaacatataacatatttatatataataattatatataaatattattctgaacactaattctttatatttatggactcagtgatgtaggttcatcataaccctgagaggcaggtgctctaattattaatgcccactttataggtg

SEQ ID NO: 38324 - DNA, 201 bp, Homo sapiens
tgtgtgtgtgtgagatggagtctcacccttttgcccaggctagaatgcactggtgcaatcttagctcactgcaatctgtgcctcccaggttcaagagattytcctgcctcagcctcccaagtagctgagattacaggcatgagccaccacgcctggctaatttttgtatttttagtagagatgggatttcaccacattggc

SEQ ID NO: 38325 - DNA, 201 bp, Homo sapiens
tgggactacaggcgtgaaccaccgcgcccggcctgatctcttatttttaaaatgtcagcatgaattcacctgaaaaccaaacacacaaaaacactttgggwcatgcattacaaaacatttgtggttggactggccagtttgggaccccctggttgaatgctcagcacacctcccgaggtggctgtcattgtcctcacttgc

SEQ ID NO: 38326 - DNA, 201 bp, Homo sapiens
ctcccaaagtgctgggactacaggcgtgaaccaccgcgcccggcctgatctcttatttttaaaatgtcagcatgaattcacctgaaaaccaaacacacaaraacactttgggacatgcattacaaaacatttgtggttggactggccagtttgggaccccctggttgaatgctcagcacacctcccgaggtggctgtcatt

SEQ ID NO: 38327 - DNA, 201 bp, Homo sapiens
ttcatgagggcctactatatgccaggcatggtgctaagcgctttacttctcaacacaccagtgaagtgtccaccagaatgatctccaatatacagaggcayagagaggggaggtgacttcccccttctagaaggttcagaaatcagagtccaacccaagttttgtcggcctccaaaatctgtgctcttaatctgcccactg

SEQ ID NO: 38328 - DNA, 201 bp, Homo sapiens; identical to SEQ ID NO: 10153

SEQ ID NO: 38329 - DNA, 201 bp, Homo sapiens
ggctcaagctggggcacatgtctatctctgaaccaattacactgaataatggatcaggcctgagtcacaagcccattactggagcggagggagggattggmccccactaagtcatgtgagaggggggtggtgagaaggagataggtcctgtcccaaagaaaaatcagatggaagatggatgcaagaccaggaaaacccaca

SEQ ID NO: 38330 - DNA, 201 bp, Homo sapiens
ccactactggtggacaaagttgccaaaacttctgttcctcagtggttaagttgcttcttttcttttcctttttttcttttttttttttttttgagacaagkttttactctgtcacccaggctggggtgcagtggtgtgaccacagctcactgcagcgtcaacttcccgggctcaggtaatttttccacctcagcctcctga

SEQ ID NO: 38331 - DNA, 201 bp, Homo sapiens
tccctgcagcctcaaactcctgggctcaagcagtcctctcacctcagcctcccaagtagctgggaccacagatgtgccaccatgtgaggctaatatttttktgtgtgtgtgagatggagtctcacccttttgcccaggctagaatgcactggtgcaatcttagctcactgcaatctgtgcctcccaggttcaagagattct

SEQ ID NO: 38332 - DNA, 201 bp, Homo sapiens
ttcagatctctttgactccagacttaacgcccttaactcctactcctggaagtcctgggctcaggttctttctcttggtttccctgtctttggagacagcstggcatttcctcaaatagttaaagatagagttactctatgacctagcaattccactcttaggtacataccccaaagaaatgaaaacttatcttcacacaa

SEQ ID NO: 38333 - DNA, 201 bp, Homo sapiens
tctttcttggccggggactggctgggcactttctggactatctcacccggcgtgaggtggctcggaccagtgagttgcccgcacaacccccgacatcaccrccctcaatggtgggcttgcaggagggtcctgggggaggaatggggaggcctcaggcagagggaaaaagggctcctttttctgtgggtccctgtgctgtgc

SEQ ID NO: 38334 - DNA, 201 bp, Homo sapiens
gagcctggttagggagggctcactgtccaccgctctcttctcccatctcctagaagctggtgtcccagccagggccctgttcccgccctcggccattgttygagaaggctatctgctgaagcgcaaggaggagcctgccggcctggccacgcgctttgccttcaagaagcgctacgtctggctcagcggggagaccctctc

SEQ ID NO: 38335 - DNA, 201 bp, Homo sapiens
aggaggtgctgcttaaatgtgacctgagtagagcagaagttaagcagcggcattggagacagaactgggagatgggggtaaggaagtgttgcaggtgtcaygagcaaaggcctagaggttgggacaaggtaggctgacggatggaaaagggtctgtgtgactggagcctagaatgagggaggagtaccgggagaggcgagg

SEQ ID NO: 38336 - DNA, 201 bp, Homo sapiens
agccccttggctttgctggaagagctgaccttgggggactgccgccaggaccttgccaccaagctggtgaaactctttcttggccggggactggctgggcrctttctggactatctcacccggcgtgaggtggctcggaccagtgagttgcccgcacaacccccgacatcaccaccctcaatggtgggcttgcaggagggt

SEQ ID NO: 38337 - DNA, 201 bp, Homo sapiens
gacctcagtgagtggtggggaatgaagccaggaaggagtggggcatttggtggtggggcaggagtccccatcagctctcccactcacagaccacttccttygccctcagaccatcaagaagactcgcttcccgcactgggatgaagtgctggagctgcgggagatgccaggtgccccgtccccactgcgggtggagctctg

SEQ ID NO: 38338 - DNA, 201 bp, Homo sapiens
aaatccacataagttcactttacacccgttcacctgttcatgtgcaaacatgttggttcacacttgatgtatatttagaactttgggtccttccacacctstccatactgttcattcttgaacacacttgtttataccatctccacttgcctgtcctgtttatacccatcaatatcatttcacacctgtttatactggccg

SEQ ID NO: 38339 - DNA, 201 bp, Homo sapiens
attgtttaggatgtgaattacgtctctataaagttatttaaaaagagagagagtgtggggcttgggtccctccagggctgtccttatgccttttgatagawgaaatttatgtccctaaacagagctgaaaatacactcagtccagacatgctatctctagcagctgtgtgaccttgggcaaatcactccacatcgctgagc

SEQ ID NO: 38340 - DNA, 201 bp, Homo sapiens
gcttcaccatgttggtcaggctggtcacaaactgctgacctcaagtgatctgcccaccttggcctcccaaaatgctgggattacaggcgtgagccatcgtrttcggccagatctttcattttcttatgatctgatcctggacagggggaacctgggtgccctgcgagtgaaggtacgcctgattgaggaccgcgtcctgcc

SEQ ID NO: 38341 - DNA, 201 bp, Homo sapiens
gaatctgggaccaagaattcacatttaaaggagtgcttaccctgagggggactcgcgggcctgcaggtgggtgatttgtgtccagctgggactgccagctyctctccccgaccagccctgccttccccctctggacctaatgctgtccctgctggctccctggggctgactcagcgctgccagcctgtgcctcctacagtg

SEQ ID NO: 38342 - DNA, 201 bp, Homo sapiens; identical to SEQ ID NO: 10161

SEQ ID NO: 38343 - DNA, 201 bp, Homo sapiens; identical to SEQ ID NO: 10150

SEQ ID NO: 38344 - DNA, 201 bp, Homo sapiens; identical to SEQ ID NO: 10151

SEQ ID NO: 38345 - DNA, 201 bp, Homo sapiens
tgcctcctgtgtggcccgaggaccccagccccctgcacctccttttgcaggacagctactgtctggaggagcctgggccccttctggggggaggagtacayggtgcacctgcctctggatttccaccagctggccttctacgtgctggatgaggacactgtcgggtttgtggttggggaaagtggaatgtgtgggttaggg

SEQ ID NO: 38346 - DNA, 201 bp, Homo sapiens; identical to SEQ ID NO: 10154

SEQ ID NO: 38347 - DNA, 201 bp, Homo sapiens
ctcggaccagtgagttgcccgcacaacccccgacatcaccaccctcaatggtgggcttgcaggagggtcctgggggaggaatggggaggcctcaggcagarggaaaaagggctcctttttctgtgggtccctgtgctgtgcacctccagacagttgggagcccaattgcaggttcaggccctggctttgctacttgtgggc

SEQ ID NO: 38348 - DNA, 201 bp, Homo sapiens; identical to SEQ ID NO: 10155

SEQ ID NO: 38349 - DNA, 201 bp, Homo sapiens
agactctgcctccacccccaaaaaaagaagctaaggggttaaggaggtccctttttcttcgcaggcacttccccactgtctcctgtgtcctcctgtttccrgtccattatcaggccacagggctgtgtgtggggattctcaaggattttagggttctcagggcacaaggcacatcttcagcatgagaaaccattgggtccg

SEQ ID NO: 38350 - DNA, 201 bp, Homo sapiens
ctcagcttctggagtagctggatttacaggcgtgagccaccacgaccagctaatttttgcatttttagtagagatgaggtatcaccatgttggccaggctsgtcacaagctcctgacctcaagtgatccgcttacttcggcctcccaaagtgctgggattacaggcatgagccactgtgcccggcaatatgagtcttcttt

SEQ ID NO: 38351 - DNA, 201 bp, Homo sapiens
gaggagggattttacaggaagaaggagcacggcttggcgaatgcctggctgtggaggcttctggaaggggagagggagttactgatgaatgaagctgtgtyccctcagccgccggctgcagccgtacacactcagctgtcaccctgggggactggagtgacccactggatcctgatgctgaggcccagacagtgtatcggc

SEQ ID NO: 38352 - DNA, 201 bp, Homo sapiens
ggctggagtgcagtggtgcaatcatggctccctgcagcctcaaactcctgggctcaagcagtcctctcacctcagcctcccaagtagctgggaccacagaygtgccaccatgtgaggctaatatttttgtgtgtgtgtgagatggagtctcacccttttgcccaggctagaatgcactggtgcaatcttagctcactgcaa

SEQ ID NO: 38353 - DNA, 201 bp, Homo sapiens
ggccaacatggtgaaaccctgtctctactaaaaatttaaaaattagccgggcgtggtggtgcacacctgtgatcccagctactggggaggctgaggcatgrgaattgcttgagcccaggaggtggaggttgcaatgagctgagatcatgctactgcactgcaccctgggcaacacagcaagactctgcctccacccccaaa

SEQ ID NO: 38354 - DNA, 201 bp, Homo sapiens
cagtcaggttccctgtgtggacaaacagtccaagctcactgggttgtaagttcctgggggcaaaatcctgttgagtccccagggactagcagcaacagacmagacactcaggatgacaggtgacaggtgagtgtggaggtgtagtcattaaattgtaactgacaaatacccaactcatactggcttaagcaaaagagctac

SEQ ID NO: 38355 - DNA, 201 bp, Homo sapiens
ttgcaggacagctactgtctggaggagcctgggccccttctggggggaggagtacacggtgcacctgcctctggatttccaccagctggccttctacgtgytggatgaggacactgtcgggtttgtggttggggaaagtggaatgtgtgggttagggacccaagcctgggcacctgaggggagaggggatgtgggtccaca

SEQ ID NO: 38356 - DNA, 201 bp, Homo sapiens
ggccttctacgtgctggatgaggacactgtcgggtttgtggttggggaaagtggaatgtgtgggttagggacccaagcctgggcacctgaggggagagggratgtgggtccacagcccacgagggtgtgccctcccacccagaccttgacacctgcccccacttctcttggggcggggcaaaggggcccctgactcagacc

SEQ ID NO: 38357 - DNA, 201 bp, Homo sapiens
tgtagcttcaggcatggctgggtccaggtgttcaaacgatgccattaggaatctgtcttttagctctgctggtctctgtgttagcttcattcttaggcagmctctccccaggtgagagatggccctagcaactccaggcgggcaccctgccagcttagccactccaacagaaaaatcacttctatttcctaccatttccaa

SEQ ID NO: 38358 - DNA, 201 bp, Homo sapiens
cctgggttcaaggaattattttgcctcagtctcccaagtagctggggttacaggtgaacaccactacatctgagtaatttttgtatttttaatagagacasggtttcatcatgttggtcaggctggtcttgaactcctgacctcaagtgatctgcccgcctcatcctcccaaagtgctgggattacaggcatgagctaccc

SEQ ID NO: 38359 - DNA, 201 bp, Homo sapiens
aagtggaaaaagccagcccctgcaaaacacatatgattccatttatacgaaatgtctagaataggcaaatctaccgacacagaaaatagattcgtggttgycaggggctggggggcacgaagtgactggtaatgagtgcaggctctttagggctcatagacaatgttctggaatcagcggcacaactaattgcggtaagtc

SEQ ID NO: 38360 - DNA, 201 bp, Homo sapiens
aagtgttgagagaaatacagaggggagaaatgtccaagatttttttgaggggagagtatgttgggattacatgatgaagttctttctataccagggggaartgtgtgatggcacatggctacgagcattggccctagaactaactatactgcctgcattcaaattccagctctgccatttgctagctgtgagaccatggac

SEQ ID NO: 38361 - DNA, 201 bp, Homo sapiens
tgtttatactggccgcacctatacacacctgtccatgcttgttcacactgtcaacaatcatctacacttgtccacacatcctgtacatatttgtgtacacyggccacatctatccactctggccacacctgcctgtttatgttgtttgtatacattcctatttatgcctgttcacagctgcctacccctgttcatacctgt

SEQ ID NO: 38362 - DNA, 201 bp, Homo sapiens
gaattataatagatagaaaagcctgggcatagtggctcctgcctgtaatcccagaactttgggaggccaaggcaggcagatggcttgagttcaggagttcragaccagcctgggcaacatggcaaaacctcgtctctacaaaaaacacaaaaaattagctagctgtggtggtatacatctgtagtccaagttactggggag

SEQ ID NO: 38363 - DNA, 201 bp, Homo sapiens
ggcgggcatctcacgcttggctggactggttggttccgggcctgccgggtgctgcgggcactggggatgtctgtgcgcgtgggcatgtgcatgtgtgtctstgtgtgcacccgcccagctgggcctgcttgtgagttgcagggggtgggggatgttgcggggctagtgtgagtgcctgtgaccacgtgtgtatgtcctcgt

SEQ ID NO: 38364 - DNA, 201 bp, Homo sapiens
gtggtgtgaccacagctcactgcagcgtcaacttcccgggctcaggtaatttttccacctcagcctcctgagtagctgggactataggcgcacaccaccaygcccagctaagtttttacatttttagcagagacagggttttgccacattgcccaggctggtctcgaactcctgggctcaagcaatcctcctgccttggtc

SEQ ID NO: 38365 - DNA, 201 bp, Homo sapiens
gaaataattttaaaaaatcaatcatctagaattttgcagaaataaaggaaggatatgattccataaatagaagcagtgcaatctctactcagcaggatttwaaaaaatctgtatctagacacattgtgatgaaactgcagtgcatcagagacatagtccttagaattataatagatagaaaagcctgggcatagtggctcc

SEQ ID NO: 38366 - DNA, 201 bp, Homo sapiens
agtggcctccctgggggcgggcatctcacgcttggctggactggttggttccgggcctgccgggtgctgcgggcactggggatgtctgtgcgcgtgggcaygtgcatgtgtgtctgtgtgtgcacccgcccagctgggcctgcttgtgagttgcagggggtgggggatgttgcggggctagtgtgagtgcctgtgaccacg

SEQ ID NO: 38367 - DNA, 201 bp, Homo sapiens
gattgcaccattgcactccagcctgggtgacagagtgagactccatctcaaacaaaaacaaaaaccattagctaaaacctaacagtgaatggtaaacaaaagcaaggagaccatgaaggatttccctgaaagcagacgtcagtatcaattctacactcaacaaagagactaaaacttggacaaggggcagggtggatgtta

SEQ ID NO: 38368 - DNA, 201 bp, Homo sapiens
ttgatttgtaggagctctttacatatttgggcagttacttctttgtcaaattagctgcaatattttttctccatttgtctcttacgttttgactttgcctrtaattttttcatgtataaaatttctttttctatatttaatctcatatttttcttttggttctgaattttctgttagacctaaaaagaacttctcaactct

SEQ ID NO: 38369 - DNA, 201 bp, Homo sapiens
gctggagtgtagtggcatgatctcagatcactgcaacctccgccttccagtttcaagcgattctcatgcctcagcctctggagtagctgggattgcaggcrtgcaccaccatgcctaactttttttgtattttcatagagacagggttttgccatgttggccaggctggtctcaaactcctgacctcaggtgatcagctca

SEQ ID NO: 38370 - DNA, 201 bp, Homo sapiens
gatcacattattaagtgaggcagccaggatttgaaccaaagttgtctagttccagagtctatgccttttgtgtgtgtgtgtgtgtgtgtgtgtgtgtgtgwgtgtgtgagagagagagacagtgtctcattctgtcacccaggctgtcgtgaagtggtgcagtcttggctcactgcagtctcaacctccctggctcaagtg

SEQ ID NO: 38371 - DNA, 201 bp, Homo sapiens
gcagcaaacatttatatactgtatatataaatataaacatataacatatttatatataataaatataaacatataacatatttatatataataattatatmtaaatattattctgaacactaattctttatatttatggactcagtgatgtaggttcatcataaccctgagaggcaggtgctctaattattaatgcccact

SEQ ID NO: 38372 - DNA, 201 bp, Homo sapiens
tgtttgccttttcttattgatttgtaggagctctttacatatttgggcagttacttctttgtcaaattagctgcaatattttttctccatttgtctcttaygttttgactttgcctgtaattttttcatgtataaaatttctttttctatatttaatctcatatttttcttttggttctgaattttctgttagacctaaaa

SEQ ID NO: 38373 - DNA, 201 bp, Homo sapiens
aacagcagcaaacatttatatactgtatatataaatataaacatataacatatttatatataataaatataaacatataacatatttatatataataattmtatataaatattattctgaacactaattctttatatttatggactcagtgatgtaggttcatcataaccctgagaggcaggtgctctaattattaatgcc

SEQ ID NO: 38374 - DNA, 201 bp, Homo sapiens
aataacagcagcaaacatttatatactgtatatataaatataaacatataacatatttatatataataaatataaacatataacatatttatatataataattatatataaatattattctgaacactaattctttatatttatggactcagtgatgtaggttcatcataaccctgagaggcaggtgctctaattattaat

SEQ ID NO: 38375 - DNA, 201 bp, Homo sapiens
ccagggctaggtgagacctgagccaggcagggcagggcaggccagggcccggctgagggtctgtgtgtctctctcaaaaggtggagttctctccaaagacyctccagcagaagccacctaaaggctggttccgcctcctgccctttcccagagccgaggaggattctgggtaaatgtgggtgcagagggagggggccaggc

SEQ ID NO: 38376 - DNA, 201 bp, Homo sapiens
caactgccccacgtgatgcaggtggtgacgcaggacggcacgggggcgctgcacaccacctacctccagtgcaaggtgagaccccaccgcgatggggagcrgggggcgtccctctgttcccacccgccccctgatcgcctcccacccgctgcagaatgtgaatgagctcaaccagtggctctcggccttgcgcaaggccag

SEQ ID NO: 38377 - DNA, 201 bp, Homo sapiens
gcctcctgtgtggcccgaggaccccagccccctgcacctccttttgcaggacagctactgtctggaggagcctgggccccttctggggggaggagtacacrgtgcacctgcctctggatttccaccagctggccttctacgtgctggatgaggacactgtcgggtttgtggttggggaaagtggaatgtgtgggttaggga

SEQ ID NO: 38378 - DNA, 201 bp, Homo sapiens
ttgccaccaagctggtgaaactctttcttggccggggactggctgggcactttctggactatctcacccggcgtgaggtggctcggaccagtgagttgccygcacaacccccgacatcaccaccctcaatggtgggcttgcaggagggtcctgggggaggaatggggaggcctcaggcagagggaaaaagggctccttttt

SEQ ID NO: 38379 - DNA, 201 bp, Homo sapiens
agagctgaccttgggggactgccgccaggaccttgccaccaagctggtgaaactctttcttggccggggactggctgggcactttctggactatctcaccyggcgtgaggtggctcggaccagtgagttgcccgcacaacccccgacatcaccaccctcaatggtgggcttgcaggagggtcctgggggaggaatggggag

SEQ ID NO: 38380 - DNA, 201 bp, Homo sapiens
tctagggataagcatgttcacttaggtttcccagagtaagatcaaacaaacatgacttcacaatcaaagatcagcaaacacacaaggaaatgagacaccawgggcaatagtcagcagaaacaataatcatctgatttagacccacaaagactttagattctgtaattataatatacgggatttttaaaaagaatcagattt

SEQ ID NO: 38381 - DNA, 201 bp, Homo sapiens
aactgactccacctgctgcacacaaccagacggaaggtgtccccaccccggccctagcccccagcccatcctgcagcgacaatcctcttccccagatgtgycactccatccccgtgtctcacatccgcgccgtggagcgcgtagacgagggcgccttccaactgccccacgtgatgcaggtggtgacgcaggacggcacgg

SEQ ID NO: 38382 - DNA, 201 bp, Homo sapiens
tgaaatgaaaagctggggacacagcattaaagcccctgcaggggagagctgggggccagaccatgatccggcccagcatttgagttcctccagccccctargaggtgtatgtgagcatcacacctgatttatagagcagagaaactgaggcccagagagggaaggggactctctgggatggcacagccagagggtggtgaa

SEQ ID NO: 38383 - DNA, 201 bp, Homo sapiens
tactgatggcatctagggaggtcatagtctttccctggttcaagcaatgctacaataactagcctgtacaaataaaatttcacacatatgtaagttatatmcatcggtcagataaattactagaggtgaattaaagagtgcacacatttgcatacttgatagttgttgctaaattaccctccatggaagaggtagcagttc

SEQ ID NO: 38384 - DNA, 201 bp, Homo sapiens
aggtcttgctctgtcacccaggctggagtgcggtggtgctatcatagctcactgcaatcttgaacctctgggctcaagcgatcctcccatctcagcttctsgagtagctgggattacaggtgcacaccaccacacccagctaattttttcagaaatatcttatagatacggagtcttgctatgttgcccaagctggtctca

SEQ ID NO: 38385 - DNA, 201 bp, Homo sapiens
gcacaggctgggcccatagtccaagtgaatgtttatggagtaaacgaatgaacaaatgaatgaatggaattgtgtgtgtgtgtgtgtgtgtgtgtgtgtgkcagtgactgtgtgtttgtatgactgtgtgtgtgtctctatgtgtacctgccttgtatcattgtaagtgtgtgagagtgtgtctctggatctctgagtgtg

SEQ ID NO: 38386 - DNA, 201 bp, Homo sapiens
aacttgggaggcagagattgcagtgaaccaagatcgcgccactgcactccagcctgggtgatacggtgagactctgtctcaaaaaaaaaaaaaaaaaaaaagaagaagaagaagaagaaagaagatgattttaggtggaggtcattttagataggacagtggtggccagggacagcctctcaaggaggtgactttggactg

SEQ ID NO: 38387 - DNA, 201 bp, Homo sapiens
gaacttgggaggcagagattgcagtgaaccaagatcgcgccactgcactccagcctgggtgatacggtgagactctgtctcaaaaaaaaaaaaaaaaaaaaagaagaagaagaagaagaaagaagatgattttaggtggaggtcattttagataggacagtggtggccagggacagcctctcaaggaggtgactttggact

SEQ ID NO: 38388 - DNA, 201 bp, Homo sapiens
ccccacgacccaaccaggggcgattgagctaaccccaatcccaggacttctcccaccatgtcctaattgctgggagagagcgcctgcttgtggaagggggktctgtggggtaagcagccctgacacctgttcctctgatccctggagcccagcacaggctgggcccatagtccaagtgaatgtttatggagtaaacgaatg

SEQ ID NO: 38389 - DNA, 201 bp, Homo sapiens
ttctacttctgagctggacttgctgtgtgaccctgggcaagtccccttctctgtctgtgcctccgactcccctgcctgtgtcatgactgggaccctccacycatggctgccctctcaacctgcttcctccctgaactccctccttctgcaggtctgggagcagcgacccctactgcctagtgaaagtggacgacgaggtgg

SEQ ID NO: 38390 - DNA, 201 bp, Homo sapiens
agagcagagaaactgaggcccagagagggaaggggactctctgggatggcacagccagagggtggtgaagccaggcattcaagacccccccaccccccccmcacacgctctgggcctctgctttgggcttttcgaggccaggactcagaacctgctggcctcaggcctccctgttctatttctatgggtggaagcccagag

SEQ ID NO: 38391 - DNA, 201 bp, Homo sapiens
tcctatgaccagccaggccagccccccaccgtggccttgctgtgtccatttattcattcttcccatgtgtgttggtggatattccccgggggcctggcccrgggtggggactgggtgtctacacagtcagggcttgggaagcatcctcagtgggaggggtcccttatgcagaactgggtcttgggatcttttaatacctgg

SEQ ID NO: 38392 - DNA, 201 bp, Homo sapiens
  misc_feature (1)...(201): n = A,T,C or G, or insertion/deletion polymorphism (see Tables 1-2)
aggtataaaatctagaagtccctctaaatattaacactttgaactgcagtgctacaaacaacttaaaagatgtcccaaaatgtaaaccattgagtggcaanatcctaggctttgtagactgtgcctctgcaagtcgactgcctcaggataaactaaattatcaatgactggtatgatttttaagattacaatcttgacaat

SEQ ID NO: 38393 - DNA, 201 bp, Homo sapiens
gtcagactcatctattcccatatgtgtctacattatttaattattagcaaaataaatttcttcaaactctttagatgttaaatcacattctacttaaatayatatgtgtgtgtgtatatatatacacatatacatataaatgtgtatatgtatatatatgactttgtaaaactgagcctaaaatgtgatgttcatattatc

SEQ ID NO: 38394 - DNA, 201 bp, Homo sapiens
aaaaccaaaaaaatgctacattgagcagggatcgggatcggtacctgtaaacattgttattccactgcatccattacggcaaaaggaatttacacaaaaasaggccacaccattcagttcagaacatctgtgctggttttgagctggtggcctctgtctacaggttttaaaattgggagtgagggcagtggggaacacaaa

SEQ ID NO: 38395 - DNA, 201 bp, Homo sapiens
cattgaatgtgaggtcattcattctcattgtgatgacattcagcttggctgttgggtgtagtacgggaaagagctgaacttcgtttctgcctctggctctmccacttactggctttgggaccttgaacaagttccctaacaattttgctttccttgtctgcaaaaatggaataatgtaaggaccccacagcatgtggtata

SEQ ID NO: 38396 - DNA, 201 bp, Homo sapiens; identical to SEQ ID NO: 10220

SEQ ID NO: 38397 - DNA, 201 bp, Homo sapiens
  misc_feature (1)...(201): n = A,T,C or G, or insertion/deletion polymorphism (see Tables 1-2)
attgtgatgacattcagcttggctgttgggtgtagtacgggaaagagctgaacttcgtttctgcctctggctctaccacttactggctttgggaccttgancaagttccctaacaattttgctttccttgtctgcaaaaatggaataatgtaaggaccccacagcatgtggtatagaatgggcctttcataagtactgact

SEQ ID NO: 38398 - DNA, 201 bp, Homo sapiens
ttaaatttagaacatagtatgacccactttgacaaattacttaaaaagcactagagaaacatgtcagtttggtttaattgatagctaaggataaaaatggyatggataggctcacgccggtaatcccagcactttgggaggccgaggcgggcagatcgcgaggggtttgagaccagtctggccaacatagtgaaaccctgt

SEQ ID NO: 38399 - DNA, 201 bp, Homo sapiens
aatagaataaataaattaatactaaaagaagtttaataaatagattaacatgcctggaacataggaagcactcggtaaatattttctcatttcgtcttttkccagtgaaaggagaaacagccttaatgtcagactcatctattcccatatgtgtctacattatttaattattagcaaaataaatttcttcaaactctttag

SEQ ID NO: 38400 - DNA, 201 bp, Homo sapiens
  misc_feature (1)...(201): n = A,T,C or G, or insertion/deletion polymorphism (see Tables 1-2)
tgagtccagaggtgtaatatattggcaggccaacctggctgcagccctgaagctaccttcccgttttattagcaatagttactttgacctccatcgacctnactccagctctctcagttccaaacttggataggaaggagggtgttctttactggatccctcaaaaattcatggaacctatatgaccagattctgattacc

SEQ ID NO: 38401 - DNA, 201 bp, Homo sapiens
  misc_feature (1)...(201): n = A,T,C or G, or insertion/deletion polymorphism (see Tables 1-2)
ggttttgtattttaggattctattttaagatacagatccattagctaatgctttcacttgtttcagatcttgcaatgggagggatcgactcggccctttanaaatgagtgatagtacatggctaacgtcagaaattcataaccctctggctgtgggacagtatgtcaacaattgttccaatggtaagaaggcatcatgggg

SEQ ID NO: 38402 - DNA, 201 bp, Homo sapiens
ttctgcttatgctgtacttaaaaaaatatagaagaaaaagctatgtagaatttggggtaaaattttttttttagtgaaaaattataactcagatttttatrttcacaccttaacgtgttaatgtaggcttatttgaaatttaaaattttcctttaaactagctcattctgtttatttttacccatttttattctatggcaa

SEQ ID NO: 38403 - DNA, 201 bp, Homo sapiens
  misc_feature (1)...(201): n = A,T,C or G, or insertion/deletion polymorphism (see Tables 1-2)
tcgcactgaacctaagccacaacccgaggtgagagggcgggacggcagaacgaggggcacctgccttcggttcccagacgccaccacggcggcgggacgcnaagcggagagcctgaggcggactgccggcctgagatgggcgggcccgggtgggcagggactgaggtgggcgggccgggtgggcggggactgaggcctcgg

SEQ ID NO: 38404 - DNA, 201 bp, Homo sapiens
  misc_feature (1)...(201): n = A,T,C or G, or insertion/deletion polymorphism (see Tables 1-2)
caacccgaggtgagagggcgggacggcagaacgaggggcacctgccttcggttcccagacgccaccacggcggcgggacgcgaagcggagagcctgaggcngactgccggcctgagatgggcgggcccgggtgggcagggactgaggtgggcgggccgggtgggcggggactgaggcctcggaggggtttaaggaacgcgg

SEQ ID NO: 38405 - DNA, 201 bp, Homo sapiens
  misc_feature (1)...(201): n = A,T,C or G, or insertion/deletion polymorphism (see Tables 1-2)
atggaaactttttaaaaagactgcccttaccgcgtgagagtgcgtggctttttctccaccaggggttaattaggtgcttgaacttcctcagaaaagccaanccagggtttattttcatagttcatacaagtacttcacgtggttaaagaagcccatcccggctgtgagaatagcgtgcagtagctcgcgcgttaagaacgg

SEQ ID NO: 38406 - DNA, 201 bp, Homo sapiens
aactatttcctcatggaaatcaaatgcataaactaaaatggaaggaacctgagtaaagttacctctataaaagccatcttggttatattaaaaatatgagrttatatttgttaatgctctaccttttgtatatctttttgttttcagcccacttcgatgtgttgttcttgtcgcacttagggacatcaatcaaggagaaga

SEQ ID NO: 38407 - DNA, 201 bp, Homo sapiens
gcacgcacctgtaatcccagctactcaggaggctgaggcaggagaatcgcttgaacccgggaggcagaggttgcagtgagccaaggtcacaccactgcacrccagcctgggtgacagagtgagattccatctcaaaaaaaacaaacaatattttatgatgtccagaaaaaagcatttttttaaaactccaactaattttaa

SEQ ID NO: 38408 - DNA, 201 bp, Homo sapiens
aatttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaacttt

SEQ ID NO: 38409 - DNA, 201 bp, Homo sapiens
atttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaacttta

SEQ ID NO: 38410 - DNA, 201 bp, Homo sapiens
ttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaactttatt

SEQ ID NO: 38411 - DNA, 201 bp, Homo sapiens
  misc_feature (1)...(201): n = A,T,C or G, or insertion/deletion polymorphism (see Tables 1-2)
tagctaaggataaaaatggtatggataggctcacgccggtaatcccagcactttgggaggccgaggcgggcagatcgcgaggggtttgagaccagtctggncaacatagtgaaaccctgtctctactgaaaatacaagaaattagccaggtgtggtggtgtgcacctgtaatcccagctattcaggaggttgaggcaggag

SEQ ID NO: 38412 - DNA, 201 bp, Homo sapiens
ggattacaggcttgagccaccacacccagctcagcatttatgcttcattttattattttttttacttttttttttttttgagacagagtcttgctctgtcrcccaggctggagtgcaacagtgcgatctctgctcactgcaacctctgcctcccgggttcaagtgattttcctgcctcagcctcccaagtagctgggatta

SEQ ID NO: 38413 - DNA, 201 bp, Homo sapiens
ccagctcagcatttatgcttcattttattattttttttacttttttttttttttgagacagagtcttgctctgtcgcccaggctggagtgcaacagtgcgrtctctgctcactgcaacctctgcctcccgggttcaagtgattttcctgcctcagcctcccaagtagctgggattacaggtgtgcaccaccaggcccagat

SEQ ID NO: 38414 - DNA, 201 bp, Homo sapiens
gggcatgatgttattagaactttgaatgtatatatgtaacaatatctaggctgggtgcggtggctcatgcctgtaatcccagcactttgggaggccgaggygggcggatcacaaggtcaggagtttgagaacagcctgaccaacatggtgaaacctcatctctactaaaaatacaaaaattagtcaggcgtggtggcacgc

SEQ ID NO: 38415 - DNA, 201 bp, Homo sapiens
aaatttgtaatgcaattccaagtttaattggttttcacctaaatacacaatagcttattaaattaaaacctactctttgaacttataatttcaatttttcttttgtttattttgtaagctctgtggtggtttataaaattgtagccaggcatcagcagttcttgtagtactgctgatgtgtacaaacttctgtaaaaactt

SEQ ID NO: 38416 - DNA, 201 bp, Homo sapiens
cagagccagacacagaacgatagagcaggaccttttaaactcctttttcaaaaaaaaaaaaaaaatgtttaattttggtaaaatacacataatataaaatmcatcatcttaaccatttcaaaatgttcagttcagtgtacactaagtgtacagktctttagcattgagtacattcacactgctgtgcagccattaccacca

SEQ ID NO: 38417 - DNA, 201 bp, Homo sapiens
agtgacagagtgagaccctgtctcaaaaagcaaataaacaaataaaatcaaaataataatagggaaatgcccttggtccacagactcagctgtcttccagrtgctagtcattggtgaatgaacaacaagagagcctgcactgtcttgtgtgaaggtctaggtattttgggtctttgtcttgataaaatcagaatagacgtg

SEQ ID NO: 38418 - DNA, 201 bp, Homo sapiens
ctacagatgcagctgtatccaagaaagccagcccagaggctgccagcactcccagggaccctattgacgttgacctggtgagatgggtttgaggtctgaasgggtggtggtggggcccagcaggtcaggcaggttgtgagtcctgctgtccctgtgtgtgcagggagagcgtctgagtgagggacagcaagtggctggact

SEQ ID NO: 38419 - DNA, 201 bp, Homo sapiens
tctactgagccctctggtgtgttccctgttttattaacgtggatggagggtgtgtcagggaggttgggacagaggcagagaagaggccagcccggccttcrgggagttcgtggcctgtctggaaagagggtcttttacataccagcagtttgcagagccagacacagaacgatagagcaggaccttttaaactcctttttc

SEQ ID NO: 38420 - DNA, 201 bp, Homo sapiens
tagtagacacaaggttttgccatattggccaggctggtcttgaattcctggcctcaagtgatctgcccgccttggcctcccaaagtgctgggattataggygtgagccactgtgcctggccatactttttaatatactgatagcccttcatttgtttattttattttttatttttattttttgagacagggtctcactctc

SEQ ID NO: 38421 - DNA, 201 bp, Homo sapiens
caataggactgtaaggttcaccactggtctttttactttaacatcacttttcccaagttttgtattttgattgagctcttaattggatagatattatcaawaagcaattttttttttccaagaaggacttttttgttctgaattccttgagtctcttggtgttgagaatgtctttgggttactctgatacttgaataatat

SEQ ID NO: 38422 - DNA, 201 bp, Homo sapiens
ctgtaaggttcaccactggtctttttactttaacatcacttttcccaagttttgtattttgattgagctcttaattggatagatattatcaawaagcaatyttttttttccaagaaggacttttttgttctgaattccttgagtctcttggtgttgagaatgtctttgggttactctgatacttgaataatatctcggctg

SEQ ID NO: 38423 - DNA, 201 bp, Homo sapiens
tgagaaactatggttgtcagatgtatggttagatatagggtcagcagtcctgagggatgtgcagatgtcctctcccctcctacaccctacccccaatgtgkgagccttctcttggagtcagaataggtgggccttcccctgctctttccccacagatggttcttggaaaggaacggggaatggtgccaggagtcagatttc

SEQ ID NO: 38424 - DNA, 201 bp, Homo sapiens
gtcacacagctgaggacaaggagcttctggggccttgcaactctaaatgtggtctgcagatatgcagtgtccgtgttgatgaccacaatttatgctgccaktccccacgcaggtggatagtaagtttccagtttcctcctgtaataaataatgctgcagaatcatctttgcatctttatccagtaacttctttaggataaa

SEQ ID NO: 38425 - DNA, 201 bp, Homo sapiens
acttggggtttggagccaaaagcaagcactctaatgccacctccttttcccttctggctgggttcctgcccactgcattcgagagagctctccttccagcygcccctccagggagttgtccagtgctttgggatgccctggaaaataggtatcctggaaaagcaacagggacctcctctctatcactgtcccaggtcagga

SEQ ID NO: 38426 - DNA, 201 bp, Homo sapiens
tgttatttcgcctttctgaagatacggttaagtctgggttcttgtcacggagcccttctgggcagtttcccacttcacctctgcctcctccaaagtgccargcacgcagcaggtactcagtgagtgtcctctgaatgaaggtaaaggaaccgcttggctaaggtcattcctggccctgggtggcagccctttgattcagga

SEQ ID NO: 38427 - DNA, 201 bp, Homo sapiens
agccctttgattcaggatctgcacctcagtcttaccagagggctgggggcttttagacccaggtgtctgattcaggctagccacctcacagacacttgccrcccatttccatctagagggaaagcaggggccagtcaccctagggagaccccattcaggacaaaagaagcttagaaaaaggacccagcggaggctatggcc

SEQ ID NO: 38428 - DNA, 201 bp, Homo sapiens
ttgattcaggatctgcacctcagtcttaccagagggctgggggcttttagacccaggtgtctgattcaggctagccacctcacagacacttgccrcccatytccatctagagggaaagcaggggccagtcaccctagggagaccccattcaggacaaaagaagcttagaaaaaggacccagcggaggctatggccatccag

SEQ ID NO: 38429 - DNA, 201 bp, Homo sapiens
ggatctgcacctcagtcttaccagagggctgggggcttttagacccaggtgtctgattcaggctagccacctcacagacacttgccrcccatytccatctrgagggaaagcaggggccagtcaccctagggagaccccattcaggacaaaagaagcttagaaaaaggacccagcggaggctatggccatccagaacgtctt

SEQ ID NO: 38430 - DNA, 201 bp, Homo sapiens
atccagccaggctgcctgaggcgtgcccttccaggcttggaaccctgtctccaaggaaggggatccaacatcagacacagcccctctccccaagtgtccargatccaaagggggaaaataacaactgtttcttattctcttccctttattcctataccctatagaattgcccacatttattagtattctgttttttaattt

SEQ ID NO: 38431 - DNA, 201 bp, Homo sapiens
cctttctcagtcccccctcgtagggtgcgacggcaccgggccggccgactcctcggaggcagagattcgggcctgggggttgccggccggtcccccccggstccgccgtgccaggcggccactcaccggcccctgtccccacgccgccccgctccggggacaagcagcccttctgcgagcccagaaagccgaagctcgact

SEQ ID NO: 38432 - DNA, 201 bp, Homo sapiens
gttcaaacaatcctcccacctcagccaccagattatacaggactgcaggtgtgcaccaccacactcagctaatttttaaattttttgtagagacagggttkcacgacattgcccagactggtcttgagaactcttgggctcaggcagcaaccctccctaggcctctcaaagtgctgggattacaggtgtgagccactgtac

SEQ ID NO: 38433 - DNA, 201 bp, Homo sapiens
gcccggcccctagcagagctgcgcaaccagtcggtgcgtgagttcctggacggcacccgcaagaccaacaacatcttctgctccaaccccaaccaccgcamccctacgctgaccaggtgagtaggccggcacagggtggggtggtgcatccaagtaccaggtagagggcgagaggagcaaagatccaaagagtcacacagc

SEQ ID NO: 38434 - DNA, 201 bp, Homo sapiens
aggcgcttcttggttcttagagatccacttgcaaaatgaaagcatttttcgctggtttttgacaactcagaactatatatggctaaaccacatatttgctraactacatatctgctaaactgactgtgatttgtttcctgctttaggataaacttcccacactatcagaataagctttcccctccgactcctcaacagctg

SEQ ID NO: 38435 - DNA, 201 bp, Homo sapiens
gttgcggttttcctttcgatttagttctaggaagtcagagggaatcggccttaggttccctgcctccagaccctattctcctgcctcagaatcatacagtrtttgaccttttgtgactggcttatttcacttagcataatgtcattgaggtctatctatgttgtagcatgtatcagaatttcatttctttctaacgctgag

SEQ ID NO: 38436 - DNA, 201 bp, Homo sapiens
aaataaaaataaataaataaaataaaatacactactcaggaggctgaggtgagaagatcacatgagcccaagaattcaagtccagcctgggcaacatagcaagaccctgtctctgaaaaaaaaattaacagtgtggctatttcactgaataatcataaagggataaatgaaacaatacatcccagagacgagaaagagctt

SEQ ID NO: 38437 - DNA, 201 bp, Homo sapiens
atcatggccaatggtgtggagcccatgagaaggacccaccgcggggttctggtacctggcacacccaggagccagcactgtgctggggccatccctgcctyaactcacatgcccagcagcctctgtcgggagcctccttgcccagccccagcttgcctgggtggttctcagaaggcccacacaggagggacagagcttgtc

SEQ ID NO: 38438 - DNA, 201 bp, Homo sapiens
gacttgatccttagagaaacttttcatctctgtggtctgaagttagacatgactcataccaggaaactgtctgtccttggattagttaggagaaaaggctsggctgccctaacagcacccccggggaaagggctttgtcaactttaggtccctggacctcctagagaagtagtgatgtccaaattgagaaatgaaggccca

SEQ ID NO: 38439 - DNA, 201 bp, Homo sapiens
caactatatgcctggaagagatgaagagaaagctcaacaggcttcactaggattgtttgggtggggtggcagcagctcagatattttccctcctctgtttytcataggctttttgtaatcgtgttataatactttaatggaaaaaaataaatttattattttaaagctataaaaattataaatcagtcattatgatgtgtt

SEQ ID NO: 38440 - DNA, 201 bp, Homo sapiens
ccactggtctttttactttaacatcacttttcccaagttttgtattttgattgagctcttaattggatagatattatcaawaagcaatyttttttttccargaaggacttttttgttctgaattccttgagtctcttggtgttgagaatgtctttgggttactctgatacttgaataatatctcggctgggtataatattc

SEQ ID NO: 38441 - DNA, 201 bp, Homo sapiens
tccctcctgaaggcctgagttccaccaggaaagtgagctggcactggggtgggaatccaggccttcatcagatcagctctttgtgggaaagtgtttgctcracgccttctctgtgctctcccctgttcttggctgcatggtcagggagcttcccataagcatggcccactcccagcccagcaggggtgctgagacactcag

SEQ ID NO: 38442 - DNA, 201 bp, Homo sapiens
atacatgttaccaaactgccctttagaatttagtggaattttccgagagcactgacacggaatctcagtaaggctggattctaggatcagagacaagtagktagtttctgtctgaaaagttgaaaccattaacaccaggcagcgctatctgagaatgtctgtatggggaaaaaaaatcacatccagttgtaattattttta

SEQ ID NO: 38443 - DNA, 201 bp, Homo sapiens
ggcagtctcaccaccccacctggatggaccgcctagccccaggagccccgtcataggaagtgaggtcttcctgcccaacagcaaccacgtggccagtggcrccggggaggcaggtagggaggtgggtagggcagtggcctgggtgctgcccgccagggtctgggcggtgcccctcttctgtattttggccccatccagaaa

SEQ ID NO: 38444 - DNA, 201 bp, Homo sapiens
ggtatgcagtgaatgtcttactctaccctcattccacccatcccatagccacttttattaatttgcatgtccttttaatatttatttattcaaatacaatmaactatgaagatattcttatttttccccattcttacacaaaaggtagcatctgatacacacatttctgcaccttgatttctaacttaaaatatatatcat

SEQ ID NO: 38445 - DNA, 201 bp, Homo sapiens
tgacctggtgagatgggtttgaggtctgaasgggtggtggtggggcccagcaggtcaggcaggttgtgagtcctgctgtccctgtgtgtgcagggagagcrtctgagtgagggacagcaagtggctggactggaaatttcagtgagaggaagtaaaggaagacattaaagaagggttggctggctagctggctctgactct

SEQ ID NO: 38446 - DNA, 201 bp, Homo sapiens
gttcctctgtcaaggcagctgagaagcccctcaccttgcagggagggacgttgaaggctcgtgtcctcagatccaccctctgaaaggagtcaatgaagggyaagagcagaaccatgccaggtccctggggggtgcggatccggcccaggcggaacacaatcatccgctcgtaggtgggcacaatctgtccacaatggcaag

SEQ ID NO: 38447 - DNA, 201 bp, Homo sapiens
ggccttgcaactctaaatgtggtctgcagatatgcagtgtccgtgttgatgaccacaatttatgctgccaktccccacgcaggtggatagtaagtttccartttcctcctgtaataaataatgctgcagaatcatctttgcatctttatccagtaacttctttaggataaatttttagaagtgccactgctgggtgtaggg

SEQ ID NO: 38448 - DNA, 201 bp, Homo sapiens
atttgatacatgttaccaaactgccctttagaatttagtggaattttccgagagcactgacacggaatctcagtaaggctggattctaggatcagagacargtagktagtttctgtctgaaaagttgaaaccattaacaccaggcagcgctatctgagaatgtctgtatggggaaaaaaaatcacatccagttgtaattat

SEQ ID NO: 38449 - DNA, 201 bp, Homo sapiens
tcttgttttttcaatggtgagatagcaggaaactgatctggtaaaatgcattcatactactgtataaatgattgatggatccttttaactgtagttacttraatttccaaaagagctctcttttaccactctaccaaagtgaaagtgccaagttgctgcatggaaatgggacaggtagaggagagtttttggtcaccattc

SEQ ID NO: 38450 - DNA, 201 bp, Homo sapiens
agctcccggcaggacgtggcacgaagcagtgccagtgtgaacggatgaatggatcaaagccgggagcagggctgcccccctgcagctctgccctacctctyccgctttaccgtaagtcagcggtaggtctgcagctctccgcctctacctcctccccgctctgggcgtgtctttaaaacccacagtcggcctctctgcccc

SEQ ID NO: 38451 - DNA, 201 bp, Homo sapiens
tgtaaaggttgagtggctttccacttgtttattggccattgtgtttctgcatttgcgagtggcctgtttaggtcctttgcctgttgttgttgttgtttcckttgaggaattaagggactaattaaagaattcaggaacaaattcctcgaaagaaaaaaatgtatgcatttcttttgctcttacaatttatgcagttttaaa

SEQ ID NO: 38452 - DNA, 201 bp, Homo sapiens
cggctcactgcaacctcctcctcccgggttcaagtgtttctcctgcctcagcctcctgagtagctgggattacaggcgtgtgccaccatgcccggctaagttttttttttttttttgtatttttagtagagaaggggtttcattatgttggccaggatggtcttgatctcctgaccttgtgatccacccgcctcagcctcc

SEQ ID NO: 38453 - DNA, 201 bp, Homo sapiens
ccctctaagattaagagaaaaaaaccccaagacattaagaggttggagccattttgttttttgaaacagagtctcgctctgttgcccaggctggagtgcartggcgcaatcttggctcactgcaacctccgcctcccgggttcaagcaattctcctgcctcagcatcccgagtagctgggattacaagtgcctgccaccac

SEQ ID NO: 38454 - DNA, 201 bp, Homo sapiens; identical to SEQ ID NO: 10245

SEQ ID NO: 38455 - DNA, 201 bp, Homo sapiens; identical to SEQ ID NO: 10235

SEQ ID NO: 38456 - DNA, 201 bp, Homo sapiens; identical to SEQ ID NO: 10239

SEQ ID NO: 38457 - DNA, 201 bp, Homo sapiens
ctgagaggggaaggctaaggcatggctgagattcaagccaccattccaggcctctttgcccaagaaagaaacttctgtcacccttgcactctcctgtrttytgagtccctggccaatagcacagccttccatgccccgacccccaccccaagcctctccactaggcctctgccaggatctaagcccatgagcacagggact

SEQ ID NO: 38458 - DNA, 201 bp, Homo sapiens
ccagctcatggagctgagaatggggacagtgtgcttctttaggattgcagaaggttccagaccaggtagcagttgtcaggcctcctgtacagggggcaaaytctgaattctgggcagataacttaattgaatattcatagataaggcacagcaagaaattatggaaacccatttgtgaattactcaaatccaaatgcaaag

SEQ ID NO: 38459 - DNA, 201 bp, Homo sapiens
gaaattatggaaacccatttgtgaattactcaaatccaaatgcaaagcagagtcacattggcacacacagtggctgttcccgtccccctgcagggcatccrtttcccccagccgactggcctgcaaggattcccataggtgcacacccacacccctcccagcatgcatcctaggcagttcataatgcatctccccttcccc

SEQ ID NO: 38460 - DNA, 201 bp, Homo sapiens
ccaaggtgatcccggctcccacctaacccatcctccccagctctgcagcttatatccagctttgcagtgaggaaagttgcagaatactggtctgctacattactactttccaagtgtatcagggcatttaggaacccctcccttgagcttcacctgtgtcctagggattcagtgagagactgtttgtgcaagaaggagcga

SEQ ID NO: 38461 - DNA, 201 bp, Homo sapiens
aattcctactccccagcttggagggggtggggtgatattcccaaggtgatcccggctcccacctaacccatcctccccagctctgcagcttatatccagcyttgcagtgaggaaagttgcagaatactggtctgctacattactactttccaagtgtatcagggcatttaggaacccctcccttgagcttcacctgtgtcc

SEQ ID NO: 38462 - DNA, 201 bp, Homo sapiens
aggcctagagacgtggggagagagccagaggaccgctgcttttgtgtatgtagctttaagacacaggttttaaaaattgttataggagtcccaaactttagaaaatatatattttaaaaccccaacaaattaggtcccccctatgcatttctcacccaacttctgggccctttccagacccctggtgcccccagagtacac

SEQ ID NO: 38463 - DNA, 201 bp, Homo sapiens; identical to SEQ ID NO: 38453

SEQ ID NO: 38464 - DNA, 201 bp, Homo sapiens
agaagataaagaaactaaagtgaaattagacttgctgaacttcaaagaaataattcttcatcttaaaatattttcctaaaaggtccctctaagattaagagaaaaaaaccccaagacattaagaggttggagccattttgttttttgaaacagagtctcgctctgttgcccaggctggagtgcartggcgcaatcttggct

SEQ ID NO: 38465 - DNA, 201 bp, Homo sapiens
ctcaaggagataagcaataattgaggcaagaacagaggcagtagcagtgggaactgctgggacaggtttaggagccagcattctgccttaatcatctttayacccttgccgcatgcctagacctagttggtacttagtaattttgggggggtttttttgagatagagtctcgctctgcctcccaggcagtagcgcagtggc

SEQ ID NO: 38466 - DNA, 201 bp, Homo sapiens
ttgcccaagaaagaaacttctgtcacccttgcactctcctgtrttytgagtccctggccaatagcacagccttccatgccccgacccccaccccaagcctytccactaggcctctgccaggatctaagcccatgagcacagggactggctatcccaagacctggcagatgtggctgctcaataaacacttgttgaaccatc

SEQ ID NO: 38467 - DNA, 201 bp, Homo sapiens
aaacttctgtcacccttgcactctcctgtrttytgagtccctggccaatagcacagccttccatgccccgacccccaccccaagcctytccactaggcctytgccaggatctaagcccatgagcacagggactggctatcccaagacctggcagatgtggctgctcaataaacacttgttgaaccatcacccttgcgaacc

SEQ ID NO: 38468 - DNA, 201 bp, Homo sapiens; identical to SEQ ID NO: 10247

SEQ ID NO: 38469 - DNA, 201 bp, Homo sapiens; identical to SEQ ID NO: 10250

SEQ ID NO: 38470 - DNA, 201 bp, Homo sapiens
aatcatctttayacccttgccgcatgcctagacctagttggtacttagtaattttgggggggtttttttgagatagagtctcgctctgcctcccaggcagkagcgcagtggcgtgatctcagctcactgcaacctctgcctcctgggttcaagtgattctcttaccctcagcctcccaagtagctgggattacaggtgccc

SEQ ID NO: 38471 - DNA, 201 bp, Homo sapiens
gagccagcattctgccttaatcatctttayacccttgccgcatgcctagacctagttggtacttagtaattttgggggggtttttttgagatagagtctcsctctgcctcccaggcagkagcgcagtggcgtgatctcagctcactgcaacctctgcctcctgggttcaagtgattctcttaccctcagcctcccaagtag

SEQ ID NO: 38472 - DNA, 201 bp, Homo sapiens
gttccagccccttcctggccgtctggtaagatcctctgtccctctcagggtgggccccatgctccccagctcatcccagacacccacctgcccaccctcaytgagggcagacgtgagcattcacctcccagatttcttctccctgctcaggtcctgccttcctcctgagtgacttctatttccacccacctgcccgccact

SEQ ID NO: 38473 - DNA, 201 bp, Homo sapiens
cctggggtgaggactttgcttaaaaactgccagagtgggtcagcagtgcgcctgccctggggcccctgctttaggatccaaagtggaaaagataggtgttytcacccactcttgtgacagattactggctccggtgccttggtggcagcagcaacaggagggggccaaggtgagggggcagcctgtggcagaagtggcagt

SEQ ID NO: 38474 - DNA, 201 bp, Homo sapiens
catctgagaaaatgaaacggaggtgctggccaagaggctggagctaggcagaagggcagcagaggccacaggctggccgagtttatggtccagttcactcmtaacatgtgcagtattcctggggtctttgaggctttgcaagagctggggttttgtgtctgcagaaagatagcaatgcatgtgtcttgccaaactgatccc

SEQ ID NO: 38475 - DNA, 201 bp, Homo sapiens
atgaatcagtgataaggacaattgttctcaagctggctgtacactggggagttttcccaactacagattcctaggtcctacgccctgagattctaatcgartcagtcttgggtgcagcctgggcctcagttttttcttaaagctatgaatgcctaaccaaagtcaagaaccactgaatcgggggattcattgcatgtctgt

SEQ ID NO: 38476 - DNA, 201 bp, Homo sapiens
ggtctgctacattactactttccaagtgtatcagggcatttaggaacccctcccttgagcttcacctgtgtcctagggattcagtgagagactgtttgtgyaagaaggagcgagaggcagcagggcatagtcatggggtggagcagtgagtcccccaggcctggttgtggagtacctggggtgaggactttgcttaaaaac

SEQ ID NO: 38477 - DNA, 201 bp, Homo sapiens
  misc_feature (1)...(201): n = A,T,C or G, or insertion/deletion polymorphism (see Tables 1-2)
gtgataagggggctgacgtgggagatgcgtcaaccccgataatggaggacagccccacccacacggctgacccgggctggccagccccactgaggcagganggcccctcccacaggcctctggagcctgagtctggggtctgccctctcctgttgagctcagacaggtccaggaacaaatcctggctcagccactccctgc

SEQ ID NO: 38478 - DNA, 201 bp, Homo sapiens
atccacaaactgttcctggttcaggcccagctcctgcagaatccggctcaggtggaattcctggattggcagctttttggcttcactggcagtcaggtgtygcattagcacagggctgccgaaggtgaggcagtccatgtcctcggtagccgcagcatagactttgccagccttcaccagggcagcacagctggcctctgc

SEQ ID NO: 38479 - DNA, 201 bp, Homo sapiens
ctgaggccccagagccgggcctggaacatcggttcctcctacctgctgggttccaaaaccatttcccacaccacacccctgcatcctcaaaccaccaatgyggctgcccccactcctgagaaatggaaactgagtcccggagaggattctagtacagggctgcaaactcctcagacaacattctctcctataccccatgcc

SEQ ID NO: 38480 - DNA, 201 bp, Homo sapiens
ttctagtacagggctgcaaactcctcagacaacattctctcctataccccatgccttaggccaccgccccgccctggtgatgggggaagcagggccagacyctgaggcccaccagactggagggaactcctgagtgggggagggcttgactgccctccccacactcggctccttcccagaaggctgcctgaagccccctca

SEQ ID NO: 38481 - DNA, 201 bp, Homo sapiens
cctcatgagctgtgtgacctggggcaagtgacctaactcctctgggtctcattttcttcatggcagtggagcaccagagtccaaggcatctcttaggcccytctgcctggctgctctgagccagataggcctcccagaaggcattgagccaatgcttttctcctcagattgccgtgggctgggctctctgcactccacagt

SEQ ID NO: 38482 - DNA, 201 bp, Homo sapiens
gtgacctggggcaagtgacctaactcctctgggtctcattttcttcatggcagtggagcaccagagtccaaggcatctcttaggcccctctgcctggctgytctgagccagataggcctcccagaaggcattgagccaatgcttttctcctcagattgccgtgggctgggctctctgcactccacagtccaccccttcgct

SEQ ID NO: 38483 - DNA, 201 bp, Homo sapiens
cctgctccctctacacccgaaatcgcaggactacaagtccctcaatgccacttgcgccggaggcacttccttttccggttgtgctaggcgcctgctcctgycgacgtgttcttccggtggcggagcggcggattagccttcgcggggcaaaatggtgagagcgttgaggggagttccagacggagatgcgaggacccctcg

SEQ ID NO: 38484 - DNA, 201 bp, Homo sapiens
accccagtgacttggagaggctgctgggaagtcagctggctgaaagggggtcaagatccagggcttaaaacttgctgcagacaatccaccaaacaggccastaggaatcagctctggtggctcatcctcagaggtgtgtgctcaatagcccttgccccaggagcacaggggtgcagggagagaaggaggaaagaagggcca

SEQ ID NO: 38485 - DNA, 201 bp, Homo sapiens
ttactgttgctggaagtgtcccacctgctgctcataataaatgcagatgtatagcagtcctgtctggggcccattctgcaggggtggtgggtgctgggacmtacattgcttccccaatctcttccctttcccatttctcatctgcctttcacagttcctgctgctgatctacttaagggggatgagatttgtgtagcaccg

SEQ ID NO: 38486 - DNA, 201 bp, Homo sapiens
tcgtgtatcctttcactgagcagccagaggaccagcattagtgatgtgggaagctcagggagaaaccacgctaggtacatggaccccgccggttttgtacrttggattggggctgagagaaggtaaggaggagaggagggctagtgatgcccaggggcaggttatagccttatttcccaagttcaggtgagctcagtttgt

SEQ ID NO: 38487 - DNA, 201 bp, Homo sapiens
gcgctctatgcacacgcaggcttctaagggtgcacggtatgggcaggaggatttgcactgggaggccctatgtacagcttgaagctagggggagattagcscagtgactacaggaacaaacgccaaaggagagagaagaagggagggatgacctgctggaccccagggcagggacagggccaagacactcacaccattgcc

SEQ ID NO: 38488 - DNA, 201 bp, Homo sapiens
gtatgggcaggaggatttgcactgggaggccctatgtacagcttgaagctagggggagattagcccagtgactacaggaacaaacgccaaaggagagagawgaagggagggatgacctgctggaccccagggcagggacagggccaagacactcacaccattgccagccgggcagctggcagcttccagcaggtggcccac

SEQ ID NO: 38489 - DNA, 201 bp, Homo sapiens
caggaggatttgcactgggaggccctatgtacagcttgaagctagggggagattagcccagtgactacaggaacaaacgccaaaggagagagaagaagggwgggatgacctgctggaccccagggcagggacagggccaagacactcacaccattgccagccgggcagctggcagcttccagcaggtggcccacttacctt

SEQ ID NO: 38490 - DNA, 201 bp, Homo sapiens
  misc_feature (1)...(201): n = A,T,C or G, or insertion/deletion polymorphism (see Tables 1-2)
cccacaagactgagtgaaccccatgtgtctcttggtcctctcaggggaacttcccagtcattgtccagagcctcgttctaggctccaggagaccctcccancaatgagtatttgggcctttctctctacgcaggtagcccccgccccaagccccagcccacagaaagccttacctgagcggttggtgctggggctgggact

SEQ ID NO: 38491 - DNA, 201 bp, Homo sapiens
ggtgagggcactcccctgaggccccagagccgggcctggaacatcggttcctcctacctgctgggttccaaaaccatttcccacaccacacccctgcatcytcaaaccaccaatgcggctgcccccactcctgagaaatggaaactgagtcccggagaggattctagtacagggctgcaaactcctcagacaacattctct

SEQ ID NO: 38492 - DNA, 201 bp, Homo sapiens
acgcgtgcccctccctgggacacagaggcccaggccccagagtgtcccttgtggagaaggctttactctataactcccagcttctgctccttgcccatttkggggcccagttgtgccaggagagaagcagctcgggcctggccggcccgcagcttcccagtcccacctacctgggtgtcctggtgggtgtggagactctgt

SEQ ID NO: 38493 - DNA, 201 bp, Homo sapiens
aagaggaaaagtgcaaatgcaaagagggccaggctgaggctgtccccagtgggctctgctggaggtcggaggagcggttaagggggtgccccatttccccrggggcaaagggagaagaaagagaaacggggctgggagggctacagagtcacaaggagagggaagcaccagaggcagtgaggctggagaactgcaagccag

SEQ ID NO: 38494 - DNA, 201 bp, Homo sapiens
cctcctcaaaagaactggaacacccagaagtagggatgggtcttcacatcccctgccaggtgtgcaggagcccgctcgaggcctgtgttcctgactgcgggcatctctcccagttctgggttcagaaacatcagttacactggtagcttgaaatcagcagtgttgacagcatcacacaaatcaggctcccctctgccccga

SEQ ID NO: 38495 - DNA, 201 bp, Homo sapiens
tccactcctagccccaatatgaagctaagaggataaggggtatgaagcatccatttggccctctggttcaggcgctcagagattccaggcttctcaggaaraactttgaattccaattggccctagccttataggtgactcctctcccaccagaccaatcccaagaagagacaaggaggcaagctcagatacaaagcagta

SEQ ID NO: 38496 - DNA, 201 bp, Homo sapiens
gaggcagaaaggcccacctcaccgagacctcagctgcctgatctcccaagctacatcctcctcttcccccaggcctgagcccatgggcagctgactccacygggcagctccactcccctagtcagccaccatgagagcccaggggacaagtcacctgaaggccatgaccaccaccagggcaatgatggttccctgcaggaa

SEQ ID NO: 38497 - DNA, 201 bp, Homo sapiens
  misc_feature (1)...(201): n = A,T,C or G, or insertion/deletion polymorphism (see Tables 1-2)
agggctacagagtcacaaggagagggaagcaccagaggcagtgaggctggagaactgcaagccagaaagggaggccacaagggaggccccctttccaaccngcctgccatccctgctcacccctaccttgctggccaccttggggggcctcttcttgtgggggacgctgcccgcccgactgaactggctccctgcatggct

SEQ ID NO: 38498 - DNA, 201 bp, Homo sapiens
  misc_feature (1)...(201): n = A,T,C or G, or insertion/deletion polymorphism (see Tables 1-2)
tgggaggccctatgtacagcttgaagctagggggagattagcccagtgactacaggaacaaacgccaaaggagagagaagaagggagggatgacctgctgnaccccagggcagggacagggccaagacactcacaccattgccagccgggcagctggcagcttccagcaggtggcccacttaccttccctgaagccctttt

SEQ ID NO: 38499 - DNA, 201 bp, Homo sapiens
caaggtgcggacagcagaacctggggccgagctggtgaggctggtggtcactgaggaggccagaggctgtatgagccagagaagccccaaagacagaacayagcaacctccctgtcctacccagacctgcccagacacgcacccagcagcaaagagggctgtatgcctggtagccccgtggtcaagggggactgtcggagc

SEQ ID NO: 38500 - DNA, 201 bp, Homo sapiens
  misc_feature (1)...(201): n = A,T,C or G, or insertion/deletion polymorphism (see Tables 1-2)
ctggtccggaaccacggacgatgactgaggaccaagaggaaaagtgcaaatgcaaagagggccaggctgaggctgtccccagtgggctctgctggaggtcngaggagcggttaagggggtgccccatttccccgggggcaaagggagaagaaagagaaacggggctgggagggctacagagtcacaaggagagggaagcac

SEQ ID NO: 38501 - DNA, 201 bp, Homo sapiens
  misc_feature (1)...(201): n = A,T,C or G, or insertion/deletion polymorphism (see Tables 1-2)
ggcccagtcagccccgggagccccaggctgccagacatcagggggcaggaggggcggccactgtccttggccactgggaggccctcaaagtctccctaccngggcgggcccctccaatccagcctcggctcccacagctcctgtgcctgtctccgagcaacacctccacctctgcaccttcacctgggctgtcccacctgc

SEQ ID NO: 38502 - DNA, 201 bp, Homo sapiens
  misc_feature (1)...(201): n = A,T,C or G, or insertion/deletion polymorphism (see Tables 1-2)
cttcccatccttaagtcaatgaagggctctaaatctcaggtctctcatctgtgaaatggctcagcctgtaggactctgtgcctggtgtgccacccagggcngtgtcttcctgcctcagaaatggaggggctccggggcagggcccccacctgctcacctctggtccgggttgggcttgcccttcttacgcatgttgttagc

SEQ ID NO: 38503 - DNA, 201 bp, Homo sapiens
gcgaggaccggaccaggtagagggatcttccagggcaatagcaaggccagatgcatgatgaggttggggaaagagggccctgacccagatttgcggctcakgtaaccaaggccctgcgccccattccctgagaggggagcccagggtgggaggcaagtgtgcagggagtttagtttgggacctggagctgaggcacctggt

SEQ ID NO: 38504 - DNA, 201 bp, Homo sapiens
tccctccctctagggagggggctgccgggagggcccagcttgggctcagcttccggctaccttcctggaatgcagagggaggaggtggggaaggaggaacygggggaaaaaacacccatctgcccacttctccctgacttggttcccagctgcccctccctggcagtcatcaccttctcagggaggcctggggctggccta

SEQ ID NO: 38505 - DNA, 201 bp, Homo sapiens
atgatgtctattcatctttgtattctcagtgccaaacagagggcccgtaattggaagctcaataaatggcagtgattgtctttatcattttgggggaaggrggccgtgattgtttactgaattgaattccagtgtctcagaacaatgggggcagtttacttctctagagttgttatgttctggattttagaagcattggct

SEQ ID NO: 38506 - DNA, 201 bp, Homo sapiens
cgggttgaagggccgcttgctccggtctgactgggactgctcgatgttaatggactggttcagggcctccagctgtggggagtgaagccagtggcacctcrggatggggctacccggctggtcctgccctcctgccccctctcagccaggcctggcccaactagagctcaccaggaaacagggcagcacccagccctcagc

SEQ ID NO: 38507 - DNA, 201 bp, Homo sapiens
cctaccctaggtgggagggccgttggtcagccacctactagaggcctgggcagggaggcacaaacctgcccaaggaggggcagcctttcacctcatcctayccacctcctgcccccaggctggaccaggagaatccaacccaaatctaaaggtccccctccgtccccatctcctctgaggcctgctcctcctctgggcctc

SEQ ID NO: 38508 - DNA, 201 bp, Homo sapiens
ttgggcccaataccccggatactctcacagtagtcactgcctagcaggatgcacagatccacaaactgttcctggttcaggcccagctcctgcagaatccrgctcaggtggaattcctggattggcagctttttggcttcactggcagtcaggtgtcgcattagcacagggctgccgaaggtgaggcagtccatgtcctcg

SEQ ID NO: 38509 - DNA, 201 bp, Homo sapiens
cattccctgagaggggagcccagggtgggaggcaagtgtgcagggagtttagtttgggacctggagctgaggcacctggtagagggcccaggagatgggtyttgactggggttgcagacttgggaatcacaggctggagcaggaaacggggcgagagggaggcagggaggcaaggaggcacagagtcagggtaaggtgccc

SEQ ID NO: 38510 - DNA, 201 bp, Homo sapiens
gaactggctccctgcatggctgcagcaagagggccaggatcaggggtgtccctgggaagaagggtctcaccttcccccaccccgcacccctacctgaaggygcccgagctgccggtggacttgaggctgtcgagccgccgcagcttggccagcttgtggctccagcgctccagctcatcaatgcgcgtctccaggttgtct

SEQ ID NO: 38511 - DNA, 201 bp, Homo sapiens
tggctgctctgagccagataggcctcccagaaggcattgagccaatgcttttctcctcagattgccgtgggctgggctctctgcactccacagtccacccyttcgctttgccttaactgctgtgcccagttacgaggtcacctctaccaagtacactcgtgatatctataaagagctcctcatctccttagtggcctcact

SEQ ID NO: 38512 - DNA, 201 bp, Homo sapiens
cctcaagccccacgtcgcagacaggggtgcccagacctccagggtaggtgggatgcccctgctcaccagcagtgccacccggaagtggtaggtgaattcayggaaggacaggatggttattggccaccggtgagaggtgccctggagagaagggagagaggggtcaggacagactgctgcccttatcccaaccagcatctc

SEQ ID NO: 38513 - DNA, 201 bp, Homo sapiens
  misc_feature (1)...(201): n = A,T,C or G, or insertion/deletion polymorphism (see Tables 1-2)
gccacttgcgccggaggcacttccttttccggttgtgctaggcgcctgctcctgccgacgtgttcttccggtggcggagcggcggattagccttcgcgggncaaaatggtgagagcgttgaggggagttccagacggagatgcgaggacccctcggggtctgacccacaccgcgcttatctcctcagacgccggagatcca

SEQ ID NO: 38514 - DNA, 201 bp, Homo sapiens
ccaccccgtcctgagccaagcccgggggctgccccccacctaccctaggtgggagggccgttggtcagccacctactagaggcctgggcagggaggcacamacctgcccaaggaggggcagcctttcacctcatcctagccacctcctgcccccaggctggaccaggagaatccaacccaaatctaaaggtccccctccgt

SEQ ID NO: 38515 - DNA, 201 bp, Homo sapiens
tttttggtaagataaacagaactcttgaccccaatccggactgcggggagcctgctcccgcggtggttctgctcttggccacctgggggccagggcacccmtgagcaccctctaaggtgaggtgggcccggcctgggaagcctgcacccaggctgcacccacggccttccccagccacccacttaccgccgaagggtgcgt

SEQ ID NO: 38516 - DNA, 201 bp, Homo sapiens
aaaatgttttgacagcagaaccttcctttgaactaaacctttcatggaatctccacatgtaaaacagatgaaaagacaatcgtgcaggttgagtcagagtsgggggcttgggtctaggaagaagactcctcagaaacctgagggttccatgagacagctgcaaaatcactggggtctgggtaagagcacagccccgggccc

SEQ ID NO: 38517 - DNA, 201 bp, Homo sapiens
  misc_feature (1)...(201): n = A,T,C or G, or insertion/deletion polymorphism (see Tables 1-2)
ccttccagctgggcagcttctctgcgtggtagggtcccacagccccccagaagctggcgacactgaggtttcgtcacatccacccttaggggcatttctcngcaccacccacattggggtgcctggcagggcctggggccgaattgtgggtaggggaccgcccaggatcccctcagacctacagggcacttggggggcagt

SEQ ID NO: 38518 - DNA, 201 bp, Homo sapiens
aagagataggaaggagcatgttctgctttggcagaaggagcaatggcagctactccatgcagaccgtgcccgggactggcaggtccacagccacctccacstggcccctgcctccttcccagtcctgttgtgctgggttccctcacccactatgctctgggcacatcaaagtatttcattagccccatcctcagtacaatc

SEQ ID NO: 38519 - DNA, 201 bp, Homo sapiens
gggaccgcccaggatcccctcagacctacagggcacttggggggcagttactagtgtccttgatgatggcacagggactcaaagactcccgccccagaccraaggccaggacttcttctctcttcctgcacccactgaagccccacagcttcctggaaacacagggccctagggggctgggcctcagggcattcagcaggt

SEQ ID NO: 38520 - DNA, 201 bp, Homo sapiens
gataggaaggagcatgttctgctttggcagaaggagcaatggcagctactccatgcagaccgtgcccgggactggcaggtccacagccacctccacctggsccctgcctccttcccagtcctgttgtgctgggttccctcacccactatgctctgggcacatcaaagtatttcattagccccatcctcagtacaatccagt

SEQ ID NO: 38521 - DNA, 201 bp, Homo sapiens
  misc_feature (1)...(201): n = A,T,C or G, or insertion/deletion polymorphism (see Tables 1-2)
cccatctacctgaggctttggctgtgcgtctgtgatgtggtttcaggcccgagcaccatgtctgctgtgtgtctagctgggctctccctctgtcttggacnctgtctcttctgcagggcgacagggctcgggcctccctcagaagcacccccacctctgttgcaggtgctttctgcacgtcttttctccctcactatagag

SEQ ID NO: 38522 - DNA, 201 bp, Homo sapiens
  misc_feature (1)...(201): n = A,T,C or G, or insertion/deletion polymorphism (see Tables 1-2)
tgagccatgggccagctcctgtggccacagtacacgtcagctggatgcgtaagtgggtgggcttggcgcgcgtgcacgggtatgcaggtgttcccatgaangtaaacagtcacagcctccagtcccgccgcttcctgtccactctccacacagcatcgagatttttctagcacttacgtcagccctcatcactcccatgct

SEQ ID NO: 38523 - DNA, 201 bp, Homo sapiens
ccaaacttgtgggaagaggcctctgggcctggccagtgttgccaaaggcctgggctcaccacctcttccctcctggagctccacccacctgcctgacctakcaaagcacccaggaagtgcctgggccacttccggggctgcagctgccaagcttcctggccttggggcctggggtggcaagggtggcccaaagagtatggc

SEQ ID NO: 38524 - DNA, 201 bp, Homo sapiens
taggctccaggagaccctcccatcaatgagtatttgggcctttctctctacgcaggtagcccccgccccaagccccagcccacagaaagccttacctgagyggttggtgctggggctgggacttgggctgagaacatggccagggttaaagctggggccaagactaggaccagtggtagggttggtagtgggtgaggaaca

SEQ ID NO: 38525 - DNA, 201 bp, Homo sapiens
accgggggaaaaaacacccatctgcccacttctccctgacttggttcccagctgcccctccctggcagtcatcaccttctcagggaggcctggggctggcmtaggagtcaggagccctgactgccagtcctggctcttccctgagcctgtttgctcttctgtgaaatgagtgctcccaggccctgctccaggaccttgatg

SEQ ID NO: 38526 - DNA, 201 bp, Homo sapiens
  misc_feature (1)...(201): n = A,T,C or G, or insertion/deletion polymorphism (see Tables 1-2)
tgatggggtcctgggctggggcgtcccaaggtgggggggcctggaggagtggggagtgttgtagggcactcacagctccttgtagttagcatcgtacaggntcgcccacttgttctgctgatgaggctgccacttgatggactggtagttggggtccaggtaggagccactgaggctgtcactgtcctgcaggaggcctgg

SEQ ID NO: 38527 - DNA, 201 bp, Homo sapiens
gccgagggtgctcctgcctctgctttgcagtgcccccagtatctatggaggtgatgagtgttccccagctggctccccacttgcctctgggctccctcccwttcccccacccacagaccttgttcaccaccaggaagttctctatggttttcccattggcaaagaccatgtctccggtgtctttcacagcctcaggcaaga

SEQ ID NO: 38528 - DNA, 201 bp, Homo sapiens
ctggatgaggtccacagcccgcttgggcccaataccccggatactctcacagtagtcactgcctagcaggatgcacagatccacaaactgttcctggttcwggcccagctcctgcagaatccggctcaggtggaattcctggattggcagctttttggcttcactggcagtcaggtgtcgcattagcacagggctgccgaa

SEQ ID NO: 38529 - DNA, 201 bp, Homo sapiens
  misc_feature (1)...(201): n = A,T,C or G, or insertion/deletion polymorphism (see Tables 1-2)
cagggctggcttacagaatcacagcaatcgcttgaggaatgaatgagtttgtccctgcctgcagtgtcacactcaaggtcaccctttatagtgggggctcnatggagagcaggccctgtgatcagaaacaagccacagagggcctgggccacaaaaaccagggaaggggagcttccgcacggcactccttccccttctggt

SEQ ID NO: 38530 - DNA, 201 bp, Homo sapiens
agggtggcgatggggctcgagtggggtgcagaggcagggctgtcacggtcccaggctcctgtttgatcattccattcagcatctgggcattgagggtgctsgggggggattcagagtgcttcctcttcttggaggggtgtgtagggagcctggggaaacagaagtgtgcgccgtgggggctggctctccccgagcccctcc

SEQ ID NO: 38531 - DNA, 201 bp, Homo sapiens
gtgaaggaggtataatggggaaacacatttattttccccttttaaacttccctgctgccccagtctttgccttcttcttagtggatcccttgggttctggmtccttgcgcttagctgaagagagtgagccggtcaccttgaagaaatcatccaggcggccctgggtgctgccttggcggctcttactcagcctcttgaccc

SEQ ID NO: 38532 - DNA, 201 bp, Homo sapiens
agctactgcactgaggcaataactcctaagaaatcttaacatttcgccaggcaaggtggctcatcctgtaatcccagcactgggagagaatggcacacgtratcctagcctttaggaggccaaggcgggaggattgcttgagcccaggagtttaagaccagcctgggcaacagtgagatcccatctttacaaaaaattgaa

SEQ ID NO: 38533 - DNA, 201 bp, Homo sapiens
tgcaggcctgattcctgatccttattctgtgctcagcaaacgtctattgactgacaagtctgaacccagacagtcacatgactgggctgaggtgggccctkgccagtgagccttgccaggctgggctgggtagtgtcaggggtgcagcaagtacctgactggccctgggcccaggtgggctcagcagggcccacgctggac

SEQ ID NO: 38534 - DNA, 201 bp, Homo sapiens
ctgcgggagattctccctggctcccctcctgcctcccacttccccacaccggcactcacttcatctgcagagtcaggctgaggtgcagtggggtgccactrctgacagggatgtggtaggtgaagttcccaggcctgcaggggcaaaactggcaccttagcctgagggtaccctgccaccccccacccccaccagggactc

SEQ ID NO: 38535 - DNA, 201 bp, Homo sapiens
  misc_feature (1)...(201): n = A,T,C or G, or insertion/deletion polymorphism (see Tables 1-2)
gaggcatcctgggagaccctaacgagaaccagatgtgctttgggggaggagggaccctcccgtgccagggtccgggcggacggaggatggaggaaggaggngggaggagggaactgatggggcagcgttgcggggaggccagtgggtggggaagaagtttgagggttgggggctcggagggcctcctgaggaacgctgacc

SEQ ID NO: 38536 - DNA, 201 bp, Homo sapiens
  misc_feature (1)...(201): n = A,T,C or G, or insertion/deletion polymorphism (see Tables 1-2)
gtcacttcaccttagtctccatcccatttcttcagctgaacaataggaacaacaattcctttcttgcaggagtgctgtgaggactaaatgggatgatctangtaaggctgcaggcctgattcctgatccttattctgtgctcagcaaacgtctattgactgacaagtctgaacccagacagtcacatgactgggctgaggt

SEQ ID NO: 38537 - DNA, 201 bp, Homo sapiens
  misc_feature (1)...(201): n = A,T,C or G, or insertion/deletion polymorphism (see Tables 1-2)
agtggccaatgccattgactgaaagaccccaggacttggctctgatgttggtgactggcagaagggccatctggctggggcctgtggatagaaccaggcanaggctaagaagctggaagctggctgcttcctgtccagctgtctctagggccccacaagactgagtgaaccccatgtgtctcttggtcctctcaggggaac

SEQ ID NO: 38538 - DNA, 201 bp, Homo sapiens
ggtgctcctgcctctgctttgcagtgcccccagtatctatggaggtgatgagtgttccccagctggctccccacttgcctctgggctccctcccattcccscacccacagaccttgttcaccaccaggaagttctctatggttttcccattggcaaagaccatgtctccggtgtctttcacagcctcaggcaagatctcct

SEQ ID NO: 38539 - DNA, 201 bp, Homo sapiens
  misc_feature (1)...(201): n = A,T,C or G, or insertion/deletion polymorphism (see Tables 1-2)
gatgtgggaagctcagggagaaaccacgctaggtacatggaccccgccggttttgtacattggattggggctgagagaaggtaaggaggagaggagggctngtgatgcccaggggcaggttatagccttatttcccaagttcaggtgagctcagtttgttctttggatttccaggacagtgagcaggggacctggctggag

SEQ ID NO: 38540 - DNA, 201 bp, Homo sapiens
  misc_feature (1)...(201): n = A,T,C or G, or insertion/deletion polymorphism (see Tables 1-2)
ccacgctaggtacatggaccccgccggttttgtacattggattggggctgagagaaggtaaggaggagaggagggctagtgatgcccaggggcaggttatngccttatttcccaagttcaggtgagctcagtttgttctttggatttccaggacagtgagcaggggacctggctggagtggaggtggggaataggggtgct

SEQ ID NO: 38541 - DNA, 201 bp, Homo sapiens
gagtccagcaggggccaggaagaagcgagcagcagggcagagtggagtccctggtggagggcaccagcgagagaagagaggatggaccatgcctggcacastgtggtgtggagttggagattctgctgggaactcctcggagctgggtgagccatgaggggtgtgtgggctggggggtccgatcggggaagcaaggtttct

SEQ ID NO: 38542 - DNA, 201 bp, Homo sapiens; identical to SEQ ID NO: 10311

SEQ ID NO: 38543 - DNA, 201 bp, Homo sapiens
cgtccctggcaacccactggggtacctgagcttcctggccaaggatgctcagggactggccctgatccatgcccgctgggatgcgcataggaggctgcagkcatgtagctgggaggatgagccggagctcaccgcagcctacggtgctctctgtgctcatgagactgcctggggctccttcatccacacccccggacccga

SEQ ID NO: 38544 - DNA, 201 bp, Homo sapiens
tccttgtcttctctcccaccctcagtttagcagcctatgcctcctggaagcctttcttgactaccgtcagtactctgggtgtcccccatagcagtactacygtgtttggcggcttgggggtagggaggcactgccacaagggcggcacactgagggcacaaagactcagaaggcatgaaatggagggaatctgtgtgtgtg

SEQ ID NO: 38545 - DNA, 201 bp, Homo sapiens
tagcagtactaccgtgtttggcggcttgggggtagggaggcactgccacaagggcggcacactgagggcacaaagactcagaaggcatgaaatggagggartctgtgtgtgtgactgagcacacgtgctggtgtttctcccggatggcgcaggcattggtggggcctccctggtggattgggctcccatcaacaccacatc

SEQ ID NO: 38546 - DNA, 201 bp, Homo sapiens
ttgggctcccatcaacaccacatccacccctcaggtgcccgctgggtctgccgcagcttccgccgccacctggaccagtgtgagcaccagattgggccccrggaaatcgagttccagctgctcaacagcgcccaagagcccctcttccactgcaactgcacgcgccggtgaggcccctttgaaccctcgcggggtgggctg

SEQ ID NO: 38547 - DNA, 201 bp, Homo sapiens
tcaagctggcccctccactggactgtgtggaaggcaaaaagtaagtgatgtcagagccaggagggatggggggttttctcaaagggtgggttgcctatacycactttgaatgcttgggccaaggggtaggggaagggatcgggagacctctgagctcctatccatagcctcatccctctaccccctgctgccccaggtcca

SEQ ID NO: 38548 - DNA, 201 bp, Homo sapiens; identical to SEQ ID NO: 10316

SEQ ID NO: 38549 - DNA, 201 bp, Homo sapiens; identical to SEQ ID NO: 10317
  misc_feature (1)...(201): n = A,T,C or G, or insertion/deletion polymorphism (see Tables 1-2)

SEQ ID NO: 38550 - DNA, 201 bp, Homo sapiens; identical to SEQ ID NO: 10319
  misc_feature (1)...(201): n = A,T,C or G, or insertion/deletion polymorphism (see Tables 1-2)

SEQ ID NO: 38551 - DNA, 201 bp, Homo sapiens
tcaaggagcagaatgtagaggctgtggcatttgacaaaagtctttaggcacccccagcccagcagtctggcctacttacctggaagggttcagtgatgccratgaggatgctgtggttgtgactatagtagcccaggatgaagtctccatggcccttgggcagtgattcctcactgaatgttacctggtaggcccaggggt

SEQ ID NO: 38552 - DNA, 201 bp, Homo sapiens
gaccaccactgcccctctcacccggtataagccgatccagtcccaggagctgcgggcgaacactgtttccatgcggtacctcaccaccgcctgctcgggcygcacccactcatctgccacctccagccgcaccagtggcatgtcgtccctgaaggcaaactgtccaggcaaggcaggggcagggggccacatcaggggaga

SEQ ID NO: 38553 - DNA, 201 bp, Homo sapiens
gggtcagggaggccacctgagagcccccaaggtgagttctgaggtcccaaaggcaacaaggacttgccctgactctcccactccttttaagtacctggtakgtattcccatccacatcttcatgtttggcccagacataagccacatagtccttgcaatggcggaaacccacctgggggatcagtgttgtggaatcagtgt

SEQ ID NO: 38554 - DNA, 201 bp, Homo sapiens
atcccacacacttaaggctcttgggtcttagcacaaattgcctgagacaaagggccactttacagactgggaaactgaggcagaacaggtctagtataaawaccaagccctgtgctgcctcccagcccagggttccttctgcccacagcctccttagggagtgagtgagaacatagctttgaagctagcaaatcctggatt

SEQ ID NO: 38555 - DNA, 201 bp, Homo sapiens
gtaagtgatgtcagagccaggagggatggggggttttctcaaagggtgggttgcctatacccactttgaatgcttgggccaaggggtaggggaagggatcsggagacctctgagctcctatccatagcctcatccctctaccccctgctgccccaggtccagctctgcagttggcctctatgggtcgcatcttggctttgt

SEQ ID NO: 38556 - DNA, 201 bp, Homo sapiens
ttcagctttgtattttttatatctttgctctccctccccatcactacacactctcataatgcttggcatatggtaagacagttaagtactcagtaaataaygaatgaatgaatatgaatgaatgttacatggagtttgattttgctggtcttattatatatgtgaatttttatatcttttctttgttatttttaagacact

SEQ ID NO: 38557 - DNA, 201 bp, Homo sapiens; identical to SEQ ID NO: 10312

SEQ ID NO: 38558 - DNA, 201 bp, Homo sapiens
cagagcattgatctccatggagacgaccctgggggcttctggaagggggattcccagtcaccaatttccaccaactgccaccacccaggtgtaggatgtayggcacagtgcccctcgctcgcctgcagcccaggaccttctacaatgcctcctggagctcccgggccacctccccaactcccagctcccggagcccagccc

SEQ ID NO: 38559 - DNA, 201 bp, Homo sapiens; identical to SEQ ID NO: 10318
  misc_feature (1)...(201): n = A,T,C or G, or insertion/deletion polymorphism (see Tables 1-2)

SEQ ID NO: 38560 - DNA, 201 bp, Homo sapiens; identical to SEQ ID NO: 10322
  misc_feature (1)...(201): n = A,T,C or G, or insertion/deletion polymorphism (see Tables 1-2)

SEQ ID NO: 38561 - DNA, 201 bp, Homo sapiens
catctcctgtcctgtgtgtgatcatcgaatgagatacatgtcagaggccatgcacatcacagacacacaatacacactggctatcatcaactagttatcakacatgttcccaggcccaggtcattgtcagaatgttccctcccatctctattcctgtgtatagactctgtagtttctgtaatgatcagatggctgcccctc

SEQ ID NO: 38562 - DNA, 201 bp, Homo sapiens
ttctggatcccatgtctttttctttcttggttatccccacctgccctccatggatgcacaacacatacacacacacacacacacacacacacacacacacmcacacacacaccctttcttcctcccggtggctcattctcaagtagctttcttagaacaccctgtgaccctgtgcctggtaacttttctattccccatata

SEQ ID NO: 38563 - DNA, 201 bp, Homo sapiens
tccacacagctcagaacagttggatcttgctcagtctctgtcagaggaagatcccttggtaagttggggatagtgtgatctacccccatgtccttattctygcaatagctctataagggaaggatcattcagcttttgtagataagctcagagaggttaggtagctggttcagatcagacaggaaagcagtggcagagccg

SEQ ID NO: 38564 - DNA, 201 bp, Homo sapiens
atactatttactgtggagctgagttgtacaccatgtttgcacatgttttgtggcacagctttactttttcctgatgtttctaattgcctttgttttttttyctcccttgtactgcttgccttcttcatttcctcagtttctctcaaactgtgaatcctttgaggtattctattgagtccctttttcccacagaaccattcc

SEQ ID NO: 38565 - DNA, 201 bp, Homo sapiens
ggagagccccacggtcagtcagtggcaggtctttcttgagctcagaaaggttaggtaactagttcagatcagacagtaaaacaggggcagagcctggaatygcactgaggcttgagtctgacttctctcccccacctgctgtgcccttaaactgcagagatcggggcgggggttggggggcaagcggctcagatgggttca

SEQ ID NO: 38566 - DNA, 201 bp, Homo sapiens
cctcacaagtattgggcaggtccgaggccccagctctgtctgccctcctgctcctcttctccctcctggtcctcctggttctcatggctcatgagatggcrttgagacagctcccctggcctagggtgtcacagagtgaacaaagcaggaagaaggggaagggaagaccccctcccgtcaccccgtcccttacagcaagaa

SEQ ID NO: 38567 - DNA, 201 bp, Homo sapiens
  misc_feature (1)...(201): n = A,T,C or G, or insertion/deletion polymorphism (see Tables 1-2)
caacacaggagatgctgtctctctgaaatgaaaaattaacaaattagtcctgcatggtgccgtgtgcctgtagtcccagctacctggaaggctgaggcagnaggatcacttgagcccaggggctctaggctacagcaagctgtgatagccccaaagcactccagactgggtgacagagcaagacagtttctcaaaaataaa

SEQ ID NO: 38568 - DNA, 201 bp, Homo sapiens
cctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttctgt

SEQ ID NO: 38569 - DNA, 201 bp, Homo sapiens
acctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttctg

SEQ ID NO: 38570 - DNA, 201 bp, Homo sapiens
aacctggacactgttggattattaaaatcacccatttttgcttcaatatcagagtcacaagggcagatgttggcctcccctctgccctccaagagctgtgtgactctgggcaagtcacctcccctcccagcctaagatttttcccctctaaaaaacttgatagagctgccaaaagtccatgaaatcaggggggtaatttct

SEQ ID NO: 38571 - DNA, 201 bp, Homo sapiens
cctggtgcccacactctcttttcttctggccatgacctgcctccgcaggagttggcctcttggaatttctcccaccctaaagataccaaggtcccagcccstcccccattccagagagttcctggttatccattgattcttctcaccaaaggaaagagaaatctcctgggccctcacaggatgcagtgtgggcaggaagga

SEQ ID NO: 38572 - DNA, 201 bp, Homo sapiens
ctgggccatgtcatccagaggctggttgcttttagttcaagtaatgcctcctgcacctgggatttcagccaggctgtgccagggagggcggagggcatccrggtcagtcgtagggggtgcagctgggaacacaacagtgtccccattgaatgttcagagtctaaaggggagacagaggcccaaagagccacatacaggtag

SEQ ID NO: 38573 - DNA, 201 bp, Homo sapiens
aggggagtgagaaggtcgcattgcagaatggtacctgtggcatgatgccagctttgcaatcatgagattcaaaagccacactgtggaattgtgagtataastacaggagtgagagcttaggtctctgtgtttgtagaagcagaatcaaacctggacactgttggattattaaaatcacccatttttgcttcaatatcagag

SEQ ID NO: 38574 - DNA, 201 bp, Homo sapiens
  misc_feature (1)...(201): n = A,T,C or G, or insertion/deletion polymorphism (see Tables 1-2)
atctcttggcatctctgatctcctgttgccctcatttaaattttcattggcagcagagggtgcagaggcagtgcgtgagttcttgagtccgtctgtctggntgggaacccagtctttaccacgtagtagattctgagcttgggcaagtcactgaacatctgtttcagttttcttacctgaaaatggaaataccaatggtac

SEQ ID NO: 38575 - DNA, 201 bp, Homo sapiens
ttattcagttgtcatttcttcagccagttctgttttccaacatctcttggcatctctgatctcctgttgccctcatttaaattttcattggcagcagaggrtgcagaggcagtgcgtgagttcttgagtccgtctgtctgggtgggaacccagtctttaccacgtagtagattctgagcttgggcaagtcactgaacatct

SEQ ID NO: 38576 - DNA, 201 bp, Homo sapiens
  misc_feature (1)...(201): n = A,T,C or G, or insertion/deletion polymorphism (see Tables 1-2)
gggaggagtagatgggctccaggaggcaccgaagcagggcgtcagtgggtgcctggacctaaggtgactgtggtggcagggagcggtgaggaaggtggggnccagagcatcagagggcctgtgtgccctgctatggggtttgaacttgaccgtggcttttcactgaagattcctcagaagggtgcagtgccacggctgagg

SEQ ID NO: 38577 - DNA, 201 bp, Homo sapiens
ttacctggccttattgtttctctttctcttcttacaataggacactagccctctagtaggattagagccctacccttgtgatctcattcagtcttaattgyttccttaaaggcccaatcttcaaatatagtcactcgagtttagggcttcagcatatgaattttgggggcacacaatccctctatagcactgatgactcca

SEQ ID NO: 38578 - DNA, 201 bp, Homo sapiens; identical to SEQ ID NO: 10321

SEQ ID NO: 38579 - DNA, 201 bp, Homo sapiens
tatttccaggaccaagtgagcagagagaatctgctacaactgctgactgatgatgaagcctggaatggattcgtggctgctgctgaactgcccaggtaagytccatggggttaactccatggggcgccccagcgatgccactcagatctcccctgggctggttgtccctgacaggcacacctcctccaggcagccccctct

SEQ ID NO: 38580 - DNA, 201 bp, Homo sapiens; identical to SEQ ID NO: 10323

SEQ ID NO: 38581 - DNA, 201 bp, Homo sapiens
tgcagggatgaggcagatgagctccgtaaagctctgaacaagcttgcaagtcacatggtcatgaaggacaaaaaccgccacgataaagaccagcagcacargcagtggtttttgaaagagtttcctcggttgaaaagggagcttgaggatcacataaggaagctccgtgcccttgcagaggaggttgagcaggtccacaga

SEQ ID NO: 38582 - DNA, 201 bp, Homo sapiens; identical to SEQ ID NO: 10325
  misc_feature (1)...(201): n = A,T,C or G, or insertion/deletion polymorphism (see Tables 1-2)

SEQ ID NO: 38583 - DNA, 201 bp, Homo sapiens
agagacacacagggcagagtctgggaggatttcaggtgtgaatcttcattgtcctcaggaggctgtgttctcctgtgtgaatgtgggacaaaacacatgcrgtgttgccaaccagggaagctcacccagttaaggaaaaattcctgtgaatcacattaaaccagaaatgaagcctttattcaggattgttgttacagggga

SEQ ID NO: 38584 - DNA, 201 bp, Homo sapiens
gcccaggtcattgtcagaatgttccctcccatctctattcctgtgtatagactctgtagtttctgtaatgatcagatggctgcccctcctctgattatctycttctcatacccctacaggacaagaggaccctgccttggtgtgagagtgagggaagaggaagctggaacgaggtgagtttctgtaaatactagctggcag

SEQ ID NO: 38585 - DNA, 201 bp, Homo sapiens
tgtagtttctgtaatgatcagatggctgcccctcctctgattatcttcttctcatacccctacaggacaagaggaccctgccttggtgtgagagtgagggwagaggaagctggaacgaggtgagtttctgtaaatactagctggcagggccccaggagataaacactctggacatttgctgctaccacagagggatctgca

SEQ ID NO: 38586 - DNA, 201 bp, Homo sapiens; identical to SEQ ID NO: 10320
  misc_feature (1)...(201): n = A,T,C or G, or insertion/deletion polymorphism (see Tables 1-2)

SEQ ID NO: 38587 - DNA, 201 bp, Homo sapiens; identical to SEQ ID NO: 10326

SEQ ID NO: 38588 - DNA, 201 bp, Homo sapiens
tggctagttcctactcgcacctagaatggagggtggcacctccacagctgagtgagccccagaagaacccagatggactaggaggccaatgagtctgcccygagcagcagaagaggtcacgtggagtcccccgacccaggggtctgggggtcatctgcatcctgacctctcctcggggtgacacggcccaggtgcccactt

SEQ ID NO: 38589 - DNA, 201 bp, Homo sapiens
gccaatgagtctgccccgagcagcagaagaggtcacgtggagtcccccgacccaggggtctgggggtcatctgcatcctgacctctcctcggggtgacacrgcccaggtgcccacttcctccctaccctgtcacccagcagatgactcaagtggggcaggacagccatgaggaagtggaacaagcaggagaggggagtggg

SEQ ID NO: 38590 - DNA, 201 bp, Homo sapiens
atccacacagctcagaacagttggatcttgctcagtctctgtcagaggaagatcccttggtaagttggggatagtgtgatctacccccatgtccttattcytgcaatagctctataagggaaggatcattcagcttttgtagataagctcagagaggttaggtagctggttcagatcagacaggaaagcagtggcagagcc

SEQ ID NO: 38591 - DNA, 201 bp, Homo sapiens
aaactgtgaatcctttgaggtattctattgagtccctttttcccacagaaccattccctttttattccatcctggactggtcgttttgtaggcctactgcmtgtcccactgtgatcctcagattcccttctctctgggttgattttcctgttttctggatcccatgtctttttctttcttggttatccccacctgccctcc

SEQ ID NO: 38592 - DNA, 201 bp, Homo sapiens
cctcggggtgacacggcccaggtgcccacttcctccctaccctgtcacccagcagatgactcaagtggggcaggacagccatgaggaagtggaacaagcargagaggggagtgggggaagagcagggtccaggaggaggggaggggtgggagaggaggttgacctgcagccctgatctcttatctaccgctcttctccctg

SEQ ID NO: 38593 - DNA, 201 bp, Homo sapiens
  misc_feature (1)...(201): n = A,T,C or G, or insertion/deletion polymorphism (see Tables 1-2)
aaggtggaggaggggaggtgacctggagcccggcatgtccttgtggccgggccacacccaggctggccccagggtgctgctgctgaagcccaatgggaacnacagatttcttttgagacacaaggaactcagaggttgtctcactcaccctgagtctgagcacctacttgtgccaggccctgtggggaaactgaggccctg

SEQ ID NO: 38594 - DNA, 201 bp, Homo sapiens
  misc_feature (1)...(201): n = A,T,C or G, or insertion/deletion polymorphism (see Tables 1-2)
agagcccattgctgacaggagcttcctccaggttgcaagcggtgggcttgcgcatgcagggagagttatcaggctgtggctgactgtcttgactggggctnccccagccctagaaataatatcgtttcttgtcttgcttcatcctaacctggcttcctgacagctcccccggataactcaaaacctgctgtaacaagctgt

SEQ ID NO: 38595 - DNA, 201 bp, Homo sapiens
gtagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccat

SEQ ID NO: 38596 - DNA, 201 bp, Homo sapiens
  misc_feature (1)...(201): n = A,T,C or G, or insertion/deletion polymorphism (see Tables 1-2)
gcttcctccaggttgcaagcggtgggcttgcgcatgcagggagagttatcaggctgtggctgactgtcttgactggggctgccccagccctagaaataatntcgtttcttgtcttgcttcatcctaacctggcttcctgacagctcccccggataactcaaaacctgctgtaacaagctgttagcaggcattttgtcaagt

SEQ ID NO: 38597 - DNA, 201 bp, Homo sapiens
tatctcgtggatcagactgaccgaagcatctgggaggtgggctggaacagtcccaagaaggccggattgtcctcccccaaaataaagacagagatcatccstgtttcttctcctgtacgcgaacctggtggatgctccaaaatcgaaccaaaacactaccatgaataagagatgactgcactcctctgacacaacttccta

SEQ ID NO: 38598 - DNA, 201 bp, Homo sapiens
ttctggtggcacatgatcctggggttggagtccaggctctgccactcagtagctgtacgtgtgaccaggttacttaacctcaccaagcctcttttttttttgagacggagtctcgctctgttgcccaggctggagcgcagtggcatgatctcagcttacaggtgcctgctaccacgcccagctaattttttatatttttag

SEQ ID NO: 38599 - DNA, 201 bp, Homo sapiens
atggcatgaaccctggaggcggagcttgcagtgagccgagatggtgccactgcactccagcctgagcgagagtgagactctgtctcaaaaaaaaaaaaaaaggaaaaaattaccttctaaagtggtatcatcatattatcagaaagttctaatatcttgtactgattggtgggagccaatgtctcctggttctgctttgtt

SEQ ID NO: 38600 - DNA, 201 bp, Homo sapiens
atgaccaacggggcagccttggcagccaacagcaatggcatcgccggcagcatgcagccagaggaggaggcagctcgggcggctggtgcagccattgcaggccaagcctctttgcctgtgttacctggggtggaccgcttgcccatggtggctggacccctatccccccaactgctgacttccccattccccagtgtggca

SEQ ID NO: 38601 - DNA, 201 bp, Homo sapiens; identical to SEQ ID NO: 10345

SEQ ID NO: 38602 - DNA, 201 bp, Homo sapiens; identical to SEQ ID NO: 10346

SEQ ID NO: 38603 - DNA, 201 bp, Homo sapiens
attgctggggcttccgggggtccctgccccgtccatcgccctcatattgtcgcctcccggagctggtgacttcacgctccccggggacaaagctcggcgtrctgtggtttgggggagaagctggacgctggcttcatctctccagctcttccgggcgcgcagcccatcagatcgatcaatgtaccgggtgcagaagcagct

SEQ ID NO: 38604 - DNA, 201 bp, Homo sapiens
gagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatcag

SEQ ID NO: 38605 - DNA, 201 bp, Homo sapiens
agagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatca

SEQ ID NO: 38606 - DNA, 201 bp, Homo sapiens
tagagacggggtttcactgtgttagccaggatggtctcgatctcctgacctcgtgatctgcccacctcagcctccctaacctcacaaagcctcttatttctttatctgtaaaatgggtataatagtaatctgtagcacaaagggtgttgggcaaattctatagaatagtgcatgcggtgtgctgggccctggtgtgccatc

SEQ ID NO: 38607 - DNA, 201 bp, Homo sapiens
gcagcctcttggcattctgggtagggagcctgagccaaactctaaagctgtctttataaagggaggtcatgtgatggccagaaattgcctttgcttcatgrtgcacttggtggggagtcaggtgtggggtgctgggtttcacatcatcccattttcttttctgccttcagacctgcaatgcttcttttgccacccgagacc

SEQ ID NO: 38608 - DNA, 201 bp, Homo sapiens
agattgaatcaggtgaacttccaggtgccctcagatccttcaatcccaacaattcttaaatagttgacttaagtatctacctatagatctgtctttttcartttttgccacaaaaatgactcctggctgtgaagaatggcaaagaggaaaggcagcctgactcctgcagcctcacacgtgagtcagatgcaagttgaagag

SEQ ID NO: 38609 - DNA, 201 bp, Homo sapiens
tgaccgcccaccgctttgcacacctcccctctgttcctccaccctccctctgctctcctcctttgttcttcccccaggcccccttcccccacagctgacgktcctccttcctggttgcttggtcctggttcccaccctgtctttgccttcactctgttgcttggctttcctctcctggtgtttgccggctccttggatggt

SEQ ID NO: 38610 - DNA, 201 bp, Homo sapiens
  misc_feature (1)...(201): n = A,T,C or G, or insertion/deletion polymorphism (see Tables 1-2)
taacctggcttcctgacagctcccccggataactcaaaacctgctgtaacaagctgttagcaggcattttgtcaagttttcaatatggaagttcccagtcngagaactggggtcagagaccagaggttgaaaactgctgagtggagaagggtgctcatgataaaactcagaaagcccagaccagatggtggagtagggcag

SEQ ID NO: 38611 - DNA, 201 bp, Homo sapiens
gcatacctccttcctgtgaaacccaagtcaaaatccttttatcggcctgcctgattctgtatccttggacgcatggctgctgtggaagttggcccaagatrtgttcttcccagcctgagatatctcgtggatcagactgaccgaagcatctgggaggtgggctggaacagtcccaagaaggccggattgtcctcccccaaa

SEQ ID NO: 38612 - DNA, 201 bp, Homo sapiens
aacctggcttcctgacagctcccccggataactcaaaacctgctgtaacaagctgttagcaggcattttgtcaagttttcaatatggaagttcccagtctragaactggggtcagagaccagaggttgaaaactgctgagtggagaagggtgctcatgataaaactcagaaagcccagaccagatggtggagtagggcaga

SEQ ID NO: 38613 - DNA, 201 bp, Homo sapiens
tgggtactcagaaagaagagaaaacaattgcagtttttatcagaagagaaggagcaggattctactcctggactcattccttgggcagaaataggaagagmcaaaaaaaaaaaaaaaaaaaaaggaagaggataaagttctttctgagcaccaaaaacattgagacattggaatcaaaatgcagagagctctgtgtcctcc

SEQ ID NO: 38614 - DNA, 201 bp, Homo sapiens
ggcttgttcactgctgtatccctagcatcttacaaaacaaaagcctggtgcttagtaggtgatcaataaatacaaatctagttaatgaatacatgaccttsacagctctgcttagcctaggagacaaggatattctcagttcgctgtccagctggtctgctgccaaaactgaggtgcatggtttccatggcaacagaagag

SEQ ID NO: 38615 - DNA, 201 bp, Homo sapiens
tgggttccagagccagagcgggaagtccctttcctgcaagaagactaaagaaggtgctggtccaacccatgctgggtactcagaaagaagagaaaacaatkgcagtttttatcagaagagaaggagcaggattctactcctggactcattccttgggcagaaataggaagagacaaaaaaaaaaaaaaaaaaaaaggaaga

SEQ ID NO: 38616 - DNA, 201 bp, Homo sapiens; identical to SEQ ID NO: 10347

SEQ ID NO: 38617 - DNA, 201 bp, Homo sapiens
gatcctggggttggagtccaggctctgccactcagtagctgtacgtgtgaccaggttacttaacctcaccaagcctcttttttttttgagacggagtctcrctctgttgcccaggctggagcgcagtggcatgatctcagcttacaggtgcctgctaccacgcccagctaattttttatatttttagtagagacggggttt

SEQ ID NO: 38618 - DNA, 201 bp, Homo sapiens
gttctaaaacagtaaacacacacacacacaaaagaaatgagtcaaaattgactagaacccatgaaacacctccctggaaccaaaatagcttgaaagccaayggattcagctcttctcagggctttcccaatattctatgacccccacagctggaatgcctttgtaagctccagctgaggaagggatgttgtgaggagactg

SEQ ID NO: 38619 - DNA, 201 bp, Homo sapiens
tgggggtgtgggatttgtgggggtcatttgaccttatagaaccatgccaggtttgggtagagtgtttttaagggcccttattttgagatggtatgcctgaracctgctttccattccctcagggaagtttttttgacgctaagtgtgccctactgtctctcctcctggggccggattcctcaggccagagccaccggacct

SEQ ID NO: 38620 - DNA, 201 bp, Homo sapiens
caccatgttggccaggctggtcttgaactcctgacctcaggtgatccacccatctcggcctcccaaagcgctgggattacaagcatgagccaccgcacccrgcccacagacacttttgaagcctctggcccttgctgtctgctaattctcatgtcgtcagaattgccactatcatttaatgggctgctttttcaattcaaa

SEQ ID NO: 38621 - DNA, 201 bp, Homo sapiens
atctcggcctcccaaagcgctgggattacaagcatgagccaccgcacccggcccacagacacttttgaagcctctggcccttgctgtctgctaattctcaygtcgtcagaattgccactatcatttaatgggctgctttttcaattcaaactcgtgaaaatattacgaataattatctctgcactttgtcctgcctttcct

SEQ ID NO: 38622 - DNA, 201 bp, Homo sapiens; identical to SEQ ID NO: 10364

SEQ ID NO: 38623 - DNA, 201 bp, Homo sapiens; identical to SEQ ID NO: 10365

SEQ ID NO: 38624 - DNA, 201 bp, Homo sapiens
gcaccagctcggtgcagggcgcggagccgttctgcagcgggtacagcacgaagggcgagttgtcgttggcgtccagcaccagcaagcgcaccagcgcctcmctgctcaacgccggggagccgcggtctgtggcgcccacgcggaactcgaaagactgcagggcctcgtagtccagcgacctgagggcaaacaggtggccgt

SEQ ID NO: 38625 - DNA, 201 bp, Homo sapiens; identical to SEQ ID NO: 10367

SEQ ID NO: 38626 - DNA, 201 bp, Homo sapiens; identical to SEQ ID NO: 10368

SEQ ID NO: 38627 - DNA, 201 bp, Homo sapiens
ctgttttaacagtaccttaatttggcctgtatttattggacttggtgttctttttgctgtgagaagacggtgaaggtgattcttgaatgtttgttttctgygttgcatcatgtttgtacaacacggtaatatatttggaccttgattaaataatgtaagaggggaatttgatcaaaaaataaaatgcacaagactgttaaa

SEQ ID NO: 38628 - DNA, 201 bp, Homo sapiens
gaaagctctgcagactcggtggactccgtttcatccagaagccaagtaaaaatacagaccacgtttacagctaaagctgagatagatgtgtccgggaaggyagtcgtcgccagacaagttgtaagaacgaatttaaaaatctctgcaaagacatccgagagggtcgacggtagatgtggtgattgggagctgaaaaggatt

SEQ ID NO: 38629 - DNA, 201 bp, Homo sapiens
aactactcaattagcaccaactcctatttccaccttttcactcgcaatcacagcgacggcaagaaatacccagagctcgtgctggatcaagcgctggacckcgaggagcagccccagctcaggttaaccctcacagcgctggatggtgggtcaccgcccagaactgggacttcccaggttctcatagtgattgtagatatc

SEQ ID NO: 38630 - DNA, 201 bp, Homo sapiens; identical to SEQ ID NO: 10370

SEQ ID NO: 38631 - DNA, 201 bp, Homo sapiens
ccgacgtcaatgacaacgcccccgccttcacccaaacctcctacaccctgttcgtccgcgagaacaacagccccgccctgcacatcggcagtgtcagcgchacagacagagactcaggcaccaacgctcaggtcacctactcgctgctgccgccccagaacccgcacctgcccctcgcctccctggtctccatcaacacag

SEQ ID NO: 38632 - DNA, 201 bp, Homo sapiens
tttcaccatcttgaccaggctggtctcgaattcctgacctcatgatccacccgcctcagcctcccaaagcgctgggattacaggtgtgagccaccacaccyggctgactattttatttttatccttaattgaagtggaactgggctgaactaaattacatttgactgtgttttgtgtccagataagtgaactgactgtcat

SEQ ID NO: 38633 - DNA, 201 bp, Homo sapiens
ggtctccgacgtcaatgacaacgcccccgccttcacccaaacctcctacaccctgttcgtccgcgagaacaacagccccgccctgcacatcggcagtgtcvgcgccacagacagagactcaggcaccaacgctcaggtcacctactcgctgctgccgccccagaacccgcacctgcccctcgcctccctggtctccatcaa

SEQ ID NO: 38634 - DNA, 201 bp, Homo sapiens
gcacaggctggtggtgctggtcaaggacaatggcgagcctccgcgctcggccaccgccacgctgcacgtgctcctggtggacggcttctcccagccctacytgcctctccctgaggcggccccggcccaggcccaggccgactcgctcaccgtctacctggtggtggcgttggcttcggtgtcttcgctcttcctcttctc

SEQ ID NO: 38635 - DNA, 201 bp, Homo sapiens; identical to SEQ ID NO: 10371

SEQ ID NO: 38636 - DNA, 201 bp, Homo sapiens
tcgccgtccaccgccaccaccttggtcaccaggtagcccggctcggccgcccggggcaccagctcggtgcagggcgcggagccgttctgcagcgggtacaycacgaagggcgagttgtcgttggcgtccagcaccagcaagcgcaccagcgcctcgctgctcaacgccggggagccgcggtctgtggcgcccacgcggaac

SEQ ID NO: 38637 - DNA, 201 bp, Homo sapiens; identical to SEQ ID NO: 10373

SEQ ID NO: 38638 - DNA, 201 bp, Homo sapiens
ccaataacccacaggaagttagaaaaatgaaaacagagagacaaacaaaaaaacagagaaaacaaacaggaaacaaaaaatggcagagttaatctctactmatcaataattatgttaatgtaaatggtttgagcacatcaattaaaacaaacattgggagaatgggtttaaaaaatcatgacccaactatatgtctcaaaa

SEQ ID NO: 38639 - DNA, 201 bp, Homo sapiens; identical to SEQ ID NO: 10375

SEQ ID NO: 38640 - DNA, 201 bp, Homo sapiens; identical to SEQ ID NO: 10374

SEQ ID NO: 38641 - DNA, 201 bp, Homo sapiens; identical to SEQ ID NO: 10376

SEQ ID NO: 38642 - DNA, 201 bp, Homo sapiens
gcaggtagggctgggagaagccgtccaccaggagcacgtgcagcgtggcggtggccgagcgcggaggctcgccattgtccttgacaagcaccaccagcctstgcttggctgcgtctcgctcgctcagcagcctggcggtgcgcacctcgccattgtgcgcccacacgccgaacagaccgggctccgtggccttgagcagct

SEQ ID NO: 38643 - DNA, 201 bp, Homo sapiens
cttgacaagcaccaccagcctctgcttggctgcgtctcgctcgctcagcagcctggcggtgcgcacctcgccattgtgcgcccacacgccgaacagaccgygctccgtggccttgagcagctggtacgacagccaggcgttctggcccgagtcgccgtccaccgccaccaccttggtcaccaggtagcccggctcggccgc

SEQ ID NO: 38644 - DNA, 201 bp, Homo sapiens
agattcctcatcagaaaccatggaggacagaaggaagttgcacaatatttttcaagtgctgaaagaaaacaactgtcatccccaaatcctatatccagtgraactatccttcagggaaagaatttgttgccagtatacctaccttaaaatatttgctaatgcaagttctccaaacagaaaggaaacaatttaaaaagcaat

SEQ ID NO: 38645 - DNA, 201 bp, Homo sapiens; identical to SEQ ID NO: 10379

SEQ ID NO: 38646 - DNA, 201 bp, Homo sapiens; identical to SEQ ID NO: 10380

SEQ ID NO: 38647 - DNA, 201 bp, Homo sapiens; identical to SEQ ID NO: 10381

SEQ ID NO: 38648 - DNA, 201 bp, Homo sapiens
aagccaacaggccccccagccaagaaagctatctctgagttgccctgatttgaagggaaaagggatgatgggattgaaggggcttctaatgacccagatayggaaacagaagacaaaattgtaagccagagtcaacaaattaaataaattaccccctcctccagatcaagtcagcttagtttttatttgggtgattttttt

SEQ ID NO: 38649 - DNA, 201 bp, Homo sapiens
cactttgggagggcgaggtgggcgaatcatgagatcaggagttcaagaccagcctggccaacatagtaaaaccccgtctcactaaaaatacaaaaaattakccagctgggcgtggtggcaggtgcctgtaatcccagctactctggaggctgaggcaggagaatcacttgaacccgggaggtggaggttgcagtgagtgga

SEQ ID NO: 38650 - DNA, 201 bp, Homo sapiens; identical to SEQ ID NO: 10382

SEQ ID NO: 38651 - DNA, 201 bp, Homo sapiens
agaggcctccagcttggtctgtctccccacctctaccagcatctgctgagctatgagccaaaccagggatttacagggtagggagggtgggataggcagcrgcattagatcggaggaatgagatggacagacctgggctgtgggctaggagggcagtcagctggcctagggtagcccgggctggtgtcagggtaaggagag

SEQ ID NO: 38652 - DNA, 201 bp, Homo sapiens
agcagccagaggccactccagcatctcccctacctggcttgggtcagggagagggcagtgagaagtgaaaactcccagctacagaaaaggaaatatgttgsggggaagggagaaggaaaggtgtcttcatcaatgccggggcagggtagatggagccctgggcagggagtttggaccaggaaatctcaatgagggaaatgt

SEQ ID NO: 38653 - DNA, 201 bp, Homo sapiens; identical to SEQ ID NO: 10383

SEQ ID NO: 38654 - DNA, 201 bp, Homo sapiens
gcttggtctgtctccccacctctaccagcatctgctgagctatgagccaaaccagggatttacagggtagggagggtgggataggcagcggcattagatcrgaggaatgagatggacagacctgggctgtgggctaggagggcagtcagctggcctagggtagcccgggctggtgtcagggtaaggagaggaagggaggga

SEQ ID NO: 38655 - DNA, 201 bp, Homo sapiens; identical to SEQ ID NO: 10384

SEQ ID NO: 38656 - DNA, 201 bp, Homo sapiens
attgggaagacatccggggagagaagctgctggccgtgtctgagcatcgcatccaagataaagatggcctgttctatgcggaagccaccctggtggtcagraacgcctctgcagagtctgtgtcctgcttggtccacaaccccgtcctcactgaggagaaggggtcggtcatcagcctcccaggtcagtgctctgcctcta

SEQ ID NO: 38657 - DNA, 201 bp, Homo sapiens
atggcaatttaagtctagttatctattttcaaaaaatgtgccaaagcttttcagcatcctgacagcaaaccctgtggcagggcatttcctcggcaccaccrgccttctgggctggatgactctttgttgtgggggctgccacgtgcctcatagaatgtttagcaacacccctggtttctactcaatatatgtcccctcccc

SEQ ID NO: 38658 - DNA, 201 bp, Homo sapiens
atgacctgtgcagtaagccaccatggcacatgtttacctatgtaacaaacctgcacatcctgcacatgtaccccggaacttaaaattgaaagaaaaaaaaagtgggttaggcatagtggctcccaaggagcttgtattctagtagaacatcaattattaacaaacagggctgcatgatttttttagcactttaaactttag

SEQ ID NO: 38659 - DNA, 201 bp, Homo sapiens
ccaaccccccaatacaacagtacagtgtggaatcttgtcttactatacattatagcattaataaaaagatatttttaaataattttaatggttgaaaaaaatcctcatgatgcactattcaatgataaacatgacatctacctataaattgacatttccaatcacataaaagttactggccttaaataacttataactgca

SEQ ID NO: 38660 - DNA, 201 bp, Homo sapiens
acgccattgacgagggcagactgaccctgcagatactcagtgccagaccttcggacgacgggcagtaccgctgcctttttgaaaaagatgatgtctaccargaggccagtttggatctgaaggtggtaggtaagaattctagatagatattttgtattcaatacctgctcctgccactttaatatgctagttcctggacaa

SEQ ID NO: 38661 - DNA, 201 bp, Homo sapiens
gcagatactcagtgccagaccttcggacgacgggcagtaccgctgcctttttgaaaaagatgatgtctaccaggaggccagtttggatctgaaggtggtargtaagaattctagatagatattttgtattcaatacctgctcctgccactttaatatgctagttcctggacaatttctctgacatttgaaattttcttaat

SEQ ID NO: 38662 - DNA, 201 bp, Homo sapiens; identical to SEQ ID NO: 10412

SEQ ID NO: 38663 - DNA, 201 bp, Homo sapiens
ttaattatttgggcatataacttgtatcttttccagtatcttcaaaaattgaccatatctttaaggaaatctgagtatcttactacatattttacaaaagrctcattgtttcacagtgtgttattagaattctgagaaatgcaataaaattctagaaactgtaatcatctgaagactaaactggatccactgtgtaaacca

SEQ ID NO: 38664 - DNA, 201 bp, Homo sapiens
cctcctgccaactccagacgggaaaaaaacaaacaaaaaaaaaacaaaaaaaaaacagtttttatatctaagagaagaggaatcctgaaaggctaaaaaaagctaataaatggatttattatctaaacttcaggaaaataaaatgttaataacaagaataaggtttccaatttaaaaagtcaatttacatgagaataaatg

SEQ ID NO: 38665 - DNA, 201 bp, Homo sapiens; identical to SEQ ID NO: 10413

SEQ ID NO: 38666 - DNA, 201 bp, Homo sapiens
acctcttaatcatcccagaatgatttaggaatacaaagaataaaaataagcaaacaaacaaaataagaaaatgctccagccagcctcatccctaagtggartgcaatcccccttaagcttttctcccttccccaagccctccacatccccttctttcctcccagtgaaattgctgcccactcatccacttgaaaggacccc

SEQ ID NO: 38667 - DNA, 201 bp, Homo sapiens
ggcttccctctgcaggtctggggtctgcccctagcatccacatggagggacctggggagagtggagtccagcttgtgtgcactgcaaggggctggttcccwgagccccaggtgtattgggaagacatccggggagagaagctgctggccgtgtctgagcatcgcatccaagataaagatggcctgttctatgcggaagcca

SEQ ID NO: 38668 - DNA, 201 bp, Homo sapiens; identical to SEQ ID NO: 10418

SEQ ID NO: 38669 - DNA, 201 bp, Homo sapiens; identical to SEQ ID NO: 10420

SEQ ID NO: 38670 - DNA, 201 bp, Homo sapiens
tctgacatttgaaattttcttaatgcttattcatcatcaaatttatatcaaatcctccagtgtgtgaaactgtcatagttacttaaaatccacaaactcamatggatgaaatttaattatttgggcatataacttgtatcttttccagtatcttcaaaaattgaccatatctttaaggaaatctgagtatcttactacata

SEQ ID NO: 38671 - DNA, 201 bp, Homo sapiens
agaattctagatagatattttgtattcaatacctgctcctgccactttaatatgctagttcctggacaatttctctgacatttgaaattttcttaatgctyattcatcatcaaatttatatcaaatcctccagtgtgtgaaactgtcatagttacttaaaatccacaaactcaaatggatgaaatttaattatttgggcat

SEQ ID NO: 38672 - DNA, 201 bp, Homo sapiens
caagccacctgtatccaaaaaggaactcctcacttttgaggagctcctccactcccaggagctcctccactcctagctgagtcacctttggaaagttactwgagcacctcataccttagttctttcatctttttaatgagaataacagcagtaactacatctcagaggccagcacaggctttaggattaaatgagacatta

SEQ ID NO: 38673 - DNA, 201 bp, Homo sapiens
aaaacacgacacagagcatcagagggcgcaggctctgcctcggcaccgcagagctggtgtgtctgcctcggtgccgcagagctggtgtgtctgccttggcsctgcagagctggtgtgatgtgatgaagctgctggcttctctgtgcttgtgctgcagctccctaccctgtaacagtcaatctgatggaatgtcttcagttc

SEQ ID NO: 38674 - DNA, 201 bp, Homo sapiens
gattggatctgcacagagaaagagcaaatggccccggagcatttagaatgagaaagaacatatcatacatgacataaaatgatcaaacataataacatacmtaactgttaaacatctcttcaatttgcagataacaaggaagagatcagacatgtcttagaatttgtttggaagacccaaaaatctctagacaaaccagtg

SEQ ID NO: 38675 - DNA, 201 bp, Homo sapiens
tttggctgttaatagaatgaaattatattgattaattatcagaatggattctctttctttacagtgaatgtgacattggcttcaaacacagctcacctgaractgatttcttctgaacagaacaagcgtgtgatccatggacattcaggcagccagatatcccacagagatctgactatctgctctatgggccagagggaa

SEQ ID NO: 38676 - DNA, 201 bp, Homo sapiens
gagcaacgtcactgggatctcagcctctgtgatttctgcctctgtgggctctgggtgtcagagctgtggcttccctctgcaggtctggggtctgcccctarcatccacatggagggacctggggagagtggagtccagcttgtgtgcactgcaaggggctggttcccagagccccaggtgtattgggaagacatccgggga

SEQ ID NO: 38677 - DNA, 201 bp, Homo sapiens
ggatgaccctgagcctcacagcaaccctgggatgctcatggtttctaaactccaatggagctgttcttagagatgacattattggttccattttgattctktcattgtgttttgtccactctatttaacagcttctttaaaagtgaatggaccttcccagcccatcctcgtcagagtgggagaagatatacagctaacctg

SEQ ID NO: 38678 - DNA, 201 bp, Homo sapiens
gaaacccccacctcacctaaggatgaccctgagcctcacagcaaccctgggatgctcatggtttctaaactccaatggagctgttcttagagatgacattrttggttccattttgattctttcattgtgttttgtccactctatttaacagcttctttaaaagtgaatggaccttcccagcccatcctcgtcagagtggga

SEQ ID NO: 38679 - DNA, 201 bp, Homo sapiens
gttttactcagactgacacacatcatggaatgattcctccttaaagaagagcaacctctattctgagtccatgaaacccccacctcacctaaggatgaccytgagcctcacagcaaccctgggatgctcatggtttctaaactccaatggagctgttcttagagatgacattattggttccattttgattctttcattgtg

SEQ ID NO: 38680 - DNA, 201 bp, Homo sapiens
cagtgctagaggcgttgcaaaatgtcatgatgtcccccttctccgattcccctttctggatctggagaaaagtactggtcagatgctaaaatgtaaagacscagactggggaacaaataaagtgtatctgaactcacatttgaatggggagactgaggtcgactttctgctcctcagactcctgaactccggccacctccc

SEQ ID NO: 38681 - DNA, 201 bp, Homo sapiens
tgcccaatacagataattttaagatgaaaaaggcagagttcatggcacagaggaattaatgaataaattacagctcatctctgtttgcagtgctagaggcrttgcaaaatgtcatgatgtcccccttctccgattcccctttctggatctggagaaaagtactggtcagatgctaaaatgtaaagacccagactggggaac

SEQ ID NO: 38682 - DNA, 201 bp, Homo sapiens; identical to SEQ ID NO: 10405

SEQ ID NO: 38683 - DNA, 201 bp, Homo sapiens
atgtgcccaatacagataattttaagatgaaaaaggcagagttcatggcacagaggaattaatgaataaattacagctcatctctgtttgcagtgctagargcgttgcaaaatgtcatgatgtcccccttctccgattcccctttctggatctggagaaaagtactggtcagatgctaaaatgtaaagacccagactgggg

SEQ ID NO: 38684 - DNA, 201 bp, Homo sapiens
atttgatttcctgctgcccattccccagtgatctggttagggaagaagaagaaaaaagtgagtagtacagccatccttgttttcaaggctgagagctgagrttcactgagatttgttggcgtgaacaatttcctatgatctttaaaaatgtggtgacctacttgttggtgatttctgtgttgctggtgacttctcatgtgt

SEQ ID NO: 38685 - DNA, 201 bp, Homo sapiens
ttttttttttttttagtagagacggggtttcaccatgttggccaggatggtctcgatctcctgacctcatgatccgccggccttggcctcccaaaggtgcwgggattacaggcatgagccactgcacccagcctaatttttgttttttaaatctcggagttggactgagggtattattttgctgcacctgagataagtggt

SEQ ID NO: 38686 - DNA, 201 bp, Homo sapiens
gattcaagctattctcctgcctcagcctcctgagtaactgggactacaggcatgcgccaccacacccagctaattttttttttttttttttagtagagacrgggtttcaccatgttggccaggatggtctcgatctcctgacctcatgatccgccggccttggcctcccaaaggtgctgggattacaggcatgagccactg

SEQ ID NO: 38687 - DNA, 201 bp, Homo sapiens
gagtgcaatggcgccatcttggctcactgcaacctccatctcctggattcaagctattctcctgcctcagcctcctgagtaactgggactacaggcatgcrccaccacacccagctaattttttttttttttttttagtagagacggggtttcaccatgttggccaggatggtctcgatctcctgacctcatgatccgccg

SEQ ID NO: 38688 - DNA, 201 bp, Homo sapiens
ctggagtgcaatggcgccatcttggctcactgcaacctccatctcctggattcaagctattctcctgcctcagcctcctgagtaactgggactacaggcakgcgccaccacacccagctaattttttttttttttttttagtagagacggggtttcaccatgttggccaggatggtctcgatctcctgacctcatgatccg

SEQ ID NO: 38689 - DNA, 201 bp, Homo sapiens
gaaaatcaagtaaatccaattactaaggcaaatggggaaaatagttctctggagatgttaacgtctccagctgatactgcttccttctttacttccctggraggctgtttcctaatacctttttttttcttaacatccattactgttactgtgttcaaggtgattcaaaatggatggaggaatacatatatttctgacatg

SEQ ID NO: 38690 - DNA, 201 bp, Homo sapiens
aaaatgtccttgtgaaaactgcattgtacatagtcccagtaattggcctcctgccaactccagacgggaaaaaaacaaacaaaaaaaaaacaaaaaaaaaacagtttttatatctaagagaagaggaatcctgaaaggctaaaaaaagctaataaatggatttattatctaaacttcaggaaaataaaatgttaataacaa

SEQ ID NO: 38691 - DNA, 201 bp, Homo sapiens
aatccagcacaaaatgtccttgtgaaaactgcattgtacatagtcccagtaattggcctcctgccaactccagacgggaaaaaaacaaacaaaaaaaaaamaaaaaaaaaacagtttttatatctaagagaagaggaatcctgaaaggctaaaaaaagctaataaatggatttattatctaaacttcaggaaaataaaatg

SEQ ID NO: 38692 - DNA, 201 bp, Homo sapiens
agcagatgccattgagtacatataggcccaagtcttggatatgctacgtgtttctcccacggattttgattctaaattaataaacacgtttagccatgggrgcgcatgttgagaagtttcatgagcctcgtattttctgccattggacgtagatatttataaggtttcgatttttgagaatatcctcctactccgtatgtt

SEQ ID NO: 38693 - DNA, 201 bp, Homo sapiens
gcagagtctgtgtcctgcttggtccacaaccccgtcctcactgaggagaaggggtcggtcatcagcctcccaggtcagtgctctgcctctaggacccacaygctcagatcagcaggagaggtcccagggactgcaccatagcacctcgtatttttatcaagagacattatctatcatatagcaatatgtattgaaagccat

SEQ ID NO: 38694 - DNA, 201 bp, Homo sapiens
cccaggtcagtgctctgcctctaggacccacatgctcagatcagcaggagaggtcccagggactgcaccatagcacctcgtatttttatcaagagacattrtctatcatatagcaatatgtattgaaagccataaaacatttatgactggaaatatacgcactacattttacttgaatagctgttatggcgcctgcgttat

SEQ ID NO: 38695 - DNA, 201 bp, Homo sapiens
agaggtcccagggactgcaccatagcacctcgtatttttatcaagagacattatctatcatatagcaatatgtattgaaagccataaaacatttatgactrgaaatatacgcactacattttacttgaatagctgttatggcgcctgcgttatttttgagttctacctttccttcttctgcattgattgtttttactcaca

SEQ ID NO: 38696 - DNA, 201 bp, Homo sapiens
acgattttaccaggtcctatgttcattaaataccagaggagaccagcaaagtaatggcctcattcaaggaggttgcagctgtgttacctgacactttgggrgctcatggagattccagtgagcatcagatggacacctataggaagcatggcatcatctctgttctatgtgttgaggggaaagggagctgcctcagaatgt

SEQ ID NO: 38697 - DNA, 201 bp, Homo sapiens
ttttttaatgaattgagcttccctatataatgtataaattgctttcttttttaaaaaatagtttctctcctttcccttacaccaaattccttaatatgttrttcttgttctttttccagagaaactccagactgagctgggtaagtacgaggtgctggcacacacctgtggagggagcctctgccctccccagcagaggga

SEQ ID NO: 38698 - DNA, 201 bp, Homo sapiens
tgcacccagcctaatttttgttttttaaatctcggagttggactgagggtattattttgctgcacctgagataagtggtttaaaacataaccagccgatgkctgagcccctttgagtttcccctttacctccttactagctccctcctttttatggcctcttctcccagcccaaggcaaccagcctgcctccctgcctagg

SEQ ID NO: 38699 - DNA, 201 bp, Homo sapiens
taatccagcacaaaatgtccttgtgaaaactgcattgtacatagtcccagtaattggcctcctgccaactccagacgggaaaaaaacaaacaaaaaaaaaacaaaaaaaaaacagtttttatatctaagagaagaggaatcctgaaaggctaaaaaaagctaataaatggatttattatctaaacttcaggaaaataaaat

SEQ ID NO: 38700 - DNA, 201 bp, Homo sapiens
agaagaaagggactttggaaatctcactagctgaattttgacgtcaaaatgttgcaccttgaaaaataattatttaaaaattcagtgtcaaaaaaaaaaaatcagtgtcagaaggagatgtcagagccctaaggaaaatgcagcatggcgaagtgggaaaaaacacgacacagagcatcagagggcgcaggctctgcctcg

SEQ ID NO: 38701 - DNA, 201 bp, Homo sapiens
gtgattccttatgttccttcaggtttggaaaataaatatgaagaccaactcagacttactcattgtattgctcttcttcctttgtgatttttatttgctgmtctctgacgaggtctcctgctatcctctgcaaagctggttttcaggacacccagggattctactcctctgagtttctctctgacaccctcaactagcgcc

SEQ ID NO: 38702 - DNA, 201 bp, Homo sapiens
ttgtttgtttgtttttaaagtctcgctttgtcacccagcctggagtgcagtggcatgatctcagctcactgcaacctctgcctcccgggttcgagcaattyttccacctcagcctcctgagtagctgggattacaggcacccaccatcatgcccgactaatttttgtatttctgtagagacggggtttcaccatgttggcc

SEQ ID NO: 38703 - DNA, 201 bp, Homo sapiens
gaaaataaagctatatttcttcaactgaaatgttttcctatgctgtcttgtgctgattacttctagaaatctatcatatgaagataatcagagatgtagamaactatttgcataatagaatattaattatggccttatttataaatagcagcaaaaacaaccaaccccccaatacaacagtacagtgtggaatcttgtctt

SEQ ID NO: 38704 - DNA, 201 bp, Homo sapiens
gaccctgagcctcacagcaaccctgggatgctcatggtttctaaactccaatggagctgttcttagagatgacattattggttccattttgattctttcaytgtgttttgtccactctatttaacagcttctttaaaagtgaatggaccttcccagcccatcctcgtcagagtgggagaagatatacagctaacctgttac

SEQ ID NO: 38705 - DNA, 201 bp, Homo sapiens
ctctttccatcaattccttgctctccatcaagtcacctgctccaggaatgtgtatccatgtgtgtgctttaggtgagcttaagcacacctttcagcccacraaagagtttttgaggaaaatcagggtaacaaacacaacccaatctctaccagagtctactatggcaccttcaaccccattaggccataaacataaaggga

SEQ ID NO: 38706 - DNA, 201 bp, Homo sapiens
tatggcaccttcaaccccattaggccataaacataaagggaagggtccctggaaggcgcaaagtaactccacaatctgaggagagacacacacctgtgtaycttacccttctgagatcaggaagtaaagccagtgtttggggcaggttgacacaagtctgtctctcaagaaggttttaggagaagagtcactcctctgagt

SEQ ID NO: 38707 - DNA, 201 bp, Homo sapiens; identical to SEQ ID NO: 10407

SEQ ID NO: 38708 - DNA, 201 bp, Homo sapiens
gagagacacacacctgtgtatcttacccttctgagatcaggaagtaaagccagtgtttggggcaggttgacacaagtctgtctctcaagaaggttttaggrgaagagtcactcctctgagttctctgagacccactggagacccagcacacacaatacgaccccatgtcctgttgttcctaagtcatggtaacctccgggg

SEQ ID NO: 38709 - DNA, 201 bp, Homo sapiens; identical to SEQ ID NO: 10410

SEQ ID NO: 38710 - DNA, 201 bp, Homo sapiens
gtgtttggggcaggttgacacaagtctgtctctcaagaaggttttaggagaagagtcactcctctgagttctctgagacccactggagacccagcacacamaatacgaccccatgtcctgttgttcctaagtcatggtaacctccggggccacaattaaccaacacggaaagatggagcttccctttgcttcctgtcaggt

SEQ ID NO: 38711 - DNA, 201 bp, Homo sapiens; identical to SEQ ID NO: 10411

SEQ ID NO: 38712 - DNA, 201 bp, Homo sapiens
cacaagtctgtctctcaagaaggttttaggagaagagtcactcctctgagttctctgagacccactggagacccagcacacacaatacgaccccatgtccwgttgttcctaagtcatggtaacctccggggccacaattaaccaacacggaaagatggagcttccctttgcttcctgtcaggtgggagaggagggctctgg

SEQ ID NO: 38713 - DNA, 201 bp, Homo sapiens
tgagacccactggagacccagcacacacaatacgaccccatgtcctgttgttcctaagtcatggtaacctccggggccacaattaaccaacacggaaagayggagcttccctttgcttcctgtcaggtgggagaggagggctctgggcacggaagctttgcaggtgagctctaatgatgggacacccagctctctatggaa

SEQ ID NO: 38714 - DNA, 201 bp, Homo sapiens
ttcagtgtacttcacgctccagaagggaattaatttttcagtggatattcagaaggcattcagaacatacaaacaataaccaaaacaaaacaaagcaatayatttcagcacaaaattgtctggaaggctgtgtacaaaaccgtatagaaaaaggaggttaactactgcatgttcacacttataagggggagctgattggtg

SEQ ID NO: 38715 - DNA, 201 bp, Homo sapiens; identical to SEQ ID NO: 10414

SEQ ID NO: 38716 - DNA, 201 bp, Homo sapiens
tgaaaggaccccaggctttggttgctttctctgccccaggtctgggttcttccccactgatcactgtggaggggcaagaagatggagaaatgcagccgatrtgctcttcagatgggtggttcccacagccccacgtgccatggagggacatggaaggaaagacgataccatcatcttcccaggccctgactcaaggcagcc

SEQ ID NO: 38717 - DNA, 201 bp, Homo sapiens
caaaattattttattattggtctgtaaactgaaaaaaatacaggtagaagcaggtagggattcaattactgttttactcagactgacacacatcatggaaygattcctccttaaagaagagcaacctctattctgagtccatgaaacccccacctcacctaaggatgaccctgagcctcacagcaaccctgggatgctcat

SEQ ID NO: 38718 - DNA, 201 bp, Homo sapiens
cacttgaaaggaccccaggctttggttgctttctctgccccaggtctgggttcttccccactgatcactgtggaggggcaagaagatggagaaatgcagcygatgtgctcttcagatgggtggttcccacagccccacgtgccatggagggacatggaaggaaagacgataccatcatcttcccaggccctgactcaaggc

SEQ ID NO: 38719 - DNA, 201 bp, Homo sapiens; identical to SEQ ID NO: 10419

SEQ ID NO: 38720 - DNA, 201 bp, Homo sapiens
ttttctctctcaggttggtgattccttatgttccttcaggtttggaaaataaatatgaagaccaactcagacttactcattgtattgctcttcttcctttktgatttttatttgctgctctctgacgaggtctcctgctatcctctgcaaagctggttttcaggacacccagggattctactcctctgagtttctctctga

SEQ ID NO: 38721 - DNA, 201 bp, Homo sapiens
gcgaggagaaaatcgcaactttttctctctcaggttggtgattccttatgttccttcaggtttggaaaataaatatgaagaccaactcagacttactcatygtattgctcttcttcctttgtgatttttatttgctgctctctgacgaggtctcctgctatcctctgcaaagctggttttcaggacacccagggattctac

SEQ ID NO: 38722 - DNA, 201 bp, Homo sapiens
ctgcctttttgaaaaagatgatgtctaccaggaggccagtttggatctgaaggtggtaggtaagaattctagatagatattttgtattcaatacctgctcytgccactttaatatgctagttcctggacaatttctctgacatttgaaattttcttaatgcttattcatcatcaaatttatatcaaatcctccagtgtgtg

SEQ ID NO: 38723 - DNA, 201 bp, Homo sapiens
ggggccacaggaaaggccggatggatggaggtagggagcctcctggagaagggccattggaccagagtcctacctgaagtgccaatactgatgccacaagyttcatcgtcccgacactcggtgggaacagggtggcagggtttggtgaagccacagatgtagcagcggagccttccccgggcaggggacatggtgagacct

SEQ ID NO: 38724 - DNA, 201 bp, Homo sapiens; identical to SEQ ID NO: 10459

SEQ ID NO: 38725 - DNA, 201 bp, Homo sapiens
tggctgtttggtctagcaagcacagagcaggtgagtgatgcagggaaaatggaaagtgggcggcaggtaagggtagagctgttgctttgtgaaaggcccaygccctacatatcttccatcactccaccccgtttggaggtgagtcaagagggacagaactatgaagaaaaacatggggctggagatagatggaatgtgagg

SEQ ID NO: 38726 - DNA, 201 bp, Homo sapiens
tcctccccctccctccccatgtctcaagctgctccctggctctctcagcttctctctgtctttgttttctctgtctttccccctcagtgctttcatgtctstcaaagtcaccctcctaaacagccccggcgtggatctgtttgagtgtagaatcaacaatacccccacccacacacccacatgcacacacaaagcccagct

SEQ ID NO: 38727 - DNA, 201 bp, Homo sapiens
ggtcttcttataataaatgtacattttatcagactcagacatttattactcaaaatggaaagaggtgagtatgggggatggggtacatatgggagcctggrtttggggagtcagctctgtacagtgaggtcatcaggtccttgtgggagccttcactggggacaacacagaagccccatttcaggcccagatcccaatccc

SEQ ID NO: 38728 - DNA, 201 bp, Homo sapiens
aggtaaggaagacaaggcccagggctggagtgggccggggtcctgcgctgttgcagttgtccttgttgcagcaggtggtgttatatgtcagacccagcttrcggttggtttggttgaaggcctcctgacagggctcttctggtgtgccacagcgcagattggagaaaacccacatcttacctaggggtgggaatgggcagg

SEQ ID NO: 38729 - DNA, 201 bp, Homo sapiens
aggcagagggtccgtggggctccaggcagaggtgagtccctccctccccggggaaagaagagggcacatgggtgggaggcaaagggctaggctcacacccygcctctgtaccccacctcctctaggggagggggcgaggaacacggctctaagttgtctgctgacttctcttctgtatccctgatggctccttctccccag

SEQ ID NO: 38730 - DNA, 201 bp, Homo sapiens
atggaggtctctggcctcatacaaccctcttcccacagacaacatgcaggccatctatgtggccttgggggaggcagtagagctgccatgtccctcaccayctactctacatggggacgaacacctgtcatggttctgcagccctgcagcaggctccttcaccaccctggtagcccaagtccaagtgggcaggccagcccc

SEQ ID NO: 38731 - DNA, 201 bp, Homo sapiens
caagatcttttctctaaaattaaataaaatcatttttagattaaacaaaaattacgtgccggatgcagtggctcacgcctgtaatcccagcactttgggargccaaggcgggtggataacctgaggtcgggagttcaagaccagcctgatcaatgtggagaaatctcgtctctactaaaaatacaaaattagccgggtgta

SEQ ID NO: 38732 - DNA, 201 bp, Homo sapiens
acaaaggggtcagctttagcctggcaggtaaactgaggaaggagacggaaagggatgttctttcacttcagcctcccaagtagctggaattacaggcgccygccaccatgcctggataattttttgtacttttagtagagacgagatttcaccattttggccaggctggtatcaacctcctgacttctagtgatctgcctg

SEQ ID NO: 38733 - DNA, 201 bp, Homo sapiens
cacctgtggcgagggcagaccccagccaggcctggaacagatcaagctacctggaaaccgtgagtcctcagtttctccctcttccagcagcctttccctgyctccagccccatgtcaatccttctggcttccagaaccctccaggctcagtctggctctgggcagatggtgcagctgttagaggagagcagtctgtacccc

SEQ ID NO: 38734 - DNA, 201 bp, Homo sapiens; identical to SEQ ID NO: 10457

SEQ ID NO: 38735 - DNA, 201 bp, Homo sapiens
tccctggctctctcagcttctctctgtctttgttttctctgtctttccccctcagtgctttcatgtctctcaaagtcaccctcctaaacagccccggcgtrgatctgtttgagtgtagaatcaacaatacccccacccacacacccacatgcacacacaaagcccagctgtgtaagggcggaccccacccagcttcagatc

SEQ ID NO: 38736 - DNA, 201 bp, Homo sapiens
ggggtacagggattgagagatgcgcagacatgaacagaagccacaagaatcagagaccaacataaaaagagtgagacaaaaagccagacccagcagcaggraagttgagggggtcagtgaaaaagttaagtaaatggcaccagagacagataggaaaatagaaattgacattgaccaaagggcccagcacagaagcaacac

SEQ ID NO: 38737 - DNA, 201 bp, Homo sapiens
gagggcactgggcccttgagaggcagctttttcactcagtgatctcactctggtctgtgggatgaaagaggcatgctgaggcgggggccacaggaaaggcyggatggatggaggtagggagcctcctggagaagggccattggaccagagtcctacctgaagtgccaatactgatgccacaagcttcatcgtcccgacact

SEQ ID NO: 38738 - DNA, 201 bp, Homo sapiens
atgccttggattctgatgctgctgctcacaatgggccagggagttgtcatcctggccctcagcatcgtgctctggaggcagagggtccgtggggctccagrcagaggtgagtccctccctccccggggaaagaagagggcacatgggtgggaggcaaagggctaggctcacaccccgcctctgtaccccacctcctctagg

SEQ ID NO: 38739 - DNA, 201 bp, Homo sapiens
atataaggcaggcagagccgggctggggaggggggtgggcaggaggtagaggcggtcctgacacgggcagactgcgatgaaaccccagtttgttgggatcktgctcagctccctgctaggggctgccttgggtaaggaggcggccagctagcttctcacacaggccttctgccagccggctccaccgagggcccaggtcca

SEQ ID NO: 38740 - DNA, 201 bp, Homo sapiens
agtactgtggggttgaggggagcctgaggttgctggtgggggcaaggaggatgggtgtgcacagggaggagacaggaatctggagacttgagcaatggtgrggaatccattgcagtggagctgaaggacaaatggggaaaacgggggaagagagagaagggaagagactcaagtcagagaaagtggaaagagatggacaga

SEQ ID NO: 38741 - DNA, 201 bp, Homo sapiens
tctcttgccaggactgtggagcggatagggggagtaggagtagagaagggaacaagggagcaagggaacaagggacatctgaacatctaatgtgagaagasaaacatccttctgtgagtcattaaaatctatgaaccactctacagctgactggaaaattacatctatctttggttgatgggagggctaaaagcgtaatat

SEQ ID NO: 38742 - DNA, 201 bp, Homo sapiens
cataggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaatactca

SEQ ID NO: 38743 - DNA, 201 bp, Homo sapiens
ccctggaaaaccaggaagggaatccaggctcagactgctggggaactattctttgtggttggagggatccaaagaggaagatgccgggcggtactggtgcrctgtgctaggtcagcaccacaactaccagaactggagggtgtacgacgtcttggtgctcaaaggtgagtgggggcatgcagaccaggggctactgtggcc

SEQ ID NO: 38744 - DNA, 201 bp, Homo sapiens
ggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaatactcaactt

SEQ ID NO: 38745 - DNA, 201 bp, Homo sapiens
taggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaatactcaac

SEQ ID NO: 38746 - DNA, 201 bp, Homo sapiens
taaaaatacaaaattagccgggtatggtggcacatgcctctaaccccagctactcgggaggctgaggcaggagaatcacttgaacctgggaggtggagggygcagtgagccaagatcacgccattgcactccagcctgggcaacaagagcgaagctctatctcaaaaaaaaaattgtatttttagtagagacggggtttca

SEQ ID NO: 38747 - DNA, 201 bp, Homo sapiens
cctcttgggttcaagctattctcccatctcagcctcctgagtagctggactacaggtgcctgccaccacgcctggctaacttttgtgtgtgtgtgtgtgtktttttttgttttttttttgagacagagtctctctctgtcgccaggctggagtgcagtggcgcaatcccggctcactgcaacctctgactccctggttcaa

SEQ ID NO: 38748 - DNA, 201 bp, Homo sapiens
cctgaagtgccaatactgatgccacaagcttcatcgtcccgacactcggtgggaacagggtggcagggtttggtgaagccacagatgtagcagcggagccytccccgggcaggggacatggtgagacctgttgaggcagcagagattaggagagcaggagaggcaaaccctccctgtggggcaggcagaggccagatccgg

SEQ ID NO: 38749 - DNA, 201 bp, Homo sapiens
atctcataggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaata

SEQ ID NO: 38750 - DNA, 201 bp, Homo sapiens
ctcataggcccattagctcacaaatgaagagctctggccctgaaaggccaaagttaaaaccaaacttcaaattttcggcattagttaaggaccagggaggggtgtgtgtgtgtgtgtgtgtgtgtgtgtgtgtgtgtgtacatgtttttaatattttattttaacataattttggattgacagaaaagttgcagaaatact

SEQ ID NO: 38751 - DNA, 201 bp, Homo sapiens
cccagccatcatttatttatttatttattttttgagaccgagtcttgctctgccacccaggctggagtgcagtggcgtgatctcggttcactgcaacctcygcctcttgggatcaagctattttccttcctcagcctcctaagtagctgggattacaagcacgcgccaccacacctggctaatttttatagttttagtaga

SEQ ID NO: 38752 - DNA, 201 bp, Homo sapiens
ccatgtgctgtggtgactgaccaccacgccctaagatttactccagaattcccctccacaaagcaccatcctttttatcctttttttttttttttttttttgagatggagttttgttctttttgcccaggctggagtacagtggcacgatctcggctcactgcaacctccgcctcccaggttcaagcgattctcctgcctc

SEQ ID NO: 38753 - DNA, 201 bp, Homo sapiens
gtctccatggagctaggcctcacctttctccctccctggcaggtttcctggaagtggcggatgaggccacgggcgccctggcatcggcggtgtcgggctaygtgcaggccctggccagcgcaggtgtggtggctgttctggccctgggggctcccgccccccagggttgcgctgtggctctggcttctgatcgctgctcca

SEQ ID NO: 38754 - DNA, 201 bp, Homo sapiens
gctcccagccaccgaggggaggcatcaacaaggacagcacatccccaggcttctcccctcaccacatgctgcacctccaggctgcaaaactggcccttctrgcctccatccaggccttcagccttctgcgaagccgcctgggagacagggatttctccaggtgagtggcctcctggggatggaccccttcatggggaggcg

SEQ ID NO: 38755 - DNA, 201 bp, Homo sapiens
gtgcagtggcgtgatctcggttcactgcaacctccgcctcttgggatcaagctattttccttcctcagcctcctaagtagctgggattacaagcacgcgcsaccacacctggctaatttttatagttttagtagaaacagagcttcaccatgttggccaggctggtcttgaactcctgatctcagatgatctgccggcctc

SEQ ID NO: 38756 - DNA, 201 bp, Homo sapiens
agctgaaaaggtttgggtgggtggggataaaggctgggggtggcagaatcttgggttctagccctgccctctcttcccagtggccgatcctacctgctccrattgcgaggagttgagctgccccaggaattggctgggcttcacactcctcacctctggctactttggaactcatcccccgaaacctccaggtaccagaca

SEQ ID NO: 38757 - DNA, 201 bp, Homo sapiens
acactcctcacctctggctactttggaactcatcccccgaaacctccaggtaccagacaagaaagttccccagaagtaaggggagaaagtcattcccttayaggatctctgtcctgtaggcccgtatgcctttgctatggcatctcctcctaggaggagaggatgctgggaacagggtgggtggaggaaagtcccctgagg

SEQ ID NO: 38758 - DNA, 201 bp, Homo sapiens; identical to SEQ ID NO: 10481

SEQ ID NO: 38759 - DNA, 201 bp, Homo sapiens
ctagtccaacttcccaaaagtctaaactgaaaacaataaactcaccttctcatgaatcagattctgcaaacagatgttcaccttttgaatctgggctaacrgggggcgaccaggctctgagtgtaaatctgttagaaaattctagaggaggagttggaggctgacaacatggtgaaaacctgaggtcgtctgccactctat

SEQ ID NO: 38760 - DNA, 201 bp, Homo sapiens
gctcggcgtgagatcttgtcccctctgcgttttgagccatacaaagcagtggccctggcctcaggaggagaggtgatcttcaccaaagaccagcacattcragacgtggcagccattgttggggagagcatggctgccctggtaagtgggggccagggccctcacttaggaactgaagggtggtcaggctgcacctctctt

SEQ ID NO: 38761 - DNA, 201 bp, Homo sapiens
cccagttttatatatatatataaaatatataatatataatatatatattatatatataatgtatatatgtatacatacatctgtgcatatgcataacttttatattgagttataatttacataatgtgcactaaagtgtacagtttgatggatttcatataatacacccagttcaggatatagaacatttccagcacccca

SEQ ID NO: 38762 - DNA, 201 bp, Homo sapiens
ccccatggaggatggaccccaccctggcctctaccccctgactcagccagttgcaggtacatttattccctgagcccccacccacctaacccccagttttwtatatatatataaaatatataatatataatatatatattatatatataatgtatatatgtatacatacatctgtgcatatgcataacttttatattgagt

SEQ ID NO: 38763 - DNA, 201 bp, Homo sapiens
cccccaccctgttgaggccttcctccccctctgctgagcctcggttaattataactctgacctaagtgccctgtgacgtcaagcccgggccagccctgcccaggagacccagcaaccaggtaggggagggcctgagaggactcaggcttcctgagcatggggagtgtttctgcggcagggctggggacgcagccagggact

SEQ ID NO: 38764 - DNA, 201 bp, Homo sapiens
ctcttccttttccccacaggaccggcacaccacccctaccggctcatctgacccgatcctcaccacggccacccctgccttttcccccttcacattggtgrctcaaggcagggctggggcagggctggctgcgggcagcccctggtggggcacagttggaggggtgctgcttctgctaggcctggcctcctggtgacacaa

SEQ ID NO: 38765 - DNA, 201 bp, Homo sapiens
gaagtttctcttcctcttagatccatgactagccacttctttttttttttttgagatggagtcttatggtcacccaggttggagtgcagtggcacaatctyggctcattgcaacctccacctcccgggttcaagggattctcctgcctcagcctcccaagtcgctagagttaccagtgcccaccaccaggcctggctaatt

SEQ ID NO: 38766 - DNA, 201 bp, Homo sapiens
aattaataaaaattatgtgtgggtgtggtggcacatgcctatagtcccagctacttgggaagctgaggcaggaggatcacttgagcccaggagactgaggytgcagtgagccgtgatggcactactgcactccagagcggcctgggtgacgcagtgagaccctgtctctaaaaaaaaaaaaaaagataactagcagacttg

SEQ ID NO: 38767 - DNA, 201 bp, Homo sapiens
aaaatacaaaattagccgggcgtggtggtgggcacctataatcccagctactcgggaggctgaggcaggagaatcgcttgaacccaggaggcagaggttgyggtgagccccgagatcgtgcctttgcactccagcctgggcaacaagagcaaaaagctctgtcacaaaaaaaaaaaaaaaaaaaaaaaaaaaaaagaaaag

SEQ ID NO: 38768 - DNA, 201 bp, Homo sapiens
ccgtcaccactgcccagtacagcttctggctctatgagctctgtgatgtctacttggtgagaaggagcacagcggggcaggggatggtgggggcaggtggscagcagagccctgggctcagttttgccagagttggccttgagacctaagccaacccatccccttcccagtcctcacaggcacagcgagggctcaaggcta

SEQ ID NO: 38769 - DNA, 201 bp, Homo sapiens
tcacctgtttgaggtatatgctcttccctgatgagttgggtccagtgatgactttgaccctccctttgtccccaccacattctgtggagttgggcacaaargttcgggcacagagttccatcagaggatgtctgcagtgggcggagaggcacctcgcatggcttgtggatcaagatagatgaacccccagaagatgtagcc

SEQ ID NO: 38770 - DNA, 201 bp, Homo sapiens; identical to SEQ ID NO: 10484

SEQ ID NO: 38771 - DNA, 201 bp, Homo sapiens
aaggggagaagagttgcaggagaagatgcagagagggtaaagacactggggccatatacgcacttttccatttggttcttctttagcaaatccttgacagrcttgatgggttttccactgcggatcaagtctgagacctaggaacaagcaagaaggtgggaggagtaaggggagtggggaagagaaggggaaataagggtc

SEQ ID NO: 38772 - DNA, 201 bp, Homo sapiens
gaggtgtctcgtgccaatgcagcccaggacttcctgccaacttccaggaatgaccccgacctgcactttgatgctgagcgactgggtcagggacgcgcgcrcctggtaggggctctgcgggagaccgtggtggcagccagggcccttgaccacaccctggctcgccagcgcctcggggctgcacttcatgccctgcaggtg

SEQ ID NO: 38773 - DNA, 201 bp, Homo sapiens
cccttggagcccgtgggacctccggagcgaggtctcctcgcagcctcgctgtcgcccacgctgctgtccacccctagacccttctccctggagctgattgkccaggacgcagcggggcggcgcctgcacagggctgcccctcagcctagcactgtagtccctgtccttctggaggtgagacgccaggggaaagtgcggctg

SEQ ID NO: 38774 - DNA, 201 bp, Homo sapiens
gtgaagatcacccccgcacatgaccaaaatgactatgaagttgggcagcggcacgggctggaggccatcagcatcatggactcccggggggccctcatcartgtgcctccgcctttcctggtgaggctgcctgaggcaagagtgcccgggtcagggagatggagggatggctgggcatcgccatgatgaggcctcattcct

SEQ ID NO: 38775 - DNA, 201 bp, Homo sapiens
cctccccacctgctctgcaggtctacctccatgccatcgtgcgagatgctcacggccggaagatgagcaagtctctaggcaatgtcatcgatcccctggaygtcatctatggaatctccctgcaggtgggctgggtgctgggccagccaggaagggccgtggggctgtggtcacagccacctgactgctcccactccaccc

SEQ ID NO: 38776 - DNA, 201 bp, Homo sapiens
agcgacgcctatatcctctctccagggctcacctggaactgaatgagtcggcctggggccgcctgtggctggaggtcccagattcagcggccccggattcygtggtgatggtgactgtgactgcagggggacgagaagccaacccagtacccccgactcatgctttcctccggctcctggtatcggccccagccccgcagg

SEQ ID NO: 38777 - DNA, 201 bp, Homo sapiens
ggctggggctggagagagttagagcggccccttccctgaagaacccttctctgcagcttagtggcccctcgggtttcttggccccgggcagcaaagtcccrctcagtctccgcatcgccagcttctcgggccctcaggatcttgaccttaggactttcgtcaaccccagcttctccctcacctccaacctctccaggtgag

SEQ ID NO: 38778 - DNA, 201 bp, Homo sapiens
aagcccggaggccatgagagcctggtggaccgctggatccgcagccgcctgacagaggctgtgaggctcagcaatcaaggcttccaggcctacgacttccyggccgtcaccactgcccagtacagcttctggctctatgagctctgtgatgtctacttggtgagaaggagcacagcggggcaggggatggtgggggcaggt

SEQ ID NO: 38779 - DNA, 201 bp, Homo sapiens
tccggagcgaggtctcctcgcagcctcgctgtcgcccacgctgctgtccacccctagacccttctccctggagctgattggccaggacgcagcggggcggygcctgcacagggctgcccctcagcctagcactgtagtccctgtccttctggaggtgagacgccaggggaaagtgcggctggggctggagagagttagagc

SEQ ID NO: 38780 - DNA, 201 bp, Homo sapiens; identical to SEQ ID NO: 10478

SEQ ID NO: 38781 - DNA, 201 bp, Homo sapiens
ggtgactgtgactgcagggggacgagaagccaacccagtacccccgactcatgctttcctccggctcctggtatcggccccagccccgcaggtgaggaacyactactttccatcacagggtgggcaaggccggggagggtggtgtaggtttaatttgagtacagctctagcacaccctgtcattctcttccttttccccac

SEQ ID NO: 38782 - DNA, 201 bp, Homo sapiens
gagatgtgcctgtcagccctgcaggtctggcccctcccttcttccccgtttcctggccccaccaccagggggagctagatccctcctggggctccccaccwccttcagcacctagatccactagcttcactgtagggttcccgggccatattcccttctgcttcatcctccgtggctctacccattcccctcctactgcca

SEQ ID NO: 38783 - DNA, 201 bp, Homo sapiens
ttcactgtgttggccaggctggtctcgaactcttgaccttgtgatccacccgcctcagcctcccaaagtgctgggattacaggcgtgaccaactgcgcccrgcccaatgacgtggtttctttctatctcccctttcttctttgttcctcatcccatacctcatcttcttccccattttctggtcctgccaatccctcaagg

SEQ ID NO: 38784 - DNA, 201 bp, Homo sapiens
ccaccagggacacctaggtctgccctgccctgccccgccctgccccgccctgcactgacaagtatgactttttttttttttttttgagatagagtctgtckccagactggagtgcagcggcacgatctcggctcactgcaacctctgcctcccgggttcaagtgattctcctgcctcagcctccccagtagctggggaggc

SEQ ID NO: 38785 - DNA, 201 bp, Homo sapiens
tgtggcgcaggctgctctgcccgccttagcctcctaaagtgctgggattacagtcgtgagccaccgcacccagcctgtgctgtgttttccagcacagcccyagtttcaaacattcaggctcactgcgggcccatgatcctaggttttagttcagaaagctttgctagggaacttctgggtgttcgcctcatcccagctggg

SEQ ID NO: 38786 - DNA, 201 bp, Homo sapiens
cctcccccaaggatgcctttctcaccaaccaggtggaatccctgactcaggagcggcgctgccgggtgagcagagctagtgggagacccagtgttagcctyccagggatgtgagagaccctgtgatgacaatctcataacgagggttgcaccacactatggtggcccaacaagccttggtatatggtgggagaagcagaca

SEQ ID NO: 38787 - DNA, 201 bp, Homo sapiens
agtggaggccaccttcccaccagggacacctaggtctgccctgccctgccccgccctgccccgccctgcactgacaagtatgactttttttttttttttttgagatagagtctgtcgccagactggagtgcagcggcacgatctcggctcactgcaacctctgcctcccgggttcaagtgattctcctgcctcagcctccc

SEQ ID NO: 38788 - DNA, 201 bp, Homo sapiens
cacactcctcacctctggctactttggaactcatcccccgaaacctccaggtaccagacaagaaagttccccagaagtaaggggagaaagtcattcccttrcaggatctctgtcctgtaggcccgtatgcctttgctatggcatctcctcctaggaggagaggatgctgggaacagggtgggtggaggaaagtcccctgag

SEQ ID NO: 38789 - DNA, 201 bp, Homo sapiens
cggaatccggggccgctgaatctgggacctccagccacaggcggccccaggccgactcattcagttccaggtgagccctggagagaggatataggcgtcgmtaaagctccaggctgcccagagcctagagtcgggacgcctgcaggggcacgggagcggagaggaggattctgagggccagtcggagggggacaggggcag

SEQ ID NO: 38790 - DNA, 201 bp, Homo sapiens
gggtgggtggaggaaagtcccctgaggaggctgtggtggggttgaggtaggggagcaacttcttcctccgctgataggatttctcccttgtcataggcagytttgggggactggctggagggatcaggggatccaccatgtgctgtggtgactgaccaccacgccctaagatttactccagaattcccctccacaaagcac

SEQ ID NO: 38791 - DNA, 201 bp, Homo sapiens
agccaatccccacctctgggaaatgcccagcctgggggtccccgaggagctagattggtctcctcaccaaatactgcaccaggggcccttgtggcagcagytgtagctgaacaaggctcagaaagttggtggccacaaagatgtgggggcatgtgggtccacgtgccagccagtgtcggagcacagcggccagaagcgcga

SEQ ID NO: 38792 - DNA, 201 bp, Homo sapiens
aagttgaatggaaatataaagggcagatctattgagagagttcccctgggacctcttgttgggctgatactcacccaaaggaagaagctctgggcccctgrgtcttggcggcttgtccccagcggcagcagcaggactgtgtagggagcctgcaccaagggcaccccgccagagccctggctccccatggctctgaggtgg

SEQ ID NO: 38793 - DNA, 201 bp, Homo sapiens
ctcacgggcaggctgccctttagagaggtgcggagacagccgagaccctcccatcgcccccagcctcctctcctaccgtcctgtgctgcagcgcagacccygcgtggctggggcatggggttagctgtgggcaggcctgacccgggggctggtgtggggttgaaatccagcctgggccctgctcagtgattcctgtgccca

SEQ ID NO: 38794 - DNA, 201 bp, Homo sapiens
cacccccgcacatgaccaaaatgactatgaagttgggcagcggcacgggctggaggccatcagcatcatggactcccggggggccctcatcaatgtgcctycgcctttcctggtgaggctgcctgaggcaagagtgcccgggtcagggagatggagggatggctgggcatcgccatgatgaggcctcattcctacccaggg

SEQ ID NO: 38795 - DNA, 201 bp, Homo sapiens
ggccaccttcccaccagggacacctaggtctgccctgccctgccccgccctgccccgccctgcactgacaagtatgactttttttttttttttttgagatrgagtctgtcgccagactggagtgcagcggcacgatctcggctcactgcaacctctgcctcccgggttcaagtgattctcctgcctcagcctccccagtag

SEQ ID NO: 38796 - DNA, 201 bp, Homo sapiens
cacgcctcctctgagctactgacctcccatggtcctcgctcatctttccaactttgttgtcctgggtgtttgggggtctcttcacttggacctgggtcctyacccaccccctggttccactccagctccaacagacagaagcagagctcaggaaggtggatgaggccatcgccctattccagaagatgctgtgatccacca

SEQ ID NO: 38797 - DNA, 201 bp, Homo sapiens
gagtttgagaccagcctgactaatatggagaaaccccgtctctactaaaaatacaaaattagccgggcgtggtggtgggcacctataatcccagctactcsggaggctgaggcaggagaatcgcttgaacccaggaggcagaggttgtggtgagccccgagatcgtgcctttgcactccagcctgggcaacaagagcaaaa

SEQ ID NO: 38798 - DNA, 201 bp, Homo sapiens
gggtttcatcatgttggccaggcttgtctcaaactcctgacttcaggtgatccacccacctcagcctcccaaaatgctgggattactggtgtgagccaccrtgcccagccatcatttatttatttatttattttttgagaccgagtcttgctctgccacccaggctggagtgcagtggcgtgatctcggttcactgcaacc

SEQ ID NO: 38799 - DNA, 201 bp, Homo sapiens
tgtggtggctgttctggccctgggggctcccgccccccagggttgcgctgtggctctggcttctgatcgctgctccatccacctgcagcttcaggggctgrtggaccctgcacgggagctgggcaagctgcaagccaagcgagttgaggcccagcggcaggcccagcgtctgcgggaacgccgtgctgcctcgggctatcc

SEQ ID NO: 38800 - DNA, 201 bp, Homo sapiens
cctgcatctttcccttcctcaggaaggagtctcgagggggcccttcccgccggggtgtggccctgcttcgcccagagcccctgcaccgggggacagcagayaccctcctcaaccgggttaagaagctgccttgtcagatcaccaggtgggaaacagcagcgaggagaggcccactggggtggaggggccatttcaggagtg

SEQ ID NO: 38801 - DNA, 201 bp, Homo sapiens
attgtctataaagacacaaactgcagaagctagggagaagaagcgtcctgtagccagttgctggatttggaggaagggggttggctcacatctatttctcygcatcctatgccctcagttcctttttctttcactttttcttacagggccttcttctagcccatctccaattcttttcctaaaacctaggctttctgcttc

SEQ ID NO: 38802 - DNA, 201 bp, Homo sapiens
cccttcctgggaaggggtgggctggaactgggaactgttctgagatggctcccttttcttgggtggggagtaagtcgccccattgttggaagcaggaggaytcctttgtctgggggcctcagttttctttctccgtgaatagtgaggacctttatgttgggcaagggctttgtctctgccatcccttcacctttatcccac

SEQ ID NO: 38803 - DNA, 201 bp, Homo sapiens
gaaagaggaaagtaaagctgtgaaggtcaggggtaaagcaggccttacagtctgtgagtgctagggctgggatggtccccagcacagtccccaggcctcamcagggttggggtttgttaacctgtgttccccacagctacctggtggcgcacaccctagggcgccggatgctgtatccaggctctgtgtacctgctgcaga

SEQ ID NO: 38804 - DNA, 201 bp, Homo sapiens
gggaatgtccctgcctcccacactgacctgacctcccctggcctctgctttctctgggtgaggttttgagtctctcagctttagggaaaagtccactcgcyatttgctttgataaccttacatccctcccctggcctgtgtccctagctattatgcttttcattctgttccattcccccaccacacaccccacacaatcac

SEQ ID NO: 38805 - DNA, 201 bp, Homo sapiens
gtgagaccatctcaggaatcccttccttttcctgaattatgtctgtttccctctggtcagccattggagggaggagaggggctgtggatttcttgaaggcstcccactcacctgagggctggggtctaggaggttgtgaaggcagcattgggagccatgcccccatccccacagtgcggggctagcaggagaggaggaggt

SEQ ID NO: 38806 - DNA, 201 bp, Homo sapiens
acacactcctgactttgccctttctcctgcagggggtgccattcccgcagaatgaggctaatgccatggatgtggtggtccagtttgccatccaccgcctrggcttccagccccaggacatcatcatctacgcctggtccatcggcggcttcactggtaccagcctccctcccatcccccactgtagacacattcatgacc

SEQ ID NO: 38807 - DNA, 201 bp, Homo sapiens
aggcacgcaccacccacaccctctaatttttgtattttttgtagagacggggtttcaccatgttggctaggctggtctccaactcatgacctcaggcgatytgcctgccccagcctcccaaagtgctgggattacaggcgtgagccaccactcctggcctctttttttttttttcttctttgagacagagtctcactctta

SEQ ID NO: 38808 - DNA, 201 bp, Homo sapiens
tccctggcaactaacctctttggctgcagggacagctgttctttctggcacagttcctgtggtgacgtttgcgcatctcttggggaccaggccaggggctrtcctgagcagggccaattgaaaaggcttgattaacttgagtagacagagagactgcctttaaatgtgatggaattatgtctggagatggaagacataatt

SEQ ID NO: 38809 - DNA, 201 bp, Homo sapiens
tgcaggtgctaagtcctgcagttccccagtgacctgtcctccctggcaactaacctctttggctgcagggacagctgttctttctggcacagttcctgtgrtgacgtttgcgcatctcttggggaccaggccaggggctgtcctgagcagggccaattgaaaaggcttgattaacttgagtagacagagagactgccttta

SEQ ID NO: 38810 - DNA, 201 bp, Homo sapiens
ggggctggcctgcccacttggacttgggctaccagggtggtgaaggagcctgctgcagggctgcagaaccatgacaggtgttcgtccccatgtagagtagrtggtgagggacatggcagctctactgcctcccccaaggccacatagatggcctgcatgttgtctgtgggaagagggttgtatgaggccagagacctccat

SEQ ID NO: 38811 - DNA, 201 bp, Homo sapiens
acggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactgccactttc

SEQ ID NO: 38812 - DNA, 201 bp, Homo sapiens
gatgattcttggtcttcggctcctgggctcagaaagcccctccccaggacacaccaagagcagggcagcctcactgccccagaaggactgaacacggcccytcacgggacccttcccttcctgccaggtcacagagtccatgcgtctgctggggaccacagagcacaggaggacattgcagggggatccatctgcagccct

SEQ ID NO: 38813 - DNA, 201 bp, Homo sapiens
cgtagctccaactgcgcgaaactcttctcaggaagcactgaaaatgtcgcaactcgcccggaggcggagccggtacgggctgacgtcaagggcacacaacmcctcagaggcagggagggcggggccggcagggggacctgctgctggaagagcagcggcccgagccggggccatggcgaagctgctgagctgcgtcctagg

SEQ ID NO: 38814 - DNA, 201 bp, Homo sapiens
accttgtgcaaatacattttagtgatgggcctccgagagggaatcattgagaatggtttaaggcatgatcttttccttaaaagacttgggttataaatatgaaaaaataactgaaaagtaacaaaaaggtttgcttttttttttttaagagatagggtctcaccatgttgtccaggctggtctcaaactcctgaactcaaa

SEQ ID NO: 38815 - DNA, 201 bp, Homo sapiens
aaagaggacagatcacctacccctagtgggtacataagatgacaaccaggtgatgggcgatgcttcaacatgggggtggtggggtcagggctggatggtcrcagttgggtccaggaccttctgcctgaggtgttctgccccctgatctctgcagggctgggctctctcctcagagaggccttccctgaccaccctgtctaa

SEQ ID NO: 38816 - DNA, 201 bp, Homo sapiens
ggcgatgcttcaacatgggggtggtggggtcagggctggatggtcgcagttgggtccaggaccttctgcctgaggtgttctgccccctgatctctgcaggrctgggctctctcctcagagaggccttccctgaccaccctgtctaaaagtagctcccactgctcagttttgtcttagttttttattttatttatttttaat

SEQ ID NO: 38817 - DNA, 201 bp, Homo sapiens
caaatacattttagtgatgggcctccgagagggaatcattgagaatggtttaaggcatgatcttttccttaaaagacttgggttataaatatgaaaaaatwactgaaaagtaacaaaaaggtttgcttttttttttttaagagatagggtctcaccatgttgtccaggctggtctcaaactcctgaactcaaagtgatcct

SEQ ID NO: 38818 - DNA, 201 bp, Homo sapiens
gaggatcacggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactgc

SEQ ID NO: 38819 - DNA, 201 bp, Homo sapiens
tgaggatcacggtaggttgaggctgcagtgagctgtgatcgtgccaccggactccagcttgggtgacagagtgagactctgtctcaaaaaaaaaaaaaaaaagcaaataggggtgcccagtctcacctcccataccctggggacaaaggacacccctccctggacatggccattagggactctgctgaactgcccctactg

SEQ ID NO: 38820 - DNA, 201 bp, Homo sapiens
tgtttatagtttgtggaaagtgggggaccatcccccttctcaccactgttcctcttgcacgtttcccctcattcatgtggctgtacttaaccttctccaayatacatcctgcattacatgaatggattattcctaataattaataaaaaggtattttttctactatcaggctaattgtataacttctcaagtgtccaggga

SEQ ID NO: 38821 - DNA, 201 bp, Homo sapiens
atggtgtcatacaccaaatatgatatgatatccctcaggttgtccatcttgctcagagtgtatagtatatgcctggaatggcaggtgtgtgtgtgtgtgtrtattgattgcctgtccctgtctctctgctgcaggcttcagtattctggtccatctcttattactcctctcccttcgccttcttctacttgtacaggaaag

SEQ ID NO: 38822 - DNA, 201 bp, Homo sapiens
gttttcggttactcttatcaagtactcctaatctcacccctcgtttccgctgtcgctctagagtctgccaataatgagacagaaaaaaattattgaaccaygcccggtaattttctgattctccgcgttctagtggtcttccactagtttcggaccactgctgtacccgtagctccaactgcgcgaaactcttctcaggaa

SEQ ID NO: 38823 - DNA, 201 bp, Homo sapiens
acttgggcctgggagtttgaggctgcagtgagctatgattgcaccaactgcattccagcctgggcaacagcacgagaccctgcctcaaaaaaaaaaaaaaaggcatgtggactggctcagtggggtggcccgaggttcggatgggctgtagggcaacactgatccatggctgcaggagttgaggaagggatgtagttgtga

SEQ ID NO: 38824 - DNA, 201 bp, Homo sapiens; identical to SEQ ID NO: 10532

SEQ ID NO: 38825 - DNA, 201 bp, Homo sapiens
ccattggagggaggagaggggctgtggatttcttgaaggcgtcccactcacctgagggctggggtctaggaggttgtgaaggcagcattgggagccatgcycccatccccacagtgcggggctagcaggagaggaggaggtagatctcattgtacacatccgtcttctggagagaacaacctctcctaccatcccttcctt

SEQ ID NO: 38826 - DNA, 201 bp, Homo sapiens
caggagggagaaaagctagggctcagtgtcttgggaattatgccaagccggctggtgctggactgtgattatctttgaggatgggctttggggccccataragctcttttctgttatgggaggtttctaggatcaaacagctatgaccaccatcatcacattcctggctactccacactatggagctgcgtaatgatgccc

SEQ ID NO: 38827 - DNA, 201 bp, Homo sapiens
tggtcagccattggagggaggagaggggctgtggatttcttgaaggcgtcccactcacctgagggctggggtctaggaggttgtgaaggcagcattgggakccatgcccccatccccacagtgcggggctagcaggagaggaggaggtagatctcattgtacacatccgtcttctggagagaacaacctctcctaccatcc

SEQ ID NO: 38828 - DNA, 201 bp, Homo sapiens
ctcattcatgtggctgtacttaaccttctccaacatacatcctgcattacatgaatggattattcctaataattaataaaaaggtattttttctactatcwggctaattgtataacttctcaagtgtccagggagccaggggcaggtagtggggagagcagaggccccaaagagctgggctttgggaaaccctaactctag

SEQ ID NO: 38829 - DNA, 201 bp, Homo sapiens
ttgagcaccaagacgtcgtacaccctccagttctggtagttgtggtgctgacctagcacagcgcaccagtaccgcccggcatcttcctctttggatccctscaaccacaaagaatagttccccagcagtctgagcctggattcccttcctggttttccagggtctggggctggcctgcccacttggacttgggctaccagg

SEQ ID NO: 38830 - DNA, 201 bp, Homo sapiens
cccaggtcctgggtggggagatcagggaaagtgaatgtttcctgcccattatcttcagtgcactatctccagtgttctatccccatcctctccagatagtyccctaaccaagtgaagtaggttaagaaaaaaacaagggataacatagggggaatggggttggcctatagggtcagtgggatgagagcatgggtggtgggg

SEQ ID NO: 38831 - DNA, 201 bp, Homo sapiens
agtgaggaagtaattatgggcaggagtcggagactctgaagccagatggcaaggggctagaatatacagaaaagaggcagaaagcaaacattggagaagartggcagtgaaaaatagagaaatttgatattcgcaagggagaatagtattatatgatagtgtttaatagtgtcatttaataggttatatgacagtgtttaa

SEQ ID NO: 38832 - DNA, 201 bp, Homo sapiens
ttgaggtggctcagcagtgaaaggagagtggatgcaatcactgactgtgtaagtgaaaagagagaggagagagagtcagcactgagagttgcttctgcttyagaaaggaaagcagaaaggaggcaggagaggaactgttcaggaactggaaggagtcaaggatgggcccaggaagcagaggcaggaagaatcttgagggac

SEQ ID NO: 38833 - DNA, 201 bp, Homo sapiens
tgggaaggcttggagttatttgcatctaagctggggggtacttctgctcttccttcccccagggatggagaaagggctgtgggccacaaggtctcagtccytcctccccctgtgttacagctggatattcagtcctgggctggaatcatccaggctttgctggaagcacggtgagaccatctcaggaatcccttccttttc

SEQ ID NO: 38834 - DNA, 201 bp, Homo sapiens
ccctataagggacccaggtggggaatagaccgtgaccagccagcgacccctactacccgtcactcaaaagcactagcaccttcagccactcctcctggggrtgggtcagacttagttttttagaaaagcagagtgttaggttcttagcttggaagagggcagacaggccagtcctgatacctgatggggcataccatctcc

SEQ ID NO: 38835 - DNA, 201 bp, Homo sapiens; identical to SEQ ID NO: 10513

SEQ ID NO: 38836 - DNA, 201 bp, Homo sapiens
gtcatctctctccctgaccagcctcaatttatagccgatgggaggtggaagaggactggtgtctgtctgtcctccgctcctaccaggcagaacacgggccygacttcccctggagcgtgggtaaggagctcctggggcaggagagagggtgggaagggcctaggaaggggatgaatacccagatgtgtggcctattttgag

SEQ ID NO: 38837 - DNA, 201 bp, Homo sapiens
ggcatggtggtggcaggcacctgtagtcccagctacttggaggctgaggcgggagaatggcgtgaagccgggaggcagagcttgcagtgatccgagatcgygccactgcactccagcctgggcgacagagtgagactccatctcaaaaaaaaaaaaaaaaaaaaaaaaagacacagctcccactgccgtcaaaaaacgtgg

SEQ ID NO: 38838 - DNA, 201 bp, Homo sapiens
ggtgaaaccccatctctgctaaaggtacaaaaattagccgggcatggtggtggcaggcacctgtagtcccagctacttggaggctgaggcgggagaatggygtgaagccgggaggcagagcttgcagtgatccgagatcgcgccactgcactccagcctgggcgacagagtgagactccatctcaaaaaaaaaaaaaaaaa

SEQ ID NO: 38839 - DNA, 201 bp, Homo sapiens
aaaaaatttctgtgcagaaaataaaaaccctcaaaatagagtgctaggagctcagggggtgggggacgaatatagtcaagtattaagacacagctaggccrggcgcggtggctcacacctgtaatcccagcactttggaaggccgaggcgggtggatcacgaggtcaggagatcaagaccatcctggctaacatggtgaaa

SEQ ID NO: 38840 - DNA, 201 bp, Homo sapiens
tactgcaagctcggcctcccgggttcatgccattgtcctgcctcagccccctgagtagctgggactacaggcgcctgccaccacgcccggctaattttttwatttttagtagagacggggtttcaccatgttagccaggatggtcttgatctcctgaccttgtgatccgcctgcctcggcctcccaaagtgctgggattac

SEQ ID NO: 38841 - DNA, 201 bp, Homo sapiens
tcctgtctcagcttcctgagtagctaggattacaggcacgcaccacccacaccctctaatttttgtattttttgtagagacggggtttcaccatgttggcyaggctggtctccaactcatgacctcaggcgatctgcctgccccagcctcccaaagtgctgggattacaggcgtgagccaccactcctggcctcttttttt

SEQ ID NO: 38842 - DNA, 201 bp, Homo sapiens
tccacctcccaggttcaagtgattctcctgtctcagcttcctgagtagctaggattacaggcacgcaccacccacaccctctaatttttgtattttttgtrgagacggggtttcaccatgttggctaggctggtctccaactcatgacctcaggcgatctgcctgccccagcctcccaaagtgctgggattacaggcgtga

SEQ ID NO: 38843 - DNA, 201 bp, Homo sapiens
ggccacagtagcccctggtctgcatgcccccactcacctttgagcaccaagacgtcgtacaccctccagttctggtagttgtggtgctgacctagcacagygcaccagtaccgcccggcatcttcctctttggatccctccaaccacaaagaatagttccccagcagtctgagcctggattcccttcctggttttccaggg

SEQ ID NO: 38844 - DNA, 201 bp, Homo sapiens
tggggtttcaccgtgttagccaggatggtctcaatctcctgacctcgtgatccacccgcctcggcctcccaaagtgctgagattacaggcttgagccaccrcgcccagcaagggcatggttttctcaaaagttaggagagtgattacctggggtgggggagaacagagtgggggagagccctgctgagaggtggctgtgtt

SEQ ID NO: 38845 - DNA, 201 bp, Homo sapiens
ctgcaagctccgcctcccgggttcacgccattctcctgcttcagcctcccgagtagctgggactacaggcgcccaccaccacacccggctaggtttttttktattttttagtagagatggggtttcaccgtgttagccaggatggtctcaatctcctgacctcgtgatccacccgcctcggcctcccaaagtgctgagatt

SEQ ID NO: 38846 - DNA, 201 bp, Homo sapiens
aaaataatgtatgcagtatgttttcatttatataaaattcaaaagggatgtgcatgtttgaggtagaacaccgaagacaacaagggcatggttttcttttyttttttttttttttttgagacggagtctcgctctgtcccccaggctggagtgcagtggcgcgatctcggctcactgcaagctccgcctcccgggttcacg

SEQ ID NO: 38847 - DNA, 201 bp, Homo sapiens
gccaggatggtctcaatctcctgacctcgtgatccacccgcctcggcctcccaaagtgctgagattacaggcttgagccaccgcgcccagcaagggcatgsttttctcaaaagttaggagagtgattacctggggtgggggagaacagagtgggggagagccctgctgagaggtggctgtgttctctttgttgacctaggt

SEQ ID NO: 38848 - DNA, 201 bp, Homo sapiens
tggtgtcatacaccaaatatgatatgatatccctcaggttgtccatcttgctcagagtgtatagtatatgcctggaatggcaggtgtgtgtgtgtgtgtgtattgattgcctgtccctgtctctctgctgcaggcttcagtattctggtccatctcttattactcctctcccttcgccttcttctacttgtacaggaaagg

SEQ ID NO: 38849 - DNA, 201 bp, Homo sapiens
gtatctctccccttagaaccattccagaaaatctctgctctgccctcccacctccatgccctctcaggtcacagtgcctgccttccaatgccattatgtcrttcctagaccccactgttctccagacctcagacatccagcttgctgctcctgaccctatccttccctgcatctttcccttcctcaggaaggagtctcgag

SEQ ID NO: 38850 - DNA, 201 bp, Homo sapiens
gggtggtcttgatctcttgaccgcttgatccacccgccttggcctcccaaagtgctgggattacaggcgtgagccactgtgcctggccgagagtagggctytcttgaggggtggccttgagtcaggagtgggctccaggtccctggagctgagttatctctgatgcttcaggagctgttgtcctgggttaccactgtggcc

SEQ ID NO: 38851 - DNA, 201 bp, Homo sapiens
ctgctcttcctggctcctgggtacctctcagctggctggagagcacaggcctcaaatgtgacagcgtcagaggcctatttttgtaccacatctggagtagragggctcctggaacctgattcggtcagcacagctgcttttacttctggcatggtgcatccacaggctgcaggatgtaggaagcagcctttgcttctaggc

SEQ ID NO: 38852 - DNA, 201 bp, Homo sapiens
tatttttgtacccttacttacttttatttctggttgatccttaccttgaaagtgtagtctttgggattccagcttaaaatgggggtgttatcagagtcctyatctctgagggcccctgagcttcgactatcatctctcccaaccccagtcaaagcccagaatgttgcctaaaggacagcttttggccaagccaacagggcc

SEQ ID NO: 38853 - DNA, 201 bp, Homo sapiens
gggcttggcctcctgagcctaatgatgaggtatcaggccttgctctgttcccagtgggctggcctttcatgcatgctgctcatgtcctctgcattatctcyggacttgatgcctcagcctttctctcacacacttttctttccctccccaagagcctgaaaaagaagctaacgatgctgcaggaaaccttgaacctgccac

SEQ ID NO: 38854 - DNA, 201 bp, Homo sapiens
caaaggccccaggaaggtaagagctttctagaagaagcacagtctaacctttggcaggactggacttttgggagggcacggtcttgccagagccttgtcaytcctggtccaggactgaggtacttcggagccacccttgggattctactcattatccctcctgcctcctagtgaggcatcagagatcctgatcttgttcca

SEQ ID NO: 38855 - DNA, 201 bp, Homo sapiens
tgcctcttccttgacagctcctccagactgacacagtcatgatccgcccattgcctgttaagcccaagaccaaggttaagcagagggtgagggtgaagacmgtgccttctctcttccaggccaagctggacaccttcctgtggtcgtgagaacagtgagtctgaccaatggccagacacatgcctgcaacttgtaggtcaa

SEQ ID NO: 38856 - DNA, 201 bp, Homo sapiens
ttttagtttatcagttactcctttaagcatactttggaactttatcctcagactctcattacctttagaattttctctgattttggctttctgcagttttrgtatagtgtatccaatatgaatttctttttacctttttcttttcttttttttttttttgagacagagtcttgctctgttgcccaggctggagcacagtgg

SEQ ID NO: 38857 - DNA, 201 bp, Homo sapiens
ccatattggctatacttgtgggttttgtactaggtagtttgaagagtcaaggccttcccagtacctcacagaggggatgctcaactaagacctcagtgagrctgggccatatttccgaaagtggttcatactctactgatgaggccagcctgaagaaccttccattagcactctagtccttggctgggctgctctcctgag

SEQ ID NO: 38858 - DNA, 201 bp, Homo sapiens
aatcatagctcactataacctcaaactcctgagttcaagggatctccccacctcagcctacctagtagctaggactgtaggggtgcaccaccatgctcggktaatttttttattttatttatttatttatttatttatttatttatttatttattttgagatgaagtctcactctgtcacccaggctggagtgtagtggcg

SEQ ID NO: 38859 - DNA, 201 bp, Homo sapiens
gggtgtcctgctctcatcttcctctgtggtattctgcttctgtcccccagcccatttatcacctctagacattgagatggggtgcccatgactatcccctycttggttttgtccacagccaaagacctggtcacaaggctgatggaggtggagcaagaccagcggatcactgcagaagaggccatctcccatgagtggtga

SEQ ID NO: 38860 - DNA, 201 bp, Homo sapiens
tcttctttgatcttgcccaggaggaggagaatgtcttggatgcagaattcttaaaggtacccagaatttatctgattctactgaactccaagccttgtgcragttcacttttcttttttcttttcttttcttttttctcttctcttctcttctcttctcttttctcttttcttttcttttcttttcttttctttttttaga

SEQ ID NO: 38861 - DNA, 201 bp, Homo sapiens
gtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgtag

SEQ ID NO: 38862 - DNA, 201 bp, Homo sapiens
ggtctcaaacttctgacctgatgatccacccgcctcgacctcccaaagtgctgggattacagacgtgagccactgggcctggcctgcctacttttaaactctgtgtaaatagaatcatacaaaatataactttttgtatctggcttctcttcctcagtgttatgtttttgtgatttattcataatattgttcttagctgta

SEQ ID NO: 38863 - DNA, 201 bp, Homo sapiens; identical to SEQ ID NO: 10540

SEQ ID NO: 38864 - DNA, 201 bp, Homo sapiens
gagtggacagatggacaagcaggcttgcagtcagatggggtgggggcatgtgtctgtggcctttctgtgtgacccttcccccatgcaggctttcaggcaayccacctttctatgaggaggtggaagaagatgattatgagaaccatgataagaatctcttccgcaagatcctggctggtgactatgagtttgactctccat

SEQ ID NO: 38865 - DNA, 201 bp, Homo sapiens
atcgcttgaactcaggaggtggaggttgcagtgagccgagattgcaccactgcactcccgcctgggtgacagagcgagactcagtcttaaaaaaaaaaaaagtgtttttttggctaggcatgatggctcacccctttaatcccagcactttgggaggtggctggattgcttgagcccaggggtccaagaccagtctgggca

SEQ ID NO: 38866 - DNA, 201 bp, Homo sapiens
ccctatgttgtggggaagtggagagtagtacagctaagccagaccccattgtgcccgcaggttagagcctggcaatgccgtttgggtgtgtgactctgggygacaagaagaactataaccagccatcggaggtgactgacagatatgatttgggacaggtcatcaagacgtgagtgccgggcctgtcaggcaaggctgggt

SEQ ID NO: 38867 - DNA, 201 bp, Homo sapiens
gctattctcctgcctcagcctcccgagtagctgggactacaggtgcccgccaccacgcccggctaattttttgtatttttagtagagacagggtttcaccrtgttagccaggatggtctccatctcctgaccttgtgatccacccacctcggcctcccaaagtgctgggattacaggtgtgcgccaccgtgcccggccaag

SEQ ID NO: 38868 - DNA, 201 bp, Homo sapiens
gatggggcagtgagggttgcctaggcttggccatggctttggttccagctacctcttgttccctcacctgagcactcaatctgtgcaaaccccttctcttktctcattattcctcaccatcacctttcaaggcaaacgtattggaatgcaagttagagagaatgcagtgatgccagaaggggtgggtctgggctggagagg

SEQ ID NO: 38869 - DNA, 201 bp, Homo sapiens
ggcaggagggtgggagagtggatgaggggcttctcactgtacatagagtcactggcatgatgccctcgctcccccatgcccccacatcccagtggggcatwactaggggtcacgggagagcagtctcgtctcctgtgtgtatgtgtgtgagtggtgggcaggccagtggcagggccggccccagcccctgcatggattcct

SEQ ID NO: 38870 - DNA, 201 bp, Homo sapiens
agagcccaaggccttaccacccaagggggtgacccacaggggcaagcatgagaagctgtctggaattccagtggggcaggtggaacctgctctggggtacrgtgggaccagaaaaagggaggctgtctccttggccaggtttgccaagtgtaattcactgtggagacaaggactatactcattcatacaggtactgttcag

SEQ ID NO: 38871 - DNA, 201 bp, Homo sapiens
aagccagctgggctgtcctacctcccaaacctcagggggcatgggcacccctgttgtagagggcgaggcctggtagcaatgagaaacaaacctaggacccrtgggctgtagtcctcagggatcctgtcagtgtctgctgtgtactctggcttcctcccattgcccttcttccgctgtaaaggttgaaggtggacacctggg

SEQ ID NO: 38872 - DNA, 201 bp, Homo sapiens
aggcctggtagcaatgagaaacaaacctaggacccgtgggctgtagtcctcagggatcctgtcagtgtctgctgtgtactctggcttcctcccattgcccytcttccgctgtaaaggttgaaggtggacacctggggtcttcaggctgccaggcctttcagagacatttccaccaccttcatggcctgtggaggtagtgaa

SEQ ID NO: 38873 - DNA, 201 bp, Homo sapiens; identical to SEQ ID NO: 10539

SEQ ID NO: 38874 - DNA, 201 bp, Homo sapiens
tcagcggtggaacagctggctgtgtactgtgtgtctctcaagaagtgcgtactgtggcccctctcagcaaacacaggagataggccatggggccccagccrtgtcattgctccccatctcttgtaaagcagatggaactaaggggcaaactctggagccatgctgcctttgtttgaaccctgattccacctttcagcaact

SEQ ID NO: 38875 - DNA, 201 bp, Homo sapiens
cagcacagtctattcttgtgtttgtttgttggtttgtttgttggtttgtttgttttgagatagggcctcattctgttgcccaggctggagtgcagtggtgygatcacagctcactgcagcctcaacctcctgggctcaggtgatgtgatcctgcctcagcctcctgggtagctgggactaaagtgctgggattacgagcgt

SEQ ID NO: 38876 - DNA, 201 bp, Homo sapiens
ctggggctttctgcatgccctctcaagtcaccagtgcctgcaggacaggcaggaggaaatagtcacttccttgcattctctgcaggaccctccacagtgcyacctggtacttgttgggctcaggtgtcaaagtaggaatgagagtgagttgaggggttgggcagtgctttgtgttagattagtgctgtggctcagtctgac

SEQ ID NO: 38877 - DNA, 201 bp, Homo sapiens
aatctaaaagaggcacggaaggcctcaggggaggtggctgacaagctgaggaaggatttgttttcctccagaagcaaggtaacttagcagtgaacagaggytgaaggagaagtggctctccttttgtcatgttcactctggtctcctgagcaaggccatgggacctgatggcacagctgactccctggggcagctggagga

SEQ ID NO: 38878 - DNA, 201 bp, Homo sapiens
ttcactctggtctcctgagcaaggccatgggacctgatggcacagctgactccctggggcagctggaggacttacagaaatttgttaccagtccttactgsgcattggcctgaatatgtggcttgtccactaggggtggacagatcacagaggtatcccccaacatgtggacactgatgctcccctctgctcttcctggct

SEQ ID NO: 38879 - DNA, 201 bp, Homo sapiens
ctcagttagttgggtcgttatataccccatttccatttataagtggttatcctagaaattaaggtatgtatccttaacttaccaatttcaaggttaatcarcacctttctcattttcccaggcaactcaaagagcttagaatactaacattcttttcccacttctacgttattgttgaatattttaattgtgtgtatgtgt

SEQ ID NO: 38880 - DNA, 201 bp, Homo sapiens
ggtggagaggaggagtagtcgcccaaggtccttggccattcctattgtgtgtccctggtgagtcagctgatgcccagagggaatgagaccaacatagagcratgaggccaaggaagtgatagaaacttctgctatggagactgatcacaggggccctactttaacttcccttccactattctacctctttacctgtcctgg

SEQ ID NO: 38881 - DNA, 201 bp, Homo sapiens
gtatcttttgagcacttaaccgtgtaggtctgtagtaatatgacttcagtgaccacgaaaccagcagccccaacttggggtacctgcaggagtaaagaggkcttttgactctaaaggatgtactttgaaaaattaggtctgagaacaggcctgacatgcatgtcaggcaggtagtcagacccatgtacaacactctcctcc

SEQ ID NO: 38882 - DNA, 201 bp, Homo sapiens
gaggtcttttgactctaaaggatgtactttgaaaaattaggtctgagaacaggcctgacatgcatgtcaggcaggtagtcagacccatgtacaacactctyctccttgcgcatgacccagctacacaatcatactcttaccttgttctcccatccaggttggcaaaagaaccattatcaataagctcttctttgatcttgc

SEQ ID NO: 38883 - DNA, 201 bp, Homo sapiens
tcacttccttgcattctctgcaggaccctccacagtgctacctggtacttgttgggctcaggtgtcaaagtaggaatgagagtgagttgaggggttgggcrgtgctttgtgttagattagtgctgtggctcagtctgacctgcaggtgttcttttctggcatctctttccatggccacattgcagagagtacgagaatcta

SEQ ID NO: 38884 - DNA, 201 bp, Homo sapiens
gccctgtggactgctgggccattggagtcatcatgtacatcctgtgagtggacagatggacaagcaggcttgcagtcagatggggtgggggcatgtgtctstggcctttctgtgtgacccttcccccatgcaggctttcaggcaacccacctttctatgaggaggtggaagaagatgattatgagaaccatgataagaatc

SEQ ID NO: 38885 - DNA, 201 bp, Homo sapiens
agtaggtcctcaggttttatgggtacagaattcatagggaggtattgccccagaactggactccccattctgggcttatcttctggttctgctccagtcawcaccttggtttggggagttgtaaaatagaggcaaatcacttcttccccttgcccttccatactgtacccatccatcccataagaaaagggccatattggc

SEQ ID NO: 38886 - DNA, 201 bp, Homo sapiens
ccagcctgggtgaagtcccctaaatttccctctcccactattaggtaggagttcacctgtttttccaggacccagcatgggcctggcacggggagtaagakgcacagggagtgagtgagtgctgcagtggaggttgcccagctgatctctagcatatctggaggagtatggggctttgtggcaaggaggtgccattcttgg

SEQ ID NO: 38887 - DNA, 201 bp, Homo sapiens
tttggttagactagaaattaagctcgcctctaagcgtactctattttctgtttgcctactctattttcttctatccttttactttatttatttatttttaytttattttatttttgagatggagtctcgctcctgtcgtgtaggctggagtgcagtggcgtgatctcggctcactgcaacctccacctcctgagttcaagt

SEQ ID NO: 38888 - DNA, 201 bp, Homo sapiens
gtttcactatgttggccagactggtctcaaactcctgacctcgtgatccgcccacctcggcctcccaaagtgctgggattacaggcgtgagctaccgtgcstggcctatcttgtctaatttaaagtccattttatctgctattagtatagccacttcagctgtcttttggtgactgcatggtatatcttttttcatctgtt

SEQ ID NO: 38889 - DNA, 201 bp, Homo sapiens
accagcacagtctattcttgtgtttgtttgttggtttgtttgttggtttgtttgttttgagatagggcctcattctgttgcccaggctggagtgcagtggygtgatcacagctcactgcagcctcaacctcctgggctcaggtgatgtgatcctgcctcagcctcctgggtagctgggactaaagtgctgggattacgagc

SEQ ID NO: 38890 - DNA, 201 bp, Homo sapiens
gcagtaggattacccttcatacctgtcattttagggaggcatcagcatgtagccaccacccccaactacagagtcaatgttaggaagatctctctcatggrccccaagggcccctgaactccaggctagagacagccagggagacctttccttagggtagggtaaggccgccaggagccatgagttcatggaggagatgtt

SEQ ID NO: 38891 - DNA, 201 bp, Homo sapiens
ggccagtgactcagtctctgtctctagatatgcaagttcctggtacagctcagcatggatttcagctcctactacaaccgggtacacatcctgggggtgascacacagcaaaacggggtgggacgtgcagagaggtatagggtaaaggcaaaggaagcagaggatgagaccagcaggccctttctctttcaggagcctcga

SEQ ID NO: 38892 - DNA, 201 bp, Homo sapiens
gaacttacctctgctaatgacgggaggacactgtcccctggcatcctaggcagactgtgtctgaaggagctggtggaagaacagggccgcacagctggctrtgaccccaacctggacaactgtctgggtaggacctgaagcctagcagggccagaaaaggcaggagggggttaggggcacatctctgcttcttgtcagtct

SEQ ID NO: 38893 - DNA, 201 bp, Homo sapiens
gtgactcagtctctgtctctagatatgcaagttcctggtacagctcagcatggatttcagctcctactacaaccgggtacacatcctgggggtgagcacayagcaaaacggggtgggacgtgcagagaggtatagggtaaaggcaaaggaagcagaggatgagaccagcaggccctttctctttcaggagcctcgaccaca

SEQ ID NO: 38894 - DNA, 201 bp, Homo sapiens
taggctggggcctcagatactggtacaggcggctgcctggttgtacatgttgttagctgtgaggaggagttccagcaacagaagttggacctgctttggcrgaagttggttgacaaggctccactcagacaggtaggttaataatgatggtggagctccccaccacctaacccccaacctcagagggcccttgaaaaccca

SEQ ID NO: 38895 - DNA, 201 bp, Homo sapiens
gtctctgtctctagatatgcaagttcctggtacagctcagcatggatttcagctcctactacaaccgggtacacatcctgggggtgagcacacagcaaaayggggtgggacgtgcagagaggtatagggtaaaggcaaaggaagcagaggatgagaccagcaggccctttctctttcaggagcctcgaccacacctctttg

SEQ ID NO: 38896 - DNA, 201 bp, Homo sapiens
ccggggctccacattgctgtacgcacagagatggtgaggcatagacaaccaggacactctacactctattctttattctggcctggggcacaagagcaaasagatgggccagtgactcagtctctgtctctagatatgcaagttcctggtacagctcagcatggatttcagctcctactacaaccgggtacacatcctggg

SEQ ID NO: 38897 - DNA, 201 bp, Homo sapiens
gtagacggaggcactcaacctggcagttccaatttgagggagtctgggctgagtagaggcaccagatttgggctcctcaagggacttcctggagagtagcrccaactaggctgagcccctgacatctttctgacagaagcacctcatctgtggccctgtgaaagtagctggtgcacctggcactctgatgactgcccctga

SEQ ID NO: 38898 - DNA, 201 bp, Homo sapiens
ccgcacagctggctatgaccccaacctggacaactgtctgggtaggacctgaagcctagcagggccagaaaaggcaggagggggttaggggcacatctctrcttcttgtcagtctcagcacctgtctgttctcttttcagtgactgaggatctcctctctgtgctggctgagctgcaagaggctctatggcattggcccga

SEQ ID NO: 38899 - DNA, 201 bp, Homo sapiens
gggtctgtagacacatcccaagaacactgaagaccaggttgagaaggatgaaccatgcgtagcctgagtggctgggtagacggaggcactcaacctggcakttccaatttgagggagtctgggctgagtagaggcaccagatttgggctcctcaagggacttcctggagagtagcgccaactaggctgagcccctgacatc

SEQ ID NO: 38900 - DNA, 201 bp, Homo sapiens
cccgagactttctggcaccgcaccgcgcgctgcaggcgcgcttcgatgacggccaggtgggcgtgagccgggcggggccgtgcggccgggagatgggcccmgtgccgtggctcttttacacgcccgttctcccgcaggttccggagcatttgctccatgccctcgcctgcctgcagggccccggtgtggccccggtgctgc

SEQ ID NO: 38901 - DNA, 201 bp, Homo sapiens
cttggagacttggaaacagaaggccttgtaggccacataggttttcagagactcgcctggcagaggcctggagcgtcctgctgcgtggactgtgggcaccsagccaccaggaggttgttgatctcattcttgctcactggtccctgccagactggtggtgcctctctactgtcgggcagccccacctctgtgctgccccat

SEQ ID NO: 38902 - DNA, 201 bp, Homo sapiens
  misc_feature (1)...(201): n = A,T,C or G, or insertion/deletion polymorphism (see Tables 1-2)
tcagtcccgatccttcccgacccacccagaggacccccgattgaagccgtggaacggctcacaccggcacgtgctgcacctgcccaccgtcttccatcacntgccacacctgctggccaaggagagcagtctgcagcccgcggtgcgcgtgggccagggccgcaccggaggtatgggcgcagacagggaggagcacggggt

SEQ ID NO: 38903 - DNA, 201 bp, Homo sapiens
acccttactcctaggaggttgcagggtctggagaggaggcagacacctgccacacacatgcatggtgacagcagaccgttaacgggcctgatatctgcctmtgcccctctgagcctgtcccttttccctgagtacaaggcacaaaggttgtgccccagcttggctctttaatctttccccaaccaagagggaagcaggggg

SEQ ID NO: 38904 - DNA, 201 bp, Homo sapiens
ctctgcattcaaggggttaggtttccagggtaaccgagcccctgagcccagcgtggagcctggcagagccagtaatctgactcccctttccctcccgccasgggctgtccagaggctccgctttgcctcagcctttagccccagagaggcagggtgtggagggtgggggctggcttcttgggtaagagatgcctcagggaa

SEQ ID NO: 38905 - DNA, 201 bp, Homo sapiens
aactgtggccctcggtcaagcacctgctgaggatctgcccagggaggcagacccttgggggcagcccggggtctcagccatgcagcgctcccagccttcargctgtccgcctccccaggcctggacttcagcaatgatggacacccttactcctaggaggttgcagggtctggagaggaggcagacacctgccacacacat

SEQ ID NO: 38906 - DNA, 201 bp, Homo sapiens
  misc_feature (1)...(201): n = A,T,C or G, or insertion/deletion polymorphism (see Tables 1-2)
gctctgctacctcagttggctgggtgtagggggtggtggggggctggcactgggtgagcctcaagaaagggccacagtctggtgggctcggcccctctcancccctggaggctgcatacggactaggccttcccgtcccccaggttccccacggagatccattctgggctcctggaggtcatctcaccctccccccacttc

SEQ ID NO: 38907 - DNA, 201 bp, Homo sapiens
ggctgaggcaggagaatcgcttgaacctgggaggctgaggttgcagtgagccgagatggtgccactgcactccaacctgggcgacagaccgagactccgtyttaaaaaaaaaaaaaaaaaaaaaggccggggtggtgactcacgcctgtaatcccagcattttgggaggccgaggcaggtagatcacgaggtcaggagatc

SEQ ID NO: 38908 - DNA, 201 bp, Homo sapiens
cgggacccctttagacttggctgtctcacttggattacaggcgtaggccacagtgcccaactgagtcactttttttttttccttaaaaaaattgttggccygcagacacatgaaaaaatgctcagcatcactggccatcagagaaatgcaaatcaaaaccacattgagatagcatctcacaccagttagaatgccaatcat

SEQ ID NO: 38909 - DNA, 201 bp, Homo sapiens
  misc_feature (1)...(201): n = A,T,C or G, or insertion/deletion polymorphism (see Tables 1-2)
tggacctgagcctgattgtagagttcattctcatgttctaccgggacaagcccatcgactggctcctggaccatattctgtgggtgaaagtctgcaacccngagaaggatgcggtgagcaagagctggcgggactggcaggggcagggccaaggggcaggcagcctccaccccaaactgtgtccctgtccttgcatctgct

SEQ ID NO: 38910 - DNA, 201 bp, Homo sapiens
tggcatgcggacccttcagggtgccccaggcgcagcacaggtctccagagacacaggcaccagggcgttcagagctagtcccctcgctgctgttgactgtscttgagcagccccagggccggtttctcaacctcatttgctcacctgagcaatgaagtgaggtgggctcctggaactgcagcagccaccccccggggccat

SEQ ID NO: 38911 - DNA, 201 bp, Homo sapiens
tcctgcctcagcctcccgagtagctgggactacaggtgcccgccaccactcccggctaatttttagtagagacggggtttcaccgtgttagctaagatggyctcggtctcctgacctcgtgatccgcccgtctcggcctcccaaagcgggacccctttagacttggctgtctcacttggattacaggcgtaggccacagtg

SEQ ID NO: 38912 - DNA, 201 bp, Homo sapiens
tctctggcgcgaacactggaatgcatatactactttatgtgctgtgttttttattcttggatacatttgattttttcacgtaagtccacatatacttctataagagcgtgacttgtaataaagggttaatgaagtgtgtgcctcaaatgtgagcgccctgggcatctccctctgcccctgcggttggcttcatttggtctg

SEQ ID NO: 38913 - DNA, 201 bp, Homo sapiens
tcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagct

SEQ ID NO: 38914 - DNA, 201 bp, Homo sapiens
ctcgtaatggtagctaccttgtgaggactaagtcaggcagcccctaggagctcagggatgtttcctgtcaccatcctcccagaggaaggccctggtctctttgcacagcctgacagctgcctggggggccctcctggcgcaggcctggcctttctctgctgggccctgggtgctgtgctggaacgctgcccctgcagcagc

SEQ ID NO: 38915 - DNA, 201 bp, Homo sapiens
  misc_feature (1)...(201): n = A,T,C or G, or insertion/deletion polymorphism (see Tables 1-2)
cagcaatgggtgagccctggggatagccagctctgcattcaaggggttaggtttccagggtaaccgagcccctgagcccagcgtggagcctggcagagccngtaatctgactcccctttccctcccgccaggggctgtccagaggctccgctttgcctcagcctttagccccagagaggcagggtgtggagggtgggggct

SEQ ID NO: 38916 - DNA, 201 bp, Homo sapiens
acccctggtgaaaccagacgtagccagtcggaggccagattggaacctggcctccactttgcagccagcgggggtccaggaacttgagggaaggacccagkaagtggaatctgcagggaaggaaggaggtgggcagggaaccagagaggaagggcagcaggtgtgggcatcatcctggaaacgcaaggtcaagcccaggac

SEQ ID NO: 38917 - DNA, 201 bp, Homo sapiens
aatgaaggcgtgggcccccatcaatatcgggctgggctgggcggggcgaggtggcccctacaccaccgggggcagggcccgttgctcccgttagcggcgckctcgggccgcccctgccccgggaagccggtacggttctgggctggtcactgctctgcatccacgagcatcggccctgataccgcctagaaaggcccatcg

SEQ ID NO: 38918 - DNA, 201 bp, Homo sapiens
gtctccccacagactgactcacagtacacttcggcagtgacagagaacatcaaggccttgtgagtactggcgaccccagagagctggtggcgggagagctyggtgcggggtgttgtgctggcaggttcctgcctccccatgagatagtgcctttcctatctcgtggggaggcagggacctggtgggggaggggtgggtgtg

SEQ ID NO: 38919 - DNA, 201 bp, Homo sapiens
  misc_feature (1)...(201): n = A,T,C or G, or insertion/deletion polymorphism (see Tables 1-2)
ccctgggtcccacagccagcctgaccacagccagattcacacccttgtgttgagcgacctcattccagccaggccatttcctgcattgcacccacagactntggtccaggcccaaactctggggtccacctccaggaccagaaaattgtgcaagcatgttgtccttgggatgcaagtgacaggttggcttgttggaccttt

SEQ ID NO: 38920 - DNA, 201 bp, Homo sapiens
gaagaaggacagagacagctggcacccgtgtctccccaggggcctggaatgagatggtgactcaccccgggtactatgctgagctggtggagaagtccacygggaagtacagcctggccacagaggagatcgagcgagacctgcaccgctccatgcccgagcaccctgccttccagaacgagctggggattgctgccctcc

SEQ ID NO: 38921 - DNA, 201 bp, Homo sapiens
tttttgtatttttggtttcgccatgctgcccgggctgatctcgaactcctgggctcaaatgaccctcctgcctcagcctcccaaagtgctgggattacagrcatgagacacggcgcccagattttctctacattttttttaatttccgttgggcctatggaggacagggaccccctccctcctaggtggggcagacacaag

SEQ ID NO: 38922 - DNA, 201 bp, Homo sapiens
cttgtgttcattcagtacaggcaaaaccccagaaacaggtgctgggggtaggggagccaggccaggcagagatctcccctcatccctttgctcttcccccrgggcttcttccccgattccttaatgggagcaaacaattcttccagcctttgaaagtggcatcgtgctgccttctctacgtttttgttttgtgtgttgttt

SEQ ID NO: 38923 - DNA, 201 bp, Homo sapiens
agctccgtggcccggtgcggtggctcacgtctgtaatcccagcactttgggaggccgaggcgggctgatcacgaggtcaggagatcgagaccatcctggcyaacacggtgaaaccacgtctctactaaaaaacacaaaaaattagctgggggtggtggcggaggcctgtagtcccagctactcgggaggctgaggcaggag

SEQ ID NO: 38924 - DNA, 201 bp, Homo sapiens; identical to SEQ ID NO: 12416

SEQ ID NO: 38925 - DNA, 201 bp, Homo sapiens
  misc_feature (1)...(201): n = A,T,C or G, or insertion/deletion polymorphism (see Tables 1-2)
catggcaaaaccccgtctctactaaaaatataaaatttatccaggcatggtggcacgcgcctgttatcccagctactcgggaggctgaggcacgagaatcncttgaacccaggaggtcaaggttgcagtgagccgagatggcgccattgcactccaccttgggcgacagagcgagactatctcaaaaaagtattaatggac

SEQ ID NO: 38926 - DNA, 201 bp, Homo sapiens
ttttcattaaagaatctgaatagctagcttggccaacatggcaaaaccccgtctctactaaaaatataaaatttatccaggcatggtggcacgcgcctgtwatcccagctactcgggaggctgaggcacgagaatcgcttgaacccaggaggtcaaggttgcagtgagccgagatggcgccattgcactccaccttgggcg

SEQ ID NO: 38927 - DNA, 201 bp, Homo sapiens
  misc_feature (1)...(201): n = A,T,C or G, or insertion/deletion polymorphism (see Tables 1-2)
acctgctcccagccgacttttaccatgccccccactcgctagtagggttctctacatggtgactccgcgtgcctgccctgccctcttctgctgaactggcntattcaggcacacgtctgtcccaaattcctggtgattccatgtcatgcaatgccttgggtgcgtgccacagccctcatctgctgcaggttcctccctaca

SEQ ID NO: 38928 - DNA, 201 bp, Homo sapiens
tgggatccagccccttcccttcagcctgctgcctcagcccaggcccaccatgccctttccctggggttcccctctcagtctttgacctgcctgcatcccargactctgatcagacctggccctgccccttccctgggtcctctgtacaaaggcactgtctgagcctccagcctggccttcaagccccggcccctcctggct

SEQ ID NO: 38929 - DNA, 201 bp, Homo sapiens
tgactcaccccgggtactatgctgagctggtggagaagtccaccgggaagtacagcctggccacagaggagatcgagcgagacctgcaccgctccatgccygagcaccctgccttccagaacgagctggggattgctgccctccggcgggtgctgactgcctatgccttccgaaaccccaccatcggctactgccaggtaa

SEQ ID NO: 38930 - DNA, 201 bp, Homo sapiens
tgagaccagcctggccaatatggtgaaacctcgtctctattaaaaatacaaaaattagccgggcatggtggcacacacctgtaatcccagctacttgggarcctgaggcaggagaattgcctgagcccaggaggcagaggttgcagtgagctgagatcacacctctgtactcctgcctgggtgacagagcaagactccatc

SEQ ID NO: 38931 - DNA, 201 bp, Homo sapiens
agacattgagcagatgcggtttaaacagaggctgaaagtgatccagtccttggaggacacggccaagaggagtgtggtatgggtgccagcagggctgggcvggggctgggctgggggggcagcagtgccttccccacagagcagggtgggtacagggctccaccgcacccagtctcctacactgctttggtatgtacatca

SEQ ID NO: 38932 - DNA, 201 bp, Homo sapiens
caccctgccttccagaacgagctggggattgctgccctccggcgggtgctgactgcctatgccttccgaaaccccaccatcggctactgccaggtaagggrcctgacaggggcccagagacagcatctgccaccagaggttcacaggagcaggtccctgtggtcccaggcctgtgtggtgaccctgccttgtgtcccaagg

SEQ ID NO: 38933 - DNA, 201 bp, Homo sapiens
gtggctgttctgggtttttttcccatgaccaccttcccaaacgccagggtgttttatgatagggccctggtaactccatgccagaaaacacccaactcttyctctccctgctgtcagcccgcagccgtctcacatgacaaagattaatctctttcctcctaacctgcagaggagaaggggaccagctctccggactatcgg

SEQ ID NO: 38934 - DNA, 201 bp, Homo sapiens
attggatttttacctgggacatgtatttccttttcaaacacaatgtcaaagtcaggaaagcggctggatgcagtaggaggcccaggcgggtggatcacttsaagtcaggagttggagaccagcctggccaacacgatgaaacctgtctctactaaaaatacaaaaattagctgggcgtggtggtgtgtgcttgtagtccca

SEQ ID NO: 38935 - DNA, 201 bp, Homo sapiens
  misc_feature (1)...(201): n = A,T,C or G, or insertion/deletion polymorphism (see Tables 1-2)
aaagaaatctctacctaccaactaggccttggcctctgtgcatcagggaaaggaggctgtaatagaaatgcaaagaaaaatgaaaaaaaaagtttaaagtnaattatggatgacttaaggggcttccaggagtaattctgggggccttttgtgactcactgcaagctgtgtgattctgggtggaatcgttttcccgtgggc

SEQ ID NO: 38936 - DNA, 201 bp, Homo sapiens
  misc_feature (1)...(201): n = A,T,C or G, or insertion/deletion polymorphism (see Tables 1-2)
cccccaagcccatcctgggaaggggcccggagtgtgagagagaggctcccccacgcccatcctgggaaggggcccggagtgtgagagagagactcccccangcccatcctggaaaggagcccggagtgtgagctgagtggtaggtggggggccagggatgggctgtgggcctcgctctctcccgaagggtccgcccttgag

SEQ ID NO: 38937 - DNA, 201 bp, Homo sapiens
  misc_feature (1)...(201): n = A,T,C or G, or insertion/deletion polymorphism (see Tables 1-2)
agagaggctcccccaagcccatcctgggaaggggcccggagtgtgagagagaggctcccccacgcccatcctgggaaggggcccggagtgtgagagagagnctcccccacgcccatcctggaaaggagcccggagtgtgagctgagtggtaggtggggggccagggatgggctgtgggcctcgctctctcccgaagggtcc

SEQ ID NO: 38938 - DNA, 201 bp, Homo sapiens
  misc_feature (1)...(201): n = A,T,C or G, or insertion/deletion polymorphism (see Tables 1-2)
cttaatggttggaatctgcctttctgttgttgttgccagttcccgtccacctctccagctgcctcaggttccgtgctcaaggtggctgctgcgctgtggcnctagcgtcacaacagttgagccagctctgcctgcctcctagagaggtcataggagcgagagcaagcctcaggcctcttgtttccctggagccctgccagg

SEQ ID NO: 38939 - DNA, 201 bp, Homo sapiens
  misc_feature (1)...(201): n = A,T,C or G, or insertion/deletion polymorphism (see Tables 1-2)
cccccacgcccatcctgggaaggggcccggagtgtgagagagaggctcccccaagcccatcctgggaaggggcccggagtgtgagagagaggctcccccangcccatcctgggaaggggcccggagtgtgagagagagactcccccacgcccatcctggaaaggagcccggagtgtgagctgagtggtaggtggggggcca

SEQ ID NO: 38940 - DNA, 201 bp, Homo sapiens
  misc_feature (1)...(201): n = A,T,C or G, or insertion/deletion polymorphism (see Tables 1-2)
ctagagaggtcataggagcgagagcaagcctcaggcctcttgtttccctggagccctgccaggaaggctcagcccttctctggggccagcagaccagctcngccccctgcaggctgccaaggactctgtctctcagccaaccccctccccatctgttaacaaggggctgatgacagcctgagagctttcgggaggtgctgc

SEQ ID NO: 38941 - DNA, 201 bp, Homo sapiens
cgcgtggccccttaccgcatcctgcaccagacccaggactcccaggtctactggacagtggcgtgtggtaggtgccctgagtggtgaggggtgctgggcarggcctgccctggaagggccgttgccgagaggaaggggtgtgtagcccacgtgtctgggtggtattccctgctgacagcatagcccaaggctgcaagaggg

SEQ ID NO: 38942 - DNA, 201 bp, Homo sapiens
  misc_feature (1)...(201): n = A,T,C or G, or insertion/deletion polymorphism (see Tables 1-2)
cttggggctggctctgtggcccagggggatgtctctgggcaccctgagccctgtaacaatgccagcagcatgagggagtatggacgggccctgaaactgcnggtcctgccgctggtttgtgtgcagggccaagaggcaggagccccctggcatacagggggccaagtgcaggacgtcctccaggatgtgataagagaagcg

SEQ ID NO: 38943 - DNA, 201 bp, Homo sapiens
gtggcccatgcccgctacactcacccaggaccatgcgatccgcaaccctgggtactgcttggtgacctccagcaaagactgcactgaatgaggccggccarcacgcacaacgcggcccgacctctgagctacccaaagggagagcagcaagttgcctgtgcgtggctggttcctgtgcgcccataggagcatgaaacgccc

SEQ ID NO: 38944 - DNA, 201 bp, Homo sapiens
tggctgctctcagagctgcgcacccaaggctgtgggtagcggcacagggtgttcctgcaagctcgccaaggtggccctttgtgggcccgggtgccaccatsacacaggatgaagctggacaggcacccttggagtcgtgcggcctgtgggatccaggggaggcccacaggccactccctccgcaggtggtgtccggggccc

SEQ ID NO: 38945 - DNA, 201 bp, Homo sapiens
ggagaaggaggttgcaatgggccacgatcctgagagattcctcctcaagagaggtatcagactttgtgatacagtaacaacattttagagtaactttttgktgggggttggggagggtgtctcctggagtgcagtggcacaatctcggctcactgcaacctctgcctcccaggttcaagcagtcttgtgcctcaggcccgt

SEQ ID NO: 38946 - DNA, 201 bp, Homo sapiens
  misc_feature (1)...(201): n = A,T,C or G, or insertion/deletion polymorphism (see Tables 1-2)
acttggataggtgactcaaaagtttagttggaattgggtttacacagcctcttaacacagggacaggccacttaaagaacaataacaggacagacgaaaanagcttatgcttccaagggcaggaaactgagaagataaatacgtgggatgaaaccgatggagtaaggtttgtttgcagatgcgtgcggtgtcatctctggg

SEQ ID NO: 38947 - DNA, 201 bp, Homo sapiens
cccccacgcccatcctgggaaggggcccggagtgtgagagagaggctcccccacgcccatcctgggaaggggcccggagtgtgagagagagactcccccakgcccatcctgggaaggggcccggagtgtgagagagaggctcccccaagcccatcctgggaaggggcccggagtgtgagagagaggctcccccacgcccat

SEQ ID NO: 38948 - DNA, 201 bp, Homo sapiens
agcgccggcactccagcctccgtcaagagcggagccctcaggaggaaagctggagccagtcctgggcctgggccttccctcagggccctgggctgaccgcygggcagtgcccacccaggctgcaccctggcagcgtgagacggagcaggcactctctggggggctccgctgacctgctcagtgtgctgtttgccacggact

SEQ ID NO: 38949 - DNA, 201 bp, Homo sapiens
agcagtctcaggacacattgcttgctggccacttctccgctggttatgtgactgtctcaccttctgcctgctcactcagcatgcatcttttattgaactckgaggtccctgagcatgacttgctcaagggaccaccccagggatcctgaatctgatgtggaaacaggcctggggaggccccaaggcttccttgagagtgtg

SEQ ID NO: 38950 - DNA, 201 bp, Homo sapiens
catatccatcagcttaagagggaaaagcagcttgaagattctggtcacttagatttagcaaatgaggtcacccactttcatctcgcttctttgaatgtgcrtttaaggcctggggaattcatgatttttcttttactttaccaaacctcttctaggttcttcccgcaaagagatcacaaaacactgggaatggctggaaaa

SEQ ID NO: 38951 - DNA, 201 bp, Homo sapiens
  misc_feature (1)...(201): n = A,T,C or G, or insertion/deletion polymorphism (see Tables 1-2)
tggggagtcagctacctcctcccacctgagtgtcaggctcagcccagggacccagagaggccatgaactctggcggggctaggtcagctgacagaggtagngctccatccccaggactgtgtccctagagaagctgattccctgggctgcagcaggcctccccacacctgactttctcctgcgactcaacctttgatccct

SEQ ID NO: 38952 - DNA, 201 bp, Homo sapiens
aagcagtctcaggacacattgcttgctggccacttctccgctggttatgtgactgtctcaccttctgcctgctcactcagcatgcatcttttattgaactstgaggtccctgagcatgacttgctcaagggaccaccccagggatcctgaatctgatgtggaaacaggcctggggaggccccaaggcttccttgagagtgt

SEQ ID NO: 38953 - DNA, 201 bp, Homo sapiens
tcaacaagcagagtgtctctcctcctatcccgcacctccgtgccttgctgagcagcagcgatgacccccctgcagaggtggacatctttgagctcctgaargtgtcctatgaggtcagcacccagtggggccattttggccaggccgctccatctggcatgtgggttggggtggctatgggcaggtggtggccctctgccc

SEQ ID NO: 38954 - DNA, 201 bp, Homo sapiens
gccaagaggagtgtggtatgggtgccagcagggctgggcgggggctgggctgggggggcagcagtgccttccccacagagcagggtgggtacagggctccrccgcacccagtctcctacactgctttggtatgtacatcatggtaggattcatgggaccgggatccaggggtgtaggtgggaatgtggggagaggttccag

SEQ ID NO: 38955 - DNA, 201 bp, Homo sapiens
gctggcagaagagcctggtcagggagggaaggaaggtggtcggggcaggcgtgccagcagagacgtctggttcacagtcacactggcctcccgagcatagygccgtagtgctcttgttcctaagagcaagaaggctgagttgtgccttgtgaaggagatccgtgcatgcgagcagcttctttcaggcgtgagtgatagtgc

SEQ ID NO: 38956 - DNA, 201 bp, Homo sapiens
  misc_feature (1)...(201): n = A,T,C or G, or insertion/deletion polymorphism (see Tables 1-2)
ctcctctgagaactgcccagactccacagacccatccttcctccttactcctctggacatgacgtgtctgcacacgcttttacgtggaagcccatgaggcngggagcttccgagggtgagggcaggctctgcagccaggcacccagggttaggattctgatttgatcacttcccagctgtgtgaccttgggtaacttattt

SEQ ID NO: 38957 - DNA, 201 bp, Homo sapiens
  misc_feature (1)...(201): n = A,T,C or G, or insertion/deletion polymorphism (see Tables 1-2)
atttctgagtgggccaggaggttggtgtgtgctaatgaggagaggagctgctttaacatgggcccttgagatttccatctctggcagcaagagctgcccgnccctggggagagaaaagtacgaggggcagagtgggaatccctttagtcacagcaggcctggtgctggggaggggcccagccacagccacgcagcggagcc

SEQ ID NO: 38958 - DNA, 201 bp, Homo sapiens
  misc_feature (1)...(201): n = A,T,C or G, or insertion/deletion polymorphism (see Tables 1-2)
gtcaaggaagtaaaagcacagggcgggcggcaccccgggaatagccccactcccaggtgggcgctctgcacgggcatcctgaccagcagtgcccttctccnttgcaggactgaataactcagtaagagttaggaaggggagtttgtccaaggccaagcagggaagcccagttagacccccgatctctggcttcagagcctg

SEQ ID NO: 38959 - DNA, 201 bp, Homo sapiens
tggctgtttaaaatggctcccaagcatagcgctcttgttcctaagagcaagaaggctgagttgtgccttgtgaaggagatctgtgcatgagagcagcttcrttcaggcgtgagtgatagtgctgctggccgtgagctcaatgccaatcgatcaggaatacgtattaaataaggcatctttaaacagaaacacatgtaaaac

SEQ ID NO: 38960 - DNA, 201 bp, Homo sapiens
tggcctcttaaagtgctgggattacaggcgtgagccactgtgcctggccagtatttctatttttaatttattttaaattattattattatttttagagacrgggtcttgctatgttgtccaggctggtctcaagctccttggaccaggggatcttccggtctcagcctcccagggcatgtaccaccacacccagctaatat

SEQ ID NO: 38961 - DNA, 201 bp, Homo sapiens
aggagcacaagggaaaccttgcctcgcagcttgtgcttgaccccaagtcccacctctcctctgtggggcacccggtgactccaacctgccctgttactgcmcccaaagtaccagaagaaggacagagacagctggcacccgtgtctccccaggggcctggaatgagatggtgactcaccccgggtactatgctgagctggt

SEQ ID NO: 38962 - DNA, 201 bp, Homo sapiens
agcggagccctcaggaggaaagctggagccagtcctgggcctgggccttccctcagggccctgggctgaccgctgggcagtgcccacccaggctgcacccyggcagcgtgagacggagcaggcactctctggggggctccgctgacctgctcagtgtgctgtttgccacggactccaggcctctgaagggaagggccctcc

SEQ ID NO: 38963 - DNA, 201 bp, Homo sapiens
gggcccggagtgtgagagagaggctcccccacgcccatcctgggaaggggcccggagtgtgagagagaggctcccccacgcccatcctgggaaggggcccrgagtgtgagagagaggctcccccacgcccatcctgggaaggggcccggagtgtgagagagaggctcccccacgcccatcctgggaaggggcccggagtgt

SEQ ID NO: 38964 - DNA, 201 bp, Homo sapiens
  misc_feature (1)...(201): n = A,T,C or G, or insertion/deletion polymorphism (see Tables 1-2)
gaggctgaggtgggagaatcactgtagcccagtaggcggagcttgcagtgagctgagatcatgtgactgcactgcagcatgggtgataaagtgagagtccnttaaaaaaaaaaaagctgaggaaagtaacaaataaccagaaccaatcatcaccatcaaaactattaccgggcactgtcatgggcaggtgctgggactggc

SEQ ID NO: 38965 - DNA, 201 bp, Homo sapiens; identical to SEQ ID NO: 38963

SEQ ID NO: 38966 - DNA, 201 bp, Homo sapiens
cacctgccttggcctcttaaagtgctgggattacaggcgtgagccactgtgcctggccagtatttctatttttaatttattttaaattattattattattwttagagacggggtcttgctatgttgtccaggctggtctcaagctccttggaccaggggatcttccggtctcagcctcccagggcatgtaccaccacaccc

SEQ ID NO: 38967 - DNA, 201 bp, Homo sapiens
ccagtcagcgatgattccagaaagacaagaggccagttgctccagggccttgtataggggcatgtttccagattgagtgagtgtctgtgaaccaggagccrgaggcttgtaggctacctttgacaagatatgcgttccacaccctgcaccctcccagccctgcccagggctctgcacacgcaggctcacatgcatcctcca

SEQ ID NO: 38968 - DNA, 201 bp, Homo sapiens
ctcactcttgtttcccaggctggagtgcagtggtgcagtctcagctcactgcaacctctaccacccaggttcaagcgattctcctgcctcagcctcttgartagctgggattacaggcatgtgccaccatgcccagttaatgttttgtatttttagtagagacggggtctcgccatgttggctaggctggtcttgaactcc

SEQ ID NO: 38969 - DNA, 201 bp, Homo sapiens; identical to SEQ ID NO: 12455
  misc_feature (1)...(201): n = A,T,C or G, or insertion/deletion polymorphism (see Tables 1-2)

SEQ ID NO: 38970 - DNA, 201 bp, Homo sapiens
tgccaatggaaatgtgctgtgagtgttcagatcactgtacacgggttttggagacttcgtatgaaaagaaaaacgtaaaatacctccatctttttttttttgggggggggacagagtcttgctctgtcacctaggctggagtgcagtggggcagtcttggctcactgcatcctctgcctcccaggttcaagtgattctcct

SEQ ID NO: 38971 - DNA, 201 bp, Homo sapiens
tggcgccggctgcttctgggcccaggaagaggctgtggctcccaccttccttacacctggtgggagcccgcctcgcaccagctgcacctgcctagcattasaggctctcagatctgcccttgcttgcctcatacctctgtgctccacactgcggccaggccagctgagtccctccatccgtggatgctttcctgcagctat

SEQ ID NO: 38972 - DNA, 201 bp, Homo sapiens
  misc_feature (1)...(201): n = A,T,C or G, or insertion/deletion polymorphism (see Tables 1-2)
ttgtgccttgtgaaggagatctgtgcatgagagcagcttcattcaggcgtgagtgatagtgctgctggccgtgagctcaatgccaatcgatcaggaatacntattaaataaggcatctttaaacagaaacacatgtaaaacagttatgtatcggtcagtcgacagaagtgtgattagaggctccaggaacctaaccctgtg

SEQ ID NO: 38973 - DNA, 201 bp, Homo sapiens
gcaccaaagtgatggaaccctcaggtgctctccgggagcctgaacctcctgactgaggaacatgggcagaacatgtttattgcacagagtgggcgctgcgyacaggcgtggctgtacacgtgctctcagctcatcatcctttccagtaactttaaaaaaacatccctcaggtcctgatatatttccttggattcatttcac

SEQ ID NO: 38974 - DNA, 201 bp, Homo sapiens
  misc_feature (1)...(201): n = A,T,C or G, or insertion/deletion polymorphism (see Tables 1-2)
tcacgtgtcctgttcacagtctctgcagtgccatgtttttcccatgtttgtgctcgttgctgatgacttggctgtttaaaatggctcccaagcatagcgcncttgttcctaagagcaagaaggctgagttgtgccttgtgaaggagatctgtgcatgagagcagcttcattcaggcgtgagtgatagtgctgctggccgtg

SEQ ID NO: 38975 - DNA, 201 bp, Homo sapiens
gacctgtttgtggtctctgcccccaaaggcagggacttcctccattgtttccacattcccagccctcctgcaggcttgtaggacactgtaaggacattggrtcgcagcaccacagactgactgctttggccaattaaagtacaggagcattggctggcaggttctcggcctccttccacagagctggcaccagggtctctg

SEQ ID NO: 38976 - DNA, 201 bp, Homo sapiens
gcaggacccgttcctagcttcctagcttcctgccagaaaagaaatggatctaagagtatcctcttagaagtagatagaaatagggaatagaatagaaaaasagaaacagatctaagtgcatcctcagatgcagttgccatgaacctcctgtggtagaatcgaatccctcttggagtttaggcaggacctcttaaatggcag

SEQ ID NO: 38977 - DNA, 201 bp, Homo sapiens
  misc_feature (1)...(201): n = A,T,C or G, or insertion/deletion polymorphism (see Tables 1-2)
aggagcccggctggctcgggctcagtgcctgtgctcttcggggcaccgactgttgccctacaggattgcggtcccagtgttgccaggtcgtccagtttatnaagagcattttctgtgaatcatcctgattttcagtgtgagcagctaatagccagatgcagacggaggcttctcctgggccacgtttcttcatgtggaaga

SEQ ID NO: 38978 - DNA, 201 bp, Homo sapiens
tcctcagcctgccctgccctgtcctgtccagacacagagaacacttgggctctgctgggcttgtggcccatgcccgctacactcacccaggaccatgcgawccgcaaccctgggtactgcttggtgacctccagcaaagactgcactgaatgaggccggccagcacgcacaacgcggcccgacctctgagctacccaaagg

SEQ ID NO: 38979 - DNA, 201 bp, Homo sapiens
taagtgcatcctcagatgcagttgccatgaacctcctgtggtagaatcgaatccctcttggagtttaggcaggacctcttaaatggcagcaaatccattcragtcatcttacacagaagagggaatacattgcccctgtattgctagactgaaaagtctagcaatgcacagcttcaggcatggctggatccaggtgctgaa

SEQ ID NO: 38980 - DNA, 201 bp, Homo sapiens
agggggcgccgcccgcccggccccgccccgccccggcccgctccgcacgctccgctccgcacgctccgctccgggacgccgacggcggcgggcgcttccgyctcgcgggcctcggcccggtgcgagcggctccgcgatgtggctgagcccggaggaggtgctggtggccaatgcgctgtgggtgacggagcgggccaaccc

SEQ ID NO: 38981 - DNA, 201 bp, Homo sapiens
tggccggccgtcgggaccccagcctgccctacctggagcagtaccggattgatgccagccagttccgggaactctttgccagcctgacaccctgggcctgrggctcccacacacctctgctggcagggcgcatgttcaggctcctggacgaaaacaaggactcgctgatcaacttcaaggagttcgtgacagggatgagtg

SEQ ID NO: 38982 - DNA, 201 bp, Homo sapiens
  misc_feature (1)...(201): n = A,T,C or G, or insertion/deletion polymorphism (see Tables 1-2)
cctgggcctgtggctcccacacacctctgctggcagggcgcatgttcaggctcctggacgaaaacaaggactcgctgatcaacttcaaggagttcgtgacngggatgagtgagtgcctgcagggcctaccaggggcttgaccctccctcaccctttcccaggaagcctccaaatgccagcatctcctgtctgttccccctg

SEQ ID NO: 38983 - DNA, 201 bp, Homo sapiens
  misc_feature (1)...(201): n = A,T,C or G, or insertion/deletion polymorphism (see Tables 1-2)
ccctggccttctccacaggcgggatgtaccacggggacctgacagagaagctcaaggtgctctacaagctacaccttcccccaggtgagagcctcctgccnactccccagccagggtctcccacttgtccagaagttcagctgcagaggacaggcctctgtgagactgtggggcctcgagggggcacagcagcgtcgcagg

SEQ ID NO: 38984 - DNA, 201 bp, Homo sapiens
gggcactgctgggtacagaactcccaccgaggaggcagctggacccaaaacccactaggagggccatgagtggagcttcagggctggaaccgaaactgctycatttatctgtcaagtttcttaagggtttattcccagagtttcagctagagaatcctgtcacatggccatgaggaggggccacttctctctggcctctca

SEQ ID NO: 38985 - DNA, 201 bp, Homo sapiens
  misc_feature (1)...(201): n = A,T,C or G, or insertion/deletion polymorphism (see Tables 1-2)
tgccaggtcgtccagtttatcaagagcattttctgtgaatcatcctgattttcagtgtgagcagctaatagccagatgcagacggaggcttctcctgggcnacgtttcttcatgtggaagagactgttctgttcccagaaacactcagtgttcccttcagcttcgggttccctcccagtgggcttcaaggatctcgggctc

SEQ ID NO: 38986 - DNA, 201 bp, Homo sapiens
ctactgggctcaatcgatcctcccacttcagcctcctgggtagctggaactacaggtacacaccaccacgcccagttactttttgtattttttatagagayggggtctcactgtgtggcccaggctggtcttgaactcctgggctcaagtgatccgacctcctcagcctcctaaagtgctaggattacaaagtgtgagcta

SEQ ID NO: 38987 - DNA, 201 bp, Homo sapiens
  misc_feature (1)...(201): n = A,T,C or G, or insertion/deletion polymorphism (see Tables 1-2)
atcatcctgattttcagtgtgagcagctaatagccagatgcagacggaggcttctcctgggccacgtttcttcatgtggaagagactgttctgttcccagnaacactcagtgttcccttcagcttcgggttccctcccagtgggcttcaaggatctcgggctcctgttctggacccgcctcctagatccagctgttcagtc

SEQ ID NO: 38988 - DNA, 201 bp, Homo sapiens
cgagctcccagggtccccccaagggaacccttctttgaaccctctcccaatctctccccactgctaggtttggtgtgtcctgctgtgccctctgacagggscttccctgtgccatcatgggcatcgtggcctcctgagtactgtcctccctgaagaggagcagacagggatgtggttttatccaagccatctattaaaaac

SEQ ID NO: 38989 - DNA, 201 bp, Homo sapiens
ctgcctatgccttccgaaaccccaccatcggctactgccaggtaaggggcctgacaggggcccagagacagcatctgccaccagaggttcacaggagcagrtccctgtggtcccaggcctgtgtggtgaccctgccttgtgtcccaaggaaggagcccagcagaaaaagatgtaatttaaaaacagtattaattgctcatc

SEQ ID NO: 38990 - DNA, 201 bp, Homo sapiens
aaatccctgaaagaaataaaaaccactgtgtgcaatgccttgctgtggcccccaaccactgcttaggcctcccaacttctccccaggccaagtatggggcyctggctgtgttctggaagttcaagacacttagtcctccacagtgggtggaagagtgcaaggtctgccaggtcagatggagacgcagaacctgctggtgca

SEQ ID NO: 38991 - DNA, 201 bp, Homo sapiens
atagagaagaagttgtccagagaagggataaagaagttaggcaaagaagatcaaacttacgtataatcgtagtgccatcccacacccttcccagaaaaaarcagtggaataacagataatagaaactgtgattcaggaaaactgataaaataagcttgaacttgtatagtggaaggacacattgaatgtctagaaaaatca

SEQ ID NO: 38992 - DNA, 201 bp, Homo sapiens
aggctctgacagcattcacacccgtggttgctggaagaggcaagtcagccacttgaactttcgggtagagcaccctccccaggagcacaagggaaaccttrcctcgcagcttgtgcttgaccccaagtcccacctctcctctgtggggcacccggtgactccaacctgccctgttactgcccccaaagtaccagaagaagg

SEQ ID NO: 38993 - DNA, 201 bp, Homo sapiens
gaaaaaaaggactgggattgaacagagcaggaacacttggggtaaaggagaaaagctttagatacaagaaagaggtggccaatcccagaaagtacaggagsaaggactacacagaccgaccacagcaggggaaaggcctctccagctgtggagttcagaaagctactctgacccacaactgcccgtacgtagaacatcctg

SEQ ID NO: 38994 - DNA, 201 bp, Homo sapiens
tgagctcgtctgtcctgagccggcctggagttggccaggcaggagctcccagctctttcacacagccgggagccgggctctgggctctgggctctggcccrggacccaaccagaaggagcatctcgagggacagaggctggggaatgggcactctgctggccgggtggtgccctcccgcccacagcgggagggaaacaggt

SEQ ID NO: 38995 - DNA, 201 bp, Homo sapiens
actacagcctccatctcccggacttaagtgattctcccacctcaacttcccgagtagctgggacagcagatgcttgccaccacacctagctgttttttttwaatttttaacagagacagggattcatcatgttgcccaggctggtctcaaacttcaggattcaagtgatcctccctcagccgtccaaagtgctgggattac

SEQ ID NO: 38996 - DNA, 201 bp, Homo sapiens
ggtaggaacagtgtaggtgtaagaaggggtcagattcaggagacgctattgtgataaaatacacataacaacatttaccattaagtacattgacattgctrtgccatcaccaccatccatccacagaactttttcagttttgcaaaactgaaactctgaacccattaaacagtaactcctcagcccccactcccccagccc

SEQ ID NO: 38997 - DNA, 201 bp, Homo sapiens
catcagcctcgctcatcctgcccgcaggagccctggtggaccaaggcatcttcgaagagctcacgagagacttcctgccgcagctctcggagaagatgcakgacctgggggtgatctccagcatctcgctgtcctggttcctgaccctcttcctcagcgtcatgcccttcgagagcgccgtggtcatcgtcgactgctttt

SEQ ID NO: 38998 - DNA, 201 bp, Homo sapiens
tggtgtcgcgcacctgtaatcccacctatttgggaggctgaggcacaagaattgcttgaacccgggaggcagaggttgcagtgagccaagattgcgccacwgcattccagcctgggcaatagagtgagaccctgtctaaaaaaaaaagaatttagacaaaatgggcactttattagaataacatttattaatttccagttg

SEQ ID NO: 38999 - DNA, 201 bp, Homo sapiens
ggcgatccacctgcctcagcctcccaaagtgctgggattacaggggtgagccaccgtgcctggccactccatcattttttaattgattcctgttgaaatgygagtattttggatatattggattaagtcaaatatattgttaaaattaatctcaataatttactttaggactttacaatgtggctactagaaaatttacaa

SEQ ID NO: 39000 - DNA, 201 bp, Homo sapiens
cctcggtgctcctgctctatggcagtgaggaggaggccttctggctcctggtggccctgtgcgagcgcatgctgcccgactactacaacaccagggtggtrggtgagtgtccccgggtgctgcctcgcctgggtctccaggtgcctgctggttccatgagggtggcagcccttcccaggccaagctccaggcttcacgtgg

SEQ ID NO: 39001 - DNA, 201 bp, Homo sapiens
catctctactaaaaatacaaaaaaattagccgggcatggtggcgggggcctgtagtcccagctactcgggaggctgaggcaggagaatggcatgaacctgsgaggcggaggttgcagtgagccgagatcatgccactgccctccagcctgggcaacagagcgagactccgtctcaaaatacgctgtgaggagcatctttaa

SEQ ID NO: 39002 - DNA, 201 bp, Homo sapiens
ccagggcatccatcagcctccccgctggagcctgaccccatggttccggctgtgggcctccgcctaggggtggatgtgtcagagctggcaagagacccctrgcccagacccacactgcccagcaacatcacagcctctctgcacccccagccacacacccggtactcctcactcctgctgggcccattgcccatgaggaac

SEQ ID NO: 39003 - DNA, 201 bp, Homo sapiens
aaaatacaaaaaaaattagccgggcgtggtggtgggcacctgtagttccagctaatcgggaggctgaggcaggagaatggcataaacccgggaagcagagkttgcagtgagccaagatgatgccactgcactccagcccaggcgacagaatgagacttcgtctcaaaaaaaaaaaaaaaaagtagagatggggttttgcca

SEQ ID NO: 39004 - DNA, 201 bp, Homo sapiens
  misc_feature (1)...(201): n = A,T,C or G, or insertion/deletion polymorphism (see Tables 1-2)
gaccaggtctcagctcagtggccgcctcccctgggaccacccagccttccctcttcccagcactcacccctgctgactgtgctcagctggtgcatccctcntccgtctccctgccaggccttgggctctgcagaggtgcccactgaaagcttgtcctgtgccctctacacctcagaggggttcagagccaagctccaggac

SEQ ID NO: 39005 - DNA, 201 bp, Homo sapiens
aaattccattcttggcgtttaccctacagtgtattcatatatgcagaatatacagtttaaagggccaggtgtggtggcccacacctataatcccagcactwtgggaggccgaggtgggtggatcatctgaggtcaggagttcaagagcagcctggccaacgtggcaaaaccccatctctactaaaaatacaaaaattagcc

SEQ ID NO: 39006 - DNA, 201 bp, Homo sapiens
aaaaaagtgcacactcacctccaccactgcccagctcacactgtcctggcttctctggccttctcttcctccctcaggcagtcctactcccctctgcaggrtgactgctgtgcccccacccatctcttccccagcactcacctggctggaccaggtctcagctcagtggccgcctcccctgggaccacccagccttccctc

SEQ ID NO: 39007 - DNA, 201 bp, Homo sapiens
  misc_feature (1)...(201): n = A,T,C or G, or insertion/deletion polymorphism (see Tables 1-2)
aggctccaggaacctaaccctgtgttcccccagggtactggttcaggattcgctaactcagtgttcgcggccaccttacagaatctgaccacctgaataangagaatctgccatgtcttggctgaggctgtcttcatgcctggtgggtgggcctcctgtcccacccccggacagctgagaatgattcagggtgtcattcac

SEQ ID NO: 39008 - DNA, 201 bp, Homo sapiens
  misc_feature (1)...(201): n = A,T,C or G, or insertion/deletion polymorphism (see Tables 1-2)
aataaggcatctttaaacagaaacatgtaaaacagttatgtatcggtcagtcgacaagagtgtgattagaggctccaggaacctaaccctgtgttcccccngggtactggttcaggattcgctaactcagtgttcgcggccaccttacagaatctgaccacctgaataacgagaatctgccatgtcttggctgaggctgtc

SEQ ID NO: 39009 - DNA, 201 bp, Homo sapiens
  misc_feature (1)...(201): n = A,T,C or G, or insertion/deletion polymorphism (see Tables 1-2)
agcttctctagaaaagtcagtgcccagccctaaaggccccatcccattgggcagcgggcgtgggagctggggctgtgcgtgtcctccatgctctagagccntgtgtggtctggcccaggcagacctttacattgtctgccccagtaatagatgctaaataaattactacgtcagtgagcgcatgggaaggggtgggcggaa

SEQ ID NO: 39010 - DNA, 201 bp, Homo sapiens
  misc_feature (1)...(201): n = A,T,C or G, or insertion/deletion polymorphism (see Tables 1-2)
gtcacactggcctcccgagcatagcgccgtagtgctcttgttcctaagagcaagaaggctgagttgtgccttgtgaaggagatccgtgcatgcgagcagcntctttcaggcgtgagtgatagtgctgctggccgtgagctcaatgccaatcgatcagggatacgtattaaataaggcatctttaaacagaaacatgtaaaa

SEQ ID NO: 39011 - DNA, 201 bp, Homo sapiens
ctctggctaaagcgatcctcccacctcagcctcctgactagctgggactgcaggcccacgcaaccatgcctcattttttctattttttgtagagacagccrtgttgcccagactgatctcaaactcctgggctcaagcgattcccctgcctcagcctcccagagtgctgggattataggactgagccactgtgcccggcct

SEQ ID NO: 39012 - DNA, 201 bp, Homo sapiens
gacgattaaggatcttcccaagatgaaccaggtaggctccactggagcccacagtagacatttctggagagttctgaccaagactgggccctaacatcacygcacctgcactgcagcatctcctggtgggtgggaaggctcctccctgcctctagagcccgttagtcctggttgccagtcagcgatgattccagaaagaca

SEQ ID NO: 39013 - DNA, 201 bp, Homo sapiens
acgattaaggatcttcccaagatgaaccaggtaggctccactggagcccacagtagacatttctggagagttctgaccaagactgggccctaacatcaccrcacctgcactgcagcatctcctggtgggtgggaaggctcctccctgcctctagagcccgttagtcctggttgccagtcagcgatgattccagaaagacaa

SEQ ID NO: 39014 - DNA, 201 bp, Homo sapiens
ggcttcagctgttgggttgaggctacagtgagccgtggttgagccactgcactccagcttgggtgacagagtgagaccctgtcttaatttttttaaaaagrctctgctcacaactggtgatgacagtagttacgggagttgcaggaactttgtctagagagtcacacaggcagcgtctctcatccatgtgccttgactgca

SEQ ID NO: 39015 - DNA, 201 bp, Homo sapiens
ccgttagtcctggttgccagtcagcgatgattccagaaagacaagaggccagttgctccagggccttgtataggggcatgtttccagattgagtgagtgtstgtgaaccaggagccagaggcttgtaggctacctttgacaagatatgcgttccacaccctgcaccctcccagccctgcccagggctctgcacacgcaggc

SEQ ID NO: 39016 - DNA, 201 bp, Homo sapiens
ctccctactgtgggcctaagtagcttttggtccacactgatgttaagatactcagcctgtggccggagtctgtggctggttttcctgccgcttcctacaaraggcggatagggcctcctccagagcaggggtctgactggggatatgaccagggctatgggcatggggagtcagctacctcctcccacctgagtgtcaggc

SEQ ID NO: 39017 - DNA, 201 bp, Homo sapiens
  misc_feature (1)...(201): n = A,T,C or G, or insertion/deletion polymorphism (see Tables 1-2)
cccaggtcagaccagcatgctctgagtgccaagagaaaggcagctggaggggaaagccttttgaagagctgtgtggcctctctgagcctgtgtcctgatcngtgagatgggactgatgaggctcatggagatgattagcaagacggcagccaacatccttaggctggtgcttgtcatcagtttggctaatatggaccccgt

SEQ ID NO: 39018 - DNA, 201 bp, Homo sapiens
  misc_feature (1)...(201): n = A,T,C or G, or insertion/deletion polymorphism (see Tables 1-2)
actgcggccaggccagctgagtccctccatccgtggatgctttcctgcagctatgtggtatgggggtcattcctgcctcttggcaccaggttggggggcangtgcttgttgggcaccaaagtgatggaaccctcaggtgctctccgggagcctgaacctcctgactgaggaacatgggcagaacatgtttattgcacagag

SEQ ID NO: 39019 - DNA, 201 bp, Homo sapiens; identical to SEQ ID NO: 12487

SEQ ID NO: 39020 - DNA, 201 bp, Homo sapiens
cacatcatagcagccagccctcccgggctacttaacgtttgggttcctaggttgtagcttatgggaaactccagaggctggacaagatctctgaggttccstgggtcccacagccagcctgaccacagccagattcacacccttgtgttgagcgacctcattccagccaggccatttcctgcattgcacccacagactatg

SEQ ID NO: 39021 - DNA, 201 bp, Homo sapiens
  misc_feature (1)...(201): n = A,T,C or G, or insertion/deletion polymorphism (see Tables 1-2)
ggttagtgagcagtggagccaggatgtagccacctcagccagggtgttctgacacccccagaaaggctttggtaaatctgggctcaagtgcacggcctccntcccaccgtgattgacagctctcctgtataccctgagactccttggccagaggcctctcacagccatgggacccccaggggtcctgagtttgacgtggaa

SEQ ID NO: 39022 - DNA, 201 bp, Homo sapiens
ccctgtgaggctgcattggctctcacttgctccttcttgggtttcttggacttccacagtgaccctggtgggagcaaggccatctgtcctgcactgcaccraaggggtgtggacagcaaggacaagggcccttgcccaaatagaaggcatgagactgagtcaggacaggtcccaaggcctccttttccttgtggccaagca

SEQ ID NO: 39023 - DNA, 201 bp, Homo sapiens
  misc_feature (1)...(201): n = A,T,C or G, or insertion/deletion polymorphism (see Tables 1-2)
cctgttctgtgttggccgcgctgtgctgtgactgttcacacctccgtgcgctcccacttgggggagctgctgggtgggtctcggtggttcacctccgcacnttcgttcctttccccttcagccactggtgggggagacactcaccgtgtgtggttggtctggaaggcagtggacacctcagtggcctggtccctccacatg

SEQ ID NO: 39024 - DNA, 201 bp, Homo sapiens
cggccttggccaggcgtacacctgctcccagccgacttttaccatgccccccactcgctagtagggttctctacatggtgactccgcgtgcctgccctgcsctcttctgctgaactggcgtattcaggcacacgtctgtcccaaattcctggtgattccatgtcatgcaatgccttgggtgcgtgccacagccctcatctg

SEQ ID NO: 39025 - DNA, 201 bp, Homo sapiens
tactaaaaatacaaaaaaattagccgggcatggtggcgggggcctgtagtcccagctactcgggaggctgaggcaggagaatggcatgaacctgggaggcrgaggttgcagtgagccgagatcatgccactgccctccagcctgggcaacagagcgagactccgtctcaaaatacgctgtgaggagcatctttaaaaaagc

SEQ ID NO: 39026 - DNA, 201 bp, Homo sapiens
tgggagagtttatgtggacagagccaccaaaggggtgagggcctgggccaggccactgtcacagccatcagatacacaggtgtgcatttctgttagcagckgcatgctttagtttaagctccacacctccctgtggggagctcctcacctaggtttcaaggtgaaacctggggttaggcctgcccagggtggaagagctgc

SEQ ID NO: 39027 - DNA, 201 bp, Homo sapiens
  misc_feature (1)...(201): n = A,T,C or G, or insertion/deletion polymorphism (see Tables 1-2)
aatttcttcactaaaggacagagaccaaactgttccttgcggtctagtatttaataactggaacttgaaagtcctccttctaccaaccccacctccaaccnatcattccccttctcccaaagtactactgctgttgcacgacaaccccaaatatgttctgtcaacacaaacctgcctttgatgcataaacagggcattaca

SEQ ID NO: 39028 - DNA, 201 bp, Homo sapiens
gaccatctggaacactaactttgtacatcaattaggcaaaatgttaacctcaaaaagagaaattcagttcttcccattagtagatctgtattacacaaathtatttgattattattattttttttttctgagaccgggtctcactctgttgcccatgctagagtgcagtggcatgatcacagctcactgcagccttaacct

SEQ ID NO: 39029 - DNA, 201 bp, Homo sapiens
ctggaccctcttcgggccttcggggttgggggaggagctgctgagcctctcactagcctccctgctcccagcccccgcctcaccggggccgcccctggccstgccccgcctcttgatccccaaccaggaagcttgcagtggtcccggggcccctcccttcctgctcatcctggtgtgcacggctccggagaacctgaacca

SEQ ID NO: 39030 - DNA, 201 bp, Homo sapiens
gtttttttgtttttgtttttgttttcttttaaggggtcatctagtcataagggaaaatccttcgggctgtgaccgaagcaacaaaggcaaaaacgcggacsttggttatgaagggtgtggtctccctggtggagtacgtcggtgggttgggatggggagcggctggacagaccggtctcactccgtttggtgccactccac

SEQ ID NO: 39031 - DNA, 201 bp, Homo sapiens
aatgtaagcattagtttctttttataataacttgggcagtcagttctgggcactgacaaaattgagtttgtgatcttggaatactttgattatggggatamagtgatttgcctaaataattgtgacccttagagattctgaggaactgacagcccaataccttaatcaaagcctgtaactcataagaccctggtttactgc

SEQ ID NO: 39032 - DNA, 201 bp, Homo sapiens
tcttcctgtcttctggtggttgtcagtaatccttagtgttccttggcttgtagctgcattactccaatctgttgctgtcatctcatggtcctcttcgtgtstctctcatgatttgtcattggatctagagcccaccctaatcaaatataacgtcattttacctaattatttccgtaacgaccttatttccaaatagggcca

SEQ ID NO: 39033 - DNA, 201 bp, Homo sapiens
gaaacccccagagtgggaagaagagctcctgcgaggacctacattttgccattcccctctgccctggggctcagagccttgaagcctttgcttggcccttrcatgttaggatatggccaagaatcagaaactgatgcgtttttccagcactacctgtgtgctgcactcatggaaggtgggaagctatacacaggtatccaa

SEQ ID NO: 39034 - DNA, 201 bp, Homo sapiens
gacttacgtgcctgtagaatctactgccacagcccggaccccaccacgatgacagagaatctttgccagtggctccttcatagctggactccataaagacrcagtacctggaagagaagaagaaccaaagttgctaatacacacctaagcctgaggttactaaacatgggaaagatgggaactcaagaccaagagataaca

SEQ ID NO: 39035 - DNA, 201 bp, Homo sapiens
cagcctcatcactggagcccccgtggcctgacaagctcctgaggaggaccagagaaaagcagggatgggctgaagatcacaaggaccagagctgtttagcmtcaaggtgttgattaaacttcaggcctcagcgaactagtgattaagccctaagcacaggagtggctgacccaggtagcccacggagggcaagctacagct

SEQ ID NO: 39036 - DNA, 201 bp, Homo sapiens
gaatattcattgagcttggaaaggggttggaatgagagaaccgtttggaagcactggaatacagctttattcctacacgattagacccgttaccccgtggstctggccgaccgtcctgactcggagatccctgagctgcgccgccgcttccttcgtcaacatccagcagctacttgatgagcgccctccagtgggccttag

SEQ ID NO: 39037 - DNA, 201 bp, Homo sapiens
cctgaccttctccagcaggggggaacctgaccttctccaggaaggaggaacctcaccctctccaggacgggggaacctgaccctctccagcaatggggggratctcaccctctccagcaggggagcctcaccttctctagcagggccttcacctcccactcctggcgctgcttccggcttctgtatggattactctccagg

SEQ ID NO: 39038 - DNA, 201 bp, Homo sapiens
catccagatcaccttgactgctggattaagaaaagaaagtggtttagggagagactgacccctttagcatttaccacagaaaataagtgattaaagccaakatagtggtctaaggtcaagccaaaacatttcacctggggaagtggggaggaggtatggttgctcacccgaattcgctaagattttcctgaaccacgagct

SEQ ID NO: 39039 - DNA, 201 bp, Homo sapiens
accccaaaccacaccttccccagcagcaggggcctcactctctgcagcaggggaacctcacctccaacaggggcaatctcaccctctccagcaggggggawcctgaccctctccaggagagggaatttcaccctctccagcagagggaaacctgaccctctccagcagggggaatctcaccctctccagcagagggaaacc

SEQ ID NO: 39040 - DNA, 201 bp, Homo sapiens
ctctagtgatccctgaaaagttccagcatattttgcgagtactcaacaccaacatcgatgggcggcggaaaatagcctttgccatcactgccattaaggtragtgaagtagggtaaggaatagggaatgtaaatgagaattgggttgtgaagacataagcaaaaatgaagcaaggctggggagacttgagtctcatccaga

SEQ ID NO: 39041 - DNA, 201 bp, Homo sapiens
gcctcttcctcctggaagctatataatgatatcgcgtcacttccgctctctcttccacaggaggcctacacgccgccgcttgtgctgcagccatggtaagrctggaatccgtgccgtgatccagcggcatcgcagctcgggcaaggaaagccggctgtcagggttctggaaacgtcctgccctgagggcctgcgactttct

SEQ ID NO: 39042 - DNA, 201 bp, Homo sapiens
ggaagcactggaatacagctttattcctacacgattagacccgttaccccgtgggtctggccgaccgtcctgactcggagatccctgagctgcgccgccgyttccttcgtcaacatccagcagctacttgatgagcgccctccagtgggccttaggtccctatgccggcgcggggttacagcagtggacagacaggccagt

SEQ ID NO: 39043 - DNA, 201 bp, Homo sapiens
tgcgagggggccgttgggggcaatgggagagaagcacggaaccccagagagaggctgagcaggaaggaggccaggttttgcacagcgaggaagtgcctctwctgtacttgggccgggtgcactggcgcgtgaacccctctcggacaccggggggcaggcaccgcgtatcagaggagcagtggcctcacacctggggcccct

SEQ ID NO: 39044 - DNA, 201 bp, Homo sapiens
gggggcaataggcagagctcaggacatgacaccaatcccccacacctggccagaaccctggagtcccaacctcacccgccagtcacctctgagcctctgtmagtggccggagcccctgtagccacctctggatatcatggtcaggttggaggttatagccacgacattcattctggagccgtcgcaactcagaaaggactg

SEQ ID NO: 39045 - DNA, 201 bp, Homo sapiens
cgcttccttcgtcaacatccagcagctacttgatgagcgccctccagtgggccttaggtccctatgccggcgcggggttacagcagtggacagacaggccrgtccctgtcctcgaggagcccatgatccgcggggagacaggcatttaacgacgactcacacgatcacttaaatacaactgtggtgaaccgcacaagaggg

SEQ ID NO: 39046 - DNA, 201 bp, Homo sapiens
tcccaacctcacccgccagtcacctctgagcctctgtcagtggccggagcccctgtagccacctctggatatcatggtcaggttggaggttatagccacgrcattcattctggagccgtcgcaactcagaaaggactgcaaactcctgggaaggagccctcaaactgcaggagccaaaactcagggacccctgacttttcc

SEQ ID NO: 39047 - DNA, 201 bp, Homo sapiens
tgagaattgggttgtgaagacataagcaaaaatgaagcaaggctggggagacttgagtctcatccagatcaccttgactgctggattaagaaaagaaagtrgtttagggagagactgacccctttagcatttaccacagaaaataagtgattaaagccaagatagtggtctaaggtcaagccaaaacatttcacctgggga

SEQ ID NO: 39048 - DNA, 201 bp, Homo sapiens
gatccctccctgccttcctcctcaatctatcatggcctaagcactccacttgaccctttaaattgaatttctcaggtagacaacgagtctgctttgcagaygagaggactggatagtatccaattcgacaggattccttatccagagaggataaggaacttgtccaaggtctcagtatttgtttatttaacaaactctagc

SEQ ID NO: 39049 - DNA, 201 bp, Homo sapiens
ggacctcacctttcgggatttgtcaatgcgacagaacttctggaccacttccacagggacgggggcggggcctgggaatggatcttgggcctaggggaaasgaggacgcaattagcagacagccttggattgaccccaaccctctcactctcaaggaacgaggcggcctgcctcgccacccatcaggtcccacgctcaccc

SEQ ID NO: 39050 - DNA, 201 bp, Homo sapiens
tgttcactcacccgctgcccccatccttttctgcttcctcagatccatatccacctgactaggattgtggggataggtggcacatttgatgtttctaaatygcctttcctctcatccccagacttaagtaaatccatgtcggggaggcagaaacttgaagcacaactaacagaaaataatatcgtgaaagaggtgagggac

SEQ ID NO: 39051 - DNA, 201 bp, Homo sapiens
tgcagagtcacgattgtttttcttaaggacacgactgatgacacttggagccttgtcctggcttgtcacctggcagaacaggagaccaaaagagcaatcartcagccatgatttcccatccttctaccctcagccactgaacccaaccacaaaatgttacttgtgtccaaggctttaaaatgaacaggaaaacccaatatg

SEQ ID NO: 39052 - DNA, 201 bp, Homo sapiens
cagccagaggaaggaaaactgggaatgaagagtcagaggtgagaagctaaagtcatgatctcaccaagggatcaagaggtcgatattggcggcttgtgacrgtaaacacggcaccatcctcctcctcatcccagacggacacaggggcctggaggagcaaggaaggggaagtcagacagttccacaccaccccccattgcc

SEQ ID NO: 39053 - DNA, 201 bp, Homo sapiens
gtgggtgtgtccaagaagaaataagtctgtaggccttgtctgttaataaatagtttatatacctatggcttcctgtcctttctgtccattctaatagggartgttaaagtgctgggtcctttttccatttagagctgccctactcagttgcccacacagtgctattagttttagcagtggtgatgctgcagaccccccagt

SEQ ID NO: 39054 - DNA, 201 bp, Homo sapiens
gggatgacagaggataactgtgtagaaactaatggcatcacctgagctaggcgtggtggctcatgcctgtaatcccagcactttgggaggccgaggtgggyggatcacctgaggtcaggagtttgagaccagccaagccaacatggcaaaaccccatctctactaaaaatacaaaaattagcgcatgcagtggcatgcact

SEQ ID NO: 39055 - DNA, 201 bp, Homo sapiens
aaccatagccatggccgggtgcagtggctcacgcctgtaatcccaacacttgcactttgggaggccgaagcaggtggatcacgatgtcaggagttcaagaycagcctggccaagatggtgaaaccccatctctactaaacattaaaaaattaactgggcgtggttcgtgggcgcctgtaatcccagctactcaggaggctg

SEQ ID NO: 39056 - DNA, 201 bp, Homo sapiens
ctcccaggcccaacgcaggggccctcactggctgcagctgatctgtttccttataccagatcctcagtctcactaaagacagcgatatgggagacacccargggcctggcccgccagcccaaaagatggtcatcgggaagagaaaaagaaaaaaatgctgcagttgttctctcaagctagggcagaagaggggtgtcaagc

SEQ ID NO: 39057 - DNA, 201 bp, Homo sapiens
aggttcttcagcaagcagcagctcagaacgagcagctttgatacttgtttcctcttcctcagcttcagccacctcaagtcggcttcgagttttggctttakaatgtggtagctgtaacattgttggtggggaggagtggcagaagaaccacaggataagtggggtcacaggagagctacctgtcccagcctccatccaact

SEQ ID NO: 39058 - DNA, 201 bp, Homo sapiens
gcatcattgtggagtgggttagctgagcctagccagttgcagttaaggtgagtttgcaggtcttggtcactctgggtttttttgtttttgtttttgttttyttttaaggggtcatctagtcataagggaaaatccttcgggctgtgaccgaagcaacaaaggcaaaaacgcggacgttggttatgaagggtgtggtctccc

SEQ ID NO: 39059 - DNA, 201 bp, Homo sapiens
atcgaatcaatgaatgcaagaatattatttcacttgagtatttctctccacaaacctaatgaattcttggctttctagatacataacgttctttttttttyccttaagtcagaatgtgtagttagttgtggaaatagcctaccagtatgtgtccatgcgtgcagggctaggcctgtcttcttggcttctgttgcatggtag

SEQ ID NO: 39060 - DNA, 201 bp, Homo sapiens
ggggtcacaggagagctacctgtcccagcctccatccaactcacccagacactccctgcctccagcacttcccaactctccggctggacctcacctttcgrgatttgtcaatgcgacagaacttctggaccacttccacagggacgggggcggggcctgggaatggatcttgggcctaggggaaaggaggacgcaattagc

SEQ ID NO: 39061 - DNA, 201 bp, Homo sapiens
catccatctttctttggcttttaagaatcgaatcaatgaatgcaagaatattatttcacttgagtatttctctccacaaacctaatgaattcttggctttstagatacataacgttctttttttttcccttaagtcagaatgtgtagttagttgtggaaatagcctaccagtatgtgtccatgcgtgcagggctaggcctg

SEQ ID NO: 39062 - DNA, 201 bp, Homo sapiens
atcttgagcggcagtcagagcaacagagggagacccttgctcagctgcagcaggagttccagcgggcccaggcagcaaaggcaggggctcctggcaaggcmtgaccccatggtggggggaggggaggggaggggagggaatgaggcagctctaggatctatactgtagctaataaaatgtaaaaacacctggctctgtttc

SEQ ID NO: 39063 - DNA, 201 bp, Homo sapiens
cctccccttccagaaacctgaaagcaagggttaggatggcagtaaagcttcccaatatgaagcaagtataccaacataaaaacgagaaaagacagtcccawaaggcagggaatgggggtccagattagggctcactcacccaggttcttcagcaagcagcagctcagaacgagcagctttgatacttgtttcctcttcctc

SEQ ID NO: 39064 - DNA, 201 bp, Homo sapiens
cagaatggagaaacctgggggagaggaagagtggttcaattgggaaatgaggtcacaggctatcattcaatcaggaatggactatctcaccccaactgacygctgacagtgaggccactgaccggatgtcccgcaccgcctccatgacgttgatctcgcacataagcttctttgttacccaatcaagggcagccacatgac

SEQ ID NO: 39065 - DNA, 201 bp, Homo sapiens
gatagggaagtccagcatccagcccagacactccgctcaccttcctccgcttgtcaaaattgatgtatccattctgcgaggaaaatggggatggggtgaargttccaaccctaccttccggccacagagagagaatatcccctctcttaaacacacacagccacatccaactcacaaccacttccctccagcctctctgac

SEQ ID NO: 39066 - DNA, 201 bp, Homo sapiens
tctgtttccttataccagatcctcagtctcactaaagacagcgatatgggagacacccaggggcctggcccgccagcccaaaagatggtcatcgggaagaraaaaagaaaaaaatgctgcagttgttctctcaagctagggcagaagaggggtgtcaagctcctcaataaacttgtctccacttcttcgagtgcagtgtgg

SEQ ID NO: 39067 - DNA, 201 bp, Homo sapiens
cctccaaccctttccttcccttttaaccccccttcttctccctcccctggatctcaagttttccacctatctctttcttgcgtttagcactctccatagtragtcctactaatttctccctttctgcttgtctcccttgtctctccttagtaagcgatacgaatcccagcttcgggatcttgagcggcagtcagagcaaca

SEQ ID NO: 39068 - DNA, 201 bp, Homo sapiens
cctttgccatcactgccattaaggtaagtgaagtagggtaaggaatagggaatgtaaatgagaattgggttgtgaagacataagcaaaaatgaagcaaggytggggagacttgagtctcatccagatcaccttgactgctggattaagaaaagaaagtggtttagggagagactgacccctttagcatttaccacagaaaa

SEQ ID NO: 39069 - DNA, 201 bp, Homo sapiens
gtgagggcacgctctccttagaggggcggaacagtttttggcaccttatcgcgagcggcagcttatgcaagagtgacttaaaaaagaaaggcaggtccggrgccaggggctaagtagcggtgcggtttctttttctggattagtttccccatcttgcctaaaaatgtcctagtctagtctttttagcagaactccactccc

SEQ ID NO: 39070 - DNA, 201 bp, Homo sapiens
aaacagtttccggaagcacttctcctagatcgcaccgcctcttcctcctggaagctatataatgatatcgcgtcacttccgctctctcttccacaggaggyctacacgccgccgcttgtgctgcagccatggtaagactggaatccgtgccgtgatccagcggcatcgcagctcgggcaaggaaagccggctgtcagggtt

SEQ ID NO: 39071 - DNA, 201 bp, Homo sapiens
ggttcattggaggaaaggaatagccctgtgtgtgatgagcattgagaggaggtctggcgagcaccatctagggctgaagaactaggcagtggctccagcgyggggcggtgggggggacaagtgagccagggcaagaagaatggatttggccctagagtacgggttctccaaatgtaacctcggccctacagatctctgaga

SEQ ID NO: 39072 - DNA, 201 bp, Homo sapiens
gaagctctctaggtgccatcttgagtgagggcacgctctccttagaggggcggaacagtttttggcaccttatcgcgagcggcagcttatgcaagagtgayttaaaaaagaaaggcaggtccggagccaggggctaagtagcggtgcggtttctttttctggattagtttccccatcttgcctaaaaatgtcctagtctag

SEQ ID NO: 39073 - DNA, 201 bp, Homo sapiens
tcttggtctgaagtttgtctttcttgggcgggacatccttgcccggcttgggggctgtctccatctcgcccacccgaacggcgatccacgtgcaaaactcytctcagctgccacacagtcggcttgaaaactcccggaagccctctgtccttcatccaatcagcagcgtaccaggtatgaagctctctaggtgccatcttg

SEQ ID NO: 39074 - DNA, 201 bp, Homo sapiens
ccagtgggccttaggtccctatgccggcgcggggttacagcagtggacagacaggccagtccctgtcctcgaggagcccatgatccgcggggagacaggcrtttaacgacgactcacacgatcacttaaatacaactgtggtgaaccgcacaagagggacgcgcggcggtctgcggggaatgacgaggccgacctcgtctg

SEQ ID NO: 39075 - DNA, 201 bp, Homo sapiens
actgagagagaaagacagagagaatgacccagtcctgattgccctctgtattccctctgctggggtcctaaaggagaggtggtcatcccaagggcttccamccagttcctgagctccatggccactcacagctgtagccaggaggaagtggaagggcaggaactcaagccgtgttactcggtcacagcggcggatacagtg

SEQ ID NO: 39076 - DNA, 201 bp, Homo sapiens
ggtgatcttggggagagactgttcccaggcaaccctggagtctggctcagcgcacaaatctgtccagggcagatggccgggcccccgtgggcttggccttygcctccttatgatgctgctgctgaaggctctgccggaccttgtcctggggaccggagacggggaggacacaggcacagagtgagaagtggcaggctgaca

SEQ ID NO: 39077 - DNA, 201 bp, Homo sapiens
aaagaaaggcaggtccggagccaggggctaagtagcggtgcggtttctttttctggattagtttccccatcttgcctaaaaatgtcctagtctagtctttktagcagaactccactccctaaacatgtcagaactacacttcccatcaagggtcagaaagaaacttccggcacagtcttttcccagcattccttgtttact

SEQ ID NO: 39078 - DNA, 201 bp, Homo sapiens
ccacaggaggcctacacgccgccgcttgtgctgcagccatggtaagactggaatccgtgccgtgatccagcggcatcgcagctcgggcaaggaaagccggytgtcagggttctggaaacgtcctgccctgagggcctgcgactttctgtatggagccttggatcgcgtccctggaaagggacaccaaagatttccaattcc

SEQ ID NO: 39079 - DNA, 201 bp, Homo sapiens
agaaaagtggaagtcccaagaaaccaccccccagccagtgaatctctcactctgtccactgcgagatgaccaatgttggccgaagcacccgtggggcaggwgggtcactggaaccaggtggctccacctcacaggatacacgatggctgggttaggggggcaataggcagagctcaggacatgacaccaatcccccacacc

SEQ ID NO: 39080 - DNA, 201 bp, Homo sapiens
ggcctcttctgcacccccactcagcggggagccacaggaggctgagcggcggtgacctcgagaaggcctaggggaggaggctggtggggagaggtggctgrggtcagctggactgtgcagggatggactgctttccaaggcagagtctagtgacgagacagatggccacttcatgtgctaggaacaaacaacatgggactg

SEQ ID NO: 39081 - DNA, 201 bp, Homo sapiens
tctttcttgggcgggacatccttgcccggcttgggggctgtctccatctcgcccacccgaacggcgatccacgtgcaaaactcctctcagctgccacacaktcggcttgaaaactcccggaagccctctgtccttcatccaatcagcagcgtaccaggtatgaagctctctaggtgccatcttgagtgagggcacgctctc

SEQ ID NO: 39082 - DNA, 201 bp, Homo sapiens
ttgtgctgcagccatggtaagactggaatccgtgccgtgatccagcggcatcgcagctcgggcaaggaaagccggctgtcagggttctggaaacgtcctgycctgagggcctgcgactttctgtatggagccttggatcgcgtccctggaaagggacaccaaagatttccaattccggagagcgggcccgaggaagggtca

SEQ ID NO: 39083 - DNA, 201 bp, Homo sapiens
aagcacacacacagttgttccccccacagccgcccagatgtggaagtactccactctcctcccgagtctgcctttccctcatggcctctgacctcgctccyctggtagcagctgtaccagctcatactctgaagccactgcagagtcacgattgtttttcttaaggacacgactgatgacacttggagccttgtcctggct

SEQ ID NO: 39084 - DNA, 201 bp, Homo sapiens
actctccggctggacctcacctttcgggatttgtcaatgcgacagaacttctggaccacttccacagggacgggggcggggcctgggaatggatcttgggyctaggggaaaggaggacgcaattagcagacagccttggattgaccccaaccctctcactctcaaggaacgaggcggcctgcctcgccacccatcaggtcc

SEQ ID NO: 39085 - DNA, 201 bp, Homo sapiens
ccaagaaaccaccccccagccagtgaatctctcactctgtccactgcgagatgaccaatgttggccgaagcacccgtggggcaggagggtcactggaaccrggtggctccacctcacaggatacacgatggctgggttaggggggcaataggcagagctcaggacatgacaccaatcccccacacctggccagaaccctgg

SEQ ID NO: 39086 - DNA, 201 bp, Homo sapiens
ctcgccacccatcaggtcccacgctcaccccggacaagccgcgctgggactccgggttcttccattctcggggtttcttcgggacctgaggcttcttagaratccgagacttctttaagatgtaagcattttttggtctctgaggacggagctcccgattcttcttgttacgaggaggccctggagaggctccggctgtgg

SEQ ID NO: 39087 - DNA, 201 bp, Homo sapiens
ctctctgactcttcgatccctccctgccttcctcctcaatctatcatggcctaagcactccacttgaccctttaaattgaatttctcaggtagacaacgartctgctttgcagatgagaggactggatagtatccaattcgacaggattccttatccagagaggataaggaacttgtccaaggtctcagtatttgtttatt

SEQ ID NO: 39088 - DNA, 201 bp, Homo sapiens
aaaaatagtaataaaataaataaatgcatcacctggccaatcattctcaaaaaccatagccatggccgggtgcagtggctcacgcctgtaatcccaacacytgcactttgggaggccgaagcaggtggatcacgatgtcaggagttcaagaccagcctggccaagatggtgaaaccccatctctactaaacattaaaaaat

SEQ ID NO: 39089 - DNA, 201 bp, Homo sapiens
ggagaagcatggagccataaggaagaacctcagtccaacagctccagcccaactaagcccccagttcctggatgtctctggcccaaacttccacccagagktcattcacttcaagccccatcccctggcccactcaccagggaccagcatgctggtgatgcccccagtgtgccccacccccagcacatcttcaaaggggca

SEQ ID NO: 39090 - DNA, 201 bp, Homo sapiens
agctactccggaggctgaagccacagaattgcttgaacccaggaggcggaggttgcagtaagccaagatcatgccactgcactgcagcctgggcggaagaktgagactccgtctcaaaaaaaaaaaaaaaagaaaaattatcccttatataagtgaaagaaaaaaaaaaaagcattccagccactcagtggagagagattg

SEQ ID NO: 39091 - DNA, 201 bp, Homo sapiens
gatttagaaaactctctcatgaggtcctctccctgcctccccgtctccagccgacctgaccctggaccctgggaccgcacaccgccgcctgctcatctccrccgaccgccgcagcgtacaactggccccaccagggacgcccgcgccccctgacggccccaagcgcttcgatcagctcccagctgtgctgggtgcgcaggg

SEQ ID NO: 39092 - DNA, 201 bp, Homo sapiens
tggtccaccatcttggtcatccaccatcttgcccagtccagattgcttctgacacccctaatccagaaatttttcttcaaagcaccccatacatataaggycaatggttctttttctggtctctggctatcaccacctgctctcctcctctgccccacaacccctacagaaataggactgtccaccccaccccccaattcc

SEQ ID NO: 39093 - DNA, 201 bp, Homo sapiens
ctgacccagctcccatgccccaccccagatgatgcagattgaggtatcagtccttactcctccctcgaagtcagatcagcctcactcttcctcccccaacsccacaaacgagacaacctctcatttgatcttcctgctgtgctccctgcactgggccagtatgatccttccccaggtccaattctacagaagtggtgcatc

SEQ ID NO: 39094 - DNA, 201 bp, Homo sapiens
aaacgagacaacctctcatttgatcttcctgctgtgctccctgcactgggccagtatgatccttccccaggtccaattctacagaagtggtgcatcagtamaaggtctgatattgcccaggtctgctcttcatatgccttccttctttttggtcctgcagtcgccttttgagctgttgtgtggtcactagctctcagtctt

SEQ ID NO: 39095 - DNA, 201 bp, Homo sapiens
gatcttcctgctgtgctccctgcactgggccagtatgatccttccccaggtccaattctacagaagtggtgcatcagtacaaggtctgatattgcccaggyctgctcttcatatgccttccttctttttggtcctgcagtcgccttttgagctgttgtgtggtcactagctctcagtcttttacgtgatcttcgttgacta

SEQ ID NO: 39096 - DNA, 201 bp, Homo sapiens
cctgaccctggaccctgggaccgcacaccgccgcctgctcatctccgccgaccgccgcagcgtacaactggccccaccagggacgcccgcgccccctgackgccccaagcgcttcgatcagctcccagctgtgctgggtgcgcagggcttcggggccggccgccactgctgggaggtggagactgcggacgccgcctcctg

SEQ ID NO: 39097 - DNA, 201 bp, Homo sapiens
aataatgagacctcacctggtctccacgtttccacgtccctgctcaaaaccaaatccattcctgccttctggctctcagaatcttctctcccctacagctrctacagtacttcctgacttctcccattcaaaccattctaggcctgcaatggggaacaggccctccccatcagtattggtaaagtgaccatgattcctaca

SEQ ID NO: 39098 - DNA, 201 bp, Homo sapiens
ccatgagacagaatctgttccatgcctgtctcctagcctctggtagcctcacatgttctttgggtgataggtctgcacattttcttttgtatgcatttgtytctgtgtccaaatttcctctttttgtaagtcagcaatctggattagagcccaccctaatgaccttcattttaacttgattacctatgtaaagatcctgtt

SEQ ID NO: 39099 - DNA, 201 bp, Homo sapiens
tcatattccagccattttccctcttcctttttcatacattcaaacaacagatccctgaaggttaggtgcctctcaaaaatctctgcttccaccacctctcrtcactcctccctggaaggggaccccagcatctccttgacccttctttcctcactcactcccaagaagaagggtgcctctacccttctttaaactgcctag

SEQ ID NO: 39100 - DNA, 201 bp, Homo sapiens
cgccttttgagctgttgtgtggtcactagctctcagtcttttacgtgatcttcgttgactattctccaccctaccccgcctgtgatttagaaaactctctsatgaggtcctctccctgcctccccgtctccagccgacctgaccctggaccctgggaccgcacaccgccgcctgctcatctccgccgaccgccgcagcgta

SEQ ID NO: 39101 - DNA, 201 bp, Homo sapiens
gtctcacacccttccccataagtataaatgggcccatatttaacacattttgtgattttgggttatttattttgtgcatctgtggcaataaatgagatctyagtggtggtatggatttgactgatctctgtaactgtgtatggcaaaaggaccggaaaatgaaaaccagatcccagtaaggggtagagaggggccaagaga

SEQ ID NO: 39102 - DNA, 201 bp, Homo sapiens
cagcaatctggattagagcccaccctaatgaccttcattttaacttgattacctatgtaaagatcctgtttcaaaacaaggtaacattctgaggtttggargacttcaacctatctttgtgtgtgtgtgtggagtgggggagggcacagttcagcctataacaatgtctatcctcgattcctcatattccagccattttcc

SEQ ID NO: 39103 - DNA, 201 bp, Homo sapiens
ttttctggggtatagtctcatcccttcttcctccagagatgtgagtggggtatgcgtgggggcattaggatcagagggctgatttcctgacccttcccctyatctgtgtagatttgaagtcccaacatccaagtcatctaattcagaggatgatctccctgaagattatccagtggtcaaaaaaatgcttcatagactgac

SEQ ID NO: 39104 - DNA, 201 bp, Homo sapiens
gaaaagagaattgagaacccttggggagtggaaagggggaggacagtggggatggagttaggaggatgagggaaaagtgatggggtgagaggaaggagggmtcatgaaaggtgaaggaggagaatgagagggaaaggagcacagtgtgtaaagaggtgagatcactctgaaaggtgaggagggacactgctaactcagaca

SEQ ID NO: 39105 - DNA, 201 bp, Homo sapiens
ttcctccagagatgtgagtggggtatgcgtgggggcattaggatcagagggctgatttcctgacccttcccctcatctgtgtagatttgaagtcccaacayccaagtcatctaattcagaggatgatctccctgaagattatccagtggtcaaaaaaatgcttcatagactgacaggtaaggaaagaagaagggagggaag

SEQ ID NO: 39106 - DNA, 201 bp, Homo sapiens
actgaggaggcagcaaggaaggcaagggctctgaggacaagaaacagtcatggacgagcctgggaaaagagaattgagaacccttggggagtggaaagggrgaggacagtggggatggagttaggaggatgagggaaaagtgatggggtgagaggaaggagggatcatgaaaggtgaaggaggagaatgagagggaaagga

SEQ ID NO: 39107 - DNA, 201 bp, Homo sapiens
cagtacaaggtctgatattgcccaggtctgctcttcatatgccttccttctttttggtcctgcagtcgccttttgagctgttgtgtggtcactagctctcagtcttttacgtgatcttcgttgactattctccaccctaccccgcctgtgatttagaaaactctctcatgaggtcctctccctgcctccccgtctccagcc

SEQ ID NO: 39108 - DNA, 201 bp, Homo sapiens
ttcagaggatgatctccctgaagattatccagtggtcaaaaaaatgcttcatagactgacaggtaaggaaagaagaagggagggaagggaattgaatgaargtctgtgttagattttcttccttttagccctaaaaagtgatcaggtcctttttgatgtctgcattagtttcctagtactgctctaatgaagcaccgcaaa

SEQ ID NO: 39109 - DNA, 201 bp, Homo sapiens
tcagtacaaggtctgatattgcccaggtctgctcttcatatgccttccttctttttggtcctgcagtcgccttttgagctgttgtgtggtcactagctctcagtcttttacgtgatcttcgttgactattctccaccctaccccgcctgtgatttagaaaactctctcatgaggtcctctccctgcctccccgtctccagc

SEQ ID NO: 39110 - DNA, 201 bp, Homo sapiens
agaggagacagtcggctctaagtgaccaatctcaagccagctttgtcagaaatcctaaataacaggagaagggtgggaagaaaggatatgattatttcttrttccattttccataagaggtgagaatgacaaggacctcttttctaactcctcttgagggtgtgagaagggttagcaggaggagaagggctgggagctctg

SEQ ID NO: 39111 - DNA, 201 bp, Homo sapiens
tattttgtgcatctgtggcaataaatgagatctcagtggtggtatggatttgactgatctctgtaactgtgtatggcaaaaggaccggaaaatgaaaaccrgatcccagtaaggggtagagaggggccaagagaactgaacatctgggctgccggagaaatcaaagtctaggaagtaagaggtaagagtgtactacagggg

SEQ ID NO: 39112 - DNA, 201 bp, Homo sapiens
tgtggtcactagctctcagtcttttacgtgatcttcgttgactattctccaccctaccccgcctgtgatttagaaaactctctcatgaggtcctctccctrcctccccgtctccagccgacctgaccctggaccctgggaccgcacaccgccgcctgctcatctccgccgaccgccgcagcgtacaactggccccaccagg

SEQ ID NO: 39113 - DNA, 201 bp, Homo sapiens
ctccctccctataaagcctgatgtggtggagagatttgacgagactgagactctggttgaagagagaggcaatcccaggagaggggcggaaagcggcaaargttaatgcgggagtcggagagaagggcatctacacagcaagcagcaggggcggcccgccatctgcgcgctcgaaggcggtcacggtggtcgcggaagggg

SEQ ID NO: 39114 - DNA, 201 bp, Homo sapiens
ggagacgccgaggggggcgcatccccaccatgggctgcctggacctgcccggagaggtgaggctgggcgcgcgtcgcggagttgttggtggaagcgggagrttcccggggaagccgggaatggcacgtctggagccggaggccctgtggaagtttaggcaaaggatggggtggggagagaaaagcaaaggatgagggggcg

SEQ ID NO: 39115 - DNA, 201 bp, Homo sapiens
ccaggcaggagcggccaggggtggaggcgaggtgcgggagaacagccgctggggcctctggctcctctccacatcccagtcttaccacccatctacccccsgcgcctctcctgggccccggctccttggccactaaccagcccattcccttgcccgaccgacccctgggcgtctgggactcctgactggcttcttcccagc

SEQ ID NO: 39116 - DNA, 201 bp, Homo sapiens
actggggaaggtagataaggatggggccgctgaaagagacagagaatgggactgaggaggcagcaaggaaggcaagggctctgaggacaagaaacagtcayggacgagcctgggaaaagagaattgagaacccttggggagtggaaagggggaggacagtggggatggagttaggaggatgagggaaaagtgatggggtga

SEQ ID NO: 39117 - DNA, 201 bp, Homo sapiens
ccagctgtgctgggtgcgcagggcttcggggccggccgccactgctgggaggtggagactgcggacgccgcctcctgcagagactcttctggggaggatgmggacgacgaggagagccactatgcagtgggcgcggccggggaatcagtgcaacgcaagggctgcgtaaggctgtgccctgcgggggccgtgtgggccgtg

SEQ ID NO: 39118 - DNA, 201 bp, Homo sapiens
taccctgcctgtccactgaggtttctcctaaaacaagaggcttgactctggtctgggccctgtggccctctgggaagctttgtacctcttttgcaggatcygggggtggggagggacaagctagttccccaacctcctatgactgctttctatgctcacagccttttttccataagaaccttcttgaaacttctccccgca

SEQ ID NO: 39119 - DNA, 201 bp, Homo sapiens
attattttaatgactctattagtgagggtcattcttcccatgtttcttgttagccatgaccctataagaaataaactgcactgcaaaatgataaacatgayatcaatcattacatgggaaggcactatataaagaataataccttaggttaaggccacataaatatttatcaggtgccttttctgcggaggactctgaagg

SEQ ID NO: 39120 - DNA, 201 bp, Homo sapiens
caaatcaaattttgcttgaatcccagtgctcagtcagccataaatggtgtgttgcctgattgaaacttaaaatctccgtagggggcttgtaacatgcagamaagtttgaaagttgctttaggagaagccaactcttaactgctgggtaaattgacaagccttcgaacactgaactgaaggccagtaaggactaggcgctgg

SEQ ID NO: 39121 - DNA, 201 bp, Homo sapiens
taataccttaggttaaggccacataaatatttatcaggtgccttttctgcggaggactctgaagggatactaaactgcatttagctgcatgcaactgaaaytacttttacctacattgtctcttataaacattataactactctttgagaaagtgtttactatggactgaattgtctccccatccccccaaattcatatat

SEQ ID NO: 39122 - DNA, 201 bp, Homo sapiens
ccaagaaggcagtgaccaaagcgcagaagaaagatggcaagaagcgcaagcgcagccgcaaggagagttactctgtgtacgtgtacaaggtgctgaaacargtccatcccgacactggcatctcttccaaggccatgggcatcatgaattctttcgttaacgacatatttgagcgcatcgcgggcgaggcttcccgcctgg

SEQ ID NO: 39123 - DNA, 201 bp, Homo sapiens
ctttttgattggtcggtagcaaatgctagtcagatagccaatagaaaagctgtactttcatacctcatttgcatagctctgcccacggatgacaactgtgyagtttgtcttccaattaactaagaggtactctccatccctcattagcataaaagccctataagtagcagaaatccgctctttactttcgacacatttctg

SEQ ID NO: 39124 - DNA, 201 bp, Homo sapiens
aattttagtaatttcacattattgccccttcacgttctttaagtaaggttagaggacagaagaaacataatgttgttacaaattggactattgagtcaggraaaaaaaagagtgctttcaatatctgaataaaacaaagatttaatattttctaaaccttaacgagtttattgtaagggatgtgatgctggaaactaggaa

SEQ ID NO: 39125 - DNA, 201 bp, Homo sapiens
tggggtcttactatgttgcccaggctggtctcaaactcctgggcttaagtgatcctcctgcctcagcctcccaaattgttgggattactagtgtgagtcaytgtaccccgccccacttcagttctgaggaggaaaaaatatgtaataataatgggactttggtttgctgatttaaagattcatgtaaccttatcatccaat

SEQ ID NO: 39126 - DNA, 201 bp, Homo sapiens
ttttacacagtttagaataaccattgataaacagataagagaacatatgattgccttagaatagatactgttgctttcgccactttagatttgtaaatcaygtactgtatacgtgtgggcgtagaggaccatgcaggttttggatgactgcctctgttttcgtcatgcctatgcgggaacacaattgcctgctttgtttaa

SEQ ID NO: 39127 - DNA, 201 bp, Homo sapiens
aaaaaaatacttcacaatttttaaataacttaaaaatattaatacctcttttattaggtttttttaataaggaaaatatataatacatctaatcaagattattttttggacaaattggcttaataatttcattttaaaaatggcttctttattcttatactgtaaaaataatattagcagaatattatagtatacacaagt

SEQ ID NO: 39128 - DNA, 201 bp, Homo sapiens; identical to SEQ ID NO: 13221

SEQ ID NO: 39129 - DNA, 201 bp, Homo sapiens
tccaaacagctctgactctatcaagtactatagctacagagaaacacaagtaagcattcgagataatgactaccttgagcctttacttatttaaaaagttrttactgtttgttaatgtggtacattcaatttactatggattgtcactctaaaataagacttcaatctttttcttatttttatatagccatgatttatatt

SEQ ID NO: 39130 - DNA, 201 bp, Homo sapiens
agtttcattagtggtcttagttaacagcttaaagtattttgtaaaaaaaatacttcacaatttttaaataacttaaaaatattaatacctcttttattagktttttttaataaggaaaatatataatacatctaatcaagattattttttggacaaattggcttaataatttcattttaaaaatggcttctttattcttat

SEQ ID NO: 39131 - DNA, 201 bp, Homo sapiens
cctaaataagaatatttactagaaaatttatttctgcctgtggcccacatttgagtcaaaataatcaattaggaaaaatgaacttgtttaactaaagttgrccaaactgatctttgagacctattcatctaagacaagccaattaaattcttggagacaatttgtactttaaggaattcttataatatttgtaattaccct

SEQ ID NO: 39132 - DNA, 201 bp, Homo sapiens
tgttaagatgatatgaatataaaatggctgccctgttataacttttgactttaagaaagtgttaggactaacaggagacaaaaaggaaatcaaggaaaccraatgtctggtctcaataactgctatggcagaggctctacagcttattattaattttagtaatttcacattattgccccttcacgttctttaagtaaggtt

SEQ ID NO: 39133 - DNA, 201 bp, Homo sapiens
caaagtctacagaggaagatgaggtctgaaatagacagcttcttccttcttttacctgtggtattattctgttttgtccttttctccattatctgtctttscagtgatgaaattttgatctggccctcccaagtattaaaaaacaagcaaataaacaaatctcagttatattttactaagatattggcatgctaacttttt

SEQ ID NO: 39134 - DNA, 201 bp, Homo sapiens
tttgctttctccattaaaaaccgggaatatacaataaataaaattagtgttaaagcagatttttacaaacttaaataccatgtaatttaggttacagttayttaacataaggactgtgtgatcttaaatctgcaatttctttcacacctgggaaataaactaaggcctgtctttggtgccagacaaggccttatacttgaa

SEQ ID NO: 39135 - DNA, 201 bp, Homo sapiens
tcacatggttagacttgctcctttatgagatatttttaccaaaaatggaggagttgaaaaactctggtgccagaaatcgtgaagacatggcctacctaacwtggaaatgttggttgtcagtggaaaatactacacagagatagccatagtgctgcacagccaatcttaagtgtttctagagaatcactaattgtttctaga

SEQ ID NO: 39136 - DNA, 201 bp, Homo sapiens
ctttacgctcctaaaaggacttgaagcagcttatgactgaagactttggtaggagttggccttctataaattataagaatttcataaattatttgatatgraaatgccagttgatcatagtatgtttaccggggtccaacaggttgagaaaaaatacactttttttccctgaacatatgaaattagctctctaggcatatt

SEQ ID NO: 39137 - DNA, 201 bp, Homo sapiens
cacctaaccccaaaggctcttttaagagccacccagatacccactaaaagagctgtggccagacgccaaattttatttggcggcggaggggtattagaatrtaggaactggagaggggtggggacaagtgttgcagcttagagagggacaaagggtcctgaacccgaaagaagccagccattaaaaatgggtttggggtca

SEQ ID NO: 39138 - DNA, 201 bp, Homo sapiens
ttcctgaaaggtattctaggctctgagtaatttctttggggtctgaagatcagtttgacatatcctcaagtatcatgagttcattataattaagaaaaagrgagtaaatctggagaatgagccactttcttactactccttgacctcagttctttttttcagagacagggtctcactttgttgcccaggctgccaggctgg

SEQ ID NO: 39139 - DNA, 201 bp, Homo sapiens
gtattagaatgtaggaactggagaggggtggggacaagtgttgcagcttagagagggacaaagggtcctgaacccgaaagaagccagccattaaaaatggstttggggtcaattcgttgtgcttaaatttaaaatggagacaagcggccattttgctaactcggcgttcccggaagaaaccgcaggctcgcttaggtttca

SEQ ID NO: 39140 - DNA, 201 bp, Homo sapiens
tgccaaattgctattcaggatcataccaatttataatcccaaaataatatgaaaattcctgttttatagcactcatatttacaataaattttaaaaatcaytgttaacctaatagtccttcaaaagaaaaaaaaattgaaattacattattttaatgactctattagtgagggtcattcttcccatgtttcttgttagcca

SEQ ID NO: 39141 - DNA, 201 bp, Homo sapiens
aactggtttattcaagattcaaatcaaatcaaattttgcttgaatcccagtgctcagtcagccataaatggtgtgttgcctgattgaaacttaaaatctcygtagggggcttgtaacatgcagaaaagtttgaaagttgctttaggagaagccaactcttaactgctgggtaaattgacaagccttcgaacactgaactga

SEQ ID NO: 39142 - DNA, 201 bp, Homo sapiens
cagctctcagtcagccatgcaattatgagggtaaacaacccatactttacagtgtactataaagagtccggcatctcccaggctcttctggagctggaaawgaactcggacctcaaggctcagctcacagagctgaatattatggcagccaaggaaattgaagttggtggtggtcagaaagctatcacaatctttgttccc

SEQ ID NO: 39143 - DNA, 201 bp, Homo sapiens
catctcccaggctcttctggagctggaaaagaactcggacctcaaggctcagctcacagagctgaatattatggcagccaaggaaattgaagttggtggtrgtcagaaagctatcacaatctttgttcccgttcctccactgaaatctttccagaaaatccaagtccggctagtatgcgaactggagaaaaagttcagtgg

SEQ ID NO: 39144 - DNA, 201 bp, Homo sapiens; identical to SEQ ID NO: 18561

SEQ ID NO: 39145 - DNA, 201 bp, Homo sapiens; identical to SEQ ID NO: 18562

SEQ ID NO: 39146 - DNA, 201 bp, Homo sapiens
tctattgattagaatagtttcagaaggaatggtaccagttccttcttgtacctctggtagaattcggctgtgaatccatctggtcctggactctttttggkaagctattgattattgccacaatttcagagcctgttattggtctatttagagattcaacttcttcctggtttagtcttgggagggtgtatgtgtcgagga

SEQ ID NO: 39147 - DNA, 201 bp, Homo sapiens
tctcagctttgtcaaagatcatatagttgtagatatgtggtgttatttctgagggctctgttctgttccattgatctatatctctgttttgttaccagtamcatgctgttttggttactgtagccttgtagtagagtttgaagtcaggtagcatgatgcctccagctttgttcttttggcttaggattgacttggcgatgc

SEQ ID NO: 39148 - DNA, 201 bp, Homo sapiens
cttgctttaaaatttagtcctgtgtatactgtggtgtttttactgtgcatatttgagtttttcatgcagtttttctttttcttttattttattattattawactttaagttttagggtacatgtgcacaatgtgcaggttagttacatatgtatacatgtgccatgctggtgtgctgcacccattaactcgtcatttagca

SEQ ID NO: 39149 - DNA, 201 bp, Homo sapiens
ataggggctatgccatgccctgtgcgtgagcagctgcagcggcagaggcagcatccagaggtggcgccagcagttccagcccgttgctttactttttgctrcaccgacatagccactatgcagaagagaaagtctccagagaatacagagggcaaagatggctccaaagtaactaaacaggagcccacaagatggtctccc

SEQ ID NO: 39150 - DNA, 201 bp, Homo sapiens
ttccctctacacactgctttgaatgtgtcccagagattctggtatgttgtgtctttgttcttattggtttcaaagaacatctttatttctgccttcatttygttatgtacccagtagtcattcaggagcaggttgttcagtttccatgtagttgagcggttttgagtgagattcttaatcctgagttctagtttgattgca

SEQ ID NO: 39151 - DNA, 201 bp, Homo sapiens
cccactttttgatggggtcatttttttttcttgtaaatttgtttgagttcattgtagattctggatattagccctttgtcagatgagtaggttgtgaaaawtttctcccattttgtaggttgcctgttcactctgatggtagtttcttttgctgtgcagaagctctttagtttaattagatcccatttgtcaatgttggct

SEQ ID NO: 39152 - DNA, 201 bp, Homo sapiens
gccacaatttcagagcctgttattggtctatttagagattcaacttcttcctggtttagtcttgggagggtgtatgtgtcgaggaatttatccatttcttmtagattgtctaatttatttgcatagaggtgtttgtagtattctctgatggtagtttgtatttctgtgggattggtggtgatatcccctttatcatttctt

SEQ ID NO: 39153 - DNA, 201 bp, Homo sapiens
ctgaaaggacaatgtttatccaagttccccttggtcactgcctagcattctgtgactttagtaataaaatgccacctacttagttattccctcaatagccytcggtgtttgtttggggatcaggtgctcctgggcatggatacaggaacaggaccaggtccccctccgcccccagataactccaattagtagaggacagac

SEQ ID NO: 39154 - DNA, 201 bp, Homo sapiens
ggcggaggttgcagtgagctaagattgcgccattgcactccagcctgggcaacagagtaaaaccctgtctcaaaataataataataataatgacacttggrtagcctgggcctactgggctggctccctgtaggaaataaactaaacctgagacttggtctaatccatagagagatgatgacgcaggcttagtataatgca

SEQ ID NO: 39155 - DNA, 201 bp, Homo sapiens
acctgtgccaccttgagcagggctctgcttttctttgcatttccaccaaggggaacagcttccctaggctctgcaggcagcatgggttttgtagtagagawgaagagggggctgcagttacagcgacatggaaatatctccacttaacgtcgcaggccttctcggctctccttgttcctgctagcctctaatggccttcag

SEQ ID NO: 39156 - DNA, 201 bp, Homo sapiens
gctcttgacacagggtcaggcccataggagacgcttagttcatgtgtgctctcttccgcattccacttacccacctggggggtcctgagtgttgcttaagyatgtcctacctttcccattgctgccagccaaatttaagaggcagcttaccccagcagggttcccatgccctaagcaacagggtttctccctctcctttgt

SEQ ID NO: 39157 - DNA, 201 bp, Homo sapiens
ttagtagagaccgggtttcaccatgttagccaggatggtctcaatctcctgacctcgtgatccgcccgccttggcctcccaaagtgctgggattacaggcmtgagccaccacgcccagcctccctcccccttccttctctacaggcctctctgctcaactccctgatgcgaccgccccttctctgtctctctcttctgtgg

SEQ ID NO: 39158 - DNA, 201 bp, Homo sapiens
tctgagccctggcgttctctgtgaaatgagagggctgggaaagaatggtggttttaaactcttaggaatcaggggtactctccttttttttttttttttttctttttttggagacagagtctcgcactgttgcccaggctggaatggaatggcacaatctcgactcactgcaacctctgcctcccaggttcaagcgattct

SEQ ID NO: 39159 - DNA, 201 bp, Homo sapiens
gaagggaaatgggatcactggtcgcccaaggccttgtgcacccaggaccctgcaggctcaatgtggactgagtggcatctcctcagcccagcccaaccagdccctagagcagtggttcctagcaacacccttctgcaaagaaagaaagctattatggtggaaggtcagaaccaagcaagtcaatagccaggggtggaggtt

SEQ ID NO: 39160 - DNA, 201 bp, Homo sapiens
taattccagcactttgagaggcagaggctggagaatcgctcaagaccagcctgggcaacatagcgagaccccatctctacaaaacataatttttttttttwaaaaaaggaaaaatggaaagaacacctcccctagcccccaaattatgtcagagaactggccaggcatgaggctggacctgcttagaaactcaggaactgc

SEQ ID NO: 39161 - DNA, 201 bp, Homo sapiens
ttcatcacacacccagcctgactatattgaaatgtctcaaatgagccatctctcaggccccggctagaacttctcgaatatcaggccttcagagccacatkcacgatgcctgctgtaccctcaaagccccagcaccactgtctgctcttccaacggtcttgctattttaactcttactttagaagaaactttgcattgttt

SEQ ID NO: 39162 - DNA, 201 bp, Homo sapiens
ggagtgtagtggcacaatctcggctcattgcaagctctgcctcctgggttcacgccattctcctgcctcagcctcccgaggagctgggactacaggcgccygccaccacgcccagctgattttttgtatttttagtagagaccgggtttcaccatgttagccaggatggtctcaatctcctgacctcgtgatccgcccgcc

SEQ ID NO: 39163 - DNA, 201 bp, Homo sapiens
cgtgatcttgactcactgcaatctccacctcccgggttcaagccattctcctgcctcagcctcctgagtagctgggattacaggtacccaccaacatgccyggctaatttttatatttttagtagagacggggttttgccacgttggccaggctggtcttgaactcctgacctcaggtgatccacctgccttggcctccct

SEQ ID NO: 39164 - DNA, 201 bp, Homo sapiens
gctggagtgtagtggcacaatctcggctcattgcaagctctgcctcctgggttcacgccattctcctgcctcagcctcccgaggagctgggactacaggcrcccgccaccacgcccagctgattttttgtatttttagtagagaccgggtttcaccatgttagccaggatggtctcaatctcctgacctcgtgatccgccc

SEQ ID NO: 39165 - DNA, 201 bp, Homo sapiens
atactctcagtgccagctaaattacctgaaattaaagaatattatgatggaaacatcttttaattccagacagaggagtggctggtcaggccagtcaggtkgtcgatctggcaattggtcaggtagagagagtcgacaaagcagttgctcaggaaagtcggcaagatggtagaagacgaagtggaacagaaatagatcaag

SEQ ID NO: 39166 - DNA, 201 bp, Homo sapiens; identical to SEQ ID NO: 16156

SEQ ID NO: 39167 - DNA, 201 bp, Homo sapiens; identical to SEQ ID NO: 16158

SEQ ID NO: 39168 - DNA, 201 bp, Homo sapiens; identical to SEQ ID NO: 16160

SEQ ID NO: 39169 - DNA, 201 bp, Homo sapiens
ccaagccttttcctttgaggctcagggcgggctggctaacattgctatattgaacaacaacttgaataccttgatccagcgttccaaccacactcaggccrccaacggtacgccctatctttgcctcttcctctgtagcccaactggaagggatgagagggcctctctgccaccctcagactaggaagcctaagtgccccc

SEQ ID NO: 39170 - DNA, 201 bp, Homo sapiens
agaccaacaggggagtttatgtttgaatttgatgaagatgagatgttctatgtggatctggacaagaaggagaccgtctggcatctggaggagtttggccragccttttcctttgaggctcagggcgggctggctaacattgctatattgaacaacaacttgaataccttgatccagcgttccaaccacactcaggccacc

SEQ ID NO: 39171 - DNA, 201 bp, Homo sapiens
atgtgtcaacttatgccgcgtttgtacagacgcatagaccaacaggggagtttatgtttgaatttgatgaagatgagatgttctatgtggatctggacaaraaggagaccgtctggcatctggaggagtttggccaagccttttcctttgaggctcagggcgggctggctaacattgctatattgaacaacaacttgaata

SEQ ID NO: 39172 - DNA, 201 bp, Homo sapiens
tacaaactccatctcagcttttcttctcacttcatgtgaaaactactccagtggctgactgaattgctgacccttcaagctctgtccttatccattaccthaaagcagtcattccttagtaaagtttccaacaaatagaaattaatgacactttggtagcactaatatggagattatcctttcattgagccttttatcctc

SEQ ID NO: 39173 - DNA, 201 bp, Homo sapiens
gatcccagcctgggatccctctctcgctataggtcatgtttgttccccgattatctgatatcagtggcctctagagctttctgacatttcttttctgtcaracccctcatcgtggaataagtgtgaatatgccaggggaaggtaagtcccgctcaccctgcaggctttctcacctttcttgctcctcctgtgcatgaagat

SEQ ID NO: 39174 - DNA, 201 bp, Homo sapiens
tccgaggagctggggccatcaagggtgagtgctcaggaggacgcaggagcgtcggggtgagtgatggggtggttcacatcaattgctgcttcagggatcasagattttaggggctcattgatctatctggtcctcatagtctatgttccctctggccctcataataataacagcaataacagccagaatttatgagactcc

SEQ ID NO: 39175 - DNA, 201 bp, Homo sapiens
gaatcccagccatgctgattcctctccacccatttccagtgctagaggcccacagtttcagtctcatctgcctccactcggcctcagttcctcatcactgytcctgtgctcacagtcatcaattatagaccccacaacatgcgccctgaagacagaatgttccatatcagagctgtgatcttgagagccctctccttggct

SEQ ID NO: 39176 - DNA, 201 bp, Homo sapiens
ggcccacagtttcagtctcatctgcctccactcggcctcagttcctcatcactgttcctgtgctcacagtcatcaattatagaccccacaacatgcgcccwgaagacagaatgttccatatcagagctgtgatcttgagagccctctccttggctttcctgctgagtctccgaggagctggggccatcaagggtgagtgct

SEQ ID NO: 39177 - DNA, 201 bp, Homo sapiens
cagtgctagaggcccacagtttcagtctcatctgcctccactcggcctcagttcctcatcactgttcctgtgctcacagtcatcaattatagaccccacarcatgcgccctgaagacagaatgttccatatcagagctgtgatcttgagagccctctccttggctttcctgctgagtctccgaggagctggggccatcaag

SEQ ID NO: 39178 - DNA, 201 bp, Homo sapiens
aaggagcctgtggagctgggccagcccaacaccctcatctgccacattgacaagttcttcccaccagtgctcaacgtcacgtggctgtgcaacggggagcyggtcactgagggtgtcgctgagagcctcttcctgcccagaacagattacagcttccacaagttccattacctgacctttgtgccctcagcagaggacttc

SEQ ID NO: 39179 - DNA, 201 bp, Homo sapiens
ctttatggtgttgctccttcttcttccccatatgtccttcctttgacctcttaccttcttcctttttatattcataagtctttattcattctctagctttsaccacttgcatattcaaactgacattttgtcgtgtttttctctactgtctttatgcagcggaccatgtgtcaacttatgccgcgtttgtacagacgcata

SEQ ID NO: 39180 - DNA, 201 bp, Homo sapiens
tgtccttcctttgacctcttaccttcttcctttttatattcataagtctttattcattctctagctttgaccacttgcatattcaaactgacattttgtcrtgtttttctctactgtctttatgcagcggaccatgtgtcaacttatgccgcgtttgtacagacgcatagaccaacaggggagtttatgtttgaatttgat

SEQ ID NO: 39181 - DNA, 201 bp, Homo sapiens
aggagcctgtggagctgggccagcccaacaccctcatctgccacattgacaagttcttcccaccagtgctcaacgtcacgtggctgtgcaacggggagctrgtcactgagggtgtcgctgagagcctcttcctgcccagaacagattacagcttccacaagttccattacctgacctttgtgccctcagcagaggacttct

SEQ ID NO: 39182 - DNA, 201 bp, Homo sapiens
ggctgtgcaacggggagctggtcactgagggtgtcgctgagagcctcttcctgcccagaacagattacagcttccacaagttccattacctgacctttgtrccctcagcagaggacttctatgactgcagggtggagcactggggcttggaccagccgctcctcaagcactggggtatgcaactgcttttctctccataat

SEQ ID NO: 39183 - DNA, 201 bp, Homo sapiens
cacttgcatattcaaactgacattttgtcgtgtttttctctactgtctttatgcagcggaccatgtgtcaacttatgccgcgtttgtacagacgcatagamcaacaggggagtttatgtttgaatttgatgaagatgagatgttctatgtggatctggacaagaaggagaccgtctggcatctggaggagtttggccaagc

SEQ ID NO: 39184 - DNA, 201 bp, Homo sapiens
gacaaaatatctgaacagaagaggacttaggagagatctgaactccagctgccctacaaactccatctcagcttttcttctcacttcatgtgaaaactacyccagtggctgactgaattgctgacccttcaagctctgtccttatccattacctcaaagcagtcattccttagtaaagtttccaacaaatagaaattaatg

SEQ ID NO: 39185 - DNA, 201 bp, Homo sapiens
gctgccctacaaactccatctcagcttttcttctcacttcatgtgaaaactactccagtggctgactgaattgctgacccttcaagctctgtccttatccrttacctcaaagcagtcattccttagtaaagtttccaacaaatagaaattaatgacactttggtagcactaatatggagattatcctttcattgagccttt

SEQ ID NO: 39186 - DNA, 201 bp, Homo sapiens
cctttgaggctcagggcgggctggctaacattgctatattgaacaacaacttgaataccttgatccagcgttccaaccacactcaggccaccaacggtackccctatctttgcctcttcctctgtagcccaactggaagggatgagagggcctctctgccaccctcagactaggaagcctaagtgccccctgctgtgtgat

SEQ ID NO: 39187 - DNA, 201 bp, Homo sapiens
agggggcggacatgagcggaggcgccactctcatctaatcctctttctccctctctctctcaatattaacgattcttcccaaatcttcccacccagggctrgattttaaaataggagttttcctagtaccgagttctgtggtcctaagcgggtcgcagagcctctccaggcctgttttctcaccacgcagagagagaattt

SEQ ID NO: 39188 - DNA, 201 bp, Homo sapiens
tttgctcctttctttttataactgctcatctgctctgtattatttcctttatggtgttgctccttcttcttccccatatgtccttcctttgacctcttacyttcttcctttttatattcataagtctttattcattctctagctttgaccacttgcatattcaaactgacattttgtcgtgtttttctctactgtctttat

SEQ ID NO: 39189 - DNA, 201 bp, Homo sapiens
ctttgaggctcagggcgggctggctaacattgctatattgaacaacaacttgaataccttgatccagcgttccaaccacactcaggccaccaacggtacgscctatctttgcctcttcctctgtagcccaactggaagggatgagagggcctctctgccaccctcagactaggaagcctaagtgccccctgctgtgtgatc

SEQ ID NO: 39190 - DNA, 201 bp, Homo sapiens
ctgcggggagggggcggacatgagcggaggcgccactctcatctaatcctctttctccctctctctctcaatattaacgattcttcccaaatcttcccacycagggctggattttaaaataggagttttcctagtaccgagttctgtggtcctaagcgggtcgcagagcctctccaggcctgttttctcaccacgcagaga

SEQ ID NO: 39191 - DNA, 201 bp, Homo sapiens
accatgtgtcaacttatgccgcgtttgtacagacgcatagaccaacaggggagtttatgtttgaatttgatgaagatgagatgttctatgtggatctggayaagaaggagaccgtctggcatctggaggagtttggccaagccttttcctttgaggctcagggcgggctggctaacattgctatattgaacaacaacttga

SEQ ID NO: 39192 - DNA, 201 bp, Homo sapiens
aattctctgcggggagggggcggacatgagcggaggcgccactctcatctaatcctctttctccctctctctctcaatattaacgattcttcccaaatctwcccacccagggctggattttaaaataggagttttcctagtaccgagttctgtggtcctaagcgggtcgcagagcctctccaggcctgttttctcaccacg

SEQ ID NO: 39193 - DNA, 201 bp, Homo sapiens
tgactgaattgctgacccttcaagctctgtccttatccattacctcaaagcagtcattccttagtaaagtttccaacaaatagaaattaatgacactttgrtagcactaatatggagattatcctttcattgagccttttatcctctgttctcctttgaagaacccctcactgtcaccttcccgagaataccctaagacca

SEQ ID NO: 39194 - DNA, 201 bp, Homo sapiens
ctgacattttgtcgtgtttttctctactgtctttatgcagcggaccatgtgtcaacttatgccgcgtttgtacagacgcatagaccaacaggggagtttakgtttgaatttgatgaagatgagatgttctatgtggatctggacaagaaggagaccgtctggcatctggaggagtttggccaagccttttcctttgaggct

SEQ ID NO: 39195 - DNA, 201 bp, Homo sapiens
ttgctgacccttcaagctctgtccttatccattacctcaaagcagtcattccttagtaaagtttccaacaaatagaaattaatgacactttggtagcactratatggagattatcctttcattgagccttttatcctctgttctcctttgaagaacccctcactgtcaccttcccgagaataccctaagaccaataaatac

SEQ ID NO: 39196 - DNA, 201 bp, Homo sapiens
tattcaaactgacattttgtcgtgtttttctctactgtctttatgcagcggaccatgtgtcaacttatgccgcgtttgtacagacgcatagaccaacaggrgagtttatgtttgaatttgatgaagatgagatgttctatgtggatctggacaagaaggagaccgtctggcatctggaggagtttggccaagccttttcct

SEQ ID NO: 39197 - DNA, 201 bp, Homo sapiens
tagatagcacattcattcttaattatcagcagaatatttttgtaaaatattgacaacataacataaaacatgatttaaaatatagtgaccaaaaaacatcraagatcatctgactgtctgggatgggggtggggctcgggagaaggaacataatggaaaacatttgccgtcagaagaaggtgtaacttatctttttacatc

SEQ ID NO: 39198 - DNA, 201 bp, Homo sapiens
agtctatgttccctctggccctcataataataacagcaataacagccagaatttatgagactcctgcatagtttctttccccatttacatctcacaggaaycttcaatgaagataatattccattcatttagaaattattccttttatttagaaattattttgaaaaaactgaagctcaaaaagatgaataagttttccaa

SEQ ID NO: 39199 - DNA, 201 bp, Homo sapiens
gagtctccgaggagctggggccatcaagggtgagtgctcaggaggacgcaggagcgtcggggtgagtgatggggtggttcacatcaattgctgcttcaggratcacagattttaggggctcattgatctatctggtcctcatagtctatgttccctctggccctcataataataacagcaataacagccagaatttatgag

SEQ ID NO: 39200 - DNA, 201 bp, Homo sapiens
ctttcctgctgagtctccgaggagctggggccatcaagggtgagtgctcaggaggacgcaggagcgtcggggtgagtgatggggtggttcacatcaattgytgcttcagggatcacagattttaggggctcattgatctatctggtcctcatagtctatgttccctctggccctcataataataacagcaataacagccag

SEQ ID NO: 39201 - DNA, 201 bp, Homo sapiens
tttgtcgtgtttttctctactgtctttatgcagcggaccatgtgtcaacttatgccgcgtttgtacagacgcatagaccaacaggggagtttatgtttgartttgatgaagatgagatgttctatgtggatctggacaagaaggagaccgtctggcatctggaggagtttggccaagccttttcctttgaggctcagggcg

SEQ ID NO: 39202 - DNA, 201 bp, Homo sapiens
tttttctctactgtctttatgcagcggaccatgtgtcaacttatgccgcgtttgtacagacgcatagaccaacaggggagtttatgtttgaatttgatgawgatgagatgttctatgtggatctggacaagaaggagaccgtctggcatctggaggagtttggccaagccttttcctttgaggctcagggcgggctggcta

SEQ ID NO: 39203 - DNA, 201 bp, Homo sapiens
cattctacgcagggagctccagtaatctaccctcagtccctgtcacatggctccactgcctcatctcattccccctacaaacctcaacccagcctttgccygtcctccctttcactgcccagcatcacatgcccccttctgctctctgctcccccacctctgggtttccttggtggctcccaacactgtccctcatcccac

SEQ ID NO: 39204 - DNA, 201 bp, Homo sapiens
catgcccccttctgctctctgctcccccacctctgggtttccttggtggctcccaacactgtccctcatcccacatgacagctctgcctatgggatggggrcgctgcatccgtcacttcctcctgacactgttcagtgtcaccagtgctgctccagcctcctctctccccagcctcacccctctgcagttcccagggctga

SEQ ID NO: 39205 - DNA, 201 bp, Homo sapiens
atgcccccttctgctctctgctcccccacctctgggtttccttggtggctcccaacactgtccctcatcccacatgacagctctgcctatgggatgggggygctgcatccgtcacttcctcctgacactgttcagtgtcaccagtgctgctccagcctcctctctccccagcctcacccctctgcagttcccagggctgag

SEQ ID NO: 39206 - DNA, 201 bp, Homo sapiens
agcagtcattccttagtaaagtttccaacaaatagaaattaatgacactttggtagcactaatatggagattatcctttcattgagccttttatcctctgktctcctttgaagaacccctcactgtcaccttcccgagaataccctaagaccaataaatacttcagtatttcagagcggggagactctgagtcattcttac

SEQ ID NO: 39207 - DNA, 201 bp, Homo sapiens
gtcattccttagtaaagtttccaacaaatagaaattaatgacactttggtagcactaatatggagattatcctttcattgagccttttatcctctgttctyctttgaagaacccctcactgtcaccttcccgagaataccctaagaccaataaatacttcagtatttcagagcggggagactctgagtcattcttactgga

SEQ ID NO: 39208 - DNA, 201 bp, Homo sapiens
cccccttctgctctctgctcccccacctctgggtttccttggtggctcccaacactgtccctcatcccacatgacagctctgcctatgggatgggggcgcygcatccgtcacttcctcctgacactgttcagtgtcaccagtgctgctccagcctcctctctccccagcctcacccctctgcagttcccagggctgagccg

SEQ ID NO: 39209 - DNA, 201 bp, Homo sapiens
ttagtaaagtttccaacaaatagaaattaatgacactttggtagcactaatatggagattatcctttcattgagccttttatcctctgttctcctttgaaraacccctcactgtcaccttcccgagaataccctaagaccaataaatacttcagtatttcagagcggggagactctgagtcattcttactggaagtctagg

SEQ ID NO: 39210 - DNA, 201 bp, Homo sapiens
ctctgctcccccacctctgggtttccttggtggctcccaacactgtccctcatcccacatgacagctctgcctatgggatgggggcgctgcatccgtcacytcctcctgacactgttcagtgtcaccagtgctgctccagcctcctctctccccagcctcacccctctgcagttcccagggctgagccgtcctgctggtta

SEQ ID NO: 39211 - DNA, 201 bp, Homo sapiens
agaggcattcttcgtgagcactgaatcctcagtgatcctcagagcctggacactccagcttagggctctctgcctgagtcccctccaggctggatgcagayatgaacacgcccaggagcctgcacttgccaacttctctctctgcaaaccttgtctgtccaaggttatccaggacctcttggtcccattttccccaaagac

SEQ ID NO: 39212 - DNA, 201 bp, Homo sapiens
tgttcttgggcacactggggaaattaaggtgctgtgattgttctgctcatctgtttcatgctccacaaattaacttctccagtttattaacctcacccctwgcagaagttgcacagctggtggcagaggatagtggagatggggtagggctgggctcaagggcaccatggagtccacctttagtctccagtgtcattgcta

SEQ ID NO: 39213 - DNA, 201 bp, Homo sapiens
gaggcattcttcgtgagcactgaatcctcagtgatcctcagagcctggacactccagcttagggctctctgcctgagtcccctccaggctggatgcagacrtgaacacgcccaggagcctgcacttgccaacttctctctctgcaaaccttgtctgtccaaggttatccaggacctcttggtcccattttccccaaagaca

SEQ ID NO: 39214 - DNA, 201 bp, Homo sapiens
gatgagtggaccccagagccagagagtcccctgctcttcagaggtggggtctagagggtcatcagagactcactccactccacggtgacaggactatccakgctggtgtgctccacttggcaggtgtagacatctccctgctggggggtcatttccagcatcaccaggatctggaaggtccagtctccattacggatcagg

SEQ ID NO: 39215 - DNA, 201 bp, Homo sapiens
ccgtccctggaaaaggtaattctctgcggggagggggcggacatgagcggaggcgccactctcatctaatcctctttctccctctctctctcaatattaasgattcttcccaaatcttcccacccagggctggattttaaaataggagttttcctagtaccgagttctgtggtcctaagcgggtcgcagagcctctccagg

SEQ ID NO: 39216 - DNA, 201 bp, Homo sapiens
caattgctgcttcagggatcacagattttaggggctcattgatctatctggtcctcatagtctatgttccctctggccctcataataataacagcaataayagccagaatttatgagactcctgcatagtttctttccccatttacatctcacaggaatcttcaatgaagataatattccattcatttagaaattattcct

SEQ ID NO: 39217 - DNA, 201 bp, Homo sapiens
gagcctggacactccagcttagggctctctgcctgagtcccctccaggctggatgcagacatgaacacgcccaggagcctgcacttgccaacttctctctstgcaaaccttgtctgtccaaggttatccaggacctcttggtcccattttccccaaagacaagcactgaccactgggcacctctctctgtttactgtaccc

SEQ ID NO: 39218 - DNA, 201 bp, Homo sapiens
agatgtgagcagcaccatcagtaacgccgtcagagccactgtccggggggccgcagaaacctgcagaaccatcatggagctggaaaaggatggcaaaatgraaagagctgcagtcaggaaaagaaggactcgctaaagggagctcctgtttgaaatattagagaccatgaacccaagtagtcttctgtgaccctgggattg

SEQ ID NO: 39219 - DNA, 201 bp, Homo sapiens
cacagattttaggggctcattgatctatctggtcctcatagtctatgttccctctggccctcataataataacagcaataacagccagaatttatgagackcctgcatagtttctttccccatttacatctcacaggaatcttcaatgaagataatattccattcatttagaaattattccttttatttagaaattatttt

SEQ ID NO: 39220 - DNA, 201 bp, Homo sapiens
acatgctgttcttcctagggagtgccatgagcagtgtctggcaggtgtgtgtctacacagaattatcagtgacacggcacatgtttgtttctgtttgagtrtcttcaggcctgctctgttcttgggcacactggggaaattaaggtgctgtgattgttctgctcatctgtttcatgctccacaaattaacttctccagttt

SEQ ID NO: 39221 - DNA, 201 bp, Homo sapiens
accccagctgtttcctcctgtccattcaggaaccatcggacttgaatgctgcctgggtagaaatccgtcacgtggcagacaagcaggttgtggtgctgcargggccccttcttggagggggaaacattcaccctaggctggactaggagcgtggaagaaaaataatgaaatagaatttgagattgtccttctttccttcct

SEQ ID NO: 39222 - DNA, 201 bp, Homo sapiens
tcgctgtcgaagcgcgcgaactcctcccggttgtagatgtatctctccaggaagcgctgtgtcccattaaacgcgtagcattcctgccgtccctggaaaasgtaattctctgcggggagggggcggacatgagcggaggcgccactctcatctaatcctctttctccctctctctctcaatattaacgattcttcccaaat

SEQ ID NO: 39223 - DNA, 201 bp, Homo sapiens
cgtcgctgtcgaagcgcgcgaactcctcccggttgtagatgtatctctccaggaagcgctgtgtcccattaaacgcgtagcattcctgccgtccctggaamaggtaattctctgcggggagggggcggacatgagcggaggcgccactctcatctaatcctctttctccctctctctctcaatattaacgattcttcccaa

SEQ ID NO: 39224 - DNA, 201 bp, Homo sapiens
cacgtcgctgtcgaagcgcgcgaactcctcccggttgtagatgtatctctccaggaagcgctgtgtcccattaaacgcgtagcattcctgccgtccctggwaaaggtaattctctgcggggagggggcggacatgagcggaggcgccactctcatctaatcctctttctccctctctctctcaatattaacgattcttccc

SEQ ID NO: 39225 - DNA, 201 bp, Homo sapiens
tcccccacgtcgctgtcgaagcgcgcgaactcctcccggttgtagatgtatctctccaggaagcgctgtgtcccattaaacgcgtagcattcctgccgtcmctggaaaaggtaattctctgcggggagggggcggacatgagcggaggcgccactctcatctaatcctctttctccctctctctctcaatattaacgattc

SEQ ID NO: 39226 - DNA, 201 bp, Homo sapiens
gggtcatttccagcatcaccaggatctggaaggtccagtctccattacggatcaggttggtggacacgaccccagctgtttcctcctgtccattcaggaascatcggacttgaatgctgcctgggtagaaatccgtcacgtggcagacaagcaggttgtggtgctgcaagggccccttcttggagggggaaacattcaccc

SEQ ID NO: 39227 - DNA, 201 bp, Homo sapiens
ctactgtctttatgcagcggaccatgtgtcaacttatgccgcgtttgtacagacgcatagaccaacaggggagtttatgtttgaatttgatgaagatgagmtgttctatgtggatctggacaagaaggagaccgtctggcatctggaggagtttggccaagccttttcctttgaggctcagggcgggctggctaacattgc

SEQ ID NO: 39228 - DNA, 201 bp, Homo sapiens
cttagggcaggagcccccgcagcctgtctcagaatttgatcccttaaagataacgtcccctaggaattgttccctgagccagaccctccaagaatggcagytcggctcttacctggagtggccctgccctggaccacagatgtgagcagcaccatcagtaacgccgtcagagccactgtccggggggccgcagaaacctgc

SEQ ID NO: 39229 - DNA, 201 bp, Homo sapiens
agatggggtttggacatggccccagggtatagatgcagaagataagatgagtggaccccagagccagagagtcccctgctcttcagaggtggggtctagabggtcatcagagactcactccactccacggtgacaggactatccaggctggtgtgctccacttggcaggtgtagacatctccctgctggggggtcatttcc

SEQ ID NO: 39230 - DNA, 201 bp, Homo sapiens
ggtcatgggcccgcccagctcgtagttgtgtctgcacatcctgtccggcactgcccgcttctcctccaggatgtccttctggctgttccagtactccgcakcaggccgccccagctccgtcaccgcccggaactcccccacgtcgctgtcgaagcgcgcgaactcctcccggttgtagatgtatctctccaggaagcgctg

SEQ ID NO: 39231 - DNA, 201 bp, Homo sapiens
ttccatatcagagctgtgatcttgagagccctctccttggctttcctgctgagtctccgaggagctggggccatcaagggtgagtgctcaggaggacgcargagcgtcggggtgagtgatggggtggttcacatcaattgctgcttcagggatcacagattttaggggctcattgatctatctggtcctcatagtctatgt

SEQ ID NO: 39232 - DNA, 201 bp, Homo sapiens
agtaaagtttccaacaaatagaaattaatgacactttggtagcactaatatggagattatcctttcattgagccttttatcctctgttctcctttgaagarcccctcactgtcaccttcccgagaataccctaagaccaataaatacttcagtatttcagagcggggagactctgagtcattcttactggaagtctaggac

SEQ ID NO: 39233 - DNA, 201 bp, Homo sapiens
ctccacatcctctccagcacctgttgtttcctgactttttaatgatcgccattttaactggtgtgagatggtatctcaagacagtgtggcaattcctcaargatctagaactagaaataccatttgacccagccatcccattactggatatatacccaaaggattataaatcatgctgctataaagacacatgcacacata

SEQ ID NO: 39234 - DNA, 201 bp, Homo sapiens
aaaaataaagtccatagagaatataaattgactggtaaataaggaagaaagtgaaaaaaaatcatcaaagaccccacctccttcaaagcatctgattctaytttgtttagagtgaatatttttacaaactttcaaagaacattacttcttactttagacacttataaatgtgatcctgttggaccaccaattctaatttca

SEQ ID NO: 39235 - DNA, 201 bp, Homo sapiens
gaaattaatgacactttggtagcactaatatggagattatcctttcattgagccttttatcctctgttctcctttgaagaacccctcactgtcaccttccygagaataccctaagaccaataaatacttcagtatttcagagcggggagactctgagtcattcttactggaagtctaggaccaggtcacatgtgaatacta

SEQ ID NO: 39236 - DNA, 201 bp, Homo sapiens
agttagtatgaaaggtctgaaaatataaagcctgtgatgcacttaagatgacggaggaaagacagtgatactcattttaaccagtcagataagtcatgatrtttggggagattatgcgttttctttgctctgaaggtgatctcaaatattctgctggcccatctacagggattatcatttccccaattctgccacacctca

SEQ ID NO: 39237 - DNA, 201 bp, Homo sapiens
gacactttggtagcactaatatggagattatcctttcattgagccttttatcctctgttctcctttgaagaacccctcactgtcaccttcccgagaatacyctaagaccaataaatacttcagtatttcagagcggggagactctgagtcattcttactggaagtctaggaccaggtcacatgtgaatactatttcttgaa

SEQ ID NO: 39238 - DNA, 201 bp, Homo sapiens
tgcctgagtcccctccaggctggatgcagacatgaacacgcccaggagcctgcacttgccaacttctctctctgcaaaccttgtctgtccaaggttatccwggacctcttggtcccattttccccaaagacaagcactgaccactgggcacctctctctgtttactgtacccatgtccttggagagagaataggccagtag

SEQ ID NO: 39239 - DNA, 201 bp, Homo sapiens
ctggattaagaaaatgcacacatatacaccatggaatactgtgcagccataaaaaaggatgagttcatgtcctttgtagggacatggaggaagctggaaaycatcattcacagcaaactattgcaaggacaaaaaaccaaagaccacatgttctcactcataggtgggaactgaacaatgagaacacatggacacaggaag

SEQ ID NO: 39240 - DNA, 201 bp, Homo sapiens
ttttttaagtacatttaacttttgaaatggaattttacctgccaagtagacataagcaatgaggggttttatggtgtaatttgaaaccttcatttttttttgtatataagaaactttatcctgtttgtggaacccttagcaattgagttgcccagagcacggtttgaaaccactgatctgaatgaattcgtctcttattca

SEQ ID NO: 39241 - DNA, 201 bp, Homo sapiens
ctcccccacgtcgctgtcgaagcgcgcgaactcctcccggttgtagatgtatctctccaggaagcgctgtgtcccattaaacgcgtagcattcctgccgtmcctggaaaaggtaattctctgcggggagggggcggacatgagcggaggcgccactctcatctaatcctctttctccctctctctctcaatattaacgatt

SEQ ID NO: 39242 - DNA, 201 bp, Homo sapiens
gcaccttccagcgtcctctttacccagcaacagagaatgtcagctctatgatttctctgataggtgaatcccagccatgctgattcctctccacccatttscagtgctagaggcccacagtttcagtctcatctgcctccactcggcctcagttcctcatcactgttcctgtgctcacagtcatcaattatagaccccaca

SEQ ID NO: 39243 - DNA, 201 bp, Homo sapiens
agtgaccaaaaaacatcaaagatcatctgactgtctgggatgggggtggggctcgggagaaggaacataatggaaaacatttgccgtcagaagaaggtgtracttatctttttacatctctttctctaactctgaaaatgaactgtgaactggagctctcttgaccacgctggtacctaaaattctcccatctcttcccca

SEQ ID NO: 39244 - DNA, 201 bp, Homo sapiens
ctcctccaggatgtccttctggctgttccagtactccgcagcaggccgccccagctccgtcaccgcccggaactcccccacgtcgctgtcgaagcgcgcgwactcctcccggttgtagatgtatctctccaggaagcgctgtgtcccattaaacgcgtagcattcctgccgtccctggaaaaggtaattctctgcggggag

SEQ ID NO: 39245 - DNA, 201 bp, Homo sapiens
cttctcctccaggatgtccttctggctgttccagtactccgcagcaggccgccccagctccgtcaccgcccggaactcccccacgtcgctgtcgaagcgcrcgaactcctcccggttgtagatgtatctctccaggaagcgctgtgtcccattaaacgcgtagcattcctgccgtccctggaaaaggtaattctctgcggg

SEQ ID NO: 39246 - DNA, 201 bp, Homo sapiens
cagggtcatgggcccgcccagctcgtagttgtgtctgcacatcctgtccggcactgcccgcttctcctccaggatgtccttctggctgttccagtactcckcagcaggccgccccagctccgtcaccgcccggaactcccccacgtcgctgtcgaagcgcgcgaactcctcccggttgtagatgtatctctccaggaagcg

SEQ ID NO: 39247 - DNA, 201 bp, Homo sapiens
gctgcagggtcatgggcccgcccagctcgtagttgtgtctgcacatcctgtccggcactgcccgcttctcctccaggatgtccttctggctgttccagtastccgcagcaggccgccccagctccgtcaccgcccggaactcccccacgtcgctgtcgaagcgcgcgaactcctcccggttgtagatgtatctctccagga

SEQ ID NO: 39248 - DNA, 201 bp, Homo sapiens
caaagccctcactcacctcggcgctgcagggtcatgggcccgcccagctcgtagttgtgtctgcacatcctgtccggcactgcccgcttctcctccaggakgtccttctggctgttccagtactccgcagcaggccgccccagctccgtcaccgcccggaactcccccacgtcgctgtcgaagcgcgcgaactcctcccgg

SEQ ID NO: 39249 - DNA, 201 bp, Homo sapiens
tcagagctgtgatcttgagagccctctccttggctttcctgctgagtctccgaggagctggggccatcaagggtgagtgctcaggaggacgcaggagcgtyggggtgagtgatggggtggttcacatcaattgctgcttcagggatcacagattttaggggctcattgatctatctggtcctcatagtctatgttccctct

SEQ ID NO: 39250 - DNA, 201 bp, Homo sapiens
ccatcggacttgaatgctgcctgggtagaaatccgtcacgtggcagacaagcaggttgtggtgctgcaagggccccttcttggagggggaaacattcaccytaggctggactaggagcgtggaagaaaaataatgaaatagaatttgagattgtccttctttccttccttccttccttccttccttccttccttccttcct

SEQ ID NO: 39251 - DNA, 201 bp, Homo sapiens
caggatctggaaggtccagtctccattacggatcaggttggtggacacgaccccagctgtttcctcctgtccattcaggaaccatcggacttgaatgctgyctgggtagaaatccgtcacgtggcagacaagcaggttgtggtgctgcaagggccccttcttggagggggaaacattcaccctaggctggactaggagcgt

SEQ ID NO: 39252 - DNA, 201 bp, Homo sapiens
aggccaacccggctgctcctgcgccctgggcacgggcccgcggggctgccctgggaccgccggcccaaagccctcactcacctcggcgctgcagggtcatsggcccgcccagctcgtagttgtgtctgcacatcctgtccggcactgcccgcttctcctccaggatgtccttctggctgttccagtactccgcagcaggcc

SEQ ID NO: 39253 - DNA, 201 bp, Homo sapiens
attacggatcaggttggtggacacgaccccagctgtttcctcctgtccattcaggaaccatcggacttgaatgctgcctgggtagaaatccgtcacgtggyagacaagcaggttgtggtgctgcaagggccccttcttggagggggaaacattcaccctaggctggactaggagcgtggaagaaaaataatgaaatagaat

SEQ ID NO: 39254 - DNA, 201 bp, Homo sapiens
tactgtctttatgcagcggaccatgtgtcaacttatgccgcgtttgtacagacgcatagaccaacaggggagtttatgtttgaatttgatgaagatgagawgttctatgtggatctggacaagaaggagaccgtctggcatctggaggagtttggccaagccttttcctttgaggctcagggcgggctggctaacattgct

SEQ ID NO: 39255 - DNA, 201 bp, Homo sapiens
agctgtttcctcctgtccattcaggaaccatcggacttgaatgctgcctgggtagaaatccgtcacgtggcagacaagcaggttgtggtgctgcaagggcyccttcttggagggggaaacattcaccctaggctggactaggagcgtggaagaaaaataatgaaatagaatttgagattgtccttctttccttccttcctt

SEQ ID NO: 39256 - DNA, 201 bp, Homo sapiens
tattcattctctagctttgaccacttgcatattcaaactgacattttgtcgtgtttttctctactgtctttatgcagcggaccatgtgtcaacttatgccrcgtttgtacagacgcatagaccaacaggggagtttatgtttgaatttgatgaagatgagatgttctatgtggatctggacaagaaggagaccgtctggca

SEQ ID NO: 39257 - DNA, 201 bp, Homo sapiens
ctttgggcctgcagtggctgcagtcttgtccagtatttagattatttcatctgcagtcactatctgtcttcctacattttacacagccttaattttcttcrgcccgcagagtgatgttcagaacttccaatgctatgttaaacatttccagcaacgaaggacatcctatcttttgcacaatctcaaaggcaatccacctca

SEQ ID NO: 39258 - DNA, 201 bp, Homo sapiens
gctatagatttttggttcactacctttaacatgtcatgaaattgattaaattctgtctatgtcttgagctgaattcagtttaaattaatatgaattttgcrgagtccactaatgtgttaaccacattatatattttctgacactgaagaatcattgcattcctagaataaatctaaaattggtcaaaacgtattgttttta

SEQ ID NO: 39259 - DNA, 201 bp, Homo sapiens
tctcatctaatcctctttctccctctctctctcaatattaacgattcttcccaaatcttcccacccagggctggattttaaaataggagttttcctagtaycgagttctgtggtcctaagcgggtcgcagagcctctccaggcctgttttctcaccacgcagagagagaatttactgaaaagaatgagctcaggggcactg

SEQ ID NO: 39260 - DNA, 201 bp, Homo sapiens
tgataggtgaatcccagccatgctgattcctctccacccatttccagtgctagaggcccacagtttcagtctcatctgcctccactcggcctcagttcctyatcactgttcctgtgctcacagtcatcaattatagaccccacaacatgcgccctgaagacagaatgttccatatcagagctgtgatcttgagagccctct

SEQ ID NO: 39261 - DNA, 201 bp, Homo sapiens
cctatgtgtgaggtcagttcctaagtgtgagggtttcgagaccagtcagtgtccctagattctctgacaagggggagaactatgaatcttcaggaaccccyaagccaaggtcaggaagtctccatttccctggcttcaaactatgctcaggagctggtatagaagaaagatggggtttggacatggccccagggtatagat

SEQ ID NO: 39262 - DNA, 201 bp, Homo sapiens
gccattttaactggtgtgagatggtatctcaagacagtgtggcaattcctcaaagatctagaactagaaataccatttgacccagccatcccattactggrtatatacccaaaggattataaatcatgctgctataaagacacatgcacacatatgtttattgcggcactattcacaatagcaaagacttggaaccaaccc

SEQ ID NO: 39263 - DNA, 201 bp, Homo sapiens
aactagaaataccatttgacccagccatcccattactggatatatacccaaaggattataaatcatgctgctataaagacacatgcacacatatgtttatwgcggcactattcacaatagcaaagacttggaaccaacccaactgtccatcagtgatagactggattaagaaaatgcacacatatacaccatggaatactg

SEQ ID NO: 39264 - DNA, 201 bp, Homo sapiens
tttccagtgctagaggcccacagtttcagtctcatctgcctccactcggcctcagttcctcatcactgttcctgtgctcacagtcatcaattatagacccyacaacatgcgccctgaagacagaatgttccatatcagagctgtgatcttgagagccctctccttggctttcctgctgagtctccgaggagctggggccat

SEQ ID NO: 39265 - DNA, 201 bp, Homo sapiens
ggaccgccggcccaaagccctcactcacctcggcgctgcagggtcatgggcccgcccagctcgtagttgtgtctgcacatcctgtccggcactgcccgctyctcctccaggatgtccttctggctgttccagtactccgcagcaggccgccccagctccgtcaccgcccggaactcccccacgtcgctgtcgaagcgcgcg

SEQ ID NO: 39266 - DNA, 201 bp, Homo sapiens
ccaagttctggggaggctgggagaagtacctttaatgagaatgccttcaggggctaaaacctatccccctccctcccttctctccttaattgtccaagggrtgtgggctcctgctccaccctggggaataagaggcattcttcgtgagcactgaatcctcagtgatcctcagagcctggacactccagcttagggctctct

SEQ ID NO: 39267 - DNA, 201 bp, Homo sapiens
cgggcccgcggggctgccctgggaccgccggcccaaagccctcactcacctcggcgctgcagggtcatgggcccgcccagctcgtagttgtgtctgcacaycctgtccggcactgcccgcttctcctccaggatgtccttctggctgttccagtactccgcagcaggccgccccagctccgtcaccgcccggaactccccc

SEQ ID NO: 39268 - DNA, 201 bp, Homo sapiens
cacgggcccgcggggctgccctgggaccgccggcccaaagccctcactcacctcggcgctgcagggtcatgggcccgcccagctcgtagttgtgtctgcayatcctgtccggcactgcccgcttctcctccaggatgtccttctggctgttccagtactccgcagcaggccgccccagctccgtcaccgcccggaactccc

SEQ ID NO: 39269 - DNA, 201 bp, Homo sapiens
tctctgcgggcctctcctcacactgcacttgggtttttttggtctctttcacaggcttttctgtcttggccaaatcacaactgtccagttcccaggatccrgtcctttgctcttccccctgggtcccctctccctggatggtctcatgtatctcagtctcctccccggctgcagacccttctgtctacctgcccatcagac

SEQ ID NO: 39270 - DNA, 201 bp, Homo sapiens
taggggctcattgatctatctggtcctcatagtctatgttccctctggccctcataataataacagcaataacagccagaatttatgagactcctgcataktttctttccccatttacatctcacaggaatcttcaatgaagataatattccattcatttagaaattattccttttatttagaaattattttgaaaaaact

SEQ ID NO: 39271 - DNA, 201 bp, Homo sapiens
aggatttgtagaatgtaaggaagggaggaaaaattcaatctgataagtgttcattgatcttctaatgggttaaaagcattcagccacataacaacaacaayaccgataactaactgagtagttaatatggtcaggcgctattctgaggatttacatttattaactcactttattctcacacatagtctttgaggtaggtac

SEQ ID NO: 39272 - DNA, 201 bp, Homo sapiens
tatgtggatctggacaagaaggagaccgtctggcatctggaggagtttggccaagccttttcctttgaggctcagggcgggctggctaacattgctatatygaacaacaacttgaataccttgatccagcgttccaaccacactcaggccaccaacggtacgccctatctttgcctcttcctctgtagcccaactggaagg

SEQ ID NO: 39273 - DNA, 201 bp, Homo sapiens
cagagactcactccactccacggtgacaggactatccaggctggtgtgctccacttggcaggtgtagacatctccctgctggggggtcatttccagcatcwccaggatctggaaggtccagtctccattacggatcaggttggtggacacgaccccagctgtttcctcctgtccattcaggaaccatcggacttgaatgct

SEQ ID NO: 39274 - DNA, 201 bp, Homo sapiens
gcattcctgccgtccctggaaaaggtaattctctgcggggagggggcggacatgagcggaggcgccactctcatctaatcctctttctccctctctctctyaatattaacgattcttcccaaatcttcccacccagggctggattttaaaataggagttttcctagtaccgagttctgtggtcctaagcgggtcgcagagc

SEQ ID NO: 39275 - DNA, 201 bp, Homo sapiens
attcattctctagctttgaccacttgcatattcaaactgacattttgtcgtgtttttctctactgtctttatgcagcggaccatgtgtcaacttatgccgygtttgtacagacgcatagaccaacaggggagtttatgtttgaatttgatgaagatgagatgttctatgtggatctggacaagaaggagaccgtctggcat

SEQ ID NO: 39276 - DNA, 201 bp, Homo sapiens
aggatgtccttctggctgttccagtactccgcagcaggccgccccagctccgtcaccgcccggaactcccccacgtcgctgtcgaagcgcgcgaactcctsccggttgtagatgtatctctccaggaagcgctgtgtcccattaaacgcgtagcattcctgccgtccctggaaaaggtaattctctgcggggagggggcgg

SEQ ID NO: 39277 - DNA, 201 bp, Homo sapiens
tcagactgtgcctctgggaaggacagacccaggtttagtgtcacctccaccagctgcatccctactcatgtcctgtctgagattctggagcctgatgcagmatatcgggatgaggacagtgcagcggaaaaagcttgctaagaggaaattcagaaagagccaccctcatatctggaacaggggtgtgacctcaacaaggtg

SEQ ID NO: 39278 - DNA, 201 bp, Homo sapiens
gtgtcattgctaaggcaagatcccaggtcttgactcagatatcctgacctgcctcttctcctggtgccttgggccccagaccctaaaattccaggcccagrgccccccagctccttgagtccagattcctcctcctctgccatccatccgcccctgcctgttcaattgccccactctgagtgtggattctcccattttcat

SEQ ID NO: 39279 - DNA, 201 bp, Homo sapiens
attgcaagcaatgcttgtatctcacatggaactgcatatacatgtgggcctgacctgcatccctggaatgtatgtatcctagaaaggggttgcagggttgytggagatgcagctccttaatttgactaaacactgctcatcttctcatcagaatggctgtactcatctgaacttcctttgtcagtactctaattgtcctgc

SEQ ID NO: 39280 - DNA, 201 bp, Homo sapiens
ctcttaccttcttcctttttatattcataagtctttattcattctctagctttgaccacttgcatattcaaactgacattttgtcgtgtttttctctactktctttatgcagcggaccatgtgtcaacttatgccgcgtttgtacagacgcatagaccaacaggggagtttatgtttgaatttgatgaagatgagatgttc

SEQ ID NO: 39281 - DNA, 201 bp, Homo sapiens
ctataatgatttgtaacagagtgaagtgaatgtagaatgtcagatgttaagaggaagaatggaaaagagggctgggactagggtgatgtaggggatgcacytggcttaggtgcaaaatttgggggataccaaaagaactcagtaataaatcatattttaatgaaatatcttgaaaaggcaaaattaatgcaaagatacatg

SEQ ID NO: 39282 - DNA, 201 bp, Homo sapiens
ctgaagacagaatgttccatatcagagctgtgatcttgagagccctctccttggctttcctgctgagtctccgaggagctggggccatcaagggtgagtgstcaggaggacgcaggagcgtcggggtgagtgatggggtggttcacatcaattgctgcttcagggatcacagattttaggggctcattgatctatctggtc

SEQ ID NO: 39283 - DNA, 201 bp, Homo sapiens
cttcttcttccccatatgtccttcctttgacctcttaccttcttcctttttatattcataagtctttattcattctctagctttgaccacttgcatattcraactgacattttgtcgtgtttttctctactgtctttatgcagcggaccatgtgtcaacttatgccgcgtttgtacagacgcatagaccaacaggggagtt

SEQ ID NO: 39284 - DNA, 201 bp, Homo sapiens
tccagtctccattacggatcaggttggtggacacgaccccagctgtttcctcctgtccattcaggaaccatcggacttgaatgctgcctgggtagaaatcygtcacgtggcagacaagcaggttgtggtgctgcaagggccccttcttggagggggaaacattcaccctaggctggactaggagcgtggaagaaaaataat

SEQ ID NO: 39285 - DNA, 201 bp, Homo sapiens
tgctcttcagaggtggggtctagagggtcatcagagactcactccactccacggtgacaggactatccaggctggtgtgctccacttggcaggtgtagacrtctccctgctggggggtcatttccagcatcaccaggatctggaaggtccagtctccattacggatcaggttggtggacacgaccccagctgtttcctcct

SEQ ID NO: 39286 - DNA, 201 bp, Homo sapiens
atgaagcatgtgggatggcctcacagtcagctggggtttgagggtgaaattcaatgactttcgtgaactccttggctcctatgtgctcttcacctggaggrccagggcatgtgcagggatgaccaccttctccctgggacctgaacagggcagagaaatgggaagctcgggtgcaaagggagtggggaagatgggtccggg

SEQ ID NO: 39287 - DNA, 201 bp, Homo sapiens
gagtcccctgctcttcagaggtggggtctagagggtcatcagagactcactccactccacggtgacaggactatccaggctggtgtgctccacttggcagrtgtagacatctccctgctggggggtcatttccagcatcaccaggatctggaaggtccagtctccattacggatcaggttggtggacacgaccccagctgt

SEQ ID NO: 39288 - DNA, 201 bp, Homo sapiens
gataagatgagtggaccccagagccagagagtcccctgctcttcagaggtggggtctagagggtcatcagagactcactccactccacggtgacaggactrtccaggctggtgtgctccacttggcaggtgtagacatctccctgctggggggtcatttccagcatcaccaggatctggaaggtccagtctccattacgga

SEQ ID NO: 39289 - DNA, 201 bp, Homo sapiens
cctgaacagggcagagaaatgggaagctcgggtgcaaagggagtggggaagatgggtccgggcttacagtactgaacccaggaatgacaataactgtgtgygttgctgcaggtgacaaaatatctgaacagaagaggacttaggagagatctgaactccagctgccctacaaactccatctcagcttttcttctcacttca

SEQ ID NO: 39290 - DNA, 201 bp, Homo sapiens
accaaattccattgcccatcactcaatggacgctccgcaggagcctgagtacttgggacctcatgcatctggctgcattaagatcccagcctgggatccchctctcgctataggtcatgtttgttccccgattatctgatatcagtggcctctagagctttctgacatttcttttctgtcaaacccctcatcgtggaataa

SEQ ID NO: 39291 - DNA, 201 bp, Homo sapiens
tcctccaggatgtccttctggctgttccagtactccgcagcaggccgccccagctccgtcaccgcccggaactcccccacgtcgctgtcgaagcgcgcgarctcctcccggttgtagatgtatctctccaggaagcgctgtgtcccattaaacgcgtagcattcctgccgtccctggaaaaggtaattctctgcggggagg

SEQ ID NO: 39292 - DNA, 201 bp, Homo sapiens
ccattgcccatcactcaatggacgctccgcaggagcctgagtacttgggacctcatgcatctggctgcattaagatcccagcctgggatccctctctcgcyataggtcatgtttgttccccgattatctgatatcagtggcctctagagctttctgacatttcttttctgtcaaacccctcatcgtggaataagtgtgaat

SEQ ID NO: 39293 - DNA, 201 bp, Homo sapiens
gaacataatggaaaacatttgccgtcagaagaaggtgtaacttatctttttacatctctttctctaactctgaaaatgaactgtgaactggagctctcttraccacgctggtacctaaaattctcccatctcttccccagcaccttccagcgtcctctttacccagcaacagagaatgtcagctctatgatttctctgata

SEQ ID NO: 39294 - DNA, 201 bp, Homo sapiens
gctccgcaggagcctgagtacttgggacctcatgcatctggctgcattaagatcccagcctgggatccctctctcgctataggtcatgtttgttccccgaytatctgatatcagtggcctctagagctttctgacatttcttttctgtcaaacccctcatcgtggaataagtgtgaatatgccaggggaaggtaagtcccg

SEQ ID NO: 39295 - DNA, 201 bp, Homo sapiens
ctttgaccacttgcatattcaaactgacattttgtcgtgtttttctctactgtctttatgcagcggaccatgtgtcaacttatgccgcgtttgtacagacscatagaccaacaggggagtttatgtttgaatttgatgaagatgagatgttctatgtggatctggacaagaaggagaccgtctggcatctggaggagtttg

SEQ ID NO: 39296 - DNA, 201 bp, Homo sapiens
caaaaaatgcccctccagagatcttacaggtttctatttatcataacactcaccatgctttatatttttatatgttttgggaattctcttagcattagacrgtgaacttccatgcagatgaccacatctaattcattattattattgttattcatgctggacctcaggtacaaaaggttaagaacttctcagttcattata

SEQ ID NO: 39297 - DNA, 201 bp, Homo sapiens
ttgtgaaggaaaagaccaagttcaaattctccagagtccattgccaaataatggagtcagatctatatttctatacataattacaacacagtgtggtgggwgcctgtaactacttactgtctctacttggactcattccatggcaatgttcacacaaaaaatgcccctccagagatcttacaggtttctatttatcataac

SEQ ID NO: 39298 - DNA, 201 bp, Homo sapiens
cctatctcttcattcttcccccagaggcccaagagccaatccagatgcctgagacaacggagactgtgctctgtgccctgggcctggtgctgggcctagtsggcatcatcgtgggcaccgtcctcatcataaagtctctgcgttctggccatgacccccgggcccaggggaccctgtgaaatactgtaaaggtgggaatgt

SEQ ID NO: 39299 - DNA, 201 bp, Homo sapiens
aaggttacacagcagatcaacgagccaagtttgaagtccagacccagctctgagggtcatacactgccttccccagattcctgcacacagtgacctactaycagggccctcctatctctctgggatccccagcctctatcttttgtggctgctttacaggaactccgagctatggactctgcattaggagacgaagtgcaa

SEQ ID NO: 39300 - DNA, 201 bp, Homo sapiens; identical to SEQ ID NO: 15514

SEQ ID NO: 39301 - DNA, 201 bp, Homo sapiens
tgtattttctttttgctgtttttctgcttttccatcctcttaattcacataattagctcatttgtttacagtcattttactctaacaaaattgtttaacartctgacattctatgcagcattttgaatgaacttatttcatctttctataaagactaaacatctattatgttttcagttatttcctcttcctccactattt

SEQ ID NO: 39302 - DNA, 201 bp, Homo sapiens
cattttctattgtttactcgatcatattgtccttgggacagtttctcagtttggctttttgtttattaattacacttcagttgcaaaagtcctatttcttrtctcatttattatgtttcttattccaatctttatcaaagctcaatatttgtgcttgattcagtggcttcttgcttttgcttcaaattcccaaattctcct

SEQ ID NO: 39303 - DNA, 201 bp, Homo sapiens
cttcttccccatatgtccttcctttgacctcttaccttcttcctttttatattcataagtctttattcattctctagctttgaccacttgcatattcaaaytgacattttgtcgtgtttttctctactgtctttatgcagcggaccatgtgtcaacttatgccgcgtttgtacagacgcatagaccaacaggggagtttat

SEQ ID NO: 39304 - DNA, 201 bp, Homo sapiens
tcaggaaccatcggacttgaatgctgcctgggtagaaatccgtcacgtggcagacaagcaggttgtggtgctgcaagggccccttcttggagggggaaacrttcaccctaggctggactaggagcgtggaagaaaaataatgaaatagaatttgagattgtccttctttccttccttccttccttccttccttccttcctt

SEQ ID NO: 39305 - DNA, 201 bp, Homo sapiens
gctggtcactgagggtgtcgctgagagcctcttcctgcccagaacagattacagcttccacaagttccattacctgacctttgtgccctcagcagaggacktctatgactgcagggtggagcactggggcttggaccagccgctcctcaagcactggggtatgcaactgcttttctctccataatctcctggcatcctcta

SEQ ID NO: 39306 - DNA, 201 bp, Homo sapiens
ttgcctcttcctctgtagcccaactggaagggatgagagggcctctctgccaccctcagactaggaagcctaagtgccccctgctgtgtgatcctcttccmctagtggccatgggctgatcccactacagcaagggcttgcatcctctcttctcaggagagagaaaggtgagcagagtgaggctggtcagtggtgtgatac

SEQ ID NO: 39307 - DNA, 201 bp, Homo sapiens
tgacccttcaagctctgtccttatccattacctcaaagcagtcattccttagtaaagtttccaacaaatagaaattaatgacactttggtagcactaatayggagattatcctttcattgagccttttatcctctgttctcctttgaagaacccctcactgtcaccttcccgagaataccctaagaccaataaatacttca

SEQ ID NO: 39308 - DNA, 201 bp, Homo sapiens
gtgagggtttcgagaccagtcagtgtccctagattctctgacaagggggagaactatgaatcttcaggaacccctaagccaaggtcaggaagtctccattkccctggcttcaaactatgctcaggagctggtatagaagaaagatggggtttggacatggccccagggtatagatgcagaagataagatgagtggacccca

SEQ ID NO: 39309 - DNA, 201 bp, Homo sapiens
ttgttctttgctcctttctttttataactgctcatctgctctgtattatttcctttatggtgttgctccttcttcttccccatatgtccttcctttgaccycttaccttcttcctttttatattcataagtctttattcattctctagctttgaccacttgcatattcaaactgacattttgtcgtgtttttctctactgt

SEQ ID NO: 39310 - DNA, 201 bp, Homo sapiens
cccggctgctcctgcgccctgggcacgggcccgcggggctgccctgggaccgccggcccaaagccctcactcacctcggcgctgcagggtcatgggcccghccagctcgtagttgtgtctgcacatcctgtccggcactgcccgcttctcctccaggatgtccttctggctgttccagtactccgcagcaggccgccccag

SEQ ID NO: 39311 - DNA, 201 bp, Homo sapiens
acatcctgtccggcactgcccgcttctcctccaggatgtccttctggctgttccagtactccgcagcaggccgccccagctccgtcaccgcccggaactcycccacgtcgctgtcgaagcgcgcgaactcctcccggttgtagatgtatctctccaggaagcgctgtgtcccattaaacgcgtagcattcctgccgtccct

SEQ ID NO: 39312 - DNA, 201 bp, Homo sapiens
gggaccgccggcccaaagccctcactcacctcggcgctgcagggtcatgggcccgcccagctcgtagttgtgtctgcacatcctgtccggcactgcccgcytctcctccaggatgtccttctggctgttccagtactccgcagcaggccgccccagctccgtcaccgcccggaactcccccacgtcgctgtcgaagcgcgc

SEQ ID NO: 39313 - DNA, 201 bp, Homo sapiens
caacccggctgctcctgcgccctgggcacgggcccgcggggctgccctgggaccgccggcccaaagccctcactcacctcggcgctgcagggtcatgggcycgcccagctcgtagttgtgtctgcacatcctgtccggcactgcccgcttctcctccaggatgtccttctggctgttccagtactccgcagcaggccgccc

SEQ ID NO: 39314 - DNA, 201 bp, Homo sapiens
tatgaaaggtctgaaaatataaagcctgtgatgcacttaagatgacggaggaaagacagtgatactcattttaaccagtcagataagtcatgatgtttggsgagattatgcgttttctttgctctgaaggtgatctcaaatattctgctggcccatctacagggattatcatttccccaattctgccacacctcacacacc

SEQ ID NO: 39315 - DNA, 201 bp, Homo sapiens
caacaccctcatctgccacattgacaagttcttcccaccagtgctcaacgtcacgtggctgtgcaacggggagctggtcactgagggtgtcgctgagagcytcttcctgcccagaacagattacagcttccacaagttccattacctgacctttgtgccctcagcagaggacttctatgactgcagggtggagcactgggg

SEQ ID NO: 39316 - DNA, 201 bp, Homo sapiens
tcccaaggagcctgtggagctgggccagcccaacaccctcatctgccacattgacaagttcttcccaccagtgctcaacgtcacgtggctgtgcaacgggragctggtcactgagggtgtcgctgagagcctcttcctgcccagaacagattacagcttccacaagttccattacctgacctttgtgccctcagcagagga

SEQ ID NO: 39317 - DNA, 201 bp, Homo sapiens
ccagtgctgctccagcctcctctctccccagcctcacccctctgcagttcccagggctgagccgtcctgctggttagttctcagcacccttctgtgactayaagttcaagttctcctccccttcctggacaatgaacccaaggtaatagataagaggttttagggcttgaggggctgtattcaggagattccaaccttgct

SEQ ID NO: 39318 - DNA, 201 bp, Homo sapiens
aggtaatagataagaggttttagggcttgaggggctgtattcaggagattccaaccttgctaccctgaaagatgaggaggtgacatgatgtcagtaccttytaggtgtgtcctaggaggggtgtggagaggtctaggaggaagggtgtaagcaggaaaagtggaagtcagtggaaaactaaggtacctactttgcagtcct

SEQ ID NO: 39319 - DNA, 201 bp, Homo sapiens
aataagataaaatattaacgtaatatatgtacttcatcattacattaaatagtaaatgttttgtgaccttctctatgagtatcaaataaatagctcaaaaytgaaatatttaaaatgagactagaaaagtatttcttaaatatggtaaagagaatataaaataaaaaattaacattacctgtaacagaaaaacattagaga

SEQ ID NO: 39320 - DNA, 201 bp, Homo sapiens
cagccacataacaacaacaacaccgataactaactgagtagttaatatggtcaggcgctattctgaggatttacatttattaactcactttattctcacamatagtctttgaggtaggtactattattttcactatttcacatgagagatacttacatctttttacatacacagagactttaagcactttgatcaagttcc

SEQ ID NO: 39321 - DNA, 201 bp, Homo sapiens
acctggtgctgtctccttccagatccccctgaggtgaccgtgtttcccaaggagcctgtggagctgggccagcccaacaccctcatctgccacattgacargttcttcccaccagtgctcaacgtcacgtggctgtgcaacggggagctggtcactgagggtgtcgctgagagcctcttcctgcccagaacagattacagc

SEQ ID NO: 39322 - DNA, 201 bp, Homo sapiens
ctgagtagttaatatggtcaggcgctattctgaggatttacatttattaactcactttattctcacacatagtctttgaggtaggtactattattttcacyatttcacatgagagatacttacatctttttacatacacagagactttaagcactttgatcaagttcccacagctatgaagtagtagggctagcttccaat

SEQ ID NO: 39323 - DNA, 201 bp, Homo sapiens
gtctggatccaagactgtttatccactgtcctattcaccctattttgtgaaggaaaagaccaagttcaaattctccagagtccattgccaaataatggagycagatctatatttctatacataattacaacacagtgtggtgggtgcctgtaactacttactgtctctacttggactcattccatggcaatgttcacacaa

SEQ ID NO: 39324 - DNA, 201 bp, Homo sapiens
gagcctgagtacttgggacctcatgcatctggctgcattaagatcccagcctgggatccctctctcgctataggtcatgtttgttccccgattatctgatwtcagtggcctctagagctttctgacatttcttttctgtcaaacccctcatcgtggaataagtgtgaatatgccaggggaaggtaagtcccgctcaccctg

SEQ ID NO: 39325 - DNA, 201 bp, Homo sapiens
agatcccagcctgggatccctctctcgctataggtcatgtttgttccccgattatctgatatcagtggcctctagagctttctgacatttcttttctgtcwaacccctcatcgtggaataagtgtgaatatgccaggggaaggtaagtcccgctcaccctgcaggctttctcacctttcttgctcctcctgtgcatgaaga

SEQ ID NO: 39326 - DNA, 201 bp, Homo sapiens
tgggctccccccatgaatccccaacccaaagtcccctttccgcccggcactaaggtcccttaggccaacccggctgctcctgcgccctgggcacgggcccrcggggctgccctgggaccgccggcccaaagccctcactcacctcggcgctgcagggtcatgggcccgcccagctcgtagttgtgtctgcacatcctgtcc

SEQ ID NO: 39327 - DNA, 201 bp, Homo sapiens
attttgaaaaaactgaagctcaaaaagatgaataagttttccaaggttacacagcagatcaacgagccaagtttgaagtccagacccagctctgagggtcrtacactgccttccccagattcctgcacacagtgacctactatcagggccctcctatctctctgggatccccagcctctatcttttgtggctgctttacag

SEQ ID NO: 39328 - DNA, 201 bp, Homo sapiens
aggtgaatcccagccatgctgattcctctccacccatttccagtgctagaggcccacagtttcagtctcatctgcctccactcggcctcagttcctcatcrctgttcctgtgctcacagtcatcaattatagaccccacaacatgcgccctgaagacagaatgttccatatcagagctgtgatcttgagagccctctcctt

SEQ ID NO: 39329 - DNA, 201 bp, Homo sapiens
atccccctgaggtgaccgtgtttcccaaggagcctgtggagctgggccagcccaacaccctcatctgccacattgacaagttcttcccaccagtgctcaaygtcacgtggctgtgcaacggggagctggtcactgagggtgtcgctgagagcctcttcctgcccagaacagattacagcttccacaagttccattacctga

SEQ ID NO: 39330 - DNA, 201 bp, Homo sapiens
ctgaggtgaccgtgtttcccaaggagcctgtggagctgggccagcccaacaccctcatctgccacattgacaagttcttcccaccagtgctcaacgtcacrtggctgtgcaacggggagctggtcactgagggtgtcgctgagagcctcttcctgcccagaacagattacagcttccacaagttccattacctgacctttg

SEQ ID NO: 39331 - DNA, 201 bp, Homo sapiens
tgtttcccaaggagcctgtggagctgggccagcccaacaccctcatctgccacattgacaagttcttcccaccagtgctcaacgtcacgtggctgtgcaayggggagctggtcactgagggtgtcgctgagagcctcttcctgcccagaacagattacagcttccacaagttccattacctgacctttgtgccctcagcag

SEQ ID NO: 39332 - DNA, 201 bp, Homo sapiens
ttcattgagccttttatcctctgttctcctttgaagaacccctcactgtcaccttcccgagaataccctaagaccaataaatacttcagtatttcagagcrgggagactctgagtcattcttactggaagtctaggaccaggtcacatgtgaatactatttcttgaaggtgtggtttcaacctctgttgccgatgtggtta

SEQ ID NO: 39333 - DNA, 201 bp, Homo sapiens
gccaacccggctgctcctgcgccctgggcacgggcccgcggggctgccctgggaccgccggcccaaagccctcactcacctcggcgctgcagggtcatggscccgcccagctcgtagttgtgtctgcacatcctgtccggcactgcccgcttctcctccaggatgtccttctggctgttccagtactccgcagcaggccgc

SEQ ID NO: 39334 - DNA, 201 bp, Homo sapiens
taggccaacccggctgctcctgcgccctgggcacgggcccgcggggctgccctgggaccgccggcccaaagccctcactcacctcggcgctgcagggtcaygggcccgcccagctcgtagttgtgtctgcacatcctgtccggcactgcccgcttctcctccaggatgtccttctggctgttccagtactccgcagcaggc

SEQ ID NO: 39335 - DNA, 201 bp, Homo sapiens
cccttttatctccagtccttactcccatatctaacctcttacccctacctcataggtaaacattttaatgaatttgatgtttccttttatttgcatagatsctctgtaatatgtagtagtgtccagtgtacatgtatttttaattaaccaaaatggcattaaattatagatctaattttgtacatccagtttgtttcttcc

SEQ ID NO: 39336 - DNA, 201 bp, Homo sapiens
cccaacccaaagtcccctttccgcccggcactaaggtcccttaggccaacccggctgctcctgcgccctgggcacgggcccgcggggctgccctgggaccsccggcccaaagccctcactcacctcggcgctgcagggtcatgggcccgcccagctcgtagttgtgtctgcacatcctgtccggcactgcccgcttctcct

SEQ ID NO: 39337 - DNA, 201 bp, Homo sapiens
ccttttcctttgaggctcagggcgggctggctaacattgctatattgaacaacaacttgaataccttgatccagcgttccaaccacactcaggccaccaayggtacgccctatctttgcctcttcctctgtagcccaactggaagggatgagagggcctctctgccaccctcagactaggaagcctaagtgccccctgctg

SEQ ID NO: 39338 - DNA, 201 bp, Homo sapiens
taatggagtcagatctatatttctatacataattacaacacagtgtggtgggtgcctgtaactacttactgtctctacttggactcattccatggcaatgytcacacaaaaaatgcccctccagagatcttacaggtttctatttatcataacactcaccatgctttatatttttatatgttttgggaattctcttagcat

SEQ ID NO: 39339 - DNA, 201 bp, Homo sapiens
tttatctccagtccttactcccatatctaacctcttacccctacctcataggtaaacattttaatgaatttgatgtttccttttatttgcatagatcctcygtaatatgtagtagtgtccagtgtacatgtatttttaattaaccaaaatggcattaaattatagatctaattttgtacatccagtttgtttcttccaaat

SEQ ID NO: 39340 - DNA, 201 bp, Homo sapiens
tgtggtgggtgcctgtaactacttactgtctctacttggactcattccatggcaatgttcacacaaaaaatgcccctccagagatcttacaggtttctatytatcataacactcaccatgctttatatttttatatgttttgggaattctcttagcattagacagtgaacttccatgcagatgaccacatctaattcatta

SEQ ID NO: 39341 - DNA, 201 bp, Homo sapiens
ttatctccagtccttactcccatatctaacctcttacccctacctcataggtaaacattttaatgaatttgatgtttccttttatttgcatagatcctctstaatatgtagtagtgtccagtgtacatgtatttttaattaaccaaaatggcattaaattatagatctaattttgtacatccagtttgtttcttccaaatc

SEQ ID NO: 39342 - DNA, 201 bp, Homo sapiens
gatgggtccgggcttacagtactgaacccaggaatgacaataactgtgtgtgttgctgcaggtgacaaaatatctgaacagaagaggacttaggagagatytgaactccagctgccctacaaactccatctcagcttttcttctcacttcatgtgaaaactactccagtggctgactgaattgctgacccttcaagctctg

SEQ ID NO: 39343 - DNA, 201 bp, Homo sapiens
ggaatgacaataactgtgtgtgttgctgcaggtgacaaaatatctgaacagaagaggacttaggagagatctgaactccagctgccctacaaactccatcwcagcttttcttctcacttcatgtgaaaactactccagtggctgactgaattgctgacccttcaagctctgtccttatccattacctcaaagcagtcattc

SEQ ID NO: 39344 - DNA, 201 bp, Homo sapiens; identical to SEQ ID NO: 14033

SEQ ID NO: 39345 - DNA, 201 bp, Homo sapiens; identical to SEQ ID NO: 14052

SEQ ID NO: 39346 - DNA, 201 bp, Homo sapiens
aagtctgtgtttgtgttgtcgtggagacaaggcctttgagccccacccttgtcctagaacctaccccctctcaaggatgcgctctttatttctaccctgtytctccccgccacccccgacttcccgtggaaattcccaactcggttctcatggaggagtgggtggagacaaggagggagtaagtcgtaggagtacaaggtt

SEQ ID NO: 39347 - DNA, 201 bp, Homo sapiens; identical to SEQ ID NO: 14037

SEQ ID NO: 39348 - DNA, 201 bp, Homo sapiens; identical to SEQ ID NO: 14042

SEQ ID NO: 39349 - DNA, 201 bp, Homo sapiens; identical to SEQ ID NO: 14040

SEQ ID NO: 39350 - DNA, 201 bp, Homo sapiens; identical to SEQ ID NO: 14044

SEQ ID NO: 39351 - DNA, 201 bp, Homo sapiens
catactccaacttccattcctcgtcctggccccagagctgagttctgtatcagcgctttatcctcacacactcttctacaatggcattcaataaagtgcadgtgttcctggttaaaaaaaaaaaaatgtactggtcagtggcttttagcataatcacaacatcgtgccacagtcgctattatctaattgggaagattttct

SEQ ID NO: 39352 - DNA, 201 bp, Homo sapiens
aaaagaaaaaatgtaaaatatgaggtagacatattttagactgtagagtaaatggatgtaccagggccaaaaggagcatgaattgccttaagggagaggargggggaagctaaggaaacaattcctgctgaagcaattgggttttgaaaaaggtgatcccagtagacaagggtcagggagaaagaatgctacctgaagagg

SEQ ID NO: 39353 - DNA, 201 bp, Homo sapiens
agacaagggtcagggagaaagaatgctacctgaagagggaataggacatgaaaagcccatgttgccaaataaaccctgagatctttacattttgaagaatracattttacccttgcatgaaatgaaaaaggtatacataaaaatgtatataagaagttctataaatgatgaaatctggttttcacagggataatgccctgg

SEQ ID NO: 39354 - DNA, 201 bp, Homo sapiens
gaaagaatgctacctgaagagggaataggacatgaaaagcccatgttgccaaataaaccctgagatctttacattttgaagaatgacattttacccttgcmtgaaatgaaaaaggtatacataaaaatgtatataagaagttctataaatgatgaaatctggttttcacagggataatgccctggtaatttctattatgta

SEQ ID NO: 39355 - DNA, 201 bp, Homo sapiens
gttgatcagaagtttcaatccatagtaattggctgtgctcttgaagatcagaagaaaattaagagaagattagagactctgcttagaaatattgaaaactstgacaaggccatcaagctattagagcattctaaaggagctggttccaaaactctgcaacaaaatgctgaaagcagattcaattagtcttcaaacctaaga

SEQ ID NO: 39356 - DNA, 201 bp, Homo sapiens
aaacttgatttgggttgaatgagagataaagaaaattaataggaagaacatcctgcatacaataaccgttttgttttcccaatttctatagggttgaagcyttgagagaagcagcaactgctgttgagcaagagaaagaaatccttctggaaatgatccacagtatccaaaatagccaggacatgaggcagatcagtgacg

SEQ ID NO: 39357 - DNA, 201 bp, Homo sapiens
agtttgcgcaaaattgctgttgtactcctcctaagtctcccagcagtttgccgtttcgatactgagactgcagaggtttgtgaggtgcccaagacctgggkactagctgaggatgcatgcgctccggttttgtcttcctactgagtactctgactaaaatttctttttgtcaaagcctacttagttgtgatttcatgcagg

SEQ ID NO: 39358 - DNA, 201 bp, Homo sapiens
atctggtatcccatatatgcagattgtcaggaagtggtattctacaacctctttctgtaatctaatacatttcatcagttaatcttacatgctatagtttyagcttttatctctaaaaaaatttcatggcagaggtaaagaaaataataaatttagtcacaaacaaatgccttaatgtttttgacacagataagtttacat

SEQ ID NO: 39359 - DNA, 201 bp, Homo sapiens
tgacgacagaagacagcttatcttctatcgtggctacattttctcaaccaaaatttggggcattgtattctgataaatgcacatgtcgttctggagagatstgggacatctgatctctggagctctacccagcataaaccctatatgtgcttactgctcacagtgttaagacttgatctccatcccagttacaaatgcata

SEQ ID NO: 39360 - DNA, 201 bp, Homo sapiens
agaagtcatctggtatcccatatatgcagattgtcaggaagtggtattctacaacctctttctgtaatctaatacatttcatcagttaatcttacatgctrtagtttcagcttttatctctaaaaaaatttcatggcagaggtaaagaaaataataaatttagtcacaaacaaatgccttaatgtttttgacacagataag

SEQ ID NO: 39361 - DNA, 201 bp, Homo sapiens
ctcaggggtcagggacccacttgaggaggcagtctgcccgttctcagatctccagctgcatgctgggagaaccactactctcttcaaagctgtcagacagkgacatttatgtctgcagaggttactgctgtctttttgtttgtctgtgccctgcccccagaggtggagcctacagaggcaggcaggcctccttgagctgtg

SEQ ID NO: 39362 - DNA, 201 bp, Homo sapiens
ctaatttatctttttttcttgtcacttgtgcttttggtattgagtctaagaagtctttgtctaatgtgaggtcataaagatttactcctacagttttttckgtaagagttttgtagttttagctcttacgtttatatctgtggttcattttgtgttaatttctatacacggtgtgaagtaagggtccaacttcattctttt

SEQ ID NO: 39363 - DNA, 201 bp, Homo sapiens
tcgaatgaaaatggccacatttaggtagggtaggagaacaggctttggaaggagcgggtattttattacagtgtgaataaaataaatatttagaacattayaagaatgatggctgacactgagagattcatgttaatgttataggtttctcaaggctgataggagctcttatattgtatttctaatgtagaggaatagaag

SEQ ID NO: 39364 - DNA, 201 bp, Homo sapiens
tcatccacctcagcctcccaaagttctgggtctacaggcgtgagccaccatgcctgatatatatatatgtgtgtgtgtgtgtgtgtgtgtgtgtgtgtgtrtacatacatatatatttatatcctcaaagaatgaaattaattacactaaatataattttcagtgttaaatattctctgtagtttaccatttacattatgg

SEQ ID NO: 39365 - DNA, 201 bp, Homo sapiens
agtaagtgatcaatgtcaggatctttacagagaacaataagatggatctaaaatgaatgaactgagtgttttctctttttttgcagttttggggggcatcraatgaaaatggccacatttaggtagggtaggagaacaggctttggaaggagcgggtattttattacagtgtgaataaaataaatatttagaacattataa

SEQ ID NO: 39366 - DNA, 201 bp, Homo sapiens
ttcatccacctcagcctcccaaagttctgggtctacaggcgtgagccaccatgcctgatatatatatatgtgtgtgtgtgtgtgtgtgtgtgtgtgtgtgygtacatacatatatatttatatcctcaaagaatgaaattaattacactaaatataattttcagtgttaaatattctctgtagtttaccatttacattatg

SEQ ID NO: 39367 - DNA, 201 bp, Homo sapiens
aattataacaaactatctctcagaccacagtgcaatcaaactagaactcaggattaagaatctcactcaaaaccactcaactacatggaaactgaacaacytgctcctgaatgactactgggtatataatgaaatgaaggcagaaataaagatgttctttgaaaccaacgagaacaaagacacaacataccagaatctctg

SEQ ID NO: 39368 - DNA, 201 bp, Homo sapiens
tttttttgataacactagcagtagcaagcaaagtatagataagaacaagtgacatattttgagtaagtgatcaatgtcaggatctttacagagaacaatargatggatctaaaatgaatgaactgagtgttttctctttttttgcagttttggggggcatcgaatgaaaatggccacatttaggtagggtaggagaacagg

SEQ ID NO: 39369 - DNA, 201 bp, Homo sapiens
attcatccacctcagcctcccaaagttctgggtctacaggcgtgagccaccatgcctgatatatatatatgtgtgtgtgtgtgtgtgtgtgtgtgtgtgtrtgtacatacatatatatttatatcctcaaagaatgaaattaattacactaaatataattttcagtgttaaatattctctgtagtttaccatttacattat

SEQ ID NO: 39370 - DNA, 201 bp, Homo sapiens
gaacaggcaacctacaaaatgggagaaaattttcgcaacctactcatctgacaaagggctaatatccagaatctacaatgaactcaaacaaatttatgagraaaaaaaaacaaccccatcaaaaagtgggcaaaggacatgaacagacacttctcaaaagaagacatttatgcagccaaaaaacacatgaaaaaatgctca

SEQ ID NO: 39371 - DNA, 201 bp, Homo sapiens
  misc_feature (1)...(201): n = A,T,C or G, or insertion/deletion polymorphism (see Tables 1-2)
gaggtagtaaagttagttgcttttataaaaattgtttttccctcacatgttaattttggtcacataatttagttatggctgtctttttttaaaattaatangcttatcaagtgagactctggaattgcttactatcccaagataataattgagaaattacttaccagttttggttctagagtttttcttctgtaaaaaagc

SEQ ID NO: 39372 - DNA, 201 bp, Homo sapiens
tttttttttggaaaacacttgccagttggagcctcaaagaagattgagtttgagaggcctttaattgtgcaccaaaaggttattgcagaagataacataayggagatgtcataaagaagaaaatttgaagctcagtaagagaaagctgtgtgaaaaaataggcattctgccaattaactgggtgcttgaaataaatagttt

SEQ ID NO: 39373 - DNA, 201 bp, Homo sapiens
  misc_feature (1)...(201): n = A,T,C or G, or insertion/deletion polymorphism (see Tables 1-2)
atggttatagacatcgagtttcagagccacgttgatgagtccagattctggtcctcaaatttgtaagtttaaaaattaaaattttagggactgggcgtggnggctcacgcctgtaatcccagcactttgggaggccgaagcaggcggatcatgaggtcaggagttcgagaccagcctgaccaatgtggtgaaaccccatct

SEQ ID NO: 39374 - DNA, 201 bp, Homo sapiens
  misc_feature (1)...(201): n = A,T,C or G, or insertion/deletion polymorphism (see Tables 1-2)
cttcttgagtttgagctgaaaatagcaatcagtgtatcctaaatacctcaaaacaactgtactatgatttggaaagactatataaaatgtaatgaaagatnctattaacaattaaataatatggaaaatgaaattccaataattagttgagtggagaagacaactctgaggagcccagattacttagaagggacagaaatg

SEQ ID NO: 39375 - DNA, 201 bp, Homo sapiens
tgagctctatgggccagttaaatcgaagatatttttgtttggtagttggtttcttttaagttaatagtgccacccagaggtagtaaagttagttgcttttwtaaaaattgtttttccctcacatgttaattttggtcacataatttagttatggctgtctttttttaaaattaataggcttatcaagtgagactctggaat

SEQ ID NO: 39376 - DNA, 201 bp, Homo sapiens
  misc_feature (1)...(201): n = A,T,C or G, or insertion/deletion polymorphism (see Tables 1-2)
caagatttggatttggaccgtgcctgttccagttttagtactggaagtcccacatccttagaaacctctcattcctggacaaactgggatggttggtcacnataatgaggtgccagaaggatatgatgaacttgaggcattgaaacgtggagagcaataatctgtaagtggggagcagctggctagggtggaggaaaaagg

SEQ ID NO: 39377 - DNA, 201 bp, Homo sapiens
  misc_feature (1)...(201): n = A,T,C or G, or insertion/deletion polymorphism (see Tables 1-2)
tcaatatagggaatatttgttagtgtccccagacgaagttacattggttcaattttcggcgtgtgggagttttcgccactagcattcagcaccccagtttnaaccgttaaagctaccgactccacatacaggaaatgcatcttaaaatttggaaaaaaaatccccaaaacactgacatccaaacactttaaagctgccaag

SEQ ID NO: 39378 - DNA, 201 bp, Homo sapiens
tcaggaggctgaggcaggagaatcacttgaactgaggcggaggttgcagtgagctgagatcgcgccactgcactccagcctgggtgacagagtaagactcygtcaaaaaaaataaaaataaaattaaaattttaccaagggatggttaggtaccaggaaaccaaccatctttcaagagccttatatacataaatcagaatg

SEQ ID NO: 39379 - DNA, 201 bp, Homo sapiens
accaagacctgtgttagtttaatgaaatgacaagtttatagaaactgcattagttgcagtaaacatttcactttattacttgaggaaaaagcctgaaataragaaactaatcaaaatgtaaattacaggtagtaacaacaagtgtttaccatgtactaagggtgtgctgtatgttaggcctattgtacacactttacatac

SEQ ID NO: 39380 - DNA, 201 bp, Homo sapiens
  misc_feature (1)...(201): n = A,T,C or G, or insertion/deletion polymorphism (see Tables 1-2)
ctgcaaaaaaatggtaatatttataagaaacaattaatgaaacccacacttgaatttgatacaggtttttggaatttgagctctatgggccagttaaatcnaagatatttttgtttggtagttggtttcttttaagttaatagtgccacccagaggtagtaaagttagttgcttttataaaaattgtttttccctcacatg

SEQ ID NO: 39381 - DNA, 201 bp, Homo sapiens
tttctcaaggctgataggagctcttatattgtatttctaatgtagaggaatagaaggaaagctatggatggggtgcagaagaatggccctttggcagtgtkggtagtgctgcttcctgtcacactctagtgttacagcacttataaactggatgtgccttctgaggatactatcctttctgagtgcatcgtggcctcttcc

SEQ ID NO: 39382 - DNA, 201 bp, Homo sapiens
aggagggggagattgcagtgagctgagatcgcgccactgcgctccagcctgggcaacaagagcaaaactccatttcaaaaaaaaaaaaatgaaaaaaatgyttaaatgtaggactggattaatgaaattcaaagacacttgtgcttcatgcaaacatagtgtcactttagcatctgtgataggcaagataatgccccaatc

SEQ ID NO: 39383 - DNA, 201 bp, Homo sapiens
agaaatgttttgggactgggtgtggtggctcatgcctgtaattctagtgctttgagggactagagtaggagtcttgaaaccaggagttcataaccagcctrggcaacatattgagactccatcatacagaagataaaaaattagcggggcatggtgggtgtcgcttgtagtcccagctgcttgggaggttgaggctggagg

SEQ ID NO: 39384 - DNA, 201 bp, Homo sapiens
gcaagaaacaaagtgaacaagatacagcatcaaaattctcttttaagtttcccaaggctgctcttatttctctctacaaaatagaaataataattttgccytttttttgataacactagcagtagcaagcaaagtatagataagaacaagtgacatattttgagtaagtgatcaatgtcaggatctttacagagaacaata

SEQ ID NO: 39385 - DNA, 201 bp, Homo sapiens
  misc_feature (1)...(201): n = A,T,C or G, or insertion/deletion polymorphism (see Tables 1-2)
gaaaaaaaagagcccctaatagtgagctaggtgcaaaaaagatcctaatgccttttttcctcattcctccccagattgaaagtgatgagtgccagccctgngggttaaagcgccatattttcctcaatatagggaatatttgttagtgtccccagacgaagttacattggttcaattttcggcgtgtgggagttttcgcca

SEQ ID NO: 39386 - DNA, 201 bp, Homo sapiens
taaataccagtaatgggatggctgggtcaaaaggtatttctagttctagatccttgaggaatcgccacactatcttccacaatggttgaactagtttacastcccaccaacagtgtaaaagtgttcctatttctccacatcctctccagcacctgttgtttcctgactttttaatgattgccattctaactggtgtgagat

SEQ ID NO: 39387 - DNA, 201 bp, Homo sapiens
aggggcttttccctattttgctcagcacttctccttactgccaccatgtgaagaaggacgtgtttgtttccccttctgccatgattgtaagtttcctgagrtctccccagccctggggaactgtgagtcagttaaacctctttccttttatgggtttactcagtcttgggtatgtctttattagcagcatgagaatggact

SEQ ID NO: 39388 - DNA, 201 bp, Homo sapiens
cttagccccttagagtttgccaaaatttaaagcagaccaagtttaatgagtgtacttcatagtatagattgtggacagtcctttttgcttgctaaattcartttagctcagatggtgaataccaatatgttcagagtactgtgtaggtgctatgggggatttaaaaacaccttcttaagtagaaagaggtataaataaatg

SEQ ID NO: 39389 - DNA, 201 bp, Homo sapiens
taatgggatggctgggtcaaaaggtatttctagttctagatccttgaggaatcgccacactatcttccacaatggttgaactagtttacactcccaccaasagtgtaaaagtgttcctatttctccacatcctctccagcacctgttgtttcctgactttttaatgattgccattctaactggtgtgagatagtatctcat

SEQ ID NO: 39390 - DNA, 201 bp, Homo sapiens
aaatctcatcttgaattgtagttcccataatccccatgtgtcatgggagggacccggtgggaggtaattgaatcatgggggtggttacccccatgctgctrttctagatagtgagttctcacaagatctgatggttttataaggggcttttccctattttgctcagcacttctccttactgccaccatgtgaagaaggacg

SEQ ID NO: 39391 - DNA, 201 bp, Homo sapiens
  misc_feature (1)...(201): n = A,T,C or G, or insertion/deletion polymorphism (see Tables 1-2)
aaattcttccaaagacagctttattatgtttaggacagtggaaagtaatgtaataaggtataaggtatgagataatgaggttgatgtttttatgtggtgcncttagccccttagagtttgccaaaatttaaagcagaccaagtttaatgagtgtacttcatagtatagattgtggacagtcctttttgcttgctaaattca

SEQ ID NO: 39392 - DNA, 201 bp, Homo sapiens
tgggttgtcatagttcgtttcgaatgtgtattcattatcatgacctactccatttctattatgtaaaatatgaacatcccatgcattgatatacatgactytctttatacctaccctcttgggtctcaagttattataagcctattaacaagttgcaaagcaatttttgtgtgatgcctgcaaaatagagagctgtgtgta

SEQ ID NO: 39393 - DNA, 201 bp, Homo sapiens
acaatggttgaactagtttacactcccaccaacagtgtaaaagtgttcctatttctccacatcctctccagcacctgttgtttcctgactttttaatgatygccattctaactggtgtgagatagtatctcattgtggttttgatttgcatttctctgatggccagtgatgatgagcattttctcatgtgtctgttggctg

SEQ ID NO: 39394 - DNA, 201 bp, Homo sapiens
cagtttctatagtttctttcatttacttcatgaggtttctaagtcacatctacctttgcatagacagatgtcatgcatggtaccatctgaaccaaacccartgcatcttccactttgcttttaactttgatccttggtgaagtccattattgcaattatcaattacagttaatttatccattcctattagaaatagtttat

SEQ ID NO: 39395 - DNA, 201 bp, Homo sapiens
ggaactctgggtttctcccctttttagactatatagggtaatttttggatgttgccatggcatttgtaaactgtactggtgctggtgggagtatcttttarcatgctaatggattataattagcatatagtgagcagtaaggatgaccagaggtcacttttgtggccatcttggttttggtgggttttggctggcttcttt

SEQ ID NO: 39396 - DNA, 201 bp, Homo sapiens
tcctgactttttaatgattgccattctaactggtgtgagatagtatctcattgtggttttgatttgcatttctctgatggccagtgatgatgagcattttytcatgtgtctgttggctgcataaatgtcttcttttgagaagtgtctgttcatatcctttgcccacttcttgatgtggttctttgtttttttcttgtaaat

SEQ ID NO: 39397 - DNA, 201 bp, Homo sapiens
cgtgaagtccttgaccatgcctatgtcctgaatggtattgcctaggttttcttctagggtttttatggttttaggtctaacatgtaagtctttaatccacyttgaattaatttttgtataaggtgtaaggaagggatccagtttcagctttctacatatggctagccagttttcccagcaccatttattaaatagggaatc

SEQ ID NO: 39398 - DNA, 201 bp, Homo sapiens
catattattgtcaagctccttagtatgaccttgcctttgtcgtgctgtctagtcacacgtctctctatatcccacaatgtattccctgtttttcttttttmtttttttattttttttttattttgagacaaggtctcactctgtcgtccaggctggagtacagtggcatgatctcagcccactgcaacttctgcctcctga

SEQ ID NO: 39399 - DNA, 201 bp, Homo sapiens
catgttggccagactggtctcgaactcctgacctcaggtgatcagcctgacttggcctcccaaagtgctaggattacaggtgtgagccaccatggctggcrtgttcctcttattctgctacattgaatttgttatagttcccaatacgtatcatgctatttaatgtctctgtacctttgaaaatgctgttttctttcctgg

SEQ ID NO: 39400 - DNA, 201 bp, Homo sapiens
tgtgaaactagtgttgactggatcatccatatgggtgtagcagtccatttggacagtggcaagaaagtggatgttgtgatgtcgacaagatttggatttgkaccgtgcctgttccagttttagtactggaagtcccacatccttagaaacctctcattcctggacaaactgggatggttggtcaccataatgaggtgccag

SEQ ID NO: 39401 - DNA, 201 bp, Homo sapiens
tagaagccaaggagggctagagtttcaataataatgatcatgatattaataatgataatagggaataacagcagatatttatattaatagtatgtttgctwtgtaccagattttgttctaagtgcattacatatattaacccatgtatgtaattcatacagcagtcttatgaggtgggtattattatcatccctattttac

SEQ ID NO: 39402 - DNA, 201 bp, Homo sapiens
tacaggaagacatgtggtgggagtagatttagcagaaggttggaatcatcaggagtaggtaagagcaccctagaaaaatatttgagtgagaagagatgacrgtggaagttaagacatgaggaataccaatattgaaggtaaagtggaattggaggaatttgggaaggagaatggaaaggagctttctcagaagtaggagat

SEQ ID NO: 39403 - DNA, 201 bp, Homo sapiens
ggagtctcactctgtcgcccaggctggagtccaatggcatgatctcagctcactgcaacctcctccgcctcctgggttcaaatgattctcctgccccagcstcccgagtagctgggattacagtcgcccaccaccatgcctggctaatttttgtatttttggtagagacggggtttcactatattggtcaggctggtcttg

SEQ ID NO: 39404 - DNA, 201 bp, Homo sapiens
  misc_feature (1)...(201): n = A,T,C or G, or insertion/deletion polymorphism (see Tables 1-2)
atgctaatgatatgatattggggtgtaagaaggatgtggccaccgtcctgggggcctacttaatcctcagtgtgttgctagagaaaagaatgggctagacntgaattgaaacagaaacactagcgttgtcttcagagtttatgttccaggatatccctgtggggaaatcagaaggaaaggtgagatactgttaatcattct

SEQ ID NO: 39405 - DNA, 201 bp, Homo sapiens
tgactgacttagtcttattaaatgagcttcttagagaagttgaaatgtgatctggacatactgaagaatgagtagaaattttccagcagagaagaagtgargagtttttccaagctgagataatggcctatgcaaaggcttggagcatgaaagagaatttcatatttgagctaacagtaacaagttcaggaattcagggtg

SEQ ID NO: 39406 - DNA, 201 bp, Homo sapiens
cagggattttgagatgaataatgttattttttgttgaagttttattctagtacatggagacagacatccaaaataatagtcataattcagtattttaactrctctagtagaagtaaatggtagtgctgttgaaacaaagaagtgggagtgactgacttagtcttattaaatgagcttcttagagaagttgaaatgtgatct

SEQ ID NO: 39407 - DNA, 201 bp, Homo sapiens
  misc_feature (1)...(201): n = A,T,C or G, or insertion/deletion polymorphism (see Tables 1-2)
ttaaagctaccgactccacatacaggaaatgcatcttaaaatttggaaaaaaaatccccaaaacactgacatccaaacactttaaagctgccaaggtgganggaacaccttgaattcccagacgcgctccactgagcatgcccagagcctcaggccaaaccccctcctacccgccaaggggaggtggggcagggctggcct

SEQ ID NO: 39408 - DNA, 201 bp, Homo sapiens
taaaaacgtgaacatttcaaagcattcatttgatctcctaaggactacctataccggagcctcattccagcacatttgtaagcgaggcacgcctcctagargccacgagtgaagttaatttccagttctcgaaaatcttacagacagcggagaactggtgtggtggctctgacgccccgcttgtgagtctgcagtcggaca

SEQ ID NO: 39409 - DNA, 201 bp, Homo sapiens
aaaaatacaaaaattagccaggcgcctgtaatcccagctatttgggaggctgaggcaggagaatcgcttgaatcccggaggcggaggttgcagtgagccargatcgctccactgcactccagcctgggcgacagaacaagactctgtctcgggtattggtggtgggtcggggggaataacctatcttatgtggttatgata

SEQ ID NO: 39410 - DNA, 201 bp, Homo sapiens
  misc_feature (1)...(201): n = A,T,C or G, or insertion/deletion polymorphism (see Tables 1-2)
atctagaaaatacgtttaatataataacctttgggaggccgaggtgggcggatcacgaggtcaggagttcgagaccagcttgccaacatggtgaaaccccntctttactaaaaatacaaaaattagccaggcgcctgtaatcccagctatttgggaggctgaggcaggagaatcgcttgaatcccggaggcggaggttgca

SEQ ID NO: 39411 - DNA, 201 bp, Homo sapiens
gcatgtaagagggagccctaatttatgttggagaaccaagggaaggcctttctgatacagtgatttttaagctgttatctgaaagataaatgagtttggtraagaatagacagaaaaagcctttaagcagagacagcaggaagtacgatggcctgaggcagcaaacaattcactgggtttgaataattgaaagggagccag

SEQ ID NO: 39412 - DNA, 201 bp, Homo sapiens
gagatccactggacagttttaaaaaattcctctgactgctatctagggaaaacatagagtagtggaaaatgggagagcaatggaaggccggttcaggcaaragatgatggagggttagactgagatggttacaggggtgatacagaaaagtgcatttgtttttaatcttggaagtagaacctataggatttggctatggtg

SEQ ID NO: 39413 - DNA, 201 bp, Homo sapiens
aaaaaataaaaaaagcagattctcctcttcatgataggaagttgatagatgtgtaaaactgaaaactttttcaggaaactgctgaaggaatggcaagcagaaaaaaaaaaaactttaaaaaatagcagtattagcaaggatagaaatggctgtaaataccaaaagaaaccgaaaaaagtgttgaaagtctttggaaacaag

SEQ ID NO: 39414 - DNA, 201 bp, Homo sapiens
agaacaggagagatgtttttaacacctagcacagctgcaaactaggtggtctggaatttgcaagtacatctttcagttttatttcatcttgaagctttcargtgggtttaacagttattcaatgtaattgaagttaatgtagctaaaattgcatattatttttgaagtgttaagaatgaaaataatttatggtctttaaga

SEQ ID NO: 39415 - DNA, 201 bp, Homo sapiens
aggcgcccgccaccacgcctggctaattttttgtatttttagtagagatggggtttcaccatgttagccaggatggtctcgatctcctgacctcgtgatcygccctccttggcctcccaaagtgctgagattacaggcgtcagccactgtgcccggccagaaccatttaattttttaaactatgaatatgtaaatagataa

SEQ ID NO: 39416 - DNA, 201 bp, Homo sapiens
tacaattttgttggctgggcgcggtggcttacacctgtaatcctagcactttgggaggccagggcaggtggatcacctgaagtcgggagttcgagaccagyctgaacaacatggattaaaccccgtgtccactaaaaatacaaaattagctgggcgtggtggcgcatgcctgtaatcccagctactccggaggctgaggca

SEQ ID NO: 39417 - DNA, 201 bp, Homo sapiens
ggggggtctgaagaaactccccaaacctccatgatttagcaggagacaagataagggtaatcacccagcacctggacccattaggattaagtaaatttacsgaggctccagaggaaggtcttcaggattcagatcttagttatagattagaagaagttaatcacttatgtcttcagatgaatgcacactaacacacagaca

SEQ ID NO: 39418 - DNA, 201 bp, Homo sapiens
  misc_feature (1)...(201): n = A,T,C or G, or insertion/deletion polymorphism (see Tables 1-2)
ggaaaactttgtaactttgagttggcctggcgatattttccaggccttttccctgtacccagttacagaaataaactgtcttctttcccagttcgtctgcntctcattattgggctgcgagaataggcagcctgaccctcagcttggtccggaaacagtttggtcacctcaattcctttatttaattcaccttttgatctc

SEQ ID NO: 39419 - DNA, 201 bp, Homo sapiens
cagtgtgaaatgccctaagggggcttaaatgctgagtaaacaaatttttaaaagcaatttagacacgcacacacacacacatacacacacacacacacacrcacacattagatgtacaagcatagaaaagtcttggaaggataaatactgtcttgctttatccatcagcatactgattacagttgtgatgaggtaagtacc

SEQ ID NO: 39420 - DNA, 201 bp, Homo sapiens
aaattctgtgcttttcctccattggattgcgttatcttttctaacaaaagtagacttttgctccttctccaagttttctttctctctttctctttctcttmcacacacacacacacacacacacacacacatgccatgcaggcacacacacacagtttttcctttctctttctctcactttcacacacacacacacacaca

SEQ ID NO: 39421 - DNA, 201 bp, Homo sapiens
gggaaaatgtgtgagggtaggggtgatgcgttgcttgtgaattgtgctgtgatcgtgggagtgggctgcagaagtggagggtgagtgggtcagaggatgcygacgactgtgaaactagtgttgactggatcatccatatgggtgtagcagtccatttggacagtggcaagaaagtggatgttgtgatgtcgacaagatttg

SEQ ID NO: 39422 - DNA, 201 bp, Homo sapiens
aattctgtgcttttcctccattggattgcgttatcttttctaacaaaagtagacttttgctccttctccaagttttctttctctctttctctttctcttacacacacacacacacacacacacacacacatgccatgcaggcacacacacacagtttttcctttctctttctctcactttcacacacacacacacacacac

SEQ ID NO: 39423 - DNA, 201 bp, Homo sapiens
acacacacacacacacacacatgccatgcaggcacacacacacagtttttcctttctctttctctcactttcacacacacacacacacacacacacacacatacactcttacatcttagtccaaagtaaaaatatcctgcttatcagatgctctgccttattttcaaggcttatgcttattttgagtgtagccatggtgaa

SEQ ID NO: 39424 - DNA, 201 bp, Homo sapiens
cacacacacacacacacacatgccatgcaggcacacacacacagtttttcctttctctttctctcactttcacacacacacacacacacacacacacacatacactcttacatcttagtccaaagtaaaaatatcctgcttatcagatgctctgccttattttcaaggcttatgcttattttgagtgtagccatggtgaac

SEQ ID NO: 39425 - DNA, 201 bp, Homo sapiens
aggacactgaaaaatgtagatgaaaatctttgaaagaagtattttttatcttaaaagaaaaaagaaaatattatgaaacagaataaaatatctgtaggcattttttttttttttttgtgagatggagtcttgctcttgttgcccaggctggagtgcaatggcgcaatctcggctcaccgcaacctccacctgctggattca

SEQ ID NO: 39426 - DNA, 201 bp, Homo sapiens
ctttgtgaagcatactacaccttgattataagatgttgcagtgataacctagctggcttttatcagttattttgaattcccctatacaccaagacctgtgrtagtttaatgaaatgacaagtttatagaaactgcattagttgcagtaaacatttcactttattacttgaggaaaaagcctgaaatacagaaactaatcaa

SEQ ID NO: 39427 - DNA, 201 bp, Homo sapiens
gaaatacagaaactaatcaaaatgtaaattacaggtagtaacaacaagtgtttaccatgtactaagggtgtgctgtatgttaggcctattgtacacacttracatactttatttaatcccaagaaaagctacatgagataggtatgattttcttcattttatccctgaagaaactaaggtgtaaagaggttaactaacctg

SEQ ID NO: 39428 - DNA, 201 bp, Homo sapiens
cctggcctgcattgctttaattcttttgaacataattattttagtccctttgctattgttccattatttccaattcttttttgttgcactcgatgactctccctcatcatgcctcctttggtggtttttaatttaggaatgtgaagtcatcttcatgagggctgccttttctatgggacttctatatgcttagcccctgta

SEQ ID NO: 39429 - DNA, 201 bp, Homo sapiens
tggtcaagtctttatatcttttttctttgtaatttataatatttaaatttgtttgctatccagagataagatattcatgtaaatattcttatggtctgtgrtgcaggttttttcaggcagtttatatgctttcaggtgtcttctttggaccacgtgatgtatttgtattacgtatttgtattatgtatttaatacagagag

SEQ ID NO: 39430 - DNA, 201 bp, Homo sapiens
ggcctgcattgctttaattcttttgaacataattattttagtccctttgctattgttccattatttccaattcttttttgttgcactcgatgactctccctcatcatgcctcctttggtggtttttaatttaggaatgtgaagtcatcttcatgagggctgccttttctatgggacttctatatgcttagcccctgtacaa

SEQ ID NO: 39431 - DNA, 201 bp, Homo sapiens
ggaccatcaagaccataaagaccgtctatatatttgttttaaattcttaaaattttgcctttcatatacaagttcttaaatcatctggaattgattttttwtatagtaggaggtagggaatacatttttcctccctatagacagccaattgtcccagcaccatttagaattgtctatttttttcttccattgatttgtacg

SEQ ID NO: 39432 - DNA, 201 bp, Homo sapiens
tctctttcatctagaccaggacatctcttcaatcacttgggagcattcaaccttctgttttggtcctcaggtggggcactttcttggcctgtcaggaccaytggggattcccctttctttgttttgacataggctattgtattttttgttgttgttacagtttatcttagtgtatatgtttatctacgcttatcaaggctg

SEQ ID NO: 39433 - DNA, 201 bp, Homo sapiens
gaaatttgattggtgaatctgcttaaaagttagctgagaagtttgtggctttttcattttgaagaagagatttgccaggagtctgagaatcctttaaattrttccaaagacagctttattatgtttaggacagtggaaagtaatgtaataaggtataaggtatgagataatgaggttgatgtttttatgtggtgctcttag

SEQ ID NO: 39434 - DNA, 201 bp, Homo sapiens
ttgccagcagcaccctttctgaatacctgaccatcagaattgagagctgtaatacaatggctgttattttaaactgttaagttttgggatagtttgttatycagtgatagataattagaactggtagctagagcttctggcttcttgagtttgagctgaaaatagcaatcagtgtatcctaaatacctcaaaacaactgta

SEQ ID NO: 39435 - DNA, 201 bp, Homo sapiens
cgcctgtcttgaaatgggctctaagtctcctgaaagcaaaggaccctgaatatggtgtttattacctaacacaatgtctagcctataggaggtacttaatytatgttggttgaacaaaggagtaaataaatgaagtagctacctacagttgttccccagaagatacattacttaagcaccctagaaactgtttggcctttt

SEQ ID NO: 39436 - DNA, 201 bp, Homo sapiens
tggcacaatctcggctcactgcaagctctgcttcctgggttcacgccattctcctgcctcagcctcctgagtagctgggactataggcacccgccaccacrcctggctaattttttgtatttttagtagagatggggtttcaccgtggtctcgatctgacctcatgatccgcccacctcggcctcccaaagtgctgggatt

SEQ ID NO: 39437 - DNA, 201 bp, Homo sapiens
gggttcgctcccttcccagatctatgcacaggagtgtcaggggacctaacaagtatatttgctgtggaggaaacttccccactgagccatcagcagtccgygtcctgaaacctcagcctctattacaatattagatctgtcttgggtctaatagggagagaaaagagagggccaaaggtccccacctgtgcatcttctttc

SEQ ID NO: 39438 - DNA, 201 bp, Homo sapiens
cccatcggtgtgctgtattcaggagacccgtctcacatgcaaacacacacataggctccaaataaagggatggaggaagatctaccaagcaaatagaaagaaaaaaaaaaaaaaagcaggggttgcaatcttagtctctgataaaacagacttctattaaatccactgcagtctctgataaaacagacttagtctctgata

SEQ ID NO: 39439 - DNA, 201 bp, Homo sapiens
agttacttaaatctctcagcgcctcagtttcctcacttgtaaaatggagataatagtagtacttcctggagttattagaggaatttaatgagttaccataygtaaaagcacttagaagagtgtaagccctcaaaagagttagtagaagtactagtagtatttgaaagttactagttatatgggaatggaagggacagaaat

SEQ ID NO: 39440 - DNA, 201 bp, Homo sapiens
  misc_feature (1)...(201): n = A,T,C or G, or insertion/deletion polymorphism (see Tables 1-2)
aataaaaaagattggattaactctacatgcagacagaaaattcccacagtgaaggtcattaatcagagtttgtagaaaaacagctgctcctgccattccantggagaaagcacaaaacaacataattgcttcataactgtactctggggaagactgaccttggttctaagagttgcttgtgtggcctggttctgtgtgtgg

SEQ ID NO: 39441 - DNA, 201 bp, Homo sapiens
ccctgcccccagaggtggagcctacagaggcaggcaggcctccttgagctgtggtgggctccacccagttcgagcttccctgccgctttgtttacctaatmaagtctcggcaatggcgggtgcccctcccccagcctccctgcggccttgcagtttgatctcagactgctgtgctagcaatgagcaagactccgtgggcat

SEQ ID NO: 39442 - DNA, 201 bp, Homo sapiens
gttttatctagactatgtactattttaaaaattaaactagcttttataattctaaaagttacaacttgcactggtaaaacttcaacctctacacaaaatgygtaaaatgatcactaaatgtctaccctctccgtatgcacttacctgatgcctgttccactcctaggggtaacatcttgttaacaatgtctttcctccttc

SEQ ID NO: 39443 - DNA, 201 bp, Homo sapiens
  misc_feature (1)...(201): n = A,T,C or G, or insertion/deletion polymorphism (see Tables 1-2)
ggaatatggaaatataactttgccaaaacagttaaaacccagtgtaatttttacttgataaaaaactataccgttataccatgtgctaccatttgaaacantcaggtactgactgttgagtgggtggatatgaataatagggattgagatgtggggaattatgagtagtagtggcaagagcagaacttcaaagctagaatg

SEQ ID NO: 39444 - DNA, 201 bp, Homo sapiens
ttactttgggtgaaaagtttagaaacacattgaattccttagaattctatctatagctttttttttttttttttttgagatggagtctcaccctgccaccygcgctggagtgcagtggtgcgatctcagctcactgcaacctttgcctgcctcctaggttcaagctattttcctgcctcagcctcctgagtagctgggatt

SEQ ID NO: 39445 - DNA, 201 bp, Homo sapiens
ttttgagatggagtctcaccctgccacctgcgctggagtgcagtggtgcgatctcagctcactgcaacctttgcctgcctcctaggttcaagctattttcmtgcctcagcctcctgagtagctgggattacagcgtgggccaccatgcccggctaatttttgtatttttagtaaagatggggtttcaccatgttggccagg

SEQ ID NO: 39446 - DNA, 201 bp, Homo sapiens
ggacactgaaaaatgtagatgaaaatctttgaaagaagtattttttatcttaaaagaaaaaagaaaatattatgaaacagaataaaatatctgtaggcattttttttttttttttgtgagatggagtcttgctcttgttgcccaggctggagtgcaatggcgcaatctcggctcaccgcaacctccacctgctggattcaa

SEQ ID NO: 39447 - DNA, 201 bp, Homo sapiens
gacactgaaaaatgtagatgaaaatctttgaaagaagtattttttatcttaaaagaaaaaagaaaatattatgaaacagaataaaatatctgtaggcattttttttttttttttgtgagatggagtcttgctcttgttgcccaggctggagtgcaatggcgcaatctcggctcaccgcaacctccacctgctggattcaag

SEQ ID NO: 39448 - DNA, 201 bp, Homo sapiens
tatctttgagtcatcttgggggttggctgatttaagctgggctaggctaggtggctggggtagctctgctctatatgcctctcatcttcctcctgggaccagtaggttgccctggacatgtgtaagaagaaaattggaaatatgcaaggtctcttaaggcctaggcttggaactggcacactaatttctgcctcatcctgt

SEQ ID NO: 39449 - DNA, 201 bp, Homo sapiens
tattttcctgcctcagcctcctgagtagctgggattacagcgtgggccaccatgcccggctaatttttgtatttttagtaaagatggggtttcaccatgtrggccaggctgggctcaaactcctgacctcaggtgatctgcccacctcagcctcccaaagtgctgggatttcaggcatgagtgactgcacccagcccagaa

SEQ ID NO: 39450 - DNA, 201 bp, Homo sapiens
tgacttcctcctttcctaattgaatgccctttatttccttctcctgcctgattgccccggccagaacttccaacactatgttgaataggagtggtgagagrgggcatccctgtcttgtgcctgttttcaaagggaatgcttccagtttttctccattcagtatgatattggctgtgggtttgtcatagatagctcttatta

SEQ ID NO: 39451 - DNA, 201 bp, Homo sapiens
gaatgccctttatttccttctcctgcctgattgccccggccagaacttccaacactatgttgaataggagtggtgagagagggcatccctgtcttgtgccwgttttcaaagggaatgcttccagtttttctccattcagtatgatattggctgtgggtttgtcatagatagctcttattattttgagatatgtcccatcaa

SEQ ID NO: 39452 - DNA, 201 bp, Homo sapiens
tacatgagagcagagccatctaagaacctccagattaatctgttcaccagctcagtacctctggtgacttcatttggtgccacatggagtagagacattgycagcagcaccctttctgaatacctgaccatcagaattgagagctgtaatacaatggctgttattttaaactgttaagttttgggatagtttgttatacag

SEQ ID NO: 39453 - DNA, 201 bp, Homo sapiens
atttacccagtagtcattcaggagcaggttgttcagtttccacgtagttgagcagatttgagtgagtttcttaatcctgagttctagtttgattgcactgkggtctgagagacagtttgttataatttctgttcttttacatttgctgaggagtgctttacttccaactatgtggtcgattttggaataggtgtggtgtgg

SEQ ID NO: 39454 - DNA, 201 bp, Homo sapiens
ttacattcaaagttaatattgttatgtgtgaatttgatcctgtcattatgatgttagctggctattttgctcgttagttgatgcagtttcttcctagcctygggggcctttacaatttggcatgtttttgcagtggctggtaccggttgttcctttccatgtttagtgcttccttcaggagctcttttagggcaggcctga

SEQ ID NO: 39455 - DNA, 201 bp, Homo sapiens
agcttagtttggctggatatgaaattctgggttgaaaattcttttcttgaagaatgttaaatattggcccctactctcttctggcttgtggggtttctgcygagagatcagctgtttgtctgatgggcttccctttgtgggtaacccgacctttctctctggctgcccttaacattgtttccttcatttcaactttggtga

SEQ ID NO: 39456 - DNA, 201 bp, Homo sapiens
tctcgaggagtatctttgtggcgttctctgtatttcctgaatctgaatgttggcctgccttgctagattggggaagttctcctggataatatcctgcagartattttccaacttggttccattctccccgtcactttcaggtgcactgatcagacgcagatttggtcttttcacatagtcccatatttcttggaggctttg

SEQ ID NO: 39457 - DNA, 201 bp, Homo sapiens
tcccagctactccggaggctgaggcaggagaatcgcttgaacccgagtggcaggggttgaggtgagcccagcctgggtgataagagcgaaactccatctcaaaaaaaaaaaaaattgcttaatttctgttttcatgcctgtgggtatttgccctgcaacactgcagcagttttcaaaaccaaagtttctgaactccttgag

SEQ ID NO: 39458 - DNA, 201 bp, Homo sapiens
taacatgtttgaaaaacatgttgagtaaagacttacatttctagaatacagtatacggtaaattaatataagatagaaaactaagcaaataacaaaaataytaagctgcgcacagtggctcacacctgtaatctcaacactttgggaggttgaggcaggaggatcacttcaacccagaagttcaagccagcttgggcaaca

SEQ ID NO: 39459 - DNA, 201 bp, Homo sapiens
caagataacaaatgaattcttaacagaggcctgtttaggattaaacaagttttattggaggtctgaagaaactccccagacctccacaaacaagtttattggggggtctgaagaaactccccaaacctccatgatttagcaggagacaagataagggtaatcacccagcacctggacccattaggattaagtaaatttacg

SEQ ID NO: 39460 - DNA, 201 bp, Homo sapiens
  misc_feature (1)...(201): n = A,T,C or G, or insertion/deletion polymorphism (see Tables 1-2)
aaagtaataactgattttttaaagaagatcgttttctaagatttctaaaattgtcaaaaaccattttaagttactgcaggtgcatttattctatgagttgngttataaatcaaaagatttcctattaacctattttaggaatagacttgtaattctcaaacttgagtaatgtaatgtaaaaaagcccttaaaaggaagaaa

SEQ ID NO: 39461 - DNA, 201 bp, Homo sapiens
tgccactgcttccatacctagtgtggataggaccttttttcttcttttattatccttcctacctgttgaaagactgttgtcagtcagagctgaaacccagrttggccctgagctcaaatcatagtcaagtatggtagtcttaagaatgggagagtcagctgggtgtggtgggttatgcctgttatcccaggactttgggag

SEQ ID NO: 39462 - DNA, 201 bp, Homo sapiens
agagccttatatacataaatcagaatgctaatttattaacctgtaataggatatatagcaagcatgataaccagatttaaacttgtcacaaaacaccttcyctttcttacaaatagcagactcctccttcttgccctctccctgttcttcttccctgaatgttttctttttgttgtgcacatacagttaggacaccaaatt

SEQ ID NO: 39463 - DNA, 201 bp, Homo sapiens
ccaccctgggccagtgcttctcaatctgggcacacaagaaacaactggtgtatcttcttgaagcaagagttctccttgaagatttacttgaagagaaagtkgaagcaggacactgaaaaatgtagatgaaaatctttgaaagaagtattttttatcttaaaagaaaaaagaaaatattatgaaacagaataaaatatctgt

SEQ ID NO: 39464 - DNA, 201 bp, Homo sapiens
  misc_feature (1)...(201): n = A,T,C or G, or insertion/deletion polymorphism (see Tables 1-2)
aacagtccccggccgggtgcagtggctcacacctgtaatcccagcactttgggaggccgaggcaggcggatcaagaagtacctttatttctttattaaagnatcttgattcaaaaggtttccctcttaccaaaaagggatagggaaagttgccagttaaattttccatcctaatagtaatgttgctgtgagagaaggagat

SEQ ID NO: 39465 - DNA, 201 bp, Homo sapiens
actgtaggcatttttaaggcacaactttaatggaattttgaactggtggtaaactactcatggtaacctgtggttgaaaccataggctttggggcaagacygaaacctagctcctcccttttctaactgtaccctggggcaagttgcttagcctttttgtgtctccatttctcatttgtaaaatgggaataatatcatctg

SEQ ID NO: 39466 - DNA, 201 bp, Homo sapiens
attaacctgtaataggatatatagcaagcatgataaccagatttaaacttgtcacaaaacaccttccctttcttacaaatagcagactcctccttcttgcyctctccctgttcttcttccctgaatgttttctttttgttgtgcacatacagttaggacaccaaattgtaagtcagaaagttgttgggtgagcacacagtt

SEQ ID NO: 39467 - DNA, 201 bp, Homo sapiens
gtctccatttctcatttgtaaaatgggaataatatcatctgcctcatagagttatcatgagaattaagtgaccagtatatgttaaatgttggaacagtggrtcgttcatagtgaattctccctaatgttagctattttcattttcatttatatttctagatatcccaagggttattattttgtcctcctcttttgttaagt

SEQ ID NO: 39468 - DNA, 201 bp, Homo sapiens
  misc_feature (1)...(201): n = A,T,C or G, or insertion/deletion polymorphism (see Tables 1-2)
caaagtattggaattacacatgtaagccgccatctctggccctctgttaacaatttcttatttattcttccagaattttagtgtgtacgaataaatagatntatgattttctgccaaatgctacatacatctatatgtgataagtaattctcaatttgaaggatagactaaatttctttcaaacacagacttagctcttta

SEQ ID NO: 39469 - DNA, 201 bp, Homo sapiens
atttcttcctcagttctacaacatatatctaagagcaaaaaccatccttcccaacacccggattaaaataacctctaagtctggatgaaaagaatggaggratgggaataggatagaagggatgaggggggaatggcatttttgtgacttttataaccatagtcacaaccattttgtgacatttataaccatatcaatgtt

SEQ ID NO: 39470 - DNA, 201 bp, Homo sapiens
  misc_feature (1)...(201): n = A,T,C or G, or insertion/deletion polymorphism (see Tables 1-2)
tgggttgcaattaaattagtcccatttttttctgtgtcaatcttgcttcccctattcccttaaaatggctgtttccaagagcattcctcaataattactcnatgaaatctaaccttcaacatgagagggactccaaagccaatggtgaagggcaaagatatagtataggaaagaatcaaaaccaataacgcaatctaccac

SEQ ID NO: 39471 - DNA, 201 bp, Homo sapiens
  misc_feature (1)...(201): n = A,T,C or G, or insertion/deletion polymorphism (see Tables 1-2)
atttgaaggatagactaaatttctttcaaacacagacttagctctttagatgaaaagtcattaggcaggaatggaggtaagggctggtctaaggtctcttnggtgtctggattcactgaatttcaatgatgatacagtaaaaaaaattgtaaaagagcaaaaacaattaaaaatagatgtgtagttatatttttcttctta

SEQ ID NO: 39472 - DNA, 201 bp, Homo sapiens
gagattatcaagagcaggaagctgctaccactgcctaaagcttaagggacaaaaggagccaggccaccagggagaagttggaaccacagaagctcttggascaagagctgggtccatagaagagatggccgctgccagagacaatacttgaagctgagagaagtggggaaaaatacccagcttctccctttctgctctctc

SEQ ID NO: 39473 - DNA, 201 bp, Homo sapiens
cctgagtgccaaatcttaactaccaattgcctgatgcttatctccacatgaacagctacacaggcaccttaactcatttacaaaattgaatgtgtcatctycttcctacaaatcttccatttcttcctcagttctacaacatatatctaagagcaaaaaccatccttcccaacacccggattaaaataacctctaagtctg

SEQ ID NO: 39474 - DNA, 201 bp, Homo sapiens
  misc_feature (1)...(201): n = A,T,C or G, or insertion/deletion polymorphism (see Tables 1-2)
actttgcagatgtggttaagaattgtgagatggggagattgtgctggattatccaagtgggcccagtgcaagcataaggagtctttataagagggaagcangagggtcagagccaaaaaagtagatgtgacacagaagcagaggtcagaaagaggggtggagaagagagagagatttgaagatgttgtgctgctggctttc

SEQ ID NO: 39475 - DNA, 201 bp, Homo sapiens
cctgcattgctttaattcttttgaacataattattttagtccctttgctattgttccattatttccaattcttttttgttgcactcgatgactctccctcatcatgcctcctttggtggtttttaatttaggaatgtgaagtcatcttcatgagggctgccttttctatgggacttctatatgcttagcccctgtacaatg

SEQ ID NO: 39476 - DNA, 201 bp, Homo sapiens
atatgttacttctagaatcagaagaagaaacctctttgttttaaaaaacttcacccaaaaagtcatccattcaagagttgtttttctccaccccagctgaygtgacaaaatgctgccaacaattttgatgccaataatgacttctacatattaaatacttctacatactgacaaaaaattatctcttaacagcatgaattg

SEQ ID NO: 39477 - DNA, 201 bp, Homo sapiens
agcagcggtggctgcagaacagcggatattggtgaaccacaaatgctgctgcctgatcattcctttggaaattttgtctccgaggagtacccggccgtgtraggtgtcagtccgcccctactggggggtgcctcccagttaggctactcaggggtcagggacccacttgaggaggcagtctgcccgttctcagatctccag

SEQ ID NO: 39478 - DNA, 201 bp, Homo sapiens
agtacccggccgtgtaaggtgtcagtccgcccctactggggggtgcctcccagttaggctactcaggggtcagggacccacttgaggaggcagtctgcccrttctcagatctccagctgcatgctgggagaaccactactctcttcaaagctgtcagacagggacatttatgtctgcagaggttactgctgtctttttgtt

SEQ ID NO: 39479 - DNA, 201 bp, Homo sapiens
catctattgagataatcatgtggtttttatctttagttctgtttatgtgatgaatcacatttattgatttgtgtatgttgaaccaaccttgcatcctggamatgaagccaagttgatcgtggtggataagctttttgatgtgctgctggattcggtttacaagtattttgttgaggatttttgcatcagtgttcatcaagg

SEQ ID NO: 39480 - DNA, 201 bp, Homo sapiens
aggggtcagggacccacttgaggaggcagtctgcccgttctcagatctccagctgcatgctgggagaaccactactctcttcaaagctgtcagacagggayatttatgtctgcagaggttactgctgtctttttgtttgtctgtgccctgcccccagaggtggagcctacagaggcaggcaggcctccttgagctgtggtg

SEQ ID NO: 39481 - DNA, 201 bp, Homo sapiens
ggaagctgaggcatgagaatcacttgaacccaggaggcagaggttgcagtgagccaagatcgtgccattgcactccagcctgggcaacagagtgagactctgtttcaaaaaaacaaacaaataaaagtagattatgttattactggacagttactactgaatgaatccaaatatttgctttcttcagccttacacttggac

SEQ ID NO: 39482 - DNA, 201 bp, Homo sapiens
gtttaacagttattcaatgtaattgaagttaatgtagctaaaattgcatattatttttgaagtgttaagaatgaaaataatttatggtctttaagaatgaytatgccaatatttcatattctgtattggcagtacagtaaaaattaattattttcactataagtattatataaataataaagatatttaggagggagtata

SEQ ID NO: 39483 - DNA, 201 bp, Homo sapiens
ataaagattaagagggtatgttaattggaatattgggacagatgagaaggttaaatcctgttttatttatttacttgtttgcttatttatttatttgagayggagcctcggtatgttgcccaggctggagtgcagtggtgcgatctcagctcactgcaacctccgcctgccgggttcaaatgattctcctgcctcagcctc

SEQ ID NO: 39484 - DNA, 201 bp, Homo sapiens
gaagctgaggcatgagaatcacttgaacccaggaggcagaggttgcagtgagccaagatcgtgccattgcactccagcctgggcaacagagtgagactctgtttcaaaaaaacaaacaaataaaagtagattatgttattactggacagttactactgaatgaatccaaatatttgctttcttcagccttacacttggact

SEQ ID NO: 39485 - DNA, 201 bp, Homo sapiens
ttaaaatatgtttttttagataagtgatgaagagaagactcttcgagaacaggagattgttgcctcatcaccaagtttaagtggacttaagttggggttcragtccatttataaggtatgtaaacatgtaaaatacttcctaggttttgttaaatatgtcgcattgagctttatatacatatttaattaatccatttttat

SEQ ID NO: 39486 - DNA, 201 bp, Homo sapiens
tgccactgtactccagcctgggcaacagagtgagactgtctcaaataaaataaaataaaccaaaaacaaaagttaaaaattataaaacaataccatttacatatatatatatatacatgcatacatatgtatgtatgtaaatacatatataatagtaaaaaagaaaaggtagtggttacttttagtaagggaaaagcatgg

SEQ ID NO: 39487 - DNA, 201 bp, Homo sapiens
gccactgtactccagcctgggcaacagagtgagactgtctcaaataaaataaaataaaccaaaaacaaaagttaaaaattataaaacaataccatttacatatatatatatatacatgcatacatatgtatgtatgtaaatacatatataatagtaaaaaagaaaaggtagtggttacttttagtaagggaaaagcatggg

SEQ ID NO: 39488 - DNA, 201 bp, Homo sapiens
ttgtttgccatgctaagaaatctggacaccctcaacagtccttagggatactgagggagcctgaggaaggcagtgagcactttcaaatagtttttgttttygtttttattttttctcctgtaaaattaaaaaattctcattgaagaaaatttggaggtgacagaaaggcataaagagaaaatatgtcacctttaatttctc

SEQ ID NO: 39489 - DNA, 201 bp, Homo sapiens
acctccacatttctgtcatgtaccagcattctctcaggcataactatctgggagtctttttttctagtactctcactcttctcatcattaattgttttgctttttttaaaaaaattaccccttattggcacagctattactctagtcctcctcagttttgattcttatttcatagcctcaacacattttcctcaaatacag

SEQ ID NO: 39490 - DNA, 201 bp, Homo sapiens
aatatttcatattctgtattggcagtacagtaaaaattaattattttcactataagtattatataaataataaagatatttaggagggagtatatatgctwataggaaataaatgttttgcctcccaggagatcatcttagctggtacagtggattaaaaatggcctcaaattatttgatattttctcattgagaagtggg

SEQ ID NO: 39491 - DNA, 201 bp, Homo sapiens
agtataaaaaccctagaagaaaacctaggcaataccattcaggacataggcatgggtaaagacttcatgactaaaacacccaaagcaatggcaacaaaagycgaaattgaaaaatgggatctaaataaactaataagcttctgctcagcaaaagaaactatcatcagagtgaacaggcaacctacagaatgggagaaaagt

SEQ ID NO: 39492 - DNA, 201 bp, Homo sapiens
tggttcatttggctgtttggatggcctttcttcttcactgttgtgctctgtcctcggcttcatcaggaaaggaagggatgctttttttctgttgaatctargccaagtaaatgatgcctactgcctaacaggcagctcccatacgaaggatgcaaacaaggagtgcctagtttttttttccatactgacatacttttctgt

SEQ ID NO: 39493 - DNA, 201 bp, Homo sapiens
gtggtctgtcttccgtggctccaggtctcaccagctctcaccaggtctctctctaggagtggtttccttctattgctggtctctgggtgtctcaacatccyttgctaattcccttaattctgcccacagctatgtcagcagtatctttgttaaagtcccttcatttgaacaatttggcttgagttctgttttctgccagaa

SEQ ID NO: 39494 - DNA, 201 bp, Homo sapiens
tcttttacattttcagcatcctaatgatgtccttagtgatagttgctatggaagtattttagtgttttctgcagtgttgggtggtgcagtacctgaagccytctttagtgtgtatttataatgacaccaagccatgaatttcattttagtggtagctttcttgcttaataactggttgtcgtcgggggagtggtctgcatt

SEQ ID NO: 39495 - DNA, 201 bp, Homo sapiens
ggtttcaccatcttggccaagatggttccaatctcttgaccttgtgatctgcccactggcagatcttgtttgtccccatttattggctgggattaaaggcrtcaaaaacttttaagaatgtatagtttggagactgagactcagtaatgggtggaggagagaaaactgggatatctagagaattggattgtgatgtcttcc

SEQ ID NO: 39496 - DNA, 201 bp, Homo sapiens
tccccatttattggctgggattaaaggcgtcaaaaacttttaagaatgtatagtttggagactgagactcagtaatgggtggaggagagaaaactgggatwtctagagaattggattgtgatgtcttccgtaaaatagtaatagtagtacatgttctacctacttgataggattgttatgagggtcatgtgattaatgtat

SEQ ID NO: 39497 - DNA, 201 bp, Homo sapiens
aaactggatggagaacgagtttgatgagttgacagaagtaggcttcagaaggtcggtaataacaaacttctctgagctaaaggagcatgttctaacccatytcaaggaagctaaaaacctcgaaaaaaggttagatgagtggctaactagaataaacagtttagagaaggccttaaatgacttgatggagctgaaaaccac

SEQ ID NO: 39498 - DNA, 201 bp, Homo sapiens
  misc_feature (1)...(201): n = A,T,C or G, or insertion/deletion polymorphism (see Tables 1-2)
ctgcaattaaacagaatttttttataaagaattctgtgcctgacaactctagacatatttattatgcagcttctcttaaaggattttcaatttgctcattnggagcaaattttgtgtgttaaatgcagttggttcctagacactgactcattttccaaatctgagtacactttttcctcaattgactttcccctgccagta

SEQ ID NO: 39499 - DNA, 201 bp, Homo sapiens
cctcttctcctccaaaggatcacagctcctcgccagcaagggaacaaaactggatggagaacgagtttgatgagttgacagaagtaggcttcagaaggtcrgtaataacaaacttctctgagctaaaggagcatgttctaacccatctcaaggaagctaaaaacctcgaaaaaaggttagatgagtggctaactagaataa

SEQ ID NO: 39500 - DNA, 201 bp, Homo sapiens
gctggagtacagtggcatgatctcagcccactgcaacttctgcctcctgagttcaagcgattctcctgcctccacattctgagtagctgggactacaggcrtgcaccaccatacccggctaatttttgtatttttagtagagatggggtttcaccatgttggccagactggtctcgaactcctgacctcaggtgatcagcc

SEQ ID NO: 39501 - DNA, 201 bp, Homo sapiens
tgcaattaaacagaatttttttataaagaattctgtgcctgacaactctagacatatttattatgcagcttctcttaaaggattttcaatttgctcattcrgagcaaattttgtgtgttaaatgcagttggttcctagacactgactcattttccaaatctgagtacactttttcctcaattgactttcccctgccagtat

SEQ ID NO: 39502 - DNA, 201 bp, Homo sapiens
cacacctcttctcctccaaaggatcacagctcctcgccagcaagggaacaaaactggatggagaacgagtttgatgagttgacagaagtaggcttcagaargtcggtaataacaaacttctctgagctaaaggagcatgttctaacccatctcaaggaagctaaaaacctcgaaaaaaggttagatgagtggctaactaga

SEQ ID NO: 39503 - DNA, 201 bp, Homo sapiens
ctggagtacagtggcatgatctcagcccactgcaacttctgcctcctgagttcaagcgattctcctgcctccacattctgagtagctgggactacaggcgygcaccaccatacccggctaatttttgtatttttagtagagatggggtttcaccatgttggccagactggtctcgaactcctgacctcaggtgatcagcct

SEQ ID NO: 39504 - DNA, 201 bp, Homo sapiens
tctgtatttagatttttggtgcaaatatcatctctgtctctaggaaacaaacccagacggcctacagagtcaagaatgaagaattcattttactgaaatgytaatgtcaactctaaaaatatcagagttttcaattttacctaatcaaataatcagctcgacaatttttttgcaaccacagttgcttatagggctgaccaa

SEQ ID NO: 39505 - DNA, 201 bp, Homo sapiens
  misc_feature (1)...(201): n = A,T,C or G, or insertion/deletion polymorphism (see Tables 1-2)
ccaaaaccccatctgtaggttaccaacgtcaaagaccaaaggtagataaaacaacaaagatggggagaaaccagagcagaaaagctgaaaattccaaaaancagcacacctcttctcctccaaaggatcacagctcctcgccagcaagggaacaaaactggatggagaacgagtttgatgagttgacagaagtaggcttca

SEQ ID NO: 39506 - DNA, 201 bp, Homo sapiens
tttggtgcaaatatcatctctgtctctaggaaacaaacccagacggcctacagagtcaagaatgaagaattcattttactgaaatgttaatgtcaactctraaaatatcagagttttcaattttacctaatcaaataatcagctcgacaatttttttgcaaccacagttgcttatagggctgaccaaagtgacgatttgtt

SEQ ID NO: 39507 - DNA, 201 bp, Homo sapiens
tatcctggcttaaacagaaccacagaagtttgtttcatgaagataaaaagaacatagagcaaacttttttctgtgggaaagaagaacatgaaagagagagrgttgagtctctacttgggagaatatttcatctagcagagattgtaaagtctgtgggtaaaatttattgtacttaaatgtttgcatgtcagataagacaaa

SEQ ID NO: 39508 - DNA, 201 bp, Homo sapiens
gaaaatgctgttttctttcctggcatttttttctcctctccttctagttttaccacttcttttatattttgtaagaatttgtttaggccatgtgtagtgaygcatgcctataatttcagcactttgggaggcaaagggggatggatcacttgagttcaggaattggagaccagcctgggcaacatggcgagaccccaaatc

SEQ ID NO: 39509 - DNA, 201 bp, Homo sapiens
caaagaaggtatacaaatggccgatgagcacatgaaaagagactcaaggtcactaatcatgagggaaatgcaactcaaaaccatgagatacaacttcacamtcattaaaatgatgattataaacaaagcagaacagaaaataaatatgagtgttggcaaggatgtggaaaaattataacctttgtgtgctgctggtgggaa

SEQ ID NO: 39510 - DNA, 201 bp, Homo sapiens
gtctcagctactcaggaggctgagactggaggatcacttgagcctaggagtttgagattacagtgagctatgatcacatcactgcactccagcctggatgrcagagtgagaccctgttttaaaaaacaaaaaataaaaaaagcagattctcctcttcatgataggaagttgatagatgtgtaaaactgaaaactttttcag

SEQ ID NO: 39511 - DNA, 201 bp, Homo sapiens
tggaggatcacttgagcctaggagtttgagattacagtgagctatgatcacatcactgcactccagcctggatggcagagtgagaccctgttttaaaaaayaaaaaataaaaaaagcagattctcctcttcatgataggaagttgatagatgtgtaaaactgaaaactttttcaggaaactgctgaaggaatggcaagcag

SEQ ID NO: 39512 - DNA, 201 bp, Homo sapiens
actttgaacttctggcctccagaaccataagaaaataaatttctgtggtttaaactacctagtctgtggtattttgttatggcagtcctactaaacgaatrtacttcctttacctgaattataagctgactttcccaatacacctccacatttctgtcatgtaccagcattctctcaggcataactatctgggagtctttt

SEQ ID NO: 39513 - DNA, 201 bp, Homo sapiens
tctttatgcaaagaggatattaggactcagacacacacagttggaagaccatgtgaagacacaagagagaagacagccatctgtaagctaacgagagaggstgcaaaagaaaccaaacctacaaacactttgactttgaacttctggcctccagaaccataagaaaataaatttctgtggtttaaactacctagtctgtgg

SEQ ID NO: 39514 - DNA, 201 bp, Homo sapiens
ctttaaaaaatagcagtattagcaaggatagaaatggctgtaaataccaaaagaaaccgaaaaaagtgttgaaagtctttggaaacaagaattggggggakggggaggagtatggaattactagattactgttttaatactaaactatgcagaactatgtattttttttttttttttttgagatggagtcttgctgagtgc

SEQ ID NO: 39515 - DNA, 201 bp, Homo sapiens
tagaggtgtcatggagtctcacagcttcagctaagatcttttagtacgtaaattctgttgggtatctccaactgcttcctaaatggttctacccagtaacytactttcattgctaattccaaaaagctaatactgaaacagtccctcccttagtctctccctgttatgagctgaattgtgtctccctgctccctccaccaa

SEQ ID NO: 39516 - DNA, 201 bp, Homo sapiens
  misc_feature (1)...(201): n = A,T,C or G, or insertion/deletion polymorphism (see Tables 1-2)
cagctgcgcgcttcctctgtgcgaggcattgccggagagcggggagcgaattgaacgtggaacctgccagtaggggcttgccgcccaatacgaaattcaanatatgtattgtatgtagacgggcaaactaacgaggatcttgtaacttgttttctcatctgccaaatgggggtaatacgatcttataggaccttataggtc

SEQ ID NO: 39517 - DNA, 201 bp, Homo sapiens
ttaaattaggttatttttaagaacaataatttaatactaaaaaattatgttttgtggctaaaaaatggaaataaaataacttacaattgacttaaattgcrtcatgtttttccaaaccaatatgatggttaccaaatcagaaggaaaaacatgttaatcatagtgtaagcttttttcctaatatggtataaacaattttaa

SEQ ID NO: 39518 - DNA, 201 bp, Homo sapiens
ggctcagctgggaggatcgcttgagtccaggaggtggaggctgcagtgggcagtgatagcatcactgcactccagcctgggcaacaggaaaccctgtcttraaaaaacaaatgaacagaaactccctccccatgcaaaatcccttaagttcttaatttaatgtagttaaaatgatcaatctttctctttttagcttgtttt

SEQ ID NO: 39519 - DNA, 201 bp, Homo sapiens
acgaggaagcagtcacatattctgttctcagaaagatgtagaagtatcactggatctccctttctgcaatcaagcctgtgacgtctgagtttgggcttggraaacgaccaatcagagctcacctaccgcagccaatcagaaaccagccatattgaccgatcagaacttagctgcaccaaccaatcagaactaagcaagttt

SEQ ID NO: 39520 - DNA, 201 bp, Homo sapiens
tcatgactaaaacacccaaagcaatggcaacaaaagccgaaattgaaaaatgggatctaaataaactaataagcttctgctcagcaaaagaaactatcatyagagtgaacaggcaacctacagaatgggagaaaagttttgcaatctatgcatttgacaaagatctaatatccagagtctacaaggtacttaaacaaattt

SEQ ID NO: 39521 - DNA, 201 bp, Homo sapiens
acggagtcttgctctgttgcccaggctggagtgtagtggtgcaatctcagctcactgcaacctcggcctcctgggttcaagtgattctcctgcctcagccwcccaagtagctgggactacaggcgcacaccaccatgcccagctcatttttgtagctttagtagagacagggtttcaccatgatggccaagctggtcttga

SEQ ID NO: 39522 - DNA, 201 bp, Homo sapiens
gaatggtaatcgttaaaatgtctggaaacaacagatgctggtgaggatgtggagaaataggaatgcttttacggtgttggtaggagtgtaaattagttcarccattgtggaagacagtgtggcgattcctgaaggatctagaactagaaataccatttgacccagcaatcccattactgggtacatacccaaaggattgta

SEQ ID NO: 39523 - DNA, 201 bp, Homo sapiens
gttgttttcagtgagatgtagatctgaataacttaagaaatcagaaactgctaatagcacggagcccatctgctgctgtgctgttggtgatgttgcaaatrgttcccctctccccttaacatattctgagcctcaagtcaagacagcttactgggctggagaggtgatggtctaaagaattataaagattttttaaaaatt

SEQ ID NO: 39524 - DNA, 201 bp, Homo sapiens
acagtgtggcgattcctgaaggatctagaactagaaataccatttgacccagcaatcccattactgggtacatacccaaaggattgtaaatcattctaccrtaaagacacatgcacacgtatgtttattgtagcactatttacaataagcaaagacttgtaaccaacccaaatgcccatcaatgacagagtggataaagaa

SEQ ID NO: 39525 - DNA, 201 bp, Homo sapiens
aaggttagatgagtggctaactagaataaacagtttagagaaggccttaaatgacttgatggagctgaaaaccacagcacgagaactttgtgacgcatgcrcaagcttcaatagctgatttgaccaagtggaagaaaggatatcagtgatcgaagatcaaattaatgaaataaagcaagaagagaagattagagaaaaaag

SEQ ID NO: 39526 - DNA, 201 bp, Homo sapiens
aggacaactacaaaccactgctcaatgaaataaaagaggacacaaacaaatggaagaacattccatgctcatggataggaagaatcaatatcatgaaaatrgccatactgcccaaggtaatttatagattcaatgccatccccatcaagctaccaatgactttcttcacagaattggaaaatattactttaaagttcattt

SEQ ID NO: 39527 - DNA, 201 bp, Homo sapiens
ttttgatgccaataatgacttctacatattaaatacttctacatactgacaaaaaattatctcttaacagcatgaattgaattttataaaaaaaaaaattygattgggaatatctgctccagtacttagaggtttaactagtagcaaaccactggtttattttggagtgaatcaatctacattgattctatggaaagagtc

SEQ ID NO: 39528 - DNA, 201 bp, Homo sapiens
ttcactgatacaaacaattgaataaataataaataaataagtggtggaagaggggaacatgctctcttttttttaacagtagaattctaattcacaaatakagaagaagtgacggaaatagaaaaatatcgagtgcagtggctcacgcctgtaatcccagcactttgggaggttgaggcgggtggatcacttgaggtcagg

SEQ ID NO: 39529 - DNA, 201 bp, Homo sapiens
agaataaacaccctgggcttcagctctgagtgggcaaggatacttgctgttcattgctgtcctgtctcgtgtgcctgtatgagctcgtgtgtgtgtatgtkcgtgtgtgtgtgcacgcatgtgtacatgttgagggatctgaaaatcgggtagtggatgggctccagacccttgagtatggtttactgtgtgccttctagt

SEQ ID NO: 39530 - DNA, 201 bp, Homo sapiens
ctgcttttctttgctttctccatggcacttattcaggataggcacttcagaagacattcctatttactggctgggaggccaaaagctaagacagaactttcagtctcactcttaggggtcacaaaattattgctttccaatttaaactgtttcacttccaaatttgagcccccaaatatgaaatactgcctcacctgtgcc

SEQ ID NO: 39531 - DNA, 201 bp, Homo sapiens
gtgacgggttgataggtgcaggaaaacaccatggcacctgtatacctatgtaacaaagctgcatgttcagcacatgtatcccagaacttaaagtaaaatgaaaaaaaaaaaaagatattccaagattcttccaagatggctaaataggaacagatctggtctgcagctcccagcaagattgacacagaagacgggtgattt

SEQ ID NO: 39532 - DNA, 201 bp, Homo sapiens
  misc_feature (1)...(201): n = A,T,C or G, or insertion/deletion polymorphism (see Tables 1-2)
gggaaacaaattatccctgaggctcagtcctagcccctctgtgtgttccttttcaacatccaatgtgacctcgtctttctctaagtactcttagcacttanctgtcctcttttggggccattttcatcctctgtcatttgcatagttgtgtctgtgtatatttcttattattttgtatatttcttgagaatatcttctccc

SEQ ID NO: 39533 - DNA, 201 bp, Homo sapiens
agtctgatccagcatttactgacattgcttaaagccagtactaaatgatttatgctcaattctaaagtcctgggttgaatcacttggtccttccagattgwccaaggaaaataccatgtgctggcaaaggtcaccgttaatgagggaaacaaattatccctgaggctcagtcctagcccctctgtgtgttccttttcaaca

SEQ ID NO: 39534 - DNA, 201 bp, Homo sapiens
tcttttatctattcatccattgatgagtactttggttgattccattccccggctattgtgaatagtgatgcaataaacataggagtgcagatatctcttcsatatattcatttcctttcttttgtatatatacccagcagtggaattgctggatcacgttctgttttcaggttttagttttttgaggaaactccatactgt

SEQ ID NO: 39535 - DNA, 201 bp, Homo sapiens
catttttaggtgtatatttcagtgttattaaatacatttatattcttttttccctttatctctctcttcccccatccctcctggcctctgctaaccacagyctactctctatcttgatgagatccacttttttagctcctgcatatgagtgagaacatgaaatatttgtcttttgtctttctgtgcttgtgttatttcact

SEQ ID NO: 39536 - DNA, 201 bp, Homo sapiens
ccctttcaggctagccctccttcattgccataacatctaggggtgacattgactgagttgtatatgattattcatcatttctcgggcctagatagattgtratgagttttagggcttgtcaaatttcaaggctctgtttttataccacacataattttgggaatttgtaaagtgcttaataattatccatcaatgagtaag

SEQ ID NO: 39537 - DNA, 201 bp, Homo sapiens
gtctcgaactcctgacctcatgatctgcctgcctcggcctcccaaagtgctgggattacaggcgtgagccaccatacccagcatgtactatcttttttttwaaaaaaaattttcattgaggtaaaatatccatatataatttaccacctttaccatttttaggtgtatatttcagtgttattaaatacatttatattcttt

SEQ ID NO: 39538 - DNA, 201 bp, Homo sapiens
aaattctcatttatagctgctgcagaagagatgcaaatgttctctatgtggttgctctgtgtgaggaggtgtttcatgggactatcaaaatcctatcttargttgtcattttggacactaaaaattttcaagtaataatttaaagaatcttgaggtttccttttgatatggcctagaaacctttggcaactaatttctgta

SEQ ID NO: 39539 - DNA, 201 bp, Homo sapiens
ttttagtagaaacggggtttcaccatattggtcggctggtctcgaactcctgacctcatgatctgcctgcctcggcctcccaaagtgctgggattacaggmgtgagccaccatacccagcatgtactatctttttttttaaaaaaaattttcattgaggtaaaatatccatatataatttaccacctttaccatttttagg

SEQ ID NO: 39540 - DNA, 201 bp, Homo sapiens
taatgtattacttcaaaataacagaatttattgaacaacacacaagtcaatttgcttattagcacattgttctctgcagaactgctggcgacctcattgcyctactttggaaaccacgttaatatactggggaaacagatttagttagctttgaaccatgatcacaggacaattatgaaaacatgcaaatttgaaaggcta

SEQ ID NO: 39541 - DNA, 201 bp, Homo sapiens
cacgcctggctaatctttgtagttttagtagaaacggggtttcaccatattggtcggctggtctcgaactcctgacctcatgatctgcctgcctcggcctyccaaagtgctgggattacaggcgtgagccaccatacccagcatgtactatctttttttttaaaaaaaattttcattgaggtaaaatatccatatataatt

SEQ ID NO: 39542 - DNA, 201 bp, Homo sapiens
atatgggtgtagcagtccatttggacagtggcaagaaagtggatgttgtgatgtcgacaagatttggatttggaccgtgcctgttccagttttagtactgraagtcccacatccttagaaacctctcattcctggacaaactgggatggttggtcaccataatgaggtgccagaaggatatgatgaacttgaggcattgaa

SEQ ID NO: 39543 - DNA, 201 bp, Homo sapiens
  misc_feature (1)...(201): n = A,T,C or G, or insertion/deletion polymorphism (see Tables 1-2)
atgtattacttcaaaataacagaatttattgaacaacacacaagtcaatttgcttattagcacattgttctctgcagaactgctggcgacctcattgcccnactttggaaaccacgttaatatactggggaaacagatttagttagctttgaaccatgatcacaggacaattatgaaaacatgcaaatttgaaaggctaga

SEQ ID NO: 39544 - DNA, 201 bp, Homo sapiens
atctggacaccctcaacagtccttagggatactgagggagcctgaggaaggcagtgagcactttcaaatagtttttgttttcgtttttattttttctcctrtaaaattaaaaaattctcattgaagaaaatttggaggtgacagaaaggcataaagagaaaatatgtcacctttaatttctccacacagaaataaccactg

SEQ ID NO: 39545 - DNA, 201 bp, Homo sapiens
acacccatggcattactacaccctgcctgaactagttcttggccttcctgctgttgggaggaccagtatctaaatgtgtatcttcctgtgttagtgcaagttccactgtggcttagattgttcatctggtggtttggagcacacatcctgagagatgaacgaatggaacaattgttagtttattgacctagtcctgtgtgc

SEQ ID NO: 39546 - DNA, 201 bp, Homo sapiens
acagacaagtgggtgagacagattaatgtgtgataaatgcaaaaagcagccaaagtatggtactatggtagcatggggtagagaggaggcagggaagtccwgttgagtgaggctgtggctgagtcctaagggatagtccttaacaaggggaagatttgggggaggaatttccagactgaagacaccctataccatgaagta

SEQ ID NO: 39547 - DNA, 201 bp, Homo sapiens
  misc_feature (1)...(201): n = A,T,C or G, or insertion/deletion polymorphism (see Tables 1-2)
aaaattaaaaactttttgagcactgatatgacatccaaaggaaatgctcactgcagcatgtcaaattttgggtttttagatttgtgattctcaactgatanaacgcaaatattccaaaatctgaaaaaaatcataaatctgaaacacttcttgtcccaagcatttcaaatgaaggatactcaacctgtagttgtttttatt

SEQ ID NO: 39548 - DNA, 201 bp, Homo sapiens
ccactgtgcccggccttgctcttgccttcttaattgcaactctgtactgacatgcatgttaataaattggccaaactggcattctcactgcagctctgttsttttccaatccttgaacctctcattatggatgcctcatctcatcctgttgccttttccactgtgggttgtattgatcagaaagcagatctgtttatggaa

SEQ ID NO: 39549 - DNA, 201 bp, Homo sapiens
  misc_feature (1)...(201): n = A,T,C or G, or insertion/deletion polymorphism (see Tables 1-2)
gtataggaaagaatcaaaaccaataacgcaatctaccacatctttgcatttaagaagtagattaaactgcatcccaggtccaaaaacaaaagcatatagtngagcagacagaatctctgtctgacatgtcttaatgtatatctaaaccattgatattggaccttgaaatatatttgacttggaaaaggcatgtggtcctga

SEQ ID NO: 39550 - DNA, 201 bp, Homo sapiens
ggagagtgttcaactaaaattaactctgtaggcagcattcccagttgtttgagtttcaggatcccctcctcaatttcctaagaaaaacaacatgcaagttaaaaaaaaaaataaacagtagttaggggcaaagaaaccggtgtaattagggctaaagtgatctgtggtatctctaaatggtagctccatttagagaatgat

SEQ ID NO: 39551 - DNA, 201 bp, Homo sapiens
tgactttcccctgccagtatgtcatccaactattctttaatgtactgtcaaaatatggtcacctcatcattaacaggaaatgggcttcttgcccagtcttwtgaaagtagaataaaatcagacagtttgatttttaaactataagaaaaggagaatgaaaaaacagcaaaacttaactaatttccaagctcagggctattt

SEQ ID NO: 39552 - DNA, 201 bp, Homo sapiens
  misc_feature (1)...(201): n = A,T,C or G, or insertion/deletion polymorphism (see Tables 1-2)
gagtgggtcagaggatgctgacgactgtgaaactagtgttgactggatcatccatatgggtgtagcagtccatttggacagtggcaagaaagtggatgttntgatgtcgacaagatttggatttggaccgtgcctgttccagttttagtactggaagtcccacatccttagaaacctctcattcctggacaaactgggatg

SEQ ID NO: 39553 - DNA, 201 bp, Homo sapiens
taagtatgtgaaagatttgtaaggcatctacaaaacaatatttggtattatttgttgagtttggccttcttgatgcttcccatattgtcttttattgccaygaatcctgtcttcccaagtgcctgacaaactcgtttggggcctaaattataggtaatatattctttctgactcttaaagtacctagtcatcatttaatac

SEQ ID NO: 39554 - DNA, 201 bp, Homo sapiens
agtggagggtgagtgggtcagaggatgctgacgactgtgaaactagtgttgactggatcatccatatgggtgtagcagtccatttggacagtggcaagaargtggatgttgtgatgtcgacaagatttggatttggaccgtgcctgttccagttttagtactggaagtcccacatccttagaaacctctcattcctggaca

SEQ ID NO: 39555 - DNA, 201 bp, Homo sapiens
accatgacgactaaatgcaacgcgggatcatggatcagaaaaaaagacatcagtgggacaatgtctttggggatagctgaaggtcgataggtaatttttgrtgttacttctcactttttatacacctgaaattattctgaagtgaagagtaataaaaactttagacatttggtctggtgccgtggctcatgcctgtagtcc

SEQ ID NO: 39556 - DNA, 201 bp, Homo sapiens
tatctatgcttaccagtacattttaaggcaagctgtgtcatttcagatgctcatatgtgtcaccaatcccattggggtcacatgagaggctggcatatggyacaatttgaaaataacacagtcatccagacaacccaggatatgctttttatgaaacttataaaaatggatggaaaaaaatggaaaaaataaaaaggaaat

SEQ ID NO: 39557 - DNA, 201 bp, Homo sapiens
aaaatgtctatgcataaaaggtgaaaaaaaatgctatctcagagccaaggttaacattcttggtagaaaaatagattacaatcaatattttttaattgagytttaaaaagaattctgatgcactaggttctgaggcattacaaggatatatatgtatatatatatggcaatttccccccacatttacttatttatttttaa

SEQ ID NO: 39558 - DNA, 201 bp, Homo sapiens
gttaatattgttttcttactgagaatgtgaacttttggatgtgattatcagctaatccagttggaattcaatcttggcattataacaggatcatatttacaacctacttcagtttccaaaaatcagccaactgagagaaaatattgtgatcaggaatttcaatgggaaagccaaaatctagagtgaaaacacatcttctgt

SEQ ID NO: 39559 - DNA, 201 bp, Homo sapiens
ttactgtaattgtagtagttcattcatttttcacttaaaaaattccattgtatgaatacaccagaatttatttatctatttctttttctttttttctctctttttttttttgagacaaggtcttgctgtgtctcccagcaggagtgcagtggcaggatcatggctcatggcagcctcccagcctcaggtgatcctcccacc

SEQ ID NO: 39560 - DNA, 201 bp, Homo sapiens
acacggtaacaatctgatctctctttcttttccccgcatttctcccttttcttttcgacaaaaccaccatcgtcatcatggcccgttctggatgattgctrtctctttggagctgttgggtacacttcccagatggggcggccgggcagaggcgttcctcacatcccagacggggtggcggccgggcagaggcgctcctca

SEQ ID NO: 39561 - DNA, 201 bp, Homo sapiens
aaagaattataaagattttttaaaaatttaagttaaaatagcttcttaaattattatatcaaattaatagagaagtattatttctttaatttgtttaactycccttgtgctcatctggagaaactgtcaggaaagatgatttttattaaaggcactgctgttacattcactcaggcatgattctgtcataacttcttggta

SEQ ID NO: 39562 - DNA, 201 bp, Homo sapiens
gatggcattaaccttttcgatgttatacttttggtagacctttctctagtttgatgagtgcaaaatacttctgtgaattttttacatgcataattttataytttttatggtcaagtctttatatcttttttctttgtaatttataatatttaaatttgtttgctatccagagataagatattcatgtaaatattcttatgg

SEQ ID NO: 39563 - DNA, 201 bp, Homo sapiens
  misc_feature (1)...(201): n = A,T,C or G, or insertion/deletion polymorphism (see Tables 1-2)
tgtttatagttgaagagagcaggaaaagactgatttcaggaaacagaacaaggtaaaataatctggtgtcagaatatttaatatggtctacaagggttatngggggaaaaaaaagtgggcattgccatgggctggattaatgtaggaaggcgtcattgagctgacagctgtgaacagcatcttaaaagataaggcagaaag

SEQ ID NO: 39564 - DNA, 201 bp, Homo sapiens
gtgaagagtttttccaagctgagataatggcctatgcaaaggcttggagcatgaaagagaatttcatatttgagctaacagtaacaagttcaggaattcagggtggatggagaagtatggagggcattttgtgccatgctaatgatatgatattggggtgtaagaaggatgtggccaccgtcctgggggcctacttaatcc

SEQ ID NO: 39565 - DNA, 201 bp, Homo sapiens
  misc_feature (1)...(201): n = A,T,C or G, or insertion/deletion polymorphism (see Tables 1-2)
tatggaagatttgcattaacatgtttatagttgaagagagcaggaaaagactgatttcaggaaacagaacaaggtaaaataatctggtgtcagaatatttnatatggtctacaagggttatagggggaaaaaaaagtgggcattgccatgggctggattaatgtaggaaggcgtcattgagctgacagctgtgaacagcat

SEQ ID NO: 39566 - DNA, 201 bp, Homo sapiens
tgaagagtttttccaagctgagataatggcctatgcaaaggcttggagcatgaaagagaatttcatatttgagctaacagtaacaagttcaggaattcagggtggatggagaagtatggagggcattttgtgccatgctaatgatatgatattggggtgtaagaaggatgtggccaccgtcctgggggcctacttaatcct

SEQ ID NO: 39567 - DNA, 201 bp, Homo sapiens
gaagagtttttccaagctgagataatggcctatgcaaaggcttggagcatgaaagagaatttcatatttgagctaacagtaacaagttcaggaattcagggtggatggagaagtatggagggcattttgtgccatgctaatgatatgatattggggtgtaagaaggatgtggccaccgtcctgggggcctacttaatcctc

SEQ ID NO: 39568 - DNA, 201 bp, Homo sapiens
tgttttggagaactatatgactagattgtggcaagtttctctttgcatctagggatgttaggggaaggtggtgatggcggcgctacaggagaaacaatgawtatagtgaatgaaattagtctcattaaaaagtggtggaggttctactatgtgctagcactgtgccaggctccaaagcctggataataacacagagaccct

SEQ ID NO: 39569 - DNA, 201 bp, Homo sapiens
agattgcacctctgcactacagcctgggtgatagagcgagactgtttaaaaaaaaaaattctacctttggagcatatacctaaaggtagccttatgctctrgggcactaggaagtctgttatccaaaaccatctctcttcccttccatgtgtcctcctaccaccagtctgttgctattagaaattcattccattgcctcca

SEQ ID NO: 39570 - DNA, 201 bp, Homo sapiens
taggacacagcagtgaacaaatcagcccaaaatctgccctcatgagcttaggtgtctggcaggcaaattctgtatctagcctgtttgtgtgaacttcctarctaggcattcagggaaggacagagatttatttactctacaaatatatattgaacacttcatatatgtcaaataatgctggatgctggggagatggaatga

SEQ ID NO: 39571 - DNA, 201 bp, Homo sapiens
gcatacatatgtatgtatgtaaatacatatataatagtaaaaaagaaaaggtagtggttacttttagtaagggaaaagcatgggtggaaagacatatatargagcttcaattttaatggtaccatcttaatttgtaagctgaatggtagatgaagaaatgatcattaagatgtaatgatatatttgggaggccaaaacagg

SEQ ID NO: 39572 - DNA, 201 bp, Homo sapiens
catactgccgaggatccatagttgattattagaattactctccattgggccgggtgtggtggtgcacacctgtaatcccagcactctgggaggccgaggcrggcggatcacgaggtcaggagatcaagaccatcctggctaacacagtgaaaccctgtctctactaaaaatacaaaaaattagccaggcatggtggcgggc

SEQ ID NO: 39573 - DNA, 201 bp, Homo sapiens
accacaatatacagcaatgtcccatttaaatcataagcataatacagaaattcgtgaacttgtaaaggcaggaaagagaacatctagttagaatgatcataaaaaaacttcaaggctattatggcagatacaaatatgaataagacactactagacttttttaagcccttaagtataggaatggcataatttatattcatt

SEQ ID NO: 39574 - DNA, 201 bp, Homo sapiens
tctccaaaatatagaactgaacaaagaaagaaaataagcaagtagcagtagcatgctagaatattatataactaataaaaagttaaaaactgggccaggcrcagtggctcacacctgtaatcccagcactttgggaggccaaggtgggtggatcagctgaggttgggagttcaagaccagcctggccaacatagtgaaacc

SEQ ID NO: 39575 - DNA, 201 bp, Homo sapiens
cgttagcacgcctgtaatcccaggctatttgggaggctgaggcaggagaattgcttgagcttgggagatcaaggctgtagtgagctgttccagcctgagcwgcagagtgagaccatatctcaaaaaaaaaaaaaaaaaaaaaaaaagaactgggaatataatcgttatgacacatttacctgtgcttaggttcatatgtta

SEQ ID NO: 39576 - DNA, 201 bp, Homo sapiens
taatgttaaattattgaaataaaatttcaactacatttgggtaaaagtgaattatgatcttaggagttcagtcatgaactattgaccatctcagtagttaytatttcccaaactgggcaaagtatgggtgagagtgtgtagaggggagacccaagaaaacatagaaatggtccatcacccttgggtctactcatctactga

SEQ ID NO: 39577 - DNA, 201 bp, Homo sapiens
actgacccagaaaccagagggcaaaggaacaaggaaaaagtaattctctgtgatacggaacagggtagagcggggacaggggataaatctaagagcaaaayaggacaagactagcacatggcctcaacttctctgctctccatggcaatgtcttcctcctcttctgtttccaggagtctctaattcctgccacttattgcc

SEQ ID NO: 39578 - DNA, 201 bp, Homo sapiens
aagagtttttccaagctgagataatggcctatgcaaaggcttggagcatgaaagagaatttcatatttgagctaacagtaacaagttcaggaattcagggtggatggagaagtatggagggcattttgtgccatgctaatgatatgatattggggtgtaagaaggatgtggccaccgtcctgggggcctacttaatcctca

SEQ ID NO: 39579 - DNA, 201 bp, Homo sapiens
aaatttggtgtcttttatttggcatttataaagacacctcaagccaaaggagtgccccatttccccattttcttttttttttctcttttctctctctctctttttttttttttgagctagggtctcatgccattacctaggctggagtacagtggtgtgatctcggctcactgcagcctcaacatccgtgggctcaggtga

SEQ ID NO: 39580 - DNA, 201 bp, Homo sapiens
gggagtctgtggtgggcagatcacttgaggtcaaaagtgcgagaccatcttgaccaacatagtgaaacccccactctacaaaaaatacaaaaattagccargcatggtgctgcgcgtccataattccagctagtcaggaggctaaggcatgaaaattgcttgaacccgggaggtggaggttgcaatgagctgagatcatgc

SEQ ID NO: 39581 - DNA, 201 bp, Homo sapiens
atacagaaactaatcaaaatgtaaattacaggtagtaacaacaagtgtttaccatgtactaagggtgtgctgtatgttaggcctattgtacacactttacytactttatttaatcccaagaaaagctacatgagataggtatgattttcttcattttatccctgaagaaactaaggtgtaaagaggttaactaacctgttt

SEQ ID NO: 39582 - DNA, 201 bp, Homo sapiens
tagctaatatttaataaatgctttatgtgtgtccagcattgtgttgtatgttatggaagatttgcattaacatgtttatagttgaagagagcaggaaaagwctgatttcaggaaacagaacaaggtaaaataatctggtgtcagaatatttaatatggtctacaagggttatagggggaaaaaaaagtgggcattgccatg

SEQ ID NO: 39583 - DNA, 201 bp, Homo sapiens
gttttcttcatttcatttttggaatgttcattgctagtatataaaaatccaggtgatttttgtatattgatcttgtatcctgcaaccttgctgaacttgttttttttttttgtttttgtttttttgtttttttgtttttttttttttgagatggagtcttgcactgtagccgaggctggagtgcaagctccacctcctgga

SEQ ID NO: 39584 - DNA, 201 bp, Homo sapiens
  misc_feature (1)...(201): n = A,T,C or G, or insertion/deletion polymorphism (see Tables 1-2)
actcctaagcacatcctatgtagaaattctggagccactgttgtcctttatattattttatagctaatatttaataaatgctttatgtgtgtccagcattntgttgtatgttatggaagatttgcattaacatgtttatagttgaagagagcaggaaaagactgatttcaggaaacagaacaaggtaaaataatctggtgt

SEQ ID NO: 39585 - DNA, 201 bp, Homo sapiens
ttcatttttggaatgttcattgctagtatataaaaatccaggtgatttttgtatattgatcttgtatcctgcaaccttgctgaacttgttttttttttttktttttgtttttttgtttttttgtttttttttttttgagatggagtcttgcactgtagccgaggctggagtgcaagctccacctcctggattcatgccatt

SEQ ID NO: 39586 - DNA, 201 bp, Homo sapiens
gtggaccttgaagtaagataaatgtgtgagtagcctctttctccttcttgatgcagggcacatggatgagatggttgggaaacactttttaagtccctgtsaatgtcaagaagtggcttgaaggggctttaatctctcaatcccttccccaccaaggtaccccagattaatgaacaattgataaaaagtgtgctttctatg

SEQ ID NO: 39587 - DNA, 201 bp, Homo sapiens
tggtgtacctgaaagtgacggggagaatggaaccaagttggaaaacactctgcaggatattatccaggagaacttccccaatctagcaaggcaggccaacrttcagattcaggaaatacagagaacgccacaaagatactcctcgagaagagcaactgcaagacacatagttgtcagattcaccaaagttgaaatgaagga

SEQ ID NO: 39588 - DNA, 201 bp, Homo sapiens
tgcaggatattatccaggagaacttccccaatctagcaaggcaggccaacattcagattcaggaaatacagagaacgccacaaagatactcctcgagaagwgcaactgcaagacacatagttgtcagattcaccaaagttgaaatgaaggaaacaatgttaagggcagccagagagaaaggttgggttaccctcaaaggga

SEQ ID NO: 39589 - DNA, 201 bp, Homo sapiens
  misc_feature (1)...(201): n = A,T,C or G, or insertion/deletion polymorphism (see Tables 1-2)
aattttcaacccagaatttcatatccagccaaactaagcttcataagtgaaggagaaataaaatcctttacagacaagcaaatgctgagagattttgtcancaccaggcctgccctaaaagagctcctgaaggaagtgctaaacatggaaaggaacaactggtaccagccactgcaaaatcatgccaaaacgtaaagacca

SEQ ID NO: 39590 - DNA, 201 bp, Homo sapiens
ttaggagggagtatatatgctaataggaaataaatgttttgcctcccaggagatcatcttagctggtacagtggattaaaaatggcctcaaattatttgarattttctcattgagaagtgggatctatgtcaccaccccttgaatctcagtagctttaaaaaattatggttaaatatacataatctttacattttaaacta

SEQ ID NO: 39591 - DNA, 201 bp, Homo sapiens
atctcgctctgttgcccaggctggagtgcagtggtgcgatcttggctcactacagcctctgcctcccaggttcaagcaattctcttgccttagcctcccgrgtagctgggattacaggcacatgccaccacccatgcccagctaatttttgtatttttagtagagacagggtttcaccatgttggccaggctgatctcgaa

SEQ ID NO: 39592 - DNA, 201 bp, Homo sapiens
agaagttcggagtcaattagattgatatgtttttactgcaattaaaaaaatggttttggaataggaacagctccggtctacagctcccagcgtgagcgacrcagaagatgggtgatttctgcatttccatctgaggtaccgggttcatctcactagggagtgccagacagtgggcgcaggtcagtgggtgcgcgcaccgtg

SEQ ID NO: 39593 - DNA, 201 bp, Homo sapiens
ttttttagattccacatatgagtgagatcatgacatatttgtctttctgtgcctggctttatttacttaacgtaatatccctgtttcattcatggtgttgyaagtggcaggattttcatttttttttatgactcaatattattccgttatgtatatatattgcatttaaaaaaatccatgtatctatcggtggacacttag

SEQ ID NO: 39594 - DNA, 201 bp, Homo sapiens
aggtcataaagatttactcctacagttttttctgtaagagttttgtagttttagctcttacgtttatatctgtggttcattttgtgttaatttctatacayggtgtgaagtaagggtccaacttcattcttttgcatgtagatatctagttgtcccagcatcatttgttgaaataaccattctttcctcattgaattgtct

SEQ ID NO: 39595 - DNA, 201 bp, Homo sapiens
actggtcatcagagaaatgcaaatcaaaaccacaatgtggtgatgactcttaacaagcatgctgccttcaagcatctgtttaacaaagcacatcttgcacygcccttaatccatttaaccctgagttgacacagcacatgtttcagagagcagggggttgagggtaaggttatagattaacagcatcccaaggcagaagaa

SEQ ID NO: 39596 - DNA, 201 bp, Homo sapiens
tccatcctggaccacagggtgagactctgtctcaaaacaaaacaaaacaacaacaaaaaataaactttagaaattagttttttaaaaaaaacatcaattcrcagactggtacactgtgctgagggaatgacgagaacaaagagatgaggagtggaagcttgggaaggctgggcacaggtggggccttcgggggatggccct

SEQ ID NO: 39597 - DNA, 201 bp, Homo sapiens
tgacatgaaatttagatcgaagtgcatgatttagagtgtgtttgcttactttgggtgaaaagtttagaaacacattgaattccttagaattctatctatarctttttttttttttttttttgagatggagtctcaccctgccacctgcgctggagtgcagtggtgcgatctcagctcactgcaacctttgcctgcctccta

SEQ ID NO: 39598 - DNA, 201 bp, Homo sapiens; identical to SEQ ID NO: 13664

SEQ ID NO: 39599 - DNA, 201 bp, Homo sapiens; identical to SEQ ID NO: 13690

SEQ ID NO: 39600 - DNA, 201 bp, Homo sapiens; identical to SEQ ID NO: 13666

SEQ ID NO: 39601 - DNA, 201 bp, Homo sapiens; identical to SEQ ID NO: 13670

SEQ ID NO: 39602 - DNA, 201 bp, Homo sapiens; identical to SEQ ID NO: 13692

SEQ ID NO: 39603 - DNA, 201 bp, Homo sapiens; identical to SEQ ID NO: 13680

SEQ ID NO: 39604 - DNA, 201 bp, Homo sapiens; identical to SEQ ID NO: 13668
  misc_feature (1)...(201): n = A,T,C or G, or insertion/deletion polymorphism (see Tables 1-2)

SEQ ID NO: 39605 - DNA, 201 bp, Homo sapiens; identical to SEQ ID NO: 13656

SEQ ID NO: 39606 - DNA, 201 bp, Homo sapiens; identical to SEQ ID NO: 13669

SEQ ID NO: 39607 - DNA, 201 bp, Homo sapiens; identical to SEQ ID NO: 13645
  misc_feature (1)...(201): n = A,T,C or G, or insertion/deletion polymorphism (see Tables 1-2)

SEQ ID NO: 39608 - DNA, 201 bp, Homo sapiens; identical to SEQ ID NO: 13676

SEQ ID NO: 39609 - DNA, 201 bp, Homo sapiens; identical to SEQ ID NO: 13701

SEQ ID NO: 39610 - DNA, 201 bp, Homo sapiens; identical to SEQ ID NO: 13646

SEQ ID NO: 39611 - DNA, 201 bp, Homo sapiens
actattctatcctgggtctgcctcaaccatgagataggagagtctccggtactagctgctgtagcagtgcccttcatccagggcagttaaaggagtattcraccctttctttctctgggatccctgcccagcaccttcctacagagatgaaaaaaaaaaaaaggaaaaacaacactccattccaaggagtctggtattcct

SEQ ID NO: 39612 - DNA, 201 bp, Homo sapiens
  misc_feature (1)...(201): n = A,T,C or G, or insertion/deletion polymorphism (see Tables 1-2)
gaaagatgtggagatggtacacacagttttgaagttggagtgagctctcttggttacagcttctcagtgtcaatagccggcaggtaataagctttccgatntgttggcacctatctcagagcagatcaaagaagtgataaccttttgggagaagaaccgaggcagcaagttgtttaatcagctgtcagctgtcagtgaaag

SEQ ID NO: 39613 - DNA, 201 bp, Homo sapiens
tatcctgggtctgcctcaaccatgagataggagagtctccggtactagctgctgtagcagtgcccttcatccagggcagttaaaggagtattcaacccttkctttctctgggatccctgcccagcaccttcctacagagatgaaaaaaaaaaaaaggaaaaacaacactccattccaaggagtctggtattcctgaatcct

SEQ ID NO: 39614 - DNA, 201 bp, Homo sapiens
cattccacgcaaaattgtttcctataagcattccttttattcactattctatcctgggtctgcctcaaccatgagataggagagtctccggtactagctgytgtagcagtgcccttcatccagggcagttaaaggagtattcaaccctttctttctctgggatccctgcccagcaccttcctacagagatgaaaaaaaaaa

SEQ ID NO: 39615 - DNA, 201 bp, Homo sapiens
tggccatctagcattccacgcaaaattgtttcctataagcattccttttattcactattctatcctgggtctgcctcaaccatgagataggagagtctccrgtactagctgctgtagcagtgcccttcatccagggcagttaaaggagtattcaaccctttctttctctgggatccctgcccagcaccttcctacagagat

SEQ ID NO: 39616 - DNA, 201 bp, Homo sapiens
aaaattggacagggcagtgggccgcctggaggcagtatcccatacctctgacatgcaccgtggatatggagatagtccttcaaaagcaggagcagctccayatgcgcaggcatttgactcgctgcttgcctgccctgtggcagagtacttgaagatcagtaaagagattggggaagacgtgcagaaagatgtggagatggt

SEQ ID NO: 39617 - DNA, 201 bp, Homo sapiens
gttagggaatgataagagaccttgggtggagatggtggtgtagtcaggagggaggtagtatgattttgtgacatgttctcaataaagattttgagtcttcratctctagataaccatactcccatgtgccttgttctatgactcttcatcatatttcatctcaggtggctgcagtgggacaagagccacaggtatttggaa

SEQ ID NO: 39618 - DNA, 201 bp, Homo sapiens
tctctctctcacacacacatacacacattgttccttctcattcttgatataccctctccctgtctctctctctctgtctctgtctctctctctctctctcwcacacacacacacacacaattgtttttctcattcttgatatacctcaggagcaaaatattgtcctccttaccttaagaaaaacctagagttttcatctag

SEQ ID NO: 39619 - DNA, 201 bp, Homo sapiens
gtgtagtcaggagggaggtagtatgattttgtgacatgttctcaataaagattttgagtcttcgatctctagataaccatactcccatgtgccttgttctrtgactcttcatcatatttcatctcaggtggctgcagtgggacaagagccacaggtatttggaagaagtcttcaagaaaatattgcctatggcctgaccca

SEQ ID NO: 39620 - DNA, 201 bp, Homo sapiens
atatggggatacctgggaccttcagtctgttccctgaacacaccctgatcccctttttttccgggttctttatagtgcagtgctggagttcgtgggtgacrggatctataacaacaccatgggccacgtgcacagccacttgcagggagaggtgtttggggctgtcctgcgccaggagacggagtttttccaacagaacca

SEQ ID NO: 39621 - DNA, 201 bp, Homo sapiens
ctctctctcacacacacatacacacattgttccttctcattcttgatataccctctccctgtctctctctctctgtctctgtctctctctctctctctctyacacacacacacacacaattgtttttctcattcttgatatacctcaggagcaaaatattgtcctccttaccttaagaaaaacctagagttttcatctagc

SEQ ID NO: 39622 - DNA, 201 bp, Homo sapiens
agtctgttccctgaacacaccctgatcccctttttttccgggttctttatagtgcagtgctggagttcgtgggtgacgggatctataacaacaccatgggycacgtgcacagccacttgcagggagaggtgtttggggctgtcctgcgccaggagacggagtttttccaacagaaccagacaggtttctcctgaaactctt

SEQ ID NO: 39623 - DNA, 201 bp, Homo sapiens
cgtgcacagccacttgcagggagaggtgtttggggctgtcctgcgccaggagacggagtttttccaacagaaccagacaggtttctcctgaaactctttcrttatacgccatgtactgttcatatcctcatacatctgctttgatctcccccctccccgctctctctctctcacacacacatacacacattgttccttctc

SEQ ID NO: 39624 - DNA, 201 bp, Homo sapiens
ttttgagtggcgcagccttgacccaaattcaggtctgcctgacttgaatgctcatctctttactactaagttatatttccttaaaatcgaatataaaaatkccaagtccatgggtagagaagaggactattcaatagtctttattcttctgtcacgtgtttcaccctagggttctcatttttatcctacttttgcaccctt

SEQ ID NO: 39625 - DNA, 201 bp, Homo sapiens
aggtcatatagcttttgagtggcgcagccttgacccaaattcaggtctgcctgacttgaatgctcatctctttactactaagttatatttccttaaaatckaatataaaaatgccaagtccatgggtagagaagaggactattcaatagtctttattcttctgtcacgtgtttcaccctagggttctcatttttatcctac

SEQ ID NO: 39626 - DNA, 201 bp, Homo sapiens
gagtgagaatctgagcttatttctgtggtacctggtgcgaggcctatgtctcttggggatcatgctctggggatcagtgtccctcaccatggtcaccctgrtcaccctgcctctgcttttccttctgcccaagaaggtgggaaaatggtaccaggtatgttcatggagttggcccgctctacacagaccctcatctcccag

SEQ ID NO: 39627 - DNA, 201 bp, Homo sapiens
cagggcaacggttggctccaagagcgaaaacgcaggtgcccagggctggctggctgctttgaagccattagctgcggcactgggcttggccctgccgggasttgccttgttccgagagctgatctcatggggagcccccgggtccgcggatagcaccaggctactgcactggggaagtcaccctaccgccttcgttgtcag

SEQ ID NO: 39628 - DNA, 201 bp, Homo sapiens
tgaccctggcatcctggctcattgttagttcgtctcatcacttggaacctgtctgattcacctcactctcttctccccaaccctgcaggtaacatcatgtytcgggtaacagaggacacgtccaccctgagtgattctctgagtgagaatctgagcttatttctgtggtacctggtgcgaggcctatgtctcttggggatc

SEQ ID NO: 39629 - DNA, 201 bp, Homo sapiens
gtttgccaacccgtgtgacatctcttgtccatgtatccacagttgctggaagtgcaggtgcgggaatctctggcaaagtccagccaggtggccattgaggytctgtcggccatgcctacagttcgaagctttgccaacgaggagggcgaagcccagaagtttagggaaaagctgcaagaaataaagacactcaaccagaag

SEQ ID NO: 39630 - DNA, 201 bp, Homo sapiens
ttcttttctagcttctccccacaatctgtctttaagaatttgatccccaacccgttctgagtcattttcctcttcctcgtatttctttagcatccaagggscatagctgtgtctctttctcttttctccttttcctctgtctcttctcacctttaatttccaaataggtaactcaggtattagtgtccctgatggtttgcc

SEQ ID NO: 39631 - DNA, 201 bp, Homo sapiens
ggaacgcagggcaagaggggaggacacaaggggactgggacaggaatcaaaggtaattgtcagtaaggtagagtagcgtgggttctgggaaatgtggagcrggagaaggactcctagcgtgggtcttggaacaccacttcggtgtagaagaaacggcactggactggcgggggccagaggttctgggctccattgctgacc

SEQ ID NO: 39632 - DNA, 201 bp, Homo sapiens
ccggcggtcagggcggctctggaaaccctgtgcgtcggcttctaggctgcctgggctcggagacgcgccgcctctcgctgttcctggtcctggtggtcctstcctctcttggtaaggggaacgcagggcaagaggggaggacacaaggggactgggacaggaatcaaaggtaattgtcagtaaggtagagtagcgtgggtt

SEQ ID NO: 39633 - DNA, 201 bp, Homo sapiens
ctgtggcctatgcagtcaactcctggaccactagtgtgagcacctgaagatgaatacccattcccttgtccttaagatgccgtgactccattcccattccyatgaccctgctcccactcctcctttactgggaaatggttggttcagtattttcgtcctagcaacctgaggctcaatgactctactcagtgtccctagccc

SEQ ID NO: 39634 - DNA, 201 bp, Homo sapiens
gcactgagatttgcagacctctggagaaccctaaccttgtttcctgcagcctccttagaaccccatgttgacacccctgaccctggcatcctggctcattkttagttcgtctcatcacttggaacctgtctgattcacctcactctcttctccccaaccctgcaggtaacatcatgtctcgggtaacagaggacacgtcca

SEQ ID NO: 39635 - DNA, 201 bp, Homo sapiens
cctgatcaccctgcctctgcttttccttctgcccaagaaggtgggaaaatggtaccaggtatgttcatggagttggcccgctctacacagaccctcatctyccagacttggcagactcagttcctctcacattgctttcagtccagctttcctggcacccttactgattctccatcttcatggaacaccctgtccctgtgg

SEQ ID NO: 39636 - DNA, 201 bp, Homo sapiens
ttcctcatttttcaaaaatggagtgatataaccttctttataaggctcttcatgtattagctgacatcacatgaatgaaagccttttgtgaagagtaaaaygctccccagacaaggtgatagtggtgatggtggtgaagataactgtgacttgcatgatgtgcattgagtcagactccatggggtctctggttcattctcc

SEQ ID NO: 39637 - DNA, 201 bp, Homo sapiens
ggtgaagataactgtgacttgcatgatgtgcattgagtcagactccatggggtctctggttcattctcctgtctgcctattgagcctgccgatgtcacttrggagacagggacttgatatttccttcaggttaatgactgtggttctttgtgtcccctccagatttctctacctcagtccctttttttgtggtctctttat

SEQ ID NO: 39638 - DNA, 201 bp, Homo sapiens
atcttggctcactgcagcttcaacctgctgggctcaagcgattctcccctcagcctcccgagtagctgggactacaggtgtacaccactatgcctggttgrcttttatatttttagtagagatgggtttcaccatgttgcccaggctggccttgaattcctgagctcaggtaatctgcccccctcagcctcccaaagggct

SEQ ID NO: 39639 - DNA, 201 bp, Homo sapiens
gggcgcggagagtcccaggcccggccgggaccgggacggcgtccgagtgccaatggctagctctaggtgtcccgctccccgcgggtgccgctgcctccccsgagcttctctcgcatggctggggacagtactgctacttctcgccgactgggtgctgctccggaccgcgctgccccgcatattctccctgctggtgcccac

SEQ ID NO: 39640 - DNA, 201 bp, Homo sapiens
acttgcagggagaggtgtttggggctgtcctgcgccaggagacggagtttttccaacagaaccagacaggtttctcctgaaactctttcattatacgccaygtactgttcatatcctcatacatctgctttgatctcccccctccccgctctctctctctcacacacacatacacacattgttccttctcattcttgatat

SEQ ID NO: 39641 - DNA, 201 bp, Homo sapiens
gggaatcctctacattggtgggcagctggtgaccagtggggctgtaagcagtgggaaccttgtcacatttgttctctaccagatgcagttcacccaggctktggaggtgaggtccctccaccttcactccccagtgtgattccttcctctggcccagcaccatctgtgtgatgtccttccattctttacccttcttgcttc

SEQ ID NO: 39642 - DNA, 201 bp, Homo sapiens
cacccctcgctgcccacccagtggtctgttgactcccttacacttggagggccttgtccagttccaagatgtctcctttgcctacccaaaccgcccagatrtcttagtgctacaggtacaacctaccactccctgtattccactggccccaactgcaattctgccatcctaaattttcttcctgccttcagcctgcttact

SEQ ID NO: 39643 - DNA, 201 bp, Homo sapiens
ccctcgttccctcccccagccgccagtaggggaggactcggcggtacccggagcttcaggccccaccggggcgcggagagtcccaggcccggccgggaccrggacggcgtccgagtgccaatggctagctctaggtgtcccgctccccgcgggtgccgctgcctccccggagcttctctcgcatggctggggacagtactg

SEQ ID NO: 39644 - DNA, 201 bp, Homo sapiens
ttgctaccaaaatagtctgggcaggccacttttggaagtaggcgttatctagtgagcaggcggccgctttcgatttcgctttcccctaaatggctgagctkctcgccagcgcaggatcagcctgttcctgggactttccgagagccccgccctcgttccctcccccagccgccagtaggggaggactcggcggtacccgga

SEQ ID NO: 39645 - DNA, 201 bp, Homo sapiens
gagatggtggtgtagtcaggagggaggtagtatgattttgtgacatgttctcaataaagattttgagtcttcgatctctagataaccatactcccatgtgycttgttctatgactcttcatcatatttcatctcaggtggctgcagtgggacaagagccacaggtatttggaagaagtcttcaagaaaatattgcctatgg

SEQ ID NO: 39646 - DNA, 201 bp, Homo sapiens
aggtccctccaccttcactccccagtgtgattccttcctctggcccagcaccatctgtgtgatgtccttccattctttacccttcttgcttcacataatgmtggcaagcagactacctcactttcactattcttacctccctctaggtactgctctccatctaccccagagtacagaaggctgtgggctcctcagagaaaa

SEQ ID NO: 39647 - DNA, 201 bp, Homo sapiens
ggtgctgggtctctgcccttgtctttgccgcttcttctatctctactccttggggaggcatcacccagaaatctgtgcatgtgggagggtaggagtttctrtatttccctgtttttcttctggggtaagacatcatgctatgtaacaaggcaatgacactctcaaggttagaggccttggtagcctcttatcgtgtgcttc

SEQ ID NO: 39648 - DNA, 201 bp, Homo sapiens
tttttccctttcctggtggtatctgacatcaagtgtgtggcatagtggtgctgggtctctgcccttgtctttgccgcttcttctatctctactccttgggraggcatcacccagaaatctgtgcatgtgggagggtaggagtttctatatttccctgtttttcttctggggtaagacatcatgctatgtaacaaggcaatg

SEQ ID NO: 39649 - DNA, 201 bp, Homo sapiens
ttaacctccatactctctgggtcttcttttctagcttctccccacaatctgtctttaagaatttgatccccaacccgttctgagtcattttcctcttcctygtatttctttagcatccaaggggcatagctgtgtctctttctcttttctccttttcctctgtctcttctcacctttaatttccaaataggtaactcaggt

SEQ ID NO: 39650 - DNA, 201 bp, Homo sapiens
cttttcctttgtaatttggaatgtgatttttccctttcctggtggtatctgacatcaagtgtgtggcatagtggtgctgggtctctgcccttgtctttgcygcttcttctatctctactccttggggaggcatcacccagaaatctgtgcatgtgggagggtaggagtttctatatttccctgtttttcttctggggtaag

SEQ ID NO: 39651 - DNA, 201 bp, Homo sapiens
tgtgcattgagtcagactccatggggtctctggttcattctcctgtctgcctattgagcctgccgatgtcacttaggagacagggacttgatatttccttyaggttaatgactgtggttctttgtgtcccctccagatttctctacctcagtccctttttttgtggtctctttatagatttcaggtatgctgctgaaagtg

SEQ ID NO: 39652 - DNA, 201 bp, Homo sapiens
ccttgtctttgccgcttcttctatctctactccttggggaggcatcacccagaaatctgtgcatgtgggagggtaggagtttctatatttccctgtttttsttctggggtaagacatcatgctatgtaacaaggcaatgacactctcaaggttagaggccttggtagcctcttatcgtgtgcttctctggcctctaggggc

SEQ ID NO: 39653 - DNA, 201 bp, Homo sapiens
tctctactccttggggaggcatcacccagaaatctgtgcatgtgggagggtaggagtttctatatttccctgtttttcttctggggtaagacatcatgctrtgtaacaaggcaatgacactctcaaggttagaggccttggtagcctcttatcgtgtgcttctctggcctctaggggctgacattcaccctacgccctggc

SEQ ID NO: 39654 - DNA, 201 bp, Homo sapiens
ttcctttcagtatggtacataaaatccacccaaccatgtggattggagagatgcgtgtcttccagtcctagggccttcctttgcctctcaggggaagtgcmgggcgccataaattcttgcacctgggactgcttcatgctggtaccttgtagatttgttagtgagagtgatgggaatagtggaagccagggatgagggaca

SEQ ID NO: 39655 - DNA, 201 bp, Homo sapiens
gggaggcatcacccagaaatctgtgcatgtgggagggtaggagtttctatatttccctgtttttcttctggggtaagacatcatgctatgtaacaaggcartgacactctcaaggttagaggccttggtagcctcttatcgtgtgcttctctggcctctaggggctgacattcaccctacgccctggcgaggtgacggcgc

SEQ ID NO: 39656 - DNA, 201 bp, Homo sapiens
ttccgagagccccgccctcgttccctcccccagccgccagtaggggaggactcggcggtacccggagcttcaggccccaccggggcgcggagagtcccagrcccggccgggaccgggacggcgtccgagtgccaatggctagctctaggtgtcccgctccccgcgggtgccgctgcctccccggagcttctctcgcatggc

SEQ ID NO: 39657 - DNA, 201 bp, Homo sapiens
tttcagtatggtacataaaatccacccaaccatgtggattggagagatgcgtgtcttccagtcctagggccttcctttgcctctcaggggaagtgcagggmgccataaattcttgcacctgggactgcttcatgctggtaccttgtagatttgttagtgagagtgatgggaatagtggaagccagggatgagggacatctg

SEQ ID NO: 39658 - DNA, 201 bp, Homo sapiens
tgagcactctgaaagaggggttagggaatgataagagaccttgggtggagatggtggtgtagtcaggagggaggtagtatgattttgtgacatgttctcartaaagattttgagtcttcgatctctagataaccatactcccatgtgccttgttctatgactcttcatcatatttcatctcaggtggctgcagtgggacaa

SEQ ID NO: 39659 - DNA, 201 bp, Homo sapiens
acccaaccatgtggattggagagatgcgtgtcttccagtcctagggccttcctttgcctctcaggggaagtgcagggcgccataaattcttgcacctgggmctgcttcatgctggtaccttgtagatttgttagtgagagtgatgggaatagtggaagccagggatgagggacatctgtgatgcactggaaagagagctac

SEQ ID NO: 39660 - DNA, 201 bp, Homo sapiens
cctatttaggttcgggattgagacgtcagtgtttcctttctgctgatgccctccaggataatggtgagggggaggaggcgtggtggggccagtctgactgraactgacctacttagacttaatatttgtgcgtgacctctcttctctttctccaggggagatggccattccattctttacgggccgcctcactgactggat

SEQ ID NO: 39661 - DNA, 201 bp, Homo sapiens
agactccatggggtctctggttcattctcctgtctgcctattgagcctgccgatgtcacttaggagacagggacttgatatttccttcaggttaatgactrtggttctttgtgtcccctccagatttctctacctcagtccctttttttgtggtctctttatagatttcaggtatgctgctgaaagtgggaatcctctaca

SEQ ID NO: 39662 - DNA, 201 bp, Homo sapiens
tgtggcctatgcagtcaactcctggaccactagtgtgagcacctgaagatgaatacccattcccttgtccttaagatgccgtgactccattcccattcctrtgaccctgctcccactcctcctttactgggaaatggttggttcagtattttcgtcctagcaacctgaggctcaatgactctactcagtgtccctagcccc

SEQ ID NO: 39663 - DNA, 201 bp, Homo sapiens
cgggacttgccttgttccgagagctgatctcatggggagcccccgggtccgcggatagcaccaggctactgcactggggaagtcaccctaccgccttcgtygtcagttatgcagcggcactgcccgcagcagccctgtggcacaaactcgggagcctctgggtgcccggcggtcagggcggctctggaaaccctgtgcgtc

SEQ ID NO: 39664 - DNA, 201 bp, Homo sapiens
ttctctctgtggtggagaaccacagctgcagagtaggcagctgcctccaggatgagttacttgaaatttgccttgagtgtgttacctcctttccaagctcytcgtgataatgcagacttcctggagtacaaacacaggatttgtaattccttactgtaacggagtttagagccagggctgatgctttggtgtggccagcac

SEQ ID NO: 39665 - DNA, 201 bp, Homo sapiens
atcttcccagaatctcccctatccagctacaaccgtcagatcttggtgtgtgtgagtgcgtgaatgcatgagtgtgtctgtgtgcatgtacatgcgtgcayacatgtggctataccgttctcatcttggccctttgctctgcagaggtagacgaggctgggagccagctgtcagggggtcagcgacaggcagtggcgttgg

SEQ ID NO: 39666 - DNA, 201 bp, Homo sapiens
tcttggccctttgctctgcagaggtagacgaggctgggagccagctgtcagggggtcagcgacaggcagtggcgttggcccgagcattgatccggaaaccrtgtgtacttatcctggatgatgccaccagtgccctggatgcaaacagccagttacaggtgaggcagtcatcttcttaatggctatatcccacccaatctt

SEQ ID NO: 39667 - DNA, 201 bp, Homo sapiens
tgtgagtgcgtgaatgcatgagtgtgtctgtgtgcatgtacatgcgtgcacacatgtggctataccgttctcatcttggccctttgctctgcagaggtagrcgaggctgggagccagctgtcagggggtcagcgacaggcagtggcgttggcccgagcattgatccggaaaccgtgtgtacttatcctggatgatgccacc

SEQ ID NO: 39668 - DNA, 201 bp, Homo sapiens
agcattgatccggaaaccgtgtgtacttatcctggatgatgccaccagtgccctggatgcaaacagccagttacaggtgaggcagtcatcttcttaatggmtatatcccacccaatcttgcttcttttatacatcttctgttagttttactaacatcataattatacaaaccagtccttgcagttctcagttcccaaatcc

SEQ ID NO: 39669 - DNA, 201 bp, Homo sapiens
gcatgtacatgcgtgcacacatgtggctataccgttctcatcttggccctttgctctgcagaggtagacgaggctgggagccagctgtcagggggtcagcracaggcagtggcgttggcccgagcattgatccggaaaccgtgtgtacttatcctggatgatgccaccagtgccctggatgcaaacagccagttacaggtg

SEQ ID NO: 39670 - DNA, 201 bp, Homo sapiens
cattgatccggaaaccgtgtgtacttatcctggatgatgccaccagtgccctggatgcaaacagccagttacaggtgaggcagtcatcttcttaatggctrtatcccacccaatcttgcttcttttatacatcttctgttagttttactaacatcataattatacaaaccagtccttgcagttctcagttcccaaatccag

SEQ ID NO: 39671 - DNA, 201 bp, Homo sapiens
gactccatggggtctctggttcattctcctgtctgcctattgagcctgccgatgtcacttaggagacagggacttgatatttccttcaggttaatgactgyggttctttgtgtcccctccagatttctctacctcagtccctttttttgtggtctctttatagatttcaggtatgctgctgaaagtgggaatcctctacat

SEQ ID NO: 39672 - DNA, 201 bp, Homo sapiens
caccctgcaaatgagggagttggaagttggggctgctgtccgaaatgcacttatatggggatacctgggaccttcagtctgttccctgaacacaccctgaycccctttttttccgggttctttatagtgcagtgctggagttcgtgggtgacgggatctataacaacaccatgggccacgtgcacagccacttgcagggag

SEQ ID NO: 39673 - DNA, 201 bp, Homo sapiens
gagttacttgaaatttgccttgagtgtgttacctcctttccaagctcctcgtgataatgcagacttcctggagtacaaacacaggatttgtaattccttastgtaacggagtttagagccagggctgatgctttggtgtggccagcactctgaaactgagaaatgttcagaatgtacggaaagatgatcagctattttcaa

SEQ ID NO: 39674 - DNA, 201 bp, Homo sapiens
agcgtcccgctatgttgcccaggctggccttgaactcctgggcccaagtgatcctccctccttgacctcccaaagtgctaggattataggcatgagccacygggcccagcccatcctaatcatattaatattaattaagctagtctgtttacatgcactgtcactcatttattcattaggaatccttctgagctaggcatt

SEQ ID NO: 39675 - DNA, 201 bp, Homo sapiens
aatgcacttatatggggatacctgggaccttcagtctgttccctgaacacaccctgatcccctttttttccgggttctttatagtgcagtgctggagttcktgggtgacgggatctataacaacaccatgggccacgtgcacagccacttgcagggagaggtgtttggggctgtcctgcgccaggagacggagtttttcca

SEQ ID NO: 39676 - DNA, 201 bp, Homo sapiens
tctctaccagatgcagttcacccaggctgtggaggtgaggtccctccaccttcactccccagtgtgattccttcctctggcccagcaccatctgtgtgatktccttccattctttacccttcttgcttcacataatgctggcaagcagactacctcactttcactattcttacctccctctaggtactgctctccatctac

SEQ ID NO: 39677 - DNA, 201 bp, Homo sapiens
aaacacaggtgtctccctgggctgagggtagtccccggctctgacggtccgatgtctttcctcaggtggagcagctcctgtacgaaagccctgagcggtaytcccgctcagtgcttctcatcacccagcacctcagcctggtggagcaggctgaccacatcctctttctggaaggaggcgctatccgggaggggggaaccc

SEQ ID NO: 39678 - DNA, 201 bp, Homo sapiens
ctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaatt

SEQ ID NO: 39679 - DNA, 201 bp, Homo sapiens
gctccgcctcccgggttcacgccgttctcccgcctcagcctcctgagtagctgggactacaggcacccgccaccacgcccggctaattttttttttttttttgtatttttagtagagacgaggtttctccgtgttagccaggatggtctcaatctcctgaccttgtgatccgcccacttcggcctcccaaagtgctggaat

SEQ ID NO: 39680 - DNA, 201 bp, Homo sapiens
actccattcccattcctatgaccctgctcccactcctcctttactgggaaatggttggttcagtattttcgtcctagcaacctgaggctcaatgactctactcagtgtccctagccccctccctctctttaaagatgctaggtggcttcctttcagtatggtacataaaatccacccaaccatgtggattggagagatgcg

SEQ ID NO: 39681 - DNA, 201 bp, Homo sapiens
ctcaggattctgttcatcttcccagaatctcccctatccagctacaaccgtcagatcttggtgtgtgtgagtgcgtgaatgcatgagtgtgtctgtgtgcytgtacatgcgtgcacacatgtggctataccgttctcatcttggccctttgctctgcagaggtagacgaggctgggagccagctgtcagggggtcagcgac

SEQ ID NO: 39682 - DNA, 201 bp, Homo sapiens
gctcctgcagatgctccagaatgaaagccttctcagacctgcgcactccatctccctcccttttcttctctctgtggtggagaaccacagctgcagagtakgcagctgcctccaggatgagttacttgaaatttgccttgagtgtgttacctcctttccaagctcctcgtgataatgcagacttcctggagtacaaacaca

SEQ ID NO: 39683 - DNA, 201 bp, Homo sapiens
cgcgcgcttcgacagcgacgtgggggagttccgggcggtgacggagctggggcggcctgctgcggagtactggaacagccagaaggacatcctggaggagragcgggcagtgccggacaggatgtgcagacacaactacgagctgggcgggcccatgaccctgcagcgccgaggtgagtgagggctttgggccggcggtcc

SEQ ID NO: 39684 - DNA, 201 bp, Homo sapiens
agagagccctaagctggagtgtccaggctctgaggatcactgaggattcagtgctcacgaagaatgcctcttattccccagggtggagcaggagcccacaycccttggacaattaaggagagaagggagggagggggataggttttagcccctgaaggcattctcattaaaggtacttctcccagcctccccagaacttgg

SEQ ID NO: 39685 - DNA, 201 bp, Homo sapiens
gggggagttccgggcggtgacggagctggggcggcctgctgcggagtactggaacagccagaaggacatcctggaggagaagcgggcagtgccggacaggrtgtgcagacacaactacgagctgggcgggcccatgaccctgcagcgccgaggtgagtgagggctttgggccggcggtcccagggcagccccgcgggcccg

SEQ ID NO: 39686 - DNA, 201 bp, Homo sapiens
atcttcatgcacaggaggagcaagaaaggtgagaaagcctgcagggtgagcgggacttaccttcccctggcatattcacacttattccacgatgaggggtytgacagaaaagaaatgtcagaaagctctagaggccactgatatcagataatcggggaacaaacatgacctatagcgagagagggatcccaggctgggatc

SEQ ID NO: 39687 - DNA, 201 bp, Homo sapiens
gggagttccgggcggtgacggagctggggcggcctgctgcggagtactggaacagccagaaggacatcctggaggagaagcgggcagtgccggacaggatrtgcagacacaactacgagctgggcgggcccatgaccctgcagcgccgaggtgagtgagggctttgggccggcggtcccagggcagccccgcgggcccgtg

SEQ ID NO: 39688 - DNA, 201 bp, Homo sapiens
gtctgatgggcaggtagacagaagggtctgcagccggggaggagactgagatacatgagaccatccagggagaggggacccagggggaagagcaaaggacyggatcctgggaactggacagttgtgatttggccaagacagaaaagcctgtgaaagagaccaaaaaaacccaagtgcagtgtgaggagaggcccgcagaga

SEQ ID NO: 39689 - DNA, 201 bp, Homo sapiens
agcattcaagtccgatggttcctgaatggacaggaggaaacagctggggtcgtgtccaccaacctgatccgtaatggagactggaccttccagatcctggwgatgctggaaatgaccccccagcagggagatgtctacacctgccaagtggagcacaccagcctggatagtcctgtcaccgtggagtggagtgagtctctg

SEQ ID NO: 39690 - DNA, 201 bp, Homo sapiens
gctctgcgacccgcttaggaccacagaactcggtactaggaaaactcctattttaaaatccagccctgggtgggaagatttgggaagaatcgttaatattragagagagagggagaaagaggattagatgagagtggcgcctccgctcatgtccgccccctccccgcagagaattaccttttccagggacggcaggaatgc

SEQ ID NO: 39691 - DNA, 201 bp, Homo sapiens
atgaaaatgggagaatccacactcagagtggggcaattgaacaggcaggggcggatggatggcagaggaggaggaatctggactcaaggagctggggggcyctgggcctggaattttagggtctggggcccaaggcaccaggagaagaggcaggtcaggatatctgagtcaagacctgggatcttgccttagcaatgacac

SEQ ID NO: 39692 - DNA, 201 bp, Homo sapiens
ccgccccctccccgcagagaattaccttttccagggacggcaggaatgctacgcgtttaatgggacacagcgcttcctggagagatacatctacaaccggsaggagttcgcgcgcttcgacagcgacgtgggggagttccgggcggtgacggagctggggcggcctgctgcggagtactggaacagccagaaggacatcct

SEQ ID NO: 39693 - DNA, 201 bp, Homo sapiens
cacccctgttccagatatgagggtggctctttctgaatttcctcttagcaagctttttccgctgcactgtcctcatcccgatatgctgcatcaggctccakaatctcagacaggacatgagtagggatgcagctggtggaggtgacactaaacctgggtctgtccttcccagaggcacagtctgattctgcccggagtaag

SEQ ID NO: 39694 - DNA, 201 bp, Homo sapiens
aaattctctctctgcgtggtgagaaaacaggcctggagaggctctgcgacccgcttaggaccacagaactcggtactaggaaaactcctattttaaaatcyagccctgggtgggaagatttgggaagaatcgttaatattgagagagagagggagaaagaggattagatgagagtggcgcctccgctcatgtccgccccct

SEQ ID NO: 39695 - DNA, 201 bp, Homo sapiens
tctctgcgtggtgagaaaacaggcctggagaggctctgcgacccgcttaggaccacagaactcggtactaggaaaactcctattttaaaatccagccctgrgtgggaagatttgggaagaatcgttaatattgagagagagagggagaaagaggattagatgagagtggcgcctccgctcatgtccgccccctccccgcag

SEQ ID NO: 39696 - DNA, 201 bp, Homo sapiens
cgtggtgagaaaacaggcctggagaggctctgcgacccgcttaggaccacagaactcggtactaggaaaactcctattttaaaatccagccctgggtgggwagatttgggaagaatcgttaatattgagagagagagggagaaagaggattagatgagagtggcgcctccgctcatgtccgccccctccccgcagagaatt

SEQ ID NO: 39697 - DNA, 201 bp, Homo sapiens
attatttttcttccacgctcctagtccagcctagggtgaatgtttccccctccaagaaggggcccttgcagcaccacaacctgcttgtctgccacgtgacrgatttctacccaggcagcattcaagtccgatggttcctgaatggacaggaggaaacagctggggtcgtgtccaccaacctgatccgtaatggagactgga

SEQ ID NO: 39698 - DNA, 201 bp, Homo sapiens
aggaggaaacagctggggtcgtgtccaccaacctgatccgtaatggagactggaccttccagatcctggtgatgctggaaatgaccccccagcagggagaygtctacacctgccaagtggagcacaccagcctggatagtcctgtcaccgtggagtggagtgagtctctgatgaccctctagaccccacctctgaagagca

SEQ ID NO: 39699 - DNA, 201 bp, Homo sapiens
acagctggggtcgtgtccaccaacctgatccgtaatggagactggaccttccagatcctggtgatgctggaaatgaccccccagcagggagatgtctacayctgccaagtggagcacaccagcctggatagtcctgtcaccgtggagtggagtgagtctctgatgaccctctagaccccacctctgaagagcaggggactc

SEQ ID NO: 39700 - DNA, 201 bp, Homo sapiens
tccgtaatggagactggaccttccagatcctggtgatgctggaaatgaccccccagcagggagatgtctacacctgccaagtggagcacaccagcctggayagtcctgtcaccgtggagtggagtgagtctctgatgaccctctagaccccacctctgaagagcaggggactctctggctctggggtccactcatcttatc

SEQ ID NO: 39701 - DNA, 201 bp, Homo sapiens
ttattccacgatgaggggtttgacagaaaagaaatgtcagaaagctctagaggccactgatatcagataatcggggaacaaacatgacctatagcgagagdgggatcccaggctgggatcttaatgcagccagatgcatgaggtcccaagtactcaggctcctgcggagcgtccattgagtgatgggcaatggaatttggt

SEQ ID NO: 39702 - DNA, 201 bp, Homo sapiens
attcacacttattccacgatgaggggtttgacagaaaagaaatgtcagaaagctctagaggccactgatatcagataatcggggaacaaacatgacctatrgcgagagagggatcccaggctgggatcttaatgcagccagatgcatgaggtcccaagtactcaggctcctgcggagcgtccattgagtgatgggcaatgg

SEQ ID NO: 39703 - DNA, 201 bp, Homo sapiens
cctccccgcagagaattaccttttccagggacggcaggaatgctacgcgtttaatgggacacagcgcttcctggagagatacatctacaaccgggaggagytcgcgcgcttcgacagcgacgtgggggagttccgggcggtgacggagctggggcggcctgctgcggagtactggaacagccagaaggacatcctggagga

SEQ ID NO: 39704 - DNA, 201 bp, Homo sapiens
cgggacttaccttcccctggcatattcacacttattccacgatgaggggtttgacagaaaagaaatgtcagaaagctctagaggccactgatatcagatartcggggaacaaacatgacctatagcgagagagggatcccaggctgggatcttaatgcagccagatgcatgaggtcccaagtactcaggctcctgcggagc

SEQ ID NO: 39705 - DNA, 201 bp, Homo sapiens
gtgggatgagggacagtgttgggagccaccaaggaaacccagaggtgggggagcagagagcagaagggggcatgtgatgctgggcagtgaaagggaggacrggcaaaggctgggttgaggtttgtagggggaatgagatgaggcagtggagccatgtgacagggactgagggtagattactggagctccctgcgtagaatg

SEQ ID NO: 39706 - DNA, 201 bp, Homo sapiens
tgaattaagaggatggaaaagcagaaaaacagcaaaaagaaaatacatgtaaataataaggacaaaagctgaattcaatgaaatataaaaatagagaagayaaaatcaaattttgaggcaatgaaaactttaatgagacctctggcaagactcctaaggaaaatacaggagattcagaacgaaaagggtaaatgacattta

SEQ ID NO: 39707 - DNA, 201 bp, Homo sapiens
tcagccctgggaactgcagaggggtgaggctggggagagaggaggctggagcagcactggtgacactgaacagtgtcaggaggaagtgacggatgcagcgyccccatcccataggcagagctgtcatgtgggatgagggacagtgttgggagccaccaaggaaacccagaggtgggggagcagagagcagaagggggcatg

SEQ ID NO: 39708 - DNA, 201 bp, Homo sapiens
aaatagtggaggaagaggaaataactgaaaacataatagatgtttagtctttatagaaagatgaaataagttcattcaaaatgctgcatagaatgtcagaytgttaaacaattttgttagagtaaaatgactgtaaacaaatgagctaattatgtgaattaagaggatggaaaagcagaaaaacagcaaaaagaaaataca

SEQ ID NO: 39709 - DNA, 201 bp, Homo sapiens
ctcagccctgggaactgcagaggggtgaggctggggagagaggaggctggagcagcactggtgacactgaacagtgtcaggaggaagtgacggatgcagcrcccccatcccataggcagagctgtcatgtgggatgagggacagtgttgggagccaccaaggaaacccagaggtgggggagcagagagcagaagggggcat

SEQ ID NO: 39710 - DNA, 201 bp, Homo sapiens
aggagaatttgggaatttgaagcaaaagcaagaagccactgaatcaagcacaaatattgagctttgataaagattggaataagaaacataataaatgagayaagaaataggacttttgcaactgaagtgtaattaataaacaaaaagccaaactgagaaactgtcccaaggacaatatgatcgagtaaacaatagaaaatg

SEQ ID NO: 39711 - DNA, 201 bp, Homo sapiens
cggctcagccctgggaactgcagaggggtgaggctggggagagaggaggctggagcagcactggtgacactgaacagtgtcaggaggaagtgacggatgcrgcgcccccatcccataggcagagctgtcatgtgggatgagggacagtgttgggagccaccaaggaaacccagaggtgggggagcagagagcagaaggggg

SEQ ID NO: 39712 - DNA, 201 bp, Homo sapiens
aaggaaggaaggaaggaaggaaggaaggaaggaaagaaggacaatctcaaattctatttcattatttttcttccacgctcctagtccagcctagggtgaaygtttccccctccaagaaggggcccttgcagcaccacaacctgcttgtctgccacgtgacggatttctacccaggcagcattcaagtccgatggttcctga

SEQ ID NO: 39713 - DNA, 201 bp, Homo sapiens
taaccagcaggacggctcagccctgggaactgcagaggggtgaggctggggagagaggaggctggagcagcactggtgacactgaacagtgtcaggaggargtgacggatgcagcgcccccatcccataggcagagctgtcatgtgggatgagggacagtgttgggagccaccaaggaaacccagaggtgggggagcagag

SEQ ID NO: 39714 - DNA, 201 bp, Homo sapiens
tagcaatgacactggagactaaaggtggactccatggtgcccttgagcccagccctaccccatctccactatcctctgccaccagctgtgcaacttctgcwaggggtgaggttaataaactggagaagttaatttgtggagcatgaaacagatgagcagaacaatcacagcaccttaatttccccagtgtgcccaagaaca

SEQ ID NO: 39715 - DNA, 201 bp, Homo sapiens
gtctttggggaaaatgggaccaagaggtcctggataaccttggacagacaaggtttgcagagagagaagttggcaagtgcaggctcctgggcgtgttcatrtctgcatccagcctggaggggactcaggcagagagccctaagctggagtgtccaggctctgaggatcactgaggattcagtgctcacgaagaatgcctct

SEQ ID NO: 39716 - DNA, 201 bp, Homo sapiens
cctggagaggctctgcgacccgcttaggaccacagaactcggtactaggaaaactcctattttaaaatccagccctgggtgggaagatttgggaagaatcsttaatattgagagagagagggagaaagaggattagatgagagtggcgcctccgctcatgtccgccccctccccgcagagaattaccttttccagggacgg

SEQ ID NO: 39717 - DNA, 201 bp, Homo sapiens
tgtctttggggaaaatgggaccaagaggtcctggataaccttggacagacaaggtttgcagagagagaagttggcaagtgcaggctcctgggcgtgttcaygtctgcatccagcctggaggggactcaggcagagagccctaagctggagtgtccaggctctgaggatcactgaggattcagtgctcacgaagaatgcctc

SEQ ID NO: 39718 - DNA, 201 bp, Homo sapiens
cctgatccgtaatggagactggaccttccagatcctggtgatgctggaaatgaccccccagcagggagatgtctacacctgccaagtggagcacaccagcmtggatagtcctgtcaccgtggagtggagtgagtctctgatgaccctctagaccccacctctgaagagcaggggactctctggctctggggtccactcatc

SEQ ID NO: 39719 - DNA, 201 bp, Homo sapiens
gggtacagtaaacagagagaggtgcccagtggtcagtgcttgtctttggggaaaatgggaccaagaggtcctggataaccttggacagacaaggtttgcasagagagaagttggcaagtgcaggctcctgggcgtgttcatgtctgcatccagcctggaggggactcaggcagagagccctaagctggagtgtccaggctc

SEQ ID NO: 39720 - DNA, 201 bp, Homo sapiens
caatcccagggtcacagaagactacttgggttcatggtctctaatatttcaaacaggagctccctttagcgagtccttcttttcctgactgcagctctttycattttgccatccttttccagctccatgatggttctgcaggtttctgcggccccccggacagtggctctgacggcgttactgatggtgctgctcacatct

SEQ ID NO: 39721 - DNA, 201 bp, Homo sapiens
aaactggagaagttaatttgtggagcatgaaacagatgagcagaacaatcacagcaccttaatttccccagtgtgcccaagaacagagcaggcctgaagayactcaaacagaaacaaacatgtgccgtgtcactgataattctgtgtagacacacacctgccagacactgctcatggcactccctaggaagaacagcatgt

SEQ ID NO: 39722 - DNA, 201 bp, Homo sapiens
atttgggaagaatcgttaatattgagagagagagggagaaagaggattagatgagagtggcgcctccgctcatgtccgccccctccccgcagagaattacsttttccagggacggcaggaatgctacgcgtttaatgggacacagcgcttcctggagagatacatctacaaccgggaggagttcgcgcgcttcgacagcga

SEQ ID NO: 39723 - DNA, 201 bp, Homo sapiens
aggaaggaaagaaggacaatctcaaattctatttcattatttttcttccacgctcctagtccagcctagggtgaatgtttccccctccaagaaggggcccytgcagcaccacaacctgcttgtctgccacgtgacggatttctacccaggcagcattcaagtccgatggttcctgaatggacaggaggaaacagctggggt

SEQ ID NO: 39724 - DNA, 201 bp, Homo sapiens
ttgggaagaatcgttaatattgagagagagagggagaaagaggattagatgagagtggcgcctccgctcatgtccgccccctccccgcagagaattacctkttccagggacggcaggaatgctacgcgtttaatgggacacagcgcttcctggagagatacatctacaaccgggaggagttcgcgcgcttcgacagcgacg

SEQ ID NO: 39725 - DNA, 201 bp, Homo sapiens
tggggtccactcatcttatcttctgcatctataccctggggccatgtccaaaccccatctttcttctataccagctcctgagcatagtttgaagccagggmaatggagacttcctgaccttggcttaggggttcctgaagattcatagttctcccccttgtcagagaatctagggacactgactggtctcgaaaccctcac

SEQ ID NO: 39726 - DNA, 201 bp, Homo sapiens
gggaagaatcgttaatattgagagagagagggagaaagaggattagatgagagtggcgcctccgctcatgtccgccccctccccgcagagaattacctttwccagggacggcaggaatgctacgcgtttaatgggacacagcgcttcctggagagatacatctacaaccgggaggagttcgcgcgcttcgacagcgacgtg

SEQ ID NO: 39727 - DNA, 201 bp, Homo sapiens
gaatcgttaatattgagagagagagggagaaagaggattagatgagagtggcgcctccgctcatgtccgccccctccccgcagagaattaccttttccagkgacggcaggaatgctacgcgtttaatgggacacagcgcttcctggagagatacatctacaaccgggaggagttcgcgcgcttcgacagcgacgtggggga

SEQ ID NO: 39728 - DNA, 201 bp, Homo sapiens
gggtgaatgtttccccctccaagaaggggcccttgcagcaccacaacctgcttgtctgccacgtgacggatttctacccaggcagcattcaagtccgatgsttcctgaatggacaggaggaaacagctggggtcgtgtccaccaacctgatccgtaatggagactggaccttccagatcctggtgatgctggaaatgaccc

SEQ ID NO: 39729 - DNA, 201 bp, Homo sapiens
ctggggcggcctgctgcggagtactggaacagccagaaggacatcctggaggagaagcgggcagtgccggacaggatgtgcagacacaactacgagctggdcgggcccatgaccctgcagcgccgaggtgagtgagggctttgggccggcggtcccagggcagccccgcgggcccgtgcccagggcgcaggagcagccggg

SEQ ID NO: 39730 - DNA, 201 bp, Homo sapiens
agggacggcaggaatgctacgcgtttaatgggacacagcgcttcctggagagatacatctacaaccgggaggagttcgcgcgcttcgacagcgacgtgggrgagttccgggcggtgacggagctggggcggcctgctgcggagtactggaacagccagaaggacatcctggaggagaagcgggcagtgccggacaggatgt

SEQ ID NO: 39731 - DNA, 201 bp, Homo sapiens
gcaggtttctgcggccccccggacagtggctctgacggcgttactgatggtgctgctcacatctgtggtccagggcagggccactccaggtaagagccgarctgccattcttggagggtctggctcagggaacaattcctaggggacgttatctttaagggatcaaattctgagacaggctgcgggggctcctgccctaag

SEQ ID NO: 39732 - DNA, 201 bp, Homo sapiens
gcgcgcttcgacagcgacgtgggggagttccgggcggtgacggagctggggcggcctgctgcggagtactggaacagccagaaggacatcctggaggagargcgggcagtgccggacaggatgtgcagacacaactacgagctgggcgggcccatgaccctgcagcgccgaggtgagtgagggctttgggccggcggtccc

SEQ ID NO: 39733 - DNA, 201 bp, Homo sapiens
ggaaatgaccccccagcagggagatgtctacacctgccaagtggagcacaccagcctggatagtcctgtcaccgtggagtggagtgagtctctgatgaccvtctagaccccacctctgaagagcaggggactctctggctctggggtccactcatcttatcttctgcatctataccctggggccatgtccaaaccccatct

SEQ ID NO: 39734 - DNA, 201 bp, Homo sapiens
gggcggcctgctgcggagtactggaacagccagaaggacatcctggaggagaagcgggcagtgccggacaggatgtgcagacacaactacgagctgggcgrgcccatgaccctgcagcgccgaggtgagtgagggctttgggccggcggtcccagggcagccccgcgggcccgtgcccagggcgcaggagcagccgggttg

SEQ ID NO: 39735 - DNA, 201 bp, Homo sapiens
cagcgcttcctggagagatacatctacaaccgggaggagttcgcgcgcttcgacagcgacgtgggggagttccgggcggtgacggagctggggcggcctgmtgcggagtactggaacagccagaaggacatcctggaggagaagcgggcagtgccggacaggatgtgcagacacaactacgagctgggcgggcccatgacc

SEQ ID NO: 39736 - DNA, 201 bp, Homo sapiens
agcaaggttggaatctcctgaatacagcccctcaagccctaaaacctcttatctattaccttgggttcattgtccaggaaggggaggagaacttgaacttrtagtcacagaagggtgctgagaactaaccagcaggacggctcagccctgggaactgcagaggggtgaggctggggagagaggaggctggagcagcactgg

SEQ ID NO: 39737 - DNA, 201 bp, Homo sapiens
aggactgcaaagtaggtaccttagttttccactgacttccacttttcctgcttacacccttcctcctagacctctccacacccctcctaggacacacctaraaggtactgacatcatgtcacctcctcatctttcagggtagcaaggttggaatctcctgaatacagcccctcaagccctaaaacctcttatctattacct

SEQ ID NO: 39738 - DNA, 201 bp, Homo sapiens
tatgtgtgcatgtgtctttatagcagcatgatttataatcctttgggtatatatccagtaatgggatggctgggtcaaatggtatttctagttctagatcyttgaggaattgccacactgtcttgagataccatctcacaccagttaaaatggcgatcattaaaaagtcaggaaacaacaggtgctggagaggatgtggag

SEQ ID NO: 39739 - DNA, 201 bp, Homo sapiens
ctactggcctattctctctccaaggacatgggtacagtaaacagagagaggtgcccagtggtcagtgcttgtctttggggaaaatgggaccaagaggtccwggataaccttggacagacaaggtttgcagagagagaagttggcaagtgcaggctcctgggcgtgttcatgtctgcatccagcctggaggggactcaggca

SEQ ID NO: 39740 - DNA, 201 bp, Homo sapiens
cttcctgtgtccatgtgttctcattgttcagttcccacctatgagtgagaacatgtggtctttggttttttgtccttgcaatagtttgctgtgaatgatgrtttccagcttcctccatgtccctacaaaggacatgaactcatccttttttatggctgcacagtattccatggtgtatatgtgtgcattttcttaatccag

SEQ ID NO: 39741 - DNA, 201 bp, Homo sapiens
aatcgttaatattgagagagagagggagaaagaggattagatgagagtggcgcctccgctcatgtccgccccctccccgcagagaattaccttttccaggkacggcaggaatgctacgcgtttaatgggacacagcgcttcctggagagatacatctacaaccgggaggagttcgcgcgcttcgacagcgacgtgggggag

SEQ ID NO: 39742 - DNA, 201 bp, Homo sapiens
tgaataagagacgaattcattcagatcagtggtttcaaaccgtgctctgggcaactcaattgctaagggttccacaaacaggataaagtttcttatatacaaaaaaaaatgaaggtttcaaattacaccataaaacccctcattgcttatgtctacttggcaggtaaaattccatttcaaaagttaaatgtacttaaaaaa

SEQ ID NO: 39743 - DNA, 201 bp, Homo sapiens
cagggtgagcgggacttaccttcccctggcatattcacacttattccacgatgaggggtttgacagaaaagaaatgtcagaaagctctagaggccactgawatcagataatcggggaacaaacatgacctatagcgagagagggatcccaggctgggatcttaatgcagccagatgcatgaggtcccaagtactcaggctc

SEQ ID NO: 39744 - DNA, 201 bp, Homo sapiens
ctccccgcagagaattaccttttccagggacggcaggaatgctacgcgtttaatgggacacagcgcttcctggagagatacatctacaaccgggaggagtwcgcgcgcttcgacagcgacgtgggggagttccgggcggtgacggagctggggcggcctgctgcggagtactggaacagccagaaggacatcctggaggag

SEQ ID NO: 39745 - DNA, 201 bp, Homo sapiens
tcttcatgcacaggaggagcaagaaaggtgagaaagcctgcagggtgagcgggacttaccttcccctggcatattcacacttattccacgatgaggggttwgacagaaaagaaatgtcagaaagctctagaggccactgatatcagataatcggggaacaaacatgacctatagcgagagagggatcccaggctgggatct

SEQ ID NO: 39746 - DNA, 201 bp, Homo sapiens
cccgcagagaattaccttttccagggacggcaggaatgctacgcgtttaatgggacacagcgcttcctggagagatacatctacaaccgggaggagttcgygcgcttcgacagcgacgtgggggagttccgggcggtgacggagctggggcggcctgctgcggagtactggaacagccagaaggacatcctggaggagaag

SEQ ID NO: 39747 - DNA, 201 bp, Homo sapiens
cgcttcctggagagatacatctacaaccgggaggagttcgcgcgcttcgacagcgacgtgggggagttccgggcggtgacggagctggggcggcctgctgmggagtactggaacagccagaaggacatcctggaggagaagcgggcagtgccggacaggatgtgcagacacaactacgagctgggcgggcccatgaccctg

SEQ ID NO: 39748 - DNA, 201 bp, Homo sapiens
ggacaggatgtgcagacacaactacgagctgggcgggcccatgaccctgcagcgccgaggtgagtgagggctttgggccggcggtcccagggcagccccgygggcccgtgcccagggcgcaggagcagccgggttggcctaagggaccttagtgccgggcggaaaggggactttgggttggggattcatggggggagccca

SEQ ID NO: 39749 - DNA, 201 bp, Homo sapiens
tcctggagagatacatctacaaccgggaggagttcgcgcgcttcgacagcgacgtgggggagttccgggcggtgacggagctggggcggcctgctgcggastactggaacagccagaaggacatcctggaggagaagcgggcagtgccggacaggatgtgcagacacaactacgagctgggcgggcccatgaccctgcagc

SEQ ID NO: 39750 - DNA, 201 bp, Homo sapiens
ccgggaggagttcgcgcgcttcgacagcgacgtgggggagttccgggcggtgacggagctggggcggcctgctgcggagtactggaacagccagaaggacmtcctggaggagaagcgggcagtgccggacaggatgtgcagacacaactacgagctgggcgggcccatgaccctgcagcgccgaggtgagtgagggctttg

SEQ ID NO: 39751 - DNA, 201 bp, Homo sapiens
aggaaggaaggaaggaaggaaggaaggaaggaaggaaggaaagaaggacaatctcaaattctatttcattatttttcttccacgctcctagtccagcctarggtgaatgtttccccctccaagaaggggcccttgcagcaccacaacctgcttgtctgccacgtgacggatttctacccaggcagcattcaagtccgatgg

SEQ ID NO: 39752 - DNA, 201 bp, Homo sapiens
ggcctgctgcggagtactggaacagccagaaggacatcctggaggagaagcgggcagtgccggacaggatgtgcagacacaactacgagctgggcgggccsatgaccctgcagcgccgaggtgagtgagggctttgggccggcggtcccagggcagccccgcgggcccgtgcccagggcgcaggagcagccgggttggcct

SEQ ID NO: 39753 - DNA, 201 bp, Homo sapiens
acgctcctagtccagcctagggtgaatgtttccccctccaagaaggggcccttgcagcaccacaacctgcttgtctgccacgtgacggatttctacccagrcagcattcaagtccgatggttcctgaatggacaggaggaaacagctggggtcgtgtccaccaacctgatccgtaatggagactggaccttccagatcctg

SEQ ID NO: 39754 - DNA, 201 bp, Homo sapiens
attctatttcattatttttcttccacgctcctagtccagcctagggtgaatgtttccccctccaagaaggggcccttgcagcaccacaacctgcttgtctrccacgtgacggatttctacccaggcagcattcaagtccgatggttcctgaatggacaggaggaaacagctggggtcgtgtccaccaacctgatccgtaat

SEQ ID NO: 39755 - DNA, 201 bp, Homo sapiens
aaggaaggaaggaaagaaggacaatctcaaattctatttcattatttttcttccacgctcctagtccagcctagggtgaatgtttccccctccaagaaggrgcccttgcagcaccacaacctgcttgtctgccacgtgacggatttctacccaggcagcattcaagtccgatggttcctgaatggacaggaggaaacagct

SEQ ID NO: 39756 - DNA, 201 bp, Homo sapiens
gcggcctgctgcggagtactggaacagccagaaggacatcctggaggagaagcgggcagtgccggacaggatgtgcagacacaactacgagctgggcgggsccatgaccctgcagcgccgaggtgagtgagggctttgggccggcggtcccagggcagccccgcgggcccgtgcccagggcgcaggagcagccgggttggc

SEQ ID NO: 39757 - DNA, 201 bp, Homo sapiens
tggacaagactgcagccactgcaggcccaaagcctgggtttaaatccaagctttgcactttgaagctgtgtggtcttcacctctcccggtgtctgattccygctctgtaacatgaaataaataagaaccaacctccagatgtaaataagtgaacacatgagaagcacttagaatagtgcctagaacatagtaagcaactca

SEQ ID NO: 39758 - DNA, 201 bp, Homo sapiens
taaaaacaatacgttttgaccaattttagatttattctaggaatgcaatgattcttcagtgtcagaaaatatataatgtggttaacacattagtggactcygcaaaattcatattaatttaaactgaattcagctcaagacatagacagaatttaatcaatttcatgacatgttaaaggtagtgaaccaaaaatctatagc

SEQ ID NO: 39759 - DNA, 201 bp, Homo sapiens
gcctgctgcggagtactggaacagccagaaggacatcctggaggagaagcgggcagtgccggacaggatgtgcagacacaactacgagctgggcgggcccrtgaccctgcagcgccgaggtgagtgagggctttgggccggcggtcccagggcagccccgcgggcccgtgcccagggcgcaggagcagccgggttggccta

SEQ ID NO: 39760 - DNA, 201 bp, Homo sapiens
aggagaagcgggcagtgccggacaggatgtgcagacacaactacgagctgggcgggcccatgaccctgcagcgccgaggtgagtgagggctttgggccggsggtcccagggcagccccgcgggcccgtgcccagggcgcaggagcagccgggttggcctaagggaccttagtgccgggcggaaaggggactttgggttggg

SEQ ID NO: 39761 - DNA, 201 bp, Homo sapiens
cagtgcccctgagctcattcttttcagtaaattctctctctgcgtggtgagaaaacaggcctggagaggctctgcgacccgcttaggaccacagaactcgrtactaggaaaactcctattttaaaatccagccctgggtgggaagatttgggaagaatcgttaatattgagagagagagggagaaagaggattagatgaga

SEQ ID NO: 39762 - DNA, 201 bp, Homo sapiens
atctataccctggggccatgtccaaaccccatctttcttctataccagctcctgagcatagtttgaagccagggaaatggagacttcctgaccttggcttrggggttcctgaagattcatagttctcccccttgtcagagaatctagggacactgactggtctcgaaaccctcacacttaggaactgacctcacacatagg

SEQ ID NO: 39763 - DNA, 201 bp, Homo sapiens
gggttggttccaagtctttgctattgtgaatagtgccgcaataaacatatgtgtgcatgtgtctttatagcagcatgatttataatcctttgggtatatayccagtaatgggatggctgggtcaaatggtatttctagttctagatctttgaggaattgccacactgtcttgagataccatctcacaccagttaaaatggc

SEQ ID NO: 39764 - DNA, 201 bp, Homo sapiens
cagtattccatggtgtatatgtgtgcattttcttaatccagtctatcactgatggacagttgggttggttccaagtctttgctattgtgaatagtgccgcwataaacatatgtgtgcatgtgtctttatagcagcatgatttataatcctttgggtatatatccagtaatgggatggctgggtcaaatggtatttctagtt

SEQ ID NO: 39765 - DNA, 201 bp, Homo sapiens
ggagttcagaaaatgtgtgaggtgaagggatggggctatgctggaggggctcattctgaggccccatccccttccagcaggaattctgaaatccccaccayttcctccctccgggggatttgatcccctatggccaccgctaacagcatcatcgtgctggatgatgatgacgaagatgaagcagctgctcagccagggccc

SEQ ID NO: 39766 - DNA, 201 bp, Homo sapiens
gtttctgaggtgggggccggacggtgcggggatcagaggcgggggcggggatatagagggagaggtattggggagagctgggcgctgagtctgaggggaawgctgtggtaccttcctgtccctgaaagggagtggagcggccgggggctgaactgggggagggggatttggcgggaagcgcatctagcggaccggccggac

SEQ ID NO: 39767 - DNA, 201 bp, Homo sapiens
ggctgaactgggggagggggatttggcgggaagcgcatctagcggaccggccggacccacggttgggatctaagaggaatcgcgagagcgtagcgcggtgyggggggacttttgatcagttacgggtcaccgagagaatggggaaaattagggtggggtgaaagggaggggacttgggtaaaatatcttcaacctaaagcc

SEQ ID NO: 39768 - DNA, 201 bp, Homo sapiens
gaaatcgacgtgaggggtggagcagaaggtggcaacttaaggtgtgggggtggtttgccccccccccacaccacttgaagggccccaaaaagcatatagarctaatggttattgaaatcaggtggtgaagacagtgttggtcagggctggatgttactgaaacccaaggagttcagaaaatgtgtgaggtgaagggatggg

SEQ ID NO: 39769 - DNA, 201 bp, Homo sapiens
gagagaatggggaaaattagggtggggtgaaagggaggggacttgggtaaaatatcttcaacctaaagccccagtttgaggagactcatcggagggtgaamtatggagataattcaaggaggagaaaagagaacggactgttgggagggaacctctttcacctcagagagtctaggagttggggtgatcattcaggatagg

SEQ ID NO: 39770 - DNA, 201 bp, Homo sapiens
gttgtctgtgcaagggggtgtcaggacgatttggggtgcagtgtgggaggaagaatcaacttgccaactctaagaaataggggggaaatgcaacagaaagrccggaaatcgacgtgaggggtggagcagaaggtggcaacttaaggtgtgggggtggtttgccccccccccacaccacttgaagggccccaaaaagcatat

SEQ ID NO: 39771 - DNA, 201 bp, Homo sapiens; identical to SEQ ID NO: 14026

SEQ ID NO: 39772 - DNA, 201 bp, Homo sapiens; identical to SEQ ID NO: 14027

SEQ ID NO: 39773 - DNA, 201 bp, Homo sapiens
taggcgttgaccctgcactatcagatcctgtgttggcccggcgccttcgggaaaaccggagtttggccatgagtcggctggatgaggtcatctccaaataygcaatgttgcaagacaaaagtgaggagggcgagagaaaaaagagaagagctcggctccaaggcacctcttcccactctgcagacacccccgaagcctcct

SEQ ID NO: 39774 - DNA, 201 bp, Homo sapiens
aatcgcgagagcgtagcgcggtgcggggggacttttgatcagttacgggtcaccgagagaatggggaaaattagggtggggtgaaagggaggggacttggktaaaatatcttcaacctaaagccccagtttgaggagactcatcggagggtgaaatatggagataattcaaggaggagaaaagagaacggactgttgggag

SEQ ID NO: 39775 - DNA, 201 bp, Homo sapiens; identical to SEQ ID NO: 14032

SEQ ID NO: 39776 - DNA, 201 bp, Homo sapiens
ctccttggattctggtgaggtgtggatggggtacagccttcagagagacattgtccttcccctgcactggccaccagggagtccaggttgactgatggggkagcatgagaaggaaagcaagaaccaaaccctctggggcaagggattccttagagaaacttctttgtctcccagggccctagtggaatggcatcccagggg

SEQ ID NO: 39777 - DNA, 201 bp, Homo sapiens
ctgattcctccacgagggtggactctcccagccatggcctggtgaccagctccctctgcatcccttctccagcccggctgtcccaaaccccccattcacakcctcctcggcctggtacttgcaaggtaagaaggggagggcgtgtttcctctgacaatttgttctctttcattggctgtttcagctgctctgtctgaatat

SEQ ID NO: 39778 - DNA, 201 bp, Homo sapiens; identical to SEQ ID NO: 14045

SEQ ID NO: 39779 - DNA, 201 bp, Homo sapiens
gcccccctccagcctcagtcttcccgtacccctccacatatttatgtttctgtttctagctatgtggaaaggcaaaggtcagtgcatgagaagaatgggaraaagatatgtaccctgcccagcccaccttcccccttggcttccttggccccagttgctgattcctccacgagggtggactctcccagccatggcctggtg

SEQ ID NO: 39780 - DNA, 201 bp, Homo sapiens
tatgtcttcccacgtaggcgttgaccctgcactatcagatcctgtgttggcccggcgccttcgggaaaaccggagtttggccatgagtcggctggatgagrtcatctccaaatatgcaatgttgcaagacaaaagtgaggagggcgagagaaaaaagagaagagctcggctccaaggcacctcttcccactctgcagacac

SEQ ID NO: 39781 - DNA, 201 bp, Homo sapiens
gccttccgagatgtgggcatcaggttacaggagcgacgtcacctcgatctcatctacaactttggctgccacctcacagatgactataggccaggtagggkgttggtgggatgcctctcagtgacccttatatgtcaggtatgaggcggatggggcatctctctagtcctttctagggtttttactcttctagtcccttca

SEQ ID NO: 39782 - DNA, 201 bp, Homo sapiens; identical to SEQ ID NO: 14038

SEQ ID NO: 39783 - DNA, 201 bp, Homo sapiens; identical to SEQ ID NO: 14041

SEQ ID NO: 39784 - DNA, 201 bp, Homo sapiens
ggtgtgggggattggtgtcatgtcctgagctctgcctattgcccccctaacccagccatcgtgtatcctgtgaggtggagccacctggttccagtgacccwcctgccccacgggtgcttcggccaacattggtcatctcgcagtggacagagtgagagattcactggctggggggtggtttcttgggacttccacttttct

SEQ ID NO: 39785 - DNA, 201 bp, Homo sapiens
cagtcccatgttgtttgttcctagcacatgaagtggccatctgtctcgtcactagactctgccttggaaagcagtccatccctgcacagtccagctgaccycagccacctctccccaccagcctcctcccctaggccttctcgaggtcaccgccgctcagcctcctgtggctccccgctgagtgggggtgcagaagaggcc

SEQ ID NO: 39786 - DNA, 201 bp, Homo sapiens
gctagagtttgttaaataaacaaatactgagaccttggacaagttccttatcctctctggataaggaatcctgtcgaattggatactatccagtcctctcrtctgcaaagcagactcgttgtctacctgagaaattcaatttaaagggtcaagtggagtgcttaggccatgatagattgaggaggaaggcagggagggatc

SEQ ID NO: 39787 - DNA, 201 bp, Homo sapiens
agccaggacaaggctccaagtgtcatcagtcgtgtccttaagaaaaacaatcgtgactctgcagtggcttcagagtatgagctggtacagctgctaccagrggagcgaggtcagaggccatgagggaaaggcagactcgggaggagagtggagtacttccacatctgggcggctgtggggggaacaactgtgtgtgtgctt

SEQ ID NO: 39788 - DNA, 201 bp, Homo sapiens
ccagggttctggccaggtgtgggggattggtgtcatgtcctgagctctgcctattgcccccctaacccagccatcgtgtatcctgtgaggtggagccaccyggttccagtgaccctcctgccccacgggtgcttcggccaacattggtcatctcgcagtggacagagtgagagattcactggctggggggtggtttcttgg

SEQ ID NO: 39789 - DNA, 201 bp, Homo sapiens
ttggatacctgtgtatagcttcccaccttccatgagtgcagcacacaggtagtgctggaaaaacgcatcagtttctgattcttggccatatcctaacatgyaagggccaagcaaaggcttcaaggctctgagccccagggcagaggggaatggcaaaatgtaggtcctcgcaggagctcttcttcccactctgggggtttc

SEQ ID NO: 39790 - DNA, 201 bp, Homo sapiens
aataaacaaatactgagaccttggacaagttccttatcctctctggataaggaatcctgtcgaattggatactatccagtcctctcatctgcaaagcagaytcgttgtctacctgagaaattcaatttaaagggtcaagtggagtgcttaggccatgatagattgaggaggaaggcagggagggatcgaagagtcagagag

SEQ ID NO: 39791 - DNA, 201 bp, Homo sapiens
catattgggttttcctgttcattttaaagccttggacacaagtaacattttgtggttgggttcagtggctgagggtagaaggatgggaaatcatggctgaytgattgctcttttggtctcctgttctgccaggtgacaagccaggacaaggctccaagtgtcatcagtcgtgtccttaagaaaaacaatcgtgactctgca

SEQ ID NO: 39792 - DNA, 201 bp, Homo sapiens; identical to SEQ ID NO: 14049

SEQ ID NO: 39793 - DNA, 201 bp, Homo sapiens
gtcagagaggctggagggaagtggttgtgagttggatgtggctgtgtgtgtttaagagaggggatattctctctctgtggccggaaggtagggttggaacyttcaccccatccccattttcctcgcagaatggatacatcaattttgacaagcggaggaaggtgagcggagtgtctgggctggatgctggacttccctatc

SEQ ID NO: 39794 - DNA, 201 bp, Homo sapiens
ccatgtcatgacctatgacctccatggctcctgggagggctacactggagagaacagccccctctacaaatacccgactgacaccggcagcaacgcctacstcaatgtggtgagtccctgtacagatgcaagagcagaccagagatgatgatgaaaatcacatagagattcaggcacaaaaggcatcataagtttagtggt

SEQ ID NO: 39795 - DNA, 201 bp, Homo sapiens
ctgatggtcactgctgcagtagctgctggcatctccaacatccagtctggctatgagatcccccaactgtcacagtgagtgatgtgccttatcttcaaacycctggaggtatcactcaggcagactagacttgtctttggtctgtcttgctattcagggaccttgtttaggaggctatggaagtggtgccttgtgcccgca

SEQ ID NO: 39796 - DNA, 201 bp, Homo sapiens
ccggcagcaacgcctacctcaatgtggtgagtccctgtacagatgcaagagcagaccagagatgatgatgaaaatcacatagagattcaggcacaaaaggyatcataagtttagtggttttctcaaatgagaaattaggctgccataatcaattaaatattctcatttactaaaaaacttgcctatttattaacaccatac

SEQ ID NO: 39797 - DNA, 201 bp, Homo sapiens
ttttttcttctcaggttgcaaagctccagcccaacccattgctcccattgccgaggcaaacatcacatgcggtgtcagccacagtggtagctctgggggcygctctggcaggagctctgggggcagccccagaggtagtggattctgtgctgacagggccagtggcctgtaccctgaccccactgacaagaatgcctccta

SEQ ID NO: 39798 - DNA, 201 bp, Homo sapiens
cttgtctttggtctgtcttgctattcagggaccttgtttaggaggctatggaagtggtgccttgtgcccgcacaggtatgggaaatgaccatcagaatgaytttaaatcctctaccccacctcaggtacccggactacatccatgtcatgacctatgacctccatggctcctgggagggctacactggagagaacagcccc

SEQ ID NO: 39799 - DNA, 201 bp, Homo sapiens
agttgccaagggaagcttataagtccaactactggtggactcagttgagaacaatcttccacttagaagcaatccaaagctggcattgataaagcattcaktctccttggtcaggagattcactcctagggaaataattggaactgtggagacattggggtgcagcaaaccaacatggcacatgtatacctatgtaacaaa

SEQ ID NO: 39800 - DNA, 201 bp, Homo sapiens
tctttctctgggtaacaggctctgcctaccagctgacatgttacttcaccaactgggcccagaaccagccaggcctggggtgcttcaagcctgatgacatygacccctgcctctgtacccacttgatctacgcctttgctggaatgcagaacaacgagatcaccaccatcgaatgggatgacatgactctctaccaagctt

SEQ ID NO: 39801 - DNA, 201 bp, Homo sapiens
cctcaatgtggtgagtccctgtacagatgcaagagcagaccagagatgatgatgaaaatcacatagagattcaggcacaaaaggcatcataagtttagtgkttttctcaaatgagaaattaggctgccataatcaattaaatattctcatttactaaaaaacttgcctatttattaacaccatactgataattttacctaa

SEQ ID NO: 39802 - DNA, 201 bp, Homo sapiens
gaaaatcacatagagattcaggcacaaaaggcatcataagtttagtggttttctcaaatgagaaattaggctgccataatcaattaaatattctcatttaytaaaaaacttgcctatttattaacaccatactgataattttacctaatatgaaagaagattaataacaagtgcattgttttttaataaaagaaaatgata

SEQ ID NO: 39803 - DNA, 201 bp, Homo sapiens
gggagggctacactggagagaacagccccctctacaaatacccgactgacaccggcagcaacgcctacctcaatgtggtgagtccctgtacagatgcaagrgcagaccagagatgatgatgaaaatcacatagagattcaggcacaaaaggcatcataagtttagtggttttctcaaatgagaaattaggctgccataatc

SEQ ID NO: 39804 - DNA, 201 bp, Homo sapiens
acctcaatgtggtgagtccctgtacagatgcaagagcagaccagagatgatgatgaaaatcacatagagattcaggcacaaaaggcatcataagtttagtrgttttctcaaatgagaaattaggctgccataatcaattaaatattctcatttactaaaaaacttgcctatttattaacaccatactgataattttaccta

SEQ ID NO: 39805 - DNA, 201 bp, Homo sapiens
tgtggagacattggggtgcagcaaaccaacatggcacatgtatacctatgtaacaaacctgcacattgtgcacatgtaccctggaacttaaagtatatttaaaaaaaaaactgtggagacattgaaacataccaatcatagtcacctactccaacattcataagtaggaaataaggataagaacaaagataaaccaggatg

SEQ ID NO: 39806 - DNA, 201 bp, Homo sapiens
gtctcaccctgccttctttgggtctccctcagtttcactgccatggtttccactcctgagaaccaccagactttcatcaactcagtcatcaaattcctgcrccagtatgagtttgacgggctggactttgactgggagtaccccggctctcgtgtgagccctcctcaggacaagcatctcttcactgtcctggtgcaggtg

SEQ ID NO: 39807 - DNA, 201 bp, Homo sapiens
ttttcttttttcttctcaggttgcaaagctccagcccaacccattgctcccattgccgaggcaaacatcacatgcggtgtcagccacagtggtagctctgrgggccgctctggcaggagctctgggggcagccccagaggtagtggattctgtgctgacagggccagtggcctgtaccctgaccccactgacaagaatgcc

SEQ ID NO: 39808 - DNA, 201 bp, Homo sapiens
gagccaagaacaaaatccaggtactagctctcacacatcaggtatcactggctaaaagcaaggaggttcaggatttgttttcttttttcttctcaggttgyaaagctccagcccaacccattgctcccattgccgaggcaaacatcacatgcggtgtcagccacagtggtagctctgggggccgctctggcaggagctctg

SEQ ID NO: 39809 - DNA, 201 bp, Homo sapiens
catctcttcactgtcctggtgcaggtgagctaagttccagatcattttcactggaaagcatacacccatctcatatgaaagatcactgggaccttaaaccyagtttcctagaattttatttggggtgaaggacctgaaaatcctattccagtaaggatgctgaggaatgaatggaaggatggaagaggttaatttaattca

SEQ ID NO: 39810 - DNA, 201 bp, Homo sapiens
tcaggatttgttttcttttttcttctcaggttgcaaagctccagcccaacccattgctcccattgccgaggcaaacatcacatgcggtgtcagccacagtsgtagctctgggggccgctctggcaggagctctgggggcagccccagaggtagtggattctgtgctgacagggccagtggcctgtaccctgaccccactga

SEQ ID NO: 39811 - DNA, 201 bp, Homo sapiens
ggttgattttactctaaggtgttgggaccaccaaggtctcaccctgccttctttgggtctccctcagtttcactgccatggtttccactcctgagaaccaycagactttcatcaactcagtcatcaaattcctgcgccagtatgagtttgacgggctggactttgactgggagtaccccggctctcgtgtgagccctcctc

SEQ ID NO: 39812 - DNA, 201 bp, Homo sapiens
agatctgtaccttcctgaagaatggagctactgaagtatgggaggcttctgaggatgttccctatgcctacaaaggaaatgagtggcttggatacgataayaccaagagtttccaaatcaaggtagactgtgttctatgggttgttgttgcctgtgagcatgttcccattatagccctggagccacagctcagccttggtg

SEQ ID NO: 39813 - DNA, 201 bp, Homo sapiens
gttccttggaagtcatggagctgttgcacaagtaattgtctgacattgtccattcctatctggtaacaattgattaatggtgggaagaacaaacagggctyttcaccatttcttccttccttcattcatttcacaagaaatttattgaacatctattacatatacagtgctctgtaggtaccacaggtgatctaaatgcat

SEQ ID NO: 39814 - DNA, 201 bp, Homo sapiens
ccattgacctggatgatttcacaggcactttctgcaaccaaggaaaattccctctgatcaccaccctgaaggatgctctgggcctgcagagtacaagtgakttagggagtgagaagggacactaagcctcagacttaagagaaattccaaaggttccttggaagtcatggagctgttgcacaagtaattgtctgacattgt

SEQ ID NO: 39815 - DNA, 201 bp, Homo sapiens
tgcgccagtatgagtttgacgggctggactttgactgggagtaccccggctctcgtgtgagccctcctcaggacaagcatctcttcactgtcctggtgcargtgagctaagttccagatcattttcactggaaagcatacacccatctcatatgaaagatcactgggaccttaaacctagtttcctagaattttatttggg

SEQ ID NO: 39816 - DNA, 201 bp, Homo sapiens
agaatttagttgagaattagacctatcactttaacagatatatgtcagtgatgctctaaaatatgttgcaagtactttgtacagtgggcacaaccaaatcraaaaaagtttagctaataattaatcactaggccatcagctgtgggtgagaactctagctaacccactgccattgcaggattatgtcatgaactactggaa

SEQ ID NO: 39817 - DNA, 201 bp, Homo sapiens
gtttttaaagaaatctgtgactcactagggagcttgtctctcaccttctttctctgggtaacaggctctgcctaccagctgacatgttacttcaccaactrggcccagaaccagccaggcctggggtgcttcaagcctgatgacatcgacccctgcctctgtacccacttgatctacgcctttgctggaatgcagaacaac

SEQ ID NO: 39818 - DNA, 201 bp, Homo sapiens
gctctcacacatcaggtatcactggctaaaagcaaggaggttcaggatttgttttcttttttcttctcaggttgcaaagctccagcccaacccattgctcycattgccgaggcaaacatcacatgcggtgtcagccacagtggtagctctgggggccgctctggcaggagctctgggggcagccccagaggtagtggattc

SEQ ID NO: 39819 - DNA, 201 bp, Homo sapiens
gtggagacatagaaggaggagccaagaacaaaatccaggtactagctctcacacatcaggtatcactggctaaaagcaaggaggttcaggatttgttttcytttttcttctcaggttgcaaagctccagcccaacccattgctcccattgccgaggcaaacatcacatgcggtgtcagccacagtggtagctctgggggcc

SEQ ID NO: 39820 - DNA, 201 bp, Homo sapiens
gtgaagcttttgagcaggaggccaagcacattaataagcccaggctgatggtcactgctgcagtagctgctggcatctccaacatccagtctggctatgasatcccccaactgtcacagtgagtgatgtgccttatcttcaaacccctggaggtatcactcaggcagactagacttgtctttggtctgtcttgctattcag

SEQ ID NO: 39821 - DNA, 201 bp, Homo sapiens
ctactggtggactcagttgagaacaatcttccacttagaagcaatccaaagctggcattgataaagcattcagtctccttggtcaggagattcactcctasggaaataattggaactgtggagacattggggtgcagcaaaccaacatggcacatgtatacctatgtaacaaacctgcacattgtgcacatgtaccctgga

SEQ ID NO: 39822 - DNA, 201 bp, Homo sapiens
ggtacccggactacatccatgtcatgacctatgacctccatggctcctgggagggctacactggagagaacagccccctctacaaatacccgactgacacyggcagcaacgcctacctcaatgtggtgagtccctgtacagatgcaagagcagaccagagatgatgatgaaaatcacatagagattcaggcacaaaaggca

SEQ ID NO: 39823 - DNA, 201 bp, Homo sapiens
cttagaagcaatccaaagctggcattgataaagcattcagtctccttggtcaggagattcactcctagggaaataattggaactgtggagacattggggtrcagcaaaccaacatggcacatgtatacctatgtaacaaacctgcacattgtgcacatgtaccctggaacttaaagtatatttaaaaaaaaaactgtggag

SEQ ID NO: 39824 - DNA, 201 bp, Homo sapiens
tgttcccattatagccctggagccacagctcagccttggtgtctgtacataactgacttcctttctaattaccacaggcagattggctaaagaagaacaastttggaggtgccatggtctgggccattgacctggatgatttcacaggcactttctgcaaccaaggaaaattccctctgatcaccaccctgaaggatgctc

SEQ ID NO: 39825 - DNA, 201 bp, Homo sapiens
tgaaaagaatgaaaaatgtgagaccaaagagaaaggagcaatcacagcaaaggaactatacacaatgatgatggataaaaacatcagcttgattataatgsatgctcaaagaatgcaggattatcaggattcctgtattttacattctctcagtgttcctgaagaagccatcagtccaggagtcactgctagttggattga

SEQ ID NO: 39826 - DNA, 201 bp, Homo sapiens
tgagaccaaagagaaaggagcaatcacagcaaaggaactatacacaatgatgatggataaaaacatcagcttgattataatggatgctcaaagaatgcagkattatcaggattcctgtattttacattctctcagtgttcctgaagaagccatcagtccaggagtcactgctagttggattgaagcacacctcccagataa

SEQ ID NO: 39827 - DNA, 201 bp, Homo sapiens
tggatctgccaatataccaggtgtgtggccttatgtgtattaacttatctgtgcctcaatgacctcatctctaaaatggggataataatgtaactatcacrtatggttgttttgatgattgaatgagttaagatatataaagcacttacactaatgcctggcacatagcatgcactatttattaatgaagataaaataaat

SEQ ID NO: 39828 - DNA, 201 bp, Homo sapiens
ttattaatgcaattatgtctggatgtcctgtgatgttgtgggactggtgctccaagcccattatgattgctgttgcctgttgagaacaggggaatccaaayagagttgactgtggcagatctccatttgcaacccctcatcccccagttataacccttatactagattgttgtctttgtttacttggtctctgaaatttat

SEQ ID NO: 39829 - DNA, 201 bp, Homo sapiens
aaacaaaactgaataataaaaagacaaatatgtaattaaaaatgggcaaaggatttgaataagcattttttttctgaagaagatatacaaatgggcataartacatgaaaagatggtttatatcattagtctctaggaaaatgcaaatcaaaaccacaatgagattcgtgacacacccattagaatggctaaaatttaaaa

SEQ ID NO: 39830 - DNA, 201 bp, Homo sapiens
taagtacttttgggaagaagaaccactttctgcttggagaagagatgaaaatggatccttcatttatggagcccaagctcttgctgtacagcccctgaaasctcctctaagtgggattggcttggacattatcctttaaccactctagatctgacagccactgggctaagcagcctctttaagatacctcttaaagaactc

SEQ ID NO: 39831 - DNA, 201 bp, Homo sapiens
acctcaaggggttcccattttagcttgaaggaaatgaggaaacaacaaaaaaagtaaactgaattttatcagataaggcaaaaactatgccaaaaaacccmcaaacaaacaccaaagcaggatgatgataggttgaccagcttttcctagtttgcccagggctgccctggtgttagcacagaaaatcttgtgtcccaggta

SEQ ID NO: 39832 - DNA, 201 bp, Homo sapiens
atgtggtgttacaggcatctgaacacagctgtaaaccacacagagaagatccagtctggacctcaaggggttcccattttagcttgaaggaaatgaggaarcaacaaaaaaagtaaactgaattttatcagataaggcaaaaactatgccaaaaaacccccaaacaaacaccaaagcaggatgatgataggttgaccagct

SEQ ID NO: 39833 - DNA, 201 bp, Homo sapiens
ggtccctatcaataatctgcagttcagggcacagatgaacatatttttatctttctttgatgcttcaagtgactctattatcttgcaatgtcttcaggtcrtcataattaacatcatgttgttgactataaatgtttaacaatgcaggttgtagagagctgtgcttaatagaaagctgaatacaaattattcgttgagata

SEQ ID NO: 39834 - DNA, 201 bp, Homo sapiens
cctcgaagaagcttaaagtctcaaaggcctttattaacttgatctttgggaatagtgttttaatttttccataatcatcatgcaaattgatcatgataatmtctggaaaggaaaataagtgaaccaatggcctcattaactccagtgctagggagacccatgttcctgagagctggtgcctttaccccatggtggctcagg

SEQ ID NO: 39835 - DNA, 201 bp, Homo sapiens
gtaaaaaaaagttggcggggggaagaagtcagccttggtgcattgaactaaactatagtttatctcaaattatttccccccttttggagaacaatctactkttctcctcgaagaagcttaaagtctcaaaggcctttattaacttgatctttgggaatagtgttttaatttttccataatcatcatgcaaattgatcatga

SEQ ID NO: 39836 - DNA, 201 bp, Homo sapiens
atgtttgctagaggagtcttatatgtaagcattactcactggtagaagattctcgcctaatacatatgctaaatttccatcttcttgcacgattctggttraggatcgtattattccagccttagttgtccccgaggtatgcaggaatttctctcttttgtgttgtgcaacccattgtgaaatcacagtgccatcagcgct

SEQ ID NO: 39837 - DNA, 201 bp, Homo sapiens
ggctataaaccattaagggttttgtgtgttttttaagtgattggagggcccatggactacagttatgagaaaagcttggagaaactgaggcaggacaaatmattaaagaaggatatttagactggactcagtggttcacacctgtaatcccagcactttgggagcctgaggtgggaggatcacttgaggcccggagttcaa

SEQ ID NO: 39838 - DNA, 201 bp, Homo sapiens
gagtttagttttccctcccaaagcactacaaatgcttagaaaagtccccagcacagaataggtgctcagttgatgtttgttgaatgaatagctttcttccrgaatgatagaaaatacgtgtcttccttaaggtcctgcaaaatgtttctccacatgccttctctccgagcactccttcactggaatgtttttattgttctt

SEQ ID NO: 39839 - DNA, 201 bp, Homo sapiens
aactaccgcaaggacaaaaaaccaaacaccacatgttctcactcataggtgggaattgaacaatgagaacacttggacacaggaaagggaacatcacacartggggccaccaaagtgtggccaccaaaaagttggtcagatacagaaactataaagggagtagtgaggatcactcaactgtttgcctttcgtctcaaaaag

SEQ ID NO: 39840 - DNA, 201 bp, Homo sapiens
tgatccacccaccttggcctcctaaggtgctgggattacaagcgtgagccattgcgctcagccccaaagtagcttctaattaagaaagtcaatgaccttaygagaatggtcaaccctgtaaagcaaataaaaaggttccgatgctttacaatatccagtgtccagagcaggtagagtacattatctgcgatttaatgcttg

SEQ ID NO: 39841 - DNA, 201 bp, Homo sapiens
tattaacattattcaacattttgctgtatatattttaattttatctttttttcaggaaactttgaaaattttaggtttattgctggtttaagatttaaackaaaatttccctttctgttttggcttccagaatgttctttatacctcagagagaggactttcctttttctaataattttttttttttttttttgagacaga

SEQ ID NO: 39842 - DNA, 201 bp, Homo sapiens
cacagaaataaagtctgagagttgtgtattttaatattttttaaggtagtgtatttgcttgtagtgacatcagcaaaggttggtctcaattaaaatttgcrctaaaactatgttctctgtatttttgttgaattctaagattctgtaatgttgggctttggtctttaaaatgaagtctttcccaagataaaacttggcttt

SEQ ID NO: 39843 - DNA, 201 bp, Homo sapiens
tgagcccgggaggctaaggttgcagtgaactgagattgagccaatgcactccagcctaggccacagagccagaccctgtctcaaaaaaaaaaaaaaggttrtaactttaaggcatgcaatgtggggttttgatataccttgtaaaatgatgaccacaatcatgctagttaacatgtccatcatgtcacatcattacctttc

SEQ ID NO: 39844 - DNA, 201 bp, Homo sapiens
agtcagggagtggctctctgaaaagaggacagttgccatcagctgtcaaggagccccttatgtgaaatctccatgaaggtgaactccagctccgaaacaaygcccagtagttgttgaggctcaatcattatttgttgagtgcataaatgaattaaggttgagaaggaaagccttagttactaaaatcaccaggaatttact

SEQ ID NO: 39845 - DNA, 201 bp, Homo sapiens
aatcttactttttacctaaggcacattgagtacggtttctagaaaatgatatgcgaaacactgctaaagtgaagaagaaacttaagaagcttagcaacggrtgtagaaatattatcatcagctatcagggtaatagtatccagtcattctccacctacaggcacaagatttaggcttaagcagctgaagacaacacagaaa

SEQ ID NO: 39846 - DNA, 201 bp, Homo sapiens
atatgcgaaacactgctaaagtgaagaagaaacttaagaagcttagcaacgggtgtagaaatattatcatcagctatcagggtaatagtatccagtcattytccacctacaggcacaagatttaggcttaagcagctgaagacaacacagaaagtgtgcagtcttagagtgtttaaatatcggcacgtcaaggggaaggac

SEQ ID NO: 39847 - DNA, 201 bp, Homo sapiens
cacccgacgccatccggcccgatggacgtcgaggatcagtctccagagtaggagaaaggccgacgggtcggagaaagggtagcagggagagcggctcgtcrtccagcagatgcagctctgggcttctccaccccctctcctccctcagaggtgtgggcgggcggagagcatctctcctcgaaggaggcgacccccatagca

SEQ ID NO: 39848 - DNA, 201 bp, Homo sapiens
aagagaatcactctctgatttgtggcactactcacaatagcaaagacttggaaccaacccaaatgtccaacaatgatagactgggtgaagaaaatgtggcrcatatgcaccatggaatactatgcagccataaaaaatgatgagttcatgtcctttgtagggacatggatgaagctggaaaccatcattctcagcaaacta

SEQ ID NO: 39849 - DNA, 201 bp, Homo sapiens
ggcagaagggatggtaaagagaatcactctctgatttgtggcactactcacaatagcaaagacttggaaccaacccaaatgtccaacaatgatagactggrtgaagaaaatgtggcacatatgcaccatggaatactatgcagccataaaaaatgatgagttcatgtcctttgtagggacatggatgaagctggaaaccat

SEQ ID NO: 39850 - DNA, 201 bp, Homo sapiens
aatcaaacaacccctccacattttttacctagtctgagcttgcagccagccagagcatgttgctggtagaataaagccaatttaagtgaaataatctattrctaaagtgattatttaatttcccgctctaacaggaggtcctccaatggatgcaaaaggacaggagagacatttcatcctatgcactgaatatattgggca

SEQ ID NO: 39851 - DNA, 201 bp, Homo sapiens
cgcacccagcctcacttatatttctttcagcaatttattccagtttgaacaagacagtcaatttctcatttaaacatggagcaagcaggttatgtgtgtgsaaacaaaaatatctggcaaccattcaaggtttggatgaaaagaaggatgtggaaacatgttacagctagaaatgattactttattgtaactgccatttga

SEQ ID NO: 39852 - DNA, 201 bp, Homo sapiens
gttctgtgactacaggcatgagccaccgcacccagcctcacttatatttctttcagcaatttattccagtttgaacaagacagtcaatttctcatttaaayatggagcaagcaggttatgtgtgtgcaaacaaaaatatctggcaaccattcaaggtttggatgaaaagaaggatgtggaaacatgttacagctagaaatg

SEQ ID NO: 39853 - DNA, 201 bp, Homo sapiens
ccctgcctcagcctcctgagtaactgagattacaggcacccaccatgaagcccagcaaattttttgtatttttagtagagacaagctttcaccatgttggycaggctggtctcgaactgacctcaagtgatccaccagcctcggcctcccaaagttctgtgactacaggcatgagccaccgcacccagcctcacttatatt

SEQ ID NO: 39854 - DNA, 201 bp, Homo sapiens
ggcagtgtctggcaacgcaagtgctatgtggttcctactagataaatggtagaaaagctcttggcacaaaccgcccaagcctgtcatgctcctgggataaractaccttcaagccctgcctgatttcattcctgtccatgtcaccagccccatctttagccattttccttttcattgatttttttctcatttctcatgtgg

SEQ ID NO: 39855 - DNA, 201 bp, Homo sapiens
tcaaacaattggaaaaagtacaatgtggcacaaacctcacaaacttttagcagttcattatttggtccatgggtgggaaggcagcatggcacagaggaaaragccaggacatgggctaggctgggctgggctgggctgggctgggttagagacctgggcccatactgctgactacatggacctggcccatctctaacccct

SEQ ID NO: 39856 - DNA, 201 bp, Homo sapiens
attttaatattatcaattagtaacttagaaattctcccaaagagtcaaacaattggaaaaagtacaatgtggcacaaacctcacaaacttttagcagttcrttatttggtccatgggtgggaaggcagcatggcacagaggaaagagccaggacatgggctaggctgggctgggctgggctgggctgggttagagacctgg

SEQ ID NO: 39857 - DNA, 201 bp, Homo sapiens
tctagtaatatgctttgtaggaaaatgtgtataaaaataaacatcttggtagataagtttttataaggtaaaaaaacagaggcaggcgttcagattttccygctaatatctcattttctcttgtctgttttagatgagtgtaaggccattatcatggactttttccccagctgcaggtaggtgtacccatttgactgaatt

SEQ ID NO: 39858 - DNA, 201 bp, Homo sapiens
ctagaaagagtccaggccttgctgcagttttcttccagtggcactcagaggggtttgtgttttcagtttctgtattattttttggcctatgcagtatttcrttcttagcattttgcaataaattggtggtctctcaatatttctatgtatctggttttaccatgtcccagttgtgtgatcttggaaaatttacttctgtgt

SEQ ID NO: 39859 - DNA, 201 bp, Homo sapiens
ggccataggtttggaactcatggagatcacagtggaaacccaggaaacattctcctgagggctgcgtctccattaatgttttctgcctagggaatgtgctkgctctggctctatgggtaaacaggagggtgaagaggaggctgactgagttaaagacatcagcaggttgggaactattaacactgaggatcatctttctgt

SEQ ID NO: 39860 - DNA, 201 bp, Homo sapiens
caagattctcagacaatgtggttttacgcatcttgtgattgactaaaagagaagtagagctggttgcatttaggaaggtcctttatacctaattgctttakccatacgttaattaactaatcaattaatcaatccgaatcaagtgccaactatgagccagcctctttgataaagtggagatgcaaagatggaggcatggat

SEQ ID NO: 39861 - DNA, 201 bp, Homo sapiens
tcctactcctggacctttccacatgtttttggaaatgttttcatttttcctgatacttttatctataacctcattcttcaggcttctattgcaagaccttstatgctgaagcacttgtttatatgaaggcttcactgtaagttccactttattcttacttttactttgtgtatttattattgtatgcaattttctattcat

SEQ ID NO: 39862 - DNA, 201 bp, Homo sapiens
gttcagtgtttaagagtgatgaataacaaagttgggaaggtgagtggaatattttaaaataatttgataaaataggatgggactgggttttggagatggayggatgtttgcacccagcttccccaagccctagaatatgtgtaggtgagaatatctagcactgtgcttggcacactgtgggcctggggagagttggaaccc

SEQ ID NO: 39863 - DNA, 201 bp, Homo sapiens
catttatttatgttattttatttaatctctatacagctctctgcggtaactactgctattatttctattatccaagagaaaaaaaatgaaaaccaaacagratgagacttaacagagtttaaggacctgcctgaaattcacattgttagtaaggtggaggcatattattccaatccaggaagtcagaattcaaagctgctg

SEQ ID NO: 39864 - DNA, 201 bp, Homo sapiens
cataacaacaaactgaagtagacgtgaatatgtccattttacagggatgaaactgagtctcaatatttgtaaccaccttgctctaggttactcagtcagtwactggacaaggtgggatttgaacccaggtcaatctaattccagatctcaggccttgagcttctacatgacactagtttaatcccttcttgccaagaattc

SEQ ID NO: 39865 - DNA, 201 bp, Homo sapiens
caatcctcataacaacaaactgaagtagacgtgaatatgtccattttacagggatgaaactgagtctcaatatttgtaaccaccttgctctaggttactcagtcagtaactggacaaggtgggatttgaacccaggtcaatctaattccagatctcaggccttgagcttctacatgacactagtttaatcccttcttgcca

SEQ ID NO: 39866 - DNA, 201 bp, Homo sapiens
gataggaatagcttttttagagcgctaggcattctgaaactttctggttatctcagatctcagattgcttaagcttcttcatgcccttacaggtaggctcyggtcttagtagctctgaaatattgtgaaagtttcgtgacctcttgggaccatagttttatcatctgtgaaacatagacattaaagtggaggactttaaaa

SEQ ID NO: 39867 - DNA, 201 bp, Homo sapiens
ggttagcagttcacttttcccagaccgcctggcttctcatagcttaatctctgggcacagctgctgtgagcacacagtccctgggactcatatcttgcccygctcctggcctgatgacaagactgggaggaactgtgggcaggtaaggccaaagggaacctcagaccaatatttctctggagggcagagggacaaacagaa

SEQ ID NO: 39868 - DNA, 201 bp, Homo sapiens
atctatctttctatgtttttcaactcaccatgcttctacactataatctccttgaagggcagggccatgtggtattcattttgttaaccttgtaacacctrgtgggacactctcaagacatgaaaaccagtttataattgtatcaactttacattctggaagatgcctgtcagtggccttttatgtaccttgcacccatct

SEQ ID NO: 39869 - DNA, 201 bp, Homo sapiens
attctttttcccttgataaattccaaggaggagttgctggaaccaagttttagagctctcaccaacttttcttggttggatttacagaggtcaaagtttgragtgcaactagagaggttagcagttcacttttcccagaccgcctggcttctcatagcttaatctctgggcacagctgctgtgagcacacagtccctggga

SEQ ID NO: 39870 - DNA, 201 bp, Homo sapiens
tagagtgttttgggatcatttctggagttatttctttctcaagttcaggcagcaatcattttgcataaaaatcatggctgggctgagtgtggtggctcatrcttgtaatcccagcaatttgggaggccgaggtgggcggatcacctggggattgtgagaccagcctgaccaacatggagaaaacccgtctctactaaaaat

SEQ ID NO: 39871 - DNA, 201 bp, Homo sapiens
tgcttgtttgtttgataagggagggaaacccccaacttttcatgagcgcaagtcctttacctgtgttgaagatacatgacttctgtccataaagtcttcgrtcttgtggactcatacagaaaacacgggtcctgtacaggaaataagaggcagacatgtactccagaacatctttctcatccattttaataatgtctggtt

SEQ ID NO: 39872 - DNA, 201 bp, Homo sapiens
ttcaggtagtcttctcaaccaccccctcggcctagcaaggcaggtgttatcaatctcccctttgtagattaaaaagctgaagatctgaattgtttgatatkttattactcttattaataagatccattcaaaataaaacttgctgtcacaaatgtaattgcagcgaacatgtgcaaagatttagaccaagtaaaaaaagct

SEQ ID NO: 39873 - DNA, 201 bp, Homo sapiens
tcagctctcataaaaactatagcagcatagaatagctgagattaaaagctagatttaaatcatgcaagggctcagttaatatcagcgcctaattaagaaayctgtaaagttgatttgatggagaaaaattctatcaaggtgtgattggaattttcccttccaattgctgttggggattttaagaggaatatatcctacatg

SEQ ID NO: 39874 - DNA, 201 bp, Homo sapiens
tgggactaaatgagtgttaataacttaggtctcttagaagctgtatgaagatatgctaacaaaattctttgctaatacacagaagagatatgccagtgttkgtggtgtgtctgtcctagagaaaggaaccctagggacaggctttcttattcagcttcatatcatcaatgagcatttcagggaccttagtgctaagtgttc

SEQ ID NO: 39875 - DNA, 201 bp, Homo sapiens
ttgagaccaggattagttatgaataaaaccctagacctgtcaagtggatggttgtgggaatcaaacatgaaagcactctgaaaattatcaagtatttcacyccagtaagatcatttattcattcatcaatttttcagaaactatttcctcagcaccagtcatatcttaggcaccatgttcggcaggggaatcacacaaaaa

SEQ ID NO: 39876 - DNA, 201 bp, Homo sapiens
gcatagtgactattaggaatagcagcccccgttaggcagggctccttcacaggttgccattattaataaatgtgatagattaccccctgcgcctcccaacrccaccccccacccccaccatgttaggttgcattctgaattagatttagatggataccctgaattccgttgcatatgactccaggctgacttcacattttt

SEQ ID NO: 39877 - DNA, 201 bp, Homo sapiens
tggaccttgatggtattttatccaattcagggaaaacacacctgctttaataactgctaaggggacaaggatggtgtgggaggaaagatttatataactarttttacaagtgtaaattttaataatttcttgtatagcaaaacaaaaaccaaaaagcatatacaataaaactttctttggtatttagatggtatttttctt

SEQ ID NO: 39878 - DNA, 201 bp, Homo sapiens
ggacagtgcccttgtacttgacccatagtaggtatgggaaagaaggtttaggagcccatctgttctgagtttgtccaacgcacagtgcttcatagggctcytccagttctcatttactctctacaatatgggaagtacatttcatgattttgattaaaaatgaggaggcagaagggatggtaaagagaatcactctctgat

SEQ ID NO: 39879 - DNA, 201 bp, Homo sapiens
cctcagcctcctgtgtaactggaactagcaccaccatccccatctaatatttgtatctgttgtagagacagggttttgccatgtctctacatgcagggggrtgagctcactgcaacctccacctcccgggttgaagcgattctcatgcctcaacctcccgagtagctgggattacaggtgcccaccatcacatccacctaa

SEQ ID NO: 39880 - DNA, 201 bp, Homo sapiens
caaagtgctgggattacaggcgtgagccactgcgtccagccctcaatagtcttgtttaaggagatgatacaattttattcttgtatcaatttctagaattyatcaaagtttgctagtaattcttttattttggaccttgatggtattttatccaattcagggaaaacacacctgctttaataactgctaaggggacaagga

SEQ ID NO: 39881 - DNA, 201 bp, Homo sapiens
catagagttgaggattgagaaggacagtgcccttgtacttgacccatagtaggtatgggaaagaaggtttaggagcccatctgttctgagtttgtccaacrcacagtgcttcatagggctcctccagttctcatttactctctacaatatgggaagtacatttcatgattttgattaaaaatgaggaggcagaagggatgg

SEQ ID NO: 39882 - DNA, 201 bp, Homo sapiens
gaacttctgcctatccatgagacttggaaacaaaagaccctaagccccagagggttgatggaaaatggggtggaagaaagggagagcagggcagctcacaygagagcagttaagggacaagggtaaagcaagtgaggccacccgagagagagcaccccctcacttgtctcatctgaggtgcctgctcaagaatgggttgtt

SEQ ID NO: 39883 - DNA, 201 bp, Homo sapiens
ttcccggggggtgggcgcaagggtgcaatccaataataattaaaaaaaagactgtataaccattgtgtaggaagagcttcagccaccctacagccgagagygagttggtcttccacaagtcactgggggagatgaagggtacactgtagtcaggtggagtctctttgggcctaaaatcactataggacacttttccaaagt

SEQ ID NO: 39884 - DNA, 201 bp, Homo sapiens
tcactctgcataactgaaatattgcaccctttcactaactcgcccgcgtccctcctcacgcgcttcccctgacaaccatcattgtaccctcttcatctgcrtgcttttgcccctctagaacttgccttggttaggactgcaaaatggatattcagttcagtcgctcttagcttctcgattgccccaaaatgccagaaaagg

SEQ ID NO: 39885 - DNA, 201 bp, Homo sapiens
gtgggcgcaagggtgcaatccaataataattaaaaaaaagactgtataaccattgtgtaggaagagcttcagccaccctacagccgagagcgagttggtcytccacaagtcactgggggagatgaagggtacactgtagtcaggtggagtctctttgggcctaaaatcactataggacacttttccaaagtaccctggtgt

SEQ ID NO: 39886 - DNA, 201 bp, Homo sapiens
ctgatagaaagtgggacaagggatcataattgggttcaactatctttctagccccttcccctcctgcatatacactggaattgcatccttagcttaacttmagaaaattcatgtatttatccttggcaaatatacacacttatacatctatatgtatatgtaaaaaattaactagggtagttaataattctaccctccatt

SEQ ID NO: 39887 - DNA, 201 bp, Homo sapiens
tttccattttttcaactctaaattgagcatctttcccctgctaggataatgtaagaatcagagacaacttctggaaagcatctagttggacacttggcacytaagcaggcacttaaaagagagaagctgttaggttctggccaggtttgaaggcaggaacatgggccatgttttagataacaaatggaaagactttactat

SEQ ID NO: 39888 - DNA, 201 bp, Homo sapiens
attattgtaattcaagaatatggttttatgtctagtaaagtaagctctccctctttaagattggtattctagatgatgctttcttatttgttattccatargaatgcatcaagtttcaagtttagatgttagaaaatacaatttaagccaagcacggtggcttacacctataatcccaggtctttggaagactgaggtggg

SEQ ID NO: 39889 - DNA, 201 bp, Homo sapiens
tgcagcagctcgtgaaatcctgactccaagcatataatacatgtgctgttacagaggcgaaaaagcagatcgagggagataggttaagtgacttctccaasgtcacaaccaataaacatcaaagcaggaagtgaaccccaagcttcattacagagcttgcaatctaatcatcggggcaccccacttcccagctggattagt

SEQ ID NO: 39890 - DNA, 201 bp, Homo sapiens
gctacttgagaggctgaggcaggagaatcacttaaacacggtaggccaaggttgcagtgagccaagatggtgccactgcactccagcctaggtgacagagygacactctgtctcaaaaaacaaaacaaaataaaaagcaaaaagatgtaatatctggatatgtaattgaaattctactttttcagatacatgcttggtttt

SEQ ID NO: 39891 - DNA, 201 bp, Homo sapiens
ttgttctaatgcaacaatcccttttagagtttttggtactctaaaaccaaattaaattggctcatgttcattcttaacaattatacttggttcccctaatwtttttttttttttttttgagaccagggtctcactctgaaacccacaatggagtgcagtggcacaatcacgctaagtgcagcctcaatctctcaggctcaa

SEQ ID NO: 39892 - DNA, 201 bp, Homo sapiens
tcttccacttaatttaaaaaaatatattacctggtcctttcttagaaattacatattggaggtctataatggccaagcctttaacccattaaaaaaatttwctcccagggaacagttaatatttgacgtttaattgctttttcttgttggagaggaaaatggtttttttcttcttttcttgattgacttttcaaaaatcac

SEQ ID NO: 39893 - DNA, 201 bp, Homo sapiens
gcttaaagagatatgcaggtaattcaagcttccctggcaaggaagatttgctccaacttctccaagtagcagtgccatttattagattttctttcttttttcttaaagttttttccaggtttttatttgatctatgtacttctcactgtttcttgttctaatgcaacaatcccttttagagtttttggtactctaaaacca

SEQ ID NO: 39894 - DNA, 201 bp, Homo sapiens
gaccacagagccaaggaaaaaggtcatgccagtggtccccatcttggagtgcaaatcctctcaacctctttagcaagcgccagattcaggaatatagcagrtaatccacaccaccagcaaaagtcaaaagagcccaactctcatcttttctaagcattttaatgtgagtccttcatggtaattaaggtaggagaagccgtt

SEQ ID NO: 39895 - DNA, 201 bp, Homo sapiens
tggcagagtttatgtattgtatgcaatgctaacataacgctgagtttcaaggatagaggccaggattcctagtttggctttgttaaatgggaaaaaaaaaatcactactgtattcgtagtgtttactacatttaagagattaattctcataaataaaattgtttataccagcttctaatcagaaagttgaaattatctgtg

SEQ ID NO: 39896 - DNA, 201 bp, Homo sapiens
gtcatgaagaactactttaatagtcataaggtgatgagctgtatgacctaaggcaatttacttaacttctttgtactgtcagtgtttatctgtcaagtggmaataataagagtatctacttcaaccaaacttccaccaattcttctgagtaataaataagcaaatatatgttaagtgcttagaatggtggctggcacactc

SEQ ID NO: 39897 - DNA, 201 bp, Homo sapiens
attagactgagaaggaagttggaaatagaaacagttcgcttagatccctcatggattcactaaaaacagctcaagtcatgctgacttatttttttttttttctgataaggtgaatgtgtggtaggaagggatgccataagccagcaaactgtagtctcttcaaactgtaaagtcaagaggaaatcaccaggggatcttgtt

SEQ ID NO: 39898 - DNA, 201 bp, Homo sapiens
aaaaggcaaacccatatttaaacttaactttatatggactgtgaacttgtcagggtgatagattgagaagttattttatttctttaaaaaaattttaaaaatgtgggcaaggtgcattggctcatgcctgtaatcccagaactttgggaggctgagggaggtggatcacttgaggtcaggggttcaagaccagcctggcta

SEQ ID NO: 39899 - DNA, 201 bp, Homo sapiens
  misc_feature (1)...(201): n = A,T,C or G, or insertion/deletion polymorphism (see Tables 1-2)
catcaaacctttatttgacaagtgtttattgagcacatattaagtgacactgacatgtggctggcccacccgaaatatacagttgctacgtaaaacaaaantcacaagtaatgtgtacagtggagattcctgatcccagctgcatttttgacccttggtcagtccctaacacttatcttgattttggataattttttggat

SEQ ID NO: 39900 - DNA, 201 bp, Homo sapiens
gctcactacctgggtgatgggatcatctataccccaaacatcagcatcacacagtatacccatttaactaacctgcatatgtagcccctaaatctaaaagytgaaattgctaaaaaaaaaaaatagcataaataaataaacttagatatgcccccctccaaaaaatgaggagagtttggtggtggaatgaggagggagaaa

SEQ ID NO: 39901 - DNA, 201 bp, Homo sapiens
cccgggaggcggaggttgtggtgagccaagatcgcgccattgcactccaacctgggcaacaaaagtgaaactgtgtctcaaaaacaaaaacaaaaaaaaaattggagagggaaaccagaagtcagaggttgggctaacctctaagtcctaagtgaaatggctcaacctggtataacctaaataagggttacacacattcta

SEQ ID NO: 39902 - DNA, 201 bp, Homo sapiens
acttttcctagagttatgaattccagttagaaatttgttcagaaaatcacttgtccttaggaatataatttcacaagacacacaagttgatttccttatartctatcatggtgatttctaccctggctcaaggctgtgattcatgaagaagagtggtaggaaccagacttcttaaaagtggtgagcatcaggccacaatct

SEQ ID NO: 39903 - DNA, 201 bp, Homo sapiens
tccttactgtaagagttctacaattgtcttggagacaaaacccagacttttaacatggtgtacaagaaaaacttttgctaatgtggcctgggcctgcttcyactatgccatctctccacaaatccagctctctagtcctgcagaagtctatttgccaggcacattataccttagtgcctttgaccatgcaattccccttgc

SEQ ID NO: 39904 - DNA, 201 bp, Homo sapiens
gactagcctgaccaatatggagaaaccccatctctactaaaaatacaaaattagctgggcgtggtggcatatgcctataatcccagctactcaggagactrgggcaagagaatcatttgaacccgggaggcggaggttgtggtgagccaagatcgcgccattgcactccaacctgggcaacaaaagtgaaactgtgtctca

SEQ ID NO: 39905 - DNA, 201 bp, Homo sapiens
tcatgattttacctgtagctatagctatgcggatgtgtttagagttaaaaaaaaaaaaatgtaaccagggctgggagtggtggttcacacctctaatcctratactttgggagggagaggcgagaggatcacttgagcccaggagttggagatcaccctgggcaacatagtaagaccctgcctctacataaaattaaaaaa

SEQ ID NO: 39906 - DNA, 201 bp, Homo sapiens
ttataattatcaccaagtacaatgaagcagagaaagaaactatctcgctcctaaatggcatcatccatataagccttgccttgttcaaagctactctgtaktattttcttttaaataaaataaataaggcacaaataaacaacataacctaaagaggagatggaatggtctatttctttttgttttttggaagctaaattt

SEQ ID NO: 39907 - DNA, 201 bp, Homo sapiens
cattaagaatcttagtcatggttttgtaactcacccccgccagcatggagcagaatctcttatttctggaggcaagacaacctcggtcaacatcaaaggargttctaggattttctatggaagaaaaccaaagagcattgaataatagctgagacctggacccaaaactgtgtcgaggaacacacattcgactagaattta

SEQ ID NO: 39908 - DNA, 201 bp, Homo sapiens
cacagatcccctgccatgaaggcatgggttttgtcattcaggaagagtctaattgactgtgtcaggatatagcttttcaacttgccactcctcaaaaatgrtatttataaaagaagttagaaaataaaggctccctgccatcttgtgcttaattaccatagcattccaatttaactctaattttcaatacattgtggatta

SEQ ID NO: 39909 - DNA, 201 bp, Homo sapiens
aaaaagaaaagttcaacaaaaaagtcaagggaagggggagaatataattctcagtaatgctacgggggcttcagggtctgggtgtgaggaccggcacccaygtggctatggaatagctctctcccttggctctctctctctctgttgagagtgggaagaaatttcaggagaaatataaggcatggcccaagatactcattt

SEQ ID NO: 39910 - DNA, 201 bp, Homo sapiens
tgtgtattctaatttacaattgaactacagatcagagcaatcaatcttgggcagcacttttacagtgtaattgctgcaacataacaaataaaaaaaaaaaagagagagagagagagaagaagaagaagaagacctaagctgagcgtcagcttgaggtggagatatctgcaggcactagttcagggtgggagggaagaaacg

SEQ ID NO: 39911 - DNA, 201 bp, Homo sapiens
atttatgtataaacatacatatgtgtatatatgtaaacatgtatgtatatatatgcttatacataaacgtatgtgtatataaggtacatatacagacagarcaaggaaatttggggtgtcttatgagaatgcatacaaactcaaggatgtcatcgaacacaatactgctattgtttatgggttgtgggaggaaaatggaag

SEQ ID NO: 39912 - DNA, 201 bp, Homo sapiens
ctaaaattagcttctagaatttatgtgttataatgaaaaattggaagccaactatatgtccaagaatagtagattgagtccatacatataacatatcaatrttgaaatattatatgggctttaaaatgttataaagtcgtattaatatttaaaaaggttttagggtaatcgtaaggacaggtaaaaggcaaacccatattt

SEQ ID NO: 39913 - DNA, 201 bp, Homo sapiens
catcatttttgccaaaattctccatttttattattgtaattcaagaatatggttttatgtctagtaaagtaagctctccctctttaagattggtattctaratgatgctttcttatttgttattccataggaatgcatcaagtttcaagtttagatgttagaaaatacaatttaagccaagcacggtggcttacacctata

SEQ ID NO: 39914 - DNA, 201 bp, Homo sapiens
gagtggaaaatattttgtgtacagtattttttgctttaggttatttagaagccttatgtatattaggtttttacatgtgagcaaataactaaaaacaagarcaggacctaccagaagcttcaacagaacagacagaccatggaagacctcatgttcttttgaattagtgaaaagctatatagtttaagtaggtatcttggt

SEQ ID NO: 39915 - DNA, 201 bp, Homo sapiens
atccagacgccagcatttaactagcgatgtgaagttaggcagatcacttaacctctttgagccccagattcttccattcacatgctatgaacctgataccrtcatcatggtgggtgcttcatagtcaacgcagggaagtcagatggagactgatccatgagccccatgacccagctgtcctgctcctgggagtggaaccca

SEQ ID NO: 39916 - DNA, 201 bp, Homo sapiens
gggcccccaaagcctccagcacattactatgcactgtgaatccccaggacatttgatcttcaatagatctgattacccaaaccgttttataaaggataagmttgtagcattggtgttcaaggaatagactttcaggagacacagattcctattttctaagatggcaacaacctgttggtagaagctagttcttttatatat

SEQ ID NO: 39917 - DNA, 201 bp, Homo sapiens
attttcctttattcttccttctgctttatgttttaaaaggctttgcctatgcccagagtaaaatcagtattaacctatattttctactagtgcttctgtgrctcctttaatttataaaaacatttaaatctcttatttatctggaatttttttttggtcattaaaatttcttttccttgttgatctaaatgtatgctattg

SEQ ID NO: 39918 - DNA, 201 bp, Homo sapiens
tagctagcttaaagtctgggcttctgacttgtgggggatgaaatgcaaaaatgaagaaagcttagattatgcaaatttgattttaaaatcacagtttaacygagtcagggataaaactgataaaaatgcagatttttaaacgttgatggaaacagacaattttgctaattattttctgatcagtttggaattgcatggcaa

SEQ ID NO: 39919 - DNA, 201 bp, Homo sapiens
ggcgggatgaagtcattgtaatattctcatttagtttgggtcctgagacttataaagagaataccggtggcagactgcacatacggaagagatgcctattyatttcacatgatactagctggcctttccaggctgtggatcatgagctcaggggagcccaatggagatgggcatactcatttgttctgcagagaagatatg

SEQ ID NO: 39920 - DNA, 201 bp, Homo sapiens
gcttgcagacactttgaagggttagaaaaacggaatttattgggcaaaagggaataaaaggggaagcagattctcagcatagtgagagtcctgctagtacwggcttcccacctcacaggctgaatcccaggtaccacccaggaagagaaggagccaggctcctccctcctgcaaatggcatgagcttcccgagactccaca

SEQ ID NO: 39921 - DNA, 201 bp, Homo sapiens
tattcagccaagggtcctcctaaaggggcttgctcagctttcaaaagaggtggactcgtttgtcagccatgcagtagatttaaatcagtgttctccagaasacgtttgaaatagtaatttcatgtctcaaaacattgatttaaaaaaatgtccggggtcaagtgagaaacagtagattaacctgagttaaatatgattgtt

SEQ ID NO: 39922 - DNA, 201 bp, Homo sapiens
ctaactttctttccatttcttgactctgtcttgttttgtgtgcaggtgattttgcatgctttttaaaatatttgtttatttaacatttgccctgtagttcyaaggaaattttcattaattttctattaaattataaaagttctttacatattaagtttatcaactctctcattatcatatattgcaaacattttctccatt

SEQ ID NO: 39923 - DNA, 201 bp, Homo sapiens
ctgtacatctagactgcattaaaaaataagcaaaactacattttccttggccttgtaaacaatcccacatggtatatgggccaaaaaaggaaaattaacaraaaagggagaatgtaccaaaccatattcagttagtaaaaggggatgtttttccatattcttaaatgaagatcttttacccaatatatccagtctctcata

SEQ ID NO: 39924 - DNA, 201 bp, Homo sapiens
aaaagataagaaacatagcatcccattgtgttttgtattatgttgattatttgtgatgctaactttctttccatttcttgactctgtcttgttttgtgtgsaggtgattttgcatgctttttaaaatatttgtttatttaacatttgccctgtagttctaaggaaattttcattaattttctattaaattataaaagttct

SEQ ID NO: 39925 - DNA, 201 bp, Homo sapiens
gatagcttttcagacccaggttttatttctatgtgttgtttcagagtctattccagtgcatgaaaaaaaaaaatcatgtggaactagtgggagaaacttarcatacaatgtgcctgagtgattggtttccctctgctttttttttttttttaatgatttctgcctgatggtggggaatagaagcaattagtttggctatgt

SEQ ID NO: 39926 - DNA, 201 bp, Homo sapiens
ttttctaatctttttcctctactttttttgcacacatatatttgtgtgtttggaaactacagtgcaggccctgctgtagtgtactattttgcaaactgcgyttcccatttgataagtcatagtaaatatttgttcattttgttaaaactattccaaaacataatttctttctttctttctttcttcttctttttttttttt

SEQ ID NO: 39927 - DNA, 201 bp, Homo sapiens
gagaagaaaaggaaacacacgatcataaagaactaatcatgaaaaatggaaagtgagaaagagccaagaacaacaagcaataaatagatttggaagggggraaaagatgaggaggaatgaaaagctatgctcaggaaagaagcaacaagagcatgtgcgtttcatttgaaaaaaattaatgattctgaaaatcattaaaaa

SEQ ID NO: 39928 - DNA, 201 bp, Homo sapiens
aaaatggtgttggaagctgcagactttctgagaacagataaaaaagaaaagaaaaaaaagccagaacaaggtgaaggcatagactcacaaactcaagaagmctggcggtccgggttcactttctcctgtagcatcttctccaggtagtccacctgacacctgcaaatttctggcaaagtaggactgaaacaaacacaagaa

SEQ ID NO: 39929 - DNA, 201 bp, Homo sapiens
ctgacccacaggcccctgacacaaaatacattaagtattcttgggacacactggtctgtcactcacaggaggagcaaataaaatggtgttggaagctgcaractttctgagaacagataaaaaagaaaagaaaaaaaagccagaacaaggtgaaggcatagactcacaaactcaagaagcctggcggtccgggttcacttt

SEQ ID NO: 39930 - DNA, 201 bp, Homo sapiens
ataaaatcagcacaaataaaacaaggcttatctaaatataagttgaggtggtcaatcaaactcttaatggaacataaaattgatatacatatatccaaatrtacatgataaacttgttaaattctttttgtcctattaaagataattaaaaaataccaaaattcaaatatgccttctgccttcaaacgtcacttcttttta

SEQ ID NO: 39931 - DNA, 201 bp, Homo sapiens
cataccactcattctgaaaacagtggtctaggtcatatttaaaaaataatgtgttcttgaatatgaaaaaattcaatagattaatttgaaaagtataaatmattcaacacaaaattatgcatttctctttacatattttcctatataaaaatattgcctcctccttgttaagtaaactcccattggcacgtgtaactccca

SEQ ID NO: 39932 - DNA, 201 bp, Homo sapiens
cactcacaaccacagcgggcacagctgaacagagagacctggctgtgtgttaaaaaggctgaggaagaacaaaaaagctgccagttttcataagaaatctyatccctcgagcattgagaactgtagcccgatactcaccacactctttatccttgtcccacaacctgccgatcccaggctgggacttggaagcagctaaaa

SEQ ID NO: 39933 - DNA, 201 bp, Homo sapiens
cttgcagcttggcactttggagggggcatctgtggaacccatacttggggggcacagcatcaagtgtgggttttaagtgaaatattgaggatttttttttwaaaaagtgccctaggcttgtgggactagagtcctctttttccctgagaattcccaaggcgctggtctttgtcttagaaggaatggagtttctgaatggtg

SEQ ID NO: 39934 - DNA, 201 bp, Homo sapiens
cctaatcagatcttcattttgtttcaacttttgtagattcctaggcctgaggcagatgcattaaaaaaatatatgattaaaaaataaatgttttagacacygttcacgatgtgaaagtttctgcatcctcctagctttctgtttccatcacaagtgaagttttgccatcagggtaggtcttgatttttaggtgcatatcca

SEQ ID NO: 39935 - DNA, 201 bp, Homo sapiens
tgtaggaagctgaagaatattttcttgccaacgttttggcaagacttattttttcccggggggtgggcgcaagggtgcaatccaataataattaaaaaaaagactgtataaccattgtgtaggaagagcttcagccaccctacagccgagagcgagttggtcttccacaagtcactgggggagatgaagggtacactgtag

SEQ ID NO: 39936 - DNA, 201 bp, Homo sapiens
tggtgcatgtaggaagctgaagaatattttcttgccaacgttttggcaagacttattttttcccggggggtgggcgcaagggtgcaatccaataataattwaaaaaaagactgtataaccattgtgtaggaagagcttcagccaccctacagccgagagcgagttggtcttccacaagtcactgggggagatgaagggtac

SEQ ID NO: 39937 - DNA, 201 bp, Homo sapiens
tcctcttcctcttcctcttcctcttcctcttcttcttcttcttcttcttcttcttcttcttcttcttcttctccttctccttctccttcttctttttcttyttcttcttcttcttcttcttcttcttcttcttcttcttctttcatggagttttgctcttgttgcctaggctggagtgcaatggtgcgatctcagctcact

SEQ ID NO: 39938 - DNA, 201 bp, Homo sapiens
caagaaagattgctaaccaaatctttgctacctatagcctaggatattgaaacataagctctctatggaagtgttgtaggcctttctccttagttcagctraaataggggtcttgtcacacaaccacgaaatattaggcttgcagacactttgaagggttagaaaaacggaatttattgggcaaaagggaataaaagggga

SEQ ID NO: 39939 - DNA, 201 bp, Homo sapiens
aaaccagtattctgttactgctcatgtaacaacccttctattttccacatcctcccctgcctcctcctcctccttcttcttcttcttcctcttcttcttcytcttcctcttcctcttcctcttcctcttcctcttcctcttcttcttcttcttcttcttcttcttcttcttcttcttcttctccttctccttctccttctt

SEQ ID NO: 39940 - DNA, 201 bp, Homo sapiens
aatgctatccacaggaacatctgccagattcctgtgattcctcctcattttttcctgacatactccctcgtcatcttgtttcagaccattctgcatttggyatctcagaacttgaagaaagtaaatcttctctggaaacagagtgactttctactgcagaggaagccaccactcttgggtgttccctgtggtaaaatacga

SEQ ID NO: 39941 - DNA, 201 bp, Homo sapiens
taaaaatttcacttatatgtattaattacaaaacaactctaccttatcaggatacaaaaacactgttaagaaaatataaattggatggccaggcatggtgrctaacacctataatcctagcaatttgggaggctgaggtgggagaattgcttgagcacaggaattcaagaccagcctgggtaacataacaggactctattt

SEQ ID NO: 39942 - DNA, 201 bp, Homo sapiens
tttataatcatgaaaccagtattctgttactgctcatgtaacaacccttctattttccacatcctcccctgcctcctcctcctccttcttcttcttcttcytcttcttcttcttcttcctcttcctcttcctcttcctcttcctcttcctcttcttcttcttcttcttcttcttcttcttcttcttcttcttctccttctc

SEQ ID NO: 39943 - DNA, 201 bp, Homo sapiens
gtggaaagaaagcaggagaaaatgacttggcttgtggcttttaggcttccctctcaatcatttctatcctttcatttctgttaatttcaacaatgctatcsacaggaacatctgccagattcctgtgattcctcctcattttttcctgacatactccctcgtcatcttgtttcagaccattctgcatttggcatctcagaa

SEQ ID NO: 39944 - DNA, 201 bp, Homo sapiens
ttatttataatcatgaaaccagtattctgttactgctcatgtaacaacccttctattttccacatcctcccctgcctcctcctcctccttcttcttcttcytcctcttcttcttcttcttcctcttcctcttcctcttcctcttcctcttcctcttcttcttcttcttcttcttcttcttcttcttcttcttcttctcctt

SEQ ID NO: 39945 - DNA, 201 bp, Homo sapiens
acaaaaaaaaaatgaagagcttactaaatactagagagctaaagacggaagtggaaagaaagcaggagaaaatgacttggcttgtggcttttaggcttccytctcaatcatttctatcctttcatttctgttaatttcaacaatgctatccacaggaacatctgccagattcctgtgattcctcctcattttttcctgaca

SEQ ID NO: 39946 - DNA, 201 bp, Homo sapiens
atttaaactaaaatttccctttctgttttggcttccagaatgttctttatacctcagagagaggactttcctttttctaataattttttttttttttttttgagacagagtctcgctctgtcacccaggctggagtgtagtggcacgatcttggcttactgcaacctctgcctcccaggatcaagccattctccttcctca

SEQ ID NO: 39947 - DNA, 201 bp, Homo sapiens
aaacaggttattttgttcagggaaccttttctgaaagagttaccagggttcatctgatgccattagctttgccagtaatttccatgatgtcaagggcacaygggagattaaagagggattaagacctgcttgcacagtcaaagcatcacagtaaattgacttgacttggcaggctacacttcaggttggcaccttttcacc

SEQ ID NO: 39948 - DNA, 201 bp, Homo sapiens
ttacagagcttacactattaatttataataccttatcattcctcataatatgtggttataagtaaaaaacaaacattaacaaccaaaaaaaaaaaaaaaaacccacaccagcaaacaaaaatcagagaagctcttctcttataataaccacatgagaaaataggaaagcttagactgagaaaacggccaaacctaaaaaag

SEQ ID NO: 39949 - DNA, 201 bp, Homo sapiens
cttgaacccaggagggagaggttgcagtgagccaagactgtgccactgcactccagtttggacgacagagcaagactccatcaaaaaaaaacaaaaaaaaratgaagagcttactaaatactagagagctaaagacggaagtggaaagaaagcaggagaaaatgacttggcttgtggcttttaggcttccctctcaatcat

SEQ ID NO: 39950 - DNA, 201 bp, Homo sapiens
aggcggaggttgcagtgagccgagatcacaccactgcactccagcctgggtgacagagcaagactccgtctcgggaaaaaagaaaaatacaaaaagtagcygggtgtggtggtaggtgtttgtagtcccagctactcaagaggctgaggcaggagaattgcttgaacccaggagggagaggttgcagtgagccaagactgt

SEQ ID NO: 39951 - DNA, 201 bp, Homo sapiens
ctacagctgctagaagatatgaaggcaagcacaaaatactacctggatcatgatttatacatgctgaacagacaataaactcactgcactcctttgccccmacagaaagtgctcacagctagctataactccagtgtggtatttccaagcaatattttccaaagttaccaagatttttcttatttacaaaagaagcaattc

SEQ ID NO: 39952 - DNA, 201 bp, Homo sapiens
aaaaattacagacattattttccatatgataatataccctaagtgccctgcagtgcattattgggttaattttgatgactgctttggtttgagaatgaacyggcaactctgttatctgtccttgatgtgtcatttacagatatttcaccctgaaaagcacaggatgataggagaaagagaaaagataaaaagtggccaaat

SEQ ID NO: 39953 - DNA, 201 bp, Homo sapiens
ttccattgtcttttctaagtccctaaaaattacagacattattttccatatgataatataccctaagtgccctgcagtgcattattgggttaattttgatractgctttggtttgagaatgaactggcaactctgttatctgtccttgatgtgtcatttacagatatttcaccctgaaaagcacaggatgataggagaaag

SEQ ID NO: 39954 - DNA, 201 bp, Homo sapiens
agaacccgtgtacaggactcaaatttccctacaggggttgtaactgaagcaaggattaagtgccagtacacaaaacctctcaagcaatggacagcatgtckattgctaaacattctatggtagaaggcctttagtttttctcttttataaagcttgagatcaagttttggtaagaagtaaaaaagcaaggcaatttagctc

SEQ ID NO: 39955 - DNA, 201 bp, Homo sapiens
atgtatagttcataaacgatgagctttgcctcccagatagattaaattggactgtggattggcacacggtaagtattcaattaatttttgttgaatgaagraatgagtgagtggctcctccttaaaccagggtccctgctccaaaatataatcctacatagctttgcatactactgtattcttcataataatcatctctga

SEQ ID NO: 39956 - DNA, 201 bp, Homo sapiens
ccgccccgcccgatggtgagtacccttctcgtcgcgattctcctcctagcttaaccgagcgctcgcctacccgaaccgtggccgagggcgccgggctaggmttttctccctccctgcctgcctggctgtcagttgcacaaggttgcaaaatgaagcgcagaggcaaagcgaacagtaaattctgatacttagtgcgagcct

SEQ ID NO: 39957 - DNA, 201 bp, Homo sapiens
tagtattccattgtagccatataccactgaggagaatttttagagagagagaatatgcaccaaagaatgccagagaagagtttccgggataatgagatggkggtggttggggggacctgaggtattttactataaaaaagggcacttttaggaaaggacaggagaactaccttctactatttaaggcaagaatcagcaaac

SEQ ID NO: 39958 - DNA, 201 bp, Homo sapiens
ggattcattgaattcctcctttccctcaatctagtccgtgtgtgtttttctcttccaccacactggagctccatgaatagggaaaggggcttccattgtgyccctctgaacttccaagtcaatgcaatttttaaccactggcttgtggtactttgaaaatcaccaggggctgtcagagttaggtcctctgaaaaatttaca

SEQ ID NO: 39959 - DNA, 201 bp, Homo sapiens
tttgctttgtaaagggaaatgtgtcaaagcattaagcaagcattaatttttcctcagagctttattcacatattggacgatgctgaataaccagagagttrtgcgattatgcacaacattattaatgcaattatgtctggatgtcctgtgatgttgtgggactggtgctccaagcccattatgattgctgttgcctgttga

SEQ ID NO: 39960 - DNA, 201 bp, Homo sapiens
ctctccagccaacatcctgccacacacccagtcatggtgagaggggaaagacctctgcccactgatggacaggaggaggcagccgcccagcctcccctgtkcacaccctctgtacacacatgtaagcgcacatgtatcagatgcacatttgtcaatgtacacagacaaagacttcaccgactatgcttctaggtcatagaa

SEQ ID NO: 39961 - DNA, 201 bp, Homo sapiens
aagtcacttcatttctcccagtcttttctcctttacttgtcacataaagagtttggaggagaattgtcaaagtagcttcttcttcttttttttttttttttgaggtggagtctcactctgtcacccaggctggagtgcagtggtgccatctcggctcactgcaacccctgcctcccgggttcaagtctcagcctcccgagt

SEQ ID NO: 39962 - DNA, 201 bp, Homo sapiens
caagtcacttcatttctcccagtcttttctcctttacttgtcacataaagagtttggaggagaattgtcaaagtagcttcttcttcttttttttttttttttgaggtggagtctcactctgtcacccaggctggagtgcagtggtgccatctcggctcactgcaacccctgcctcccgggttcaagtctcagcctcccgag

SEQ ID NO: 39963 - DNA, 201 bp, Homo sapiens
atcaggtagtttctcaatacaatctcccatttattcagtgctattgtgcatgcagtttccctattcaatttcatgacttcgctgagcaacattatttttttcagcattttaagcatttttatttcatatttgccactttactggtttcttattcaaataacttgtcaatttgattctcttgaatcatctaggtagataaca

SEQ ID NO: 39964 - DNA, 201 bp, Homo sapiens
gactttcaggcccgaagccccggcccaagagtagtggagtccgagggtcgggattcctcacatcttactcgggcaacgtagcagaccgaggtagcgctccygtaggacgcagcgggaccccgcagtgccctactccaggtccacggtgcggccctgcaataatgaaatcgtctgcgcccggggaaggccaggagggccagg

SEQ ID NO: 39965 - DNA, 201 bp, Homo sapiens
aaaaaaaatgtgagctttaataaattcccctttggtgtgcttccattgtcttttctaagtccctaaaaattacagacattattttccatatgataatataycctaagtgccctgcagtgcattattgggttaattttgatgactgctttggtttgagaatgaactggcaactctgttatctgtccttgatgtgtcatttac

SEQ ID NO: 39966 - DNA, 201 bp, Homo sapiens
gagactaggagtttaaggctgccgtgagccatgatatagccgctgcacttcagcctgggcaacagagagagattctgattcaaaaaaaaaaagagagagartacaatttatagattaatgtgtgtggattagaggtctttttaaaaccaggttttctcatgtagaaataaaccatgccttctcatcgatcttttcatatga

SEQ ID NO: 39967 - DNA, 201 bp, Homo sapiens
cagcaaccatcctaaaggggtgtagcaagtcatttgaaatttgtacacagactgccctatccattacacatggcccatatcatacccataatctcccaagscagatatgctattacactcagcgggccaaggtctgctggtgcttatatacacataactcccactgactctgtgccactgagacacttcaatgggggttgt

SEQ ID NO: 39968 - DNA, 201 bp, Homo sapiens
gaagagcaggactgcccaatgcagcagtattgaaacgacaagtcatgattttacctgtagctatagctatgcggatgtgtttagagttaaaaaaaaaaaaatgtaaccagggctgggagtggtggttcacacctctaatcctaatactttgggagggagaggcgagaggatcacttgagcccaggagttggagatcaccct

SEQ ID NO: 39969 - DNA, 201 bp, Homo sapiens
tcaattgcaaaggttggcagtatttcagagagggtatgaaggcttcttggaggtcatcatttaacatttcataaaatgtttgtgtgtgtgtgtgtgtgtgttttaacttttagatctttctctctcttagttggaaggcaaagaagagagtgagtttactgttctaaaccctgtgacctaatagtcctctaatgctccggt

SEQ ID NO: 39970 - DNA, 201 bp, Homo sapiens
taatattggcattgcataaaagcaacagaacaagtctgcagattatacactgcagaggccctttaaagaaacagttaatccagagattaggctgcatattytgaggactttttcaaatttttgtcaggcacacactctcatctgatgcttgcaacagtgttgagcatattgtttgtgaagtggtagtgaaccttagtatga

SEQ ID NO: 39971 - DNA, 201 bp, Homo sapiens
attggttgcagataaacacgttaaatactttgctgacagatttcgttcataagacacaagatatagcaatttcaactgatgtgcgagttcatagatgttcmcgttgctttacaagttcattagaatggttttgctggctgtaatcatagaggcatacatacgtctgctgcaaagacatcagagctcacctaattttcctag

SEQ ID NO: 39972 - DNA, 201 bp, Homo sapiens
gtcaattgcaaaggttggcagtatttcagagagggtatgaaggcttcttggaggtcatcatttaacatttcataaaatgtttgtgtgtgtgtgtgtgtgtkttttaacttttagatctttctctctcttagttggaaggcaaagaagagagtgagtttactgttctaaaccctgtgacctaatagtcctctaatgctccgg

SEQ ID NO: 39973 - DNA, 201 bp, Homo sapiens
tggctttagagagtcttccatgagcaaatatatgagcttggcaccctgaagcttttgcagctattttgactgcccacaggatttttcttgcttacttactsgtttcttagcttccattcagaaggcagaactttccagctaattgacctccaaatagttgaagcgtgattgtattattgctactaataatattggcattgc

SEQ ID NO: 39974 - DNA, 201 bp, Homo sapiens
tcattttagaagaagttaggtaaaaaaggggcttatgcatcgaatgtgattattgcaattggttgcagataaacacgttaaatactttgctgacagatttygttcataagacacaagatatagcaatttcaactgatgtgcgagttcatagatgttcacgttgctttacaagttcattagaatggttttgctggctgtaat

SEQ ID NO: 39975 - DNA, 201 bp, Homo sapiens
tatgtaagtatattcacatacaaaccagtaacacataggggcacacatgcatgtgtacacactctccccaacatatgtgtgtgtgtgtatatatatatatwcatatatattcagatcacatatgacaaaaatgttcagtgaagttaaaaaaaagtccatccattatacagatgtatctaacctttcctgaataagaatgtg

SEQ ID NO: 39976 - DNA, 201 bp, Homo sapiens
gctctgtcacccaggctggagtgcagtggcacgatcacagctcactgcagtctcgacctcctgggctcaagtgatcctctcacctcagctccctgactagytgggatcacaggcgcatgccaccacacccaactgatttttttggtttttagtagagagggggtctcactatcctgccaaggctggtctagaactcctggg

SEQ ID NO: 39977 - DNA, 201 bp, Homo sapiens
tctgatcataatgcagtaaaactagacatgagcataaaaagttgacaaaaagttcttaaaattaaaaacactcttttaaataatccttggatcaaagaagrtaaccaaattaaagttatgaattagagtaataaaagtatttcctactatataggacattcaaacaactttgtactgaggcaaaaattatacccttaaatt

SEQ ID NO: 39978 - DNA, 201 bp, Homo sapiens
gcttatattattatatgtaagtatattcacatacaaaccagtaacacataggggcacacatgcatgtgtacacactctccccaacatatgtgtgtgtgtgkatatatatatatacatatatattcagatcacatatgacaaaaatgttcagtgaagttaaaaaaaagtccatccattatacagatgtatctaacctttcct

SEQ ID NO: 39979 - DNA, 201 bp, Homo sapiens
aatttgtttcaatgatttctctttaggctgaatgccagccgtttttctatctttctctttgctcttcagaacaacaacaacaaccaaaaaaaaaaaaaaaagccttctttccatattctaagttaagagacaataatagaaatagacaagttaggtgtaatgttgcaacacagttataggtctgagtgttttttatctctg

SEQ ID NO: 39980 - DNA, 201 bp, Homo sapiens
aggaaagaatccaggggaggaaggaggagccacacagccagcagcagcccaaggagagcagcccctcgggaggctgcaacggctgaacttttcccctgacrttttactggatgtgcagggagcaccagcttgcaccaccgtggggtgacaggaagagagagacaacagtgagaaatggagaatggaggaaccaaggaagaa

SEQ ID NO: 39981 - DNA, 201 bp, Homo sapiens
gtgttaggagtgtgttcaggctcaagagccatttttgagggctggaagagggagtggggaggctctggcccactccccactgtgaggcagcggaggttacygttgtttgtgaagactcaggccgttaacttctgcaggaaatctgccctcattcccagcctgcagtatggctaggggcctcatcctgggcccctgtgggat

SEQ ID NO: 39982 - DNA, 201 bp, Homo sapiens
caactccttaacaaggtaaaataatatcaagccacacaaatataacctttatgaatatgaaaaggaagacaagttccttttcaagctattttttctgaggsctcagacaagctattttttctgaggcaacagaactttcctgtttggaatgagcaagagatgtacacaaatggcaaatgcgaaggatccctgagggggaaa

SEQ ID NO: 39983 - DNA, 201 bp, Homo sapiens
tttgtgaatctgggatgcacgcttttcaagataccagtgaagcagcagaggatgagcaagcagaagtgtctcctgatgactgatggccctttctttttttyttcttttttttttttgagatggagtcccagctcggtcacccaggctggagtgcagttgtgcaagctcagctaactgcaacctctgcctcccaggctcaag

SEQ ID NO: 39984 - DNA, 201 bp, Homo sapiens
ctatgaagtctattgtcttattttattagttttctctttaggacaatcctatagtgaactgtgtatttaaaggagaagagaaaccgttgaataaattgtaragatacactcagactttcctcctcattggcaaattttcgggcgttcttttttgtttgtttatttatttgtttttaatttaaacaggagatttaaactggc

SEQ ID NO: 39985 - DNA, 201 bp, Homo sapiens
tggctagtctgggttgatagtccaccttagcggttggttagaggctgctattagtatgaccagccttaaataatttgattttcaggttgggtaagtcacartatctcctgtgggcttgatagtcaagctacacatttatttaaaaattggtttcttcacattatatttgaaagcagtgctactcattcatctgtaaaccat

SEQ ID NO: 39986 - DNA, 201 bp, Homo sapiens
caagggaaaggccccctgaggtggcttagatgaggccttctggaagaggggaggggacaattgaacttagctgaattttataggattcaaaagggacaagygaaagtaagggtgacatggagatactcgaggtgaagagagtctgggagacaggagaaagcatggctctctggggctgttgtcagtggtgacaaggtaccg

SEQ ID NO: 39987 - DNA, 201 bp, Homo sapiens
tacttgataccatacatctggatctttaataacatctggatttttgactcttttctcctcctaggtttcatctgggtgtttggcatcatgttcagaaatgygaaaaataaaattcagcaccgttattactgaattagataaaatgattgtatttaattaatccgtaaatattaactaattattctgtttacaataacatgt

SEQ ID NO: 39988 - DNA, 201 bp, Homo sapiens
ggctaatcatgggggcatagccagatgttcagaaacggggctgctcagggccattgaggtgaccagacattcagaaactggggagcatcaggtcaacaaamgaagcctgttcatcttttaaaaatgcatcaacaaagtcagtgacacattttcattttgatcataacgttgatgtccaaattcaaacaattgcctctgaca

SEQ ID NO: 39989 - DNA, 201 bp, Homo sapiens
acctgcagatccctcaggatgaggttcatctcctggtgatctttcaaaagaatagattcgtgctttgagaagaagaataaacatttatgaaaagttttctrtgagccaaacagtgtaaatatgttatctcatttaattcctacagccccaagtggtaggtaggcattagtttttccattttacatgttagacattaagtga

SEQ ID NO: 39990 - DNA, 201 bp, Homo sapiens
aggtgggaggatcagttgagcccagggggtaaaggctgcagtgaccactgcactccagcctgggtgacagagtgagcctctgtctcaaaaaaaaaaaagcyctttgatatcatacctggtgtcagatcttctccattcaatgctggcaggcctggtgttgggctcacataagacatggggtgaagaggggtttgctttccc

SEQ ID NO: 39991 - DNA, 201 bp, Homo sapiens
cttttcccgctcctggccttttcctaaatatctgcgctccctaaagcaactgatagctacctacgtttgtttatttatttagaaaggttcaccccccccccaccaccaccccccaattgctcgattttcttggcagcttgagggatccaatccaggctgccctgcttggctcttcggtgcaacaggaaatgtagctgcaga

SEQ ID NO: 39992 - DNA, 201 bp, Homo sapiens
gggcacagaggtgctctttcaaccaaaaacttgtgctacattttctgcctgtattggtgctaaatacaataagcactgggcagggttttttttttttttttctttgctctccaaagcaagaaagcaccctaattaaattgttttatatggacagtcaagacggaccaattaagtatgcattagtataaagatatagtctgc

SEQ ID NO: 39993 - DNA, 201 bp, Homo sapiens
gaactgcttgaacccaggaggcagaggttgcagtgagccaagatcacactactgccctccagcctgggctactgagtgagacaccgtctaaaaaaaaaaawatatatatatatatatgtatatatatctgtaatgtgacattgttttctcaaacctcagactaatcttatgctcaatatggaagataatcataactcatca

SEQ ID NO: 39994 - DNA, 201 bp, Homo sapiens
gtcctgccagtcctttcagtgcctcagcagatggtaacaggaagataaacttccctaccattttggactttctccttgcccagaaccaaacatctgacctmtacaaactaatagaacatgaccttcaagaaaaactatggcttctccagtgggattcaggaactagaggagagaaacccaaatggttaggacagacgactc

SEQ ID NO: 39995 - DNA, 201 bp, Homo sapiens
gtagaatataaattccaagtcacatgaggtcttatcagttataatactgagaaagaattagcccctctgttttggtaagatgatagctgtgggctaattcrttttttcttgatatatttgggggatttgaaaacttaggaagtaaacaggttattttgttcagggaaccttttctgaaagagttaccagggttcatctgat

SEQ ID NO: 39996 - DNA, 201 bp, Homo sapiens
gtcactattactggaaaaggaattaaaatctccttaaataaccaatgttttcaagatctctgggtgaagactcagagttaaggtcctccctttctcattcktttctccgttcctcttcctcttccctggtttctgcccctcaactattgacctgcctatctccctctccccactgtaacaataatggtcataacaagaatg

SEQ ID NO: 39997 - DNA, 201 bp, Homo sapiens
tgctatccttaaaaaaggaataattagaaactctcatttacattgtaatttacattcagatttcctggaactgtagctttactcttttttgcttttttttwaaaaaaaaaactccttttatttattataattcctggagatttggctctgctcatgtcctagatatagggttatggatgtggggcagagttcagcgagaca

SEQ ID NO: 39998 - DNA, 201 bp, Homo sapiens
aaagcggtagcctctgcgttcagcaaggaatttgcagtcctgtgaggtgataggcacttgcacccatgattatagtgagaagtagctgctggcccagaggktgacagaggtatttgagggaacacaagggaaaggccccctgaggtggcttagatgaggccttctggaagaggggaggggacaattgaacttagctgaatt

SEQ ID NO: 39999 - DNA, 201 bp, Homo sapiens
caacctgtttgcagctggaggccattatcctaaacaaactaacacagaaacagaaaaccaaatggcacacattctcacatgtaagtgggagccaaatattsagtatgcatggacataaacaatgaacactgtagactgctagagcaggagggaggaaagggagcatgggctaaaaaaaactacctattgaatcctatgctc

SEQ ID NO: 40000 - DNA, 201 bp, Homo sapiens
atattacagaactttgaccttctaggagaaaggcatgaaatacacccccctcccataatgtccatactcatatacgtgtgtgtgtgtgtgtgtgtgtgtgktaaaacatctacgtctaaatctacaatttaagtggagtgctatccttaaaaaaggaataattagaaactctcatttacattgtaatttacattcagattt

SEQ ID NO: 40001 - DNA, 201 bp, Homo sapiens
cttggagccccattcatttcattcatttatgcattcgtccagcattaatacactgttttccaagcacagggctaggtggtgggggtttgaagatgaaagcrgtagcctctgcgttcagcaaggaatttgcagtcctgtgaggtgataggcacttgcacccatgattatagtgagaagtagctgctggcccagaggttgaca

SEQ ID NO: 40002 - DNA, 201 bp, Homo sapiens
atcagatgtgctggagactgttagtgcctggagcgtaaaggttttatcacggggacacagtatggtgtattgggttcaaaccctggctctgcctgttactracctgtcattctttggcgtaatactaacttattaatgcttagagtccttccatgcaaaataaggacaatgttagctatttcacaggtgacatgaaataac

SEQ ID NO: 40003 - DNA, 201 bp, Homo sapiens
tacataataaggtaaaagtacagttgggcctccatattcctgggttccacatctgcagctttgagcaaccacagattaaaaataattgtaaaaaaaaaaaagaagtaataatacaacaataaaagtaatacaaataaaaatgcagtataaccatttacgtagcactcacattatattaggtattgtaagtaatctagagat

SEQ ID NO: 40004 - DNA, 201 bp, Homo sapiens
ttccaaccatgtttcccatcaaaatatggtttcttgtacttctttgtgacattataaaagcagtacatactcaaaacaaagaaaaattagaatatacaaamagcaaaactaagaagaataccctgaaaaataattttttccttttctacaagttagccaatgtgatggcattggtatatatctttgcagatgtataaaata

SEQ ID NO: 40005 - DNA, 201 bp, Homo sapiens
ttgaacctgggaggcggaggttgcagtgagtggagattgtgccattgcaatccagcctgggcaacgagagtgaaactctgtctcgaaaaaaaaaaaaaaaagaaaagaagaaaaaggtaaggaaacaggaagtccaggataagtggactttcccaatttcctgcacctgctaaatgatggagtcaggttttcagccagaat

SEQ ID NO: 40006 - DNA, 201 bp, Homo sapiens
gtcacagctacttgggaggctgaggcaggagaatggcgtgaacccgggtggcagagattgcagtgagccaagatcgcgccactgcactccagcctgggtgrcagagcgagactccatctcaaaaaaaaaaaaaaaaaagagctttttactaacatacttttttactgactctctggcctcattcatacatttccctttgaa

SEQ ID NO: 40007 - DNA, 201 bp, Homo sapiens
aacctggacaacatagcaagactccatctctactcgcccccccaaaaattagcctggcatggtcgcacacacctgtagtcccagctactcgggaggctgamgcaagaggattgcttgagcccaggagttcgaggctgcagtgatcatgccactgcactccagcctgggcaacaaagtgagactttatcttaaaaaaataaa

SEQ ID NO: 40008 - DNA, 201 bp, Homo sapiens
gtgaacccgggtggcagagattgcagtgagccaagatcgcgccactgcactccagcctgggtgacagagcgagactccatctcaaaaaaaaaaaaaaaaaagagctttttactaacatacttttttactgactctctggcctcattcatacatttccctttgaacctcagtttcctcatctgtgatctgggggttgaatag

SEQ ID NO: 40009 - DNA, 201 bp, Homo sapiens
tagtcacagctacttgggaggctgaggcaggagaatggcgtgaacccgggtggcagagattgcagtgagccaagatcgcgccactgcactccagcctgggygacagagcgagactccatctcaaaaaaaaaaaaaaaaaagagctttttactaacatacttttttactgactctctggcctcattcatacatttccctttg

SEQ ID NO: 40010 - DNA, 201 bp, Homo sapiens
cggccgggcgcagtggctcacgcctgtaatcccagcactttggggggccgaggcaggcggatcacgaggtcaggagattgagaccatcctggctaacacgrtgaaaccctgtctctactaaaaatacagaaaaaattagccaggggtggtggtgggcacctgtagtcacagctacttgggaggctgaggcaggagaatggc

SEQ ID NO: 40011 - DNA, 201 bp, Homo sapiens
tcacttgtaaaagctactcctagagatgttgctctttctgcacagcttctcttccttgatgcttgcctgggttatgtggacacttctcagaacactttggktccagctctgtggcagcatggtgcagctctgtttacctgccccaggtggtcagtcacacagtgcctgcatacatatgggaagtatgctgaataggaggtg

SEQ ID NO: 40012 - DNA, 201 bp, Homo sapiens
tccatttgatgaaacaaagtataattattttaaaatccctttatagattaaaaagctgaagatctgaattgtttgacattttattactcttaacatgaacrgtcacatgtaaatgtaatgaaagtggtatagaaatatgacttaacttgtgagtgtgaatcgtaagagctttttacggccgggcgcagtggctcacgcctg

SEQ ID NO: 40013 - DNA, 201 bp, Homo sapiens
tctaatgccaaagagaaatacattctctaccagatattggccattgttatttttgccacttttaaagcagtcaaaccaatcttctcacttatagaataacrtctttggggtcatgatatatattttttaagatttattgttccttcccatgaatctatgttcagatggttccaaatgaaaaactctgagggtatcaggaca

SEQ ID NO: 40014 - DNA, 201 bp, Homo sapiens
cagacaccaaaacccctgcattgtatgattccatttgtatgaaatgtctaatgcaagcaagttcatagagacagaaggtagattagtggttgtcaggagcraggagaggttagaatagagagtgattgctaatggacatgggatttatttttgaggtgttgaaaatgttctgaaattagatagtggtgatgtttatataac

SEQ ID NO: 40015 - DNA, 201 bp, Homo sapiens
ggaggttgtggtgagccaagatcgcgccattgcactccaacctgggcaacaaaagtgaaactgtgtctcaaaaacaaaaacaaaaaaaaaattggagaggraaaccagaagtcagaggttgggctaacctctaagtcctaagtgaaatggctcaacctggtataacctaaataagggttacacacattctaagtgatggat

SEQ ID NO: 40016 - DNA, 201 bp, Homo sapiens
aaatttactacaattgtaatagattttggcagagtttatgtattgtatgcaatgctaacataacgctgagtttcaaggatagaggccaggattcctagttyggctttgttaaatgggaaaaaaaaaatcactactgtattcgtagtgtttactacatttaagagattaattctcataaataaaattgtttataccagcttc

SEQ ID NO: 40017 - DNA, 201 bp, Homo sapiens
attaaaagtctgtgggagagggactgaaaattatcaaggtttgatgctttgtaccactcattcattgattagttagatgcccctcactatgagttatgcawaagctgagttttaatgacaattttcaaaatatctgagttgtttgcatgttttgtcttttcttctaagtgaagatatggctgattgtgttttcattagaat

SEQ ID NO: 40018 - DNA, 201 bp, Homo sapiens
cttgggtagaatataaattccaagtcacatgaggtcttatcagttataatactgagaaagaattagcccctctgttttggtaagatgatagctgtgggctmattcgttttttcttgatatatttgggggatttgaaaacttaggaagtaaacaggttattttgttcagggaaccttttctgaaagagttaccagggttcat

SEQ ID NO: 40019 - DNA, 201 bp, Homo sapiens
agaccagcctgatcatcatggaaaaaccccacttctactaaaaatacaaaattagccgggcatggtggcacatgaggttgtggtgagctgagatcgtgccmttgcactccagcctgggcaacaagagcaaaactccatctcaaaaaaaaaaaaaaaaaaacaaaactgaataataaaaagacaaatatgtaattaaaaatg

SEQ ID NO: 40020 - DNA, 201 bp, Homo sapiens
ggcaatggtttcctagatggcactaaaagcaaaagcaacaatagaaaaaaaataggtatatttgactttatttttatttttaattttttttttgagacagrgtcttactctgtcaaccagactggactgcagtggcacgattatagctcactgcagcctcaacctcctgggctcaagtaatcctcccacctcagcctcttc

SEQ ID NO: 40021 - DNA, 201 bp, Homo sapiens
tggcaaggaagatttgctccaacttctccaagtagcagtgccatttattagattttctttcttttttcttaaagttttttccaggtttttatttgatctaygtacttctcactgtttcttgttctaatgcaacaatcccttttagagtttttggtactctaaaaccaaattaaattggctcatgttcattcttaacaatta

SEQ ID NO: 40022 - DNA, 201 bp, Homo sapiens
ccctcccccccactccacaacaggccccggtgtgtgatgttccccttcctgtgtccaaaagttctcattgttcaattcccacctctgagtgagaacgtgcrgtgtttgattttttgtctttgcaatagtttgctgagaatgatggtttccagcttcatccatgtctctacaaaggacatgaactcatccttttttatggct

SEQ ID NO: 40023 - DNA, 201 bp, Homo sapiens
tgtatactatgaaaatatttcaataattaatgcatgctccatctagaggaatcgacagtgaggtcataaacgtaatgggccatctgtgtttgatttgtacrtgaaaatgcttaaagagatatgcaggtaattcaagcttccctggcaaggaagatttgctccaacttctccaagtagcagtgccatttattagattttctt

SEQ ID NO: 40024 - DNA, 201 bp, Homo sapiens
aggtggacaatggccaggccatacaggcccctggagggcagggaaactattttatttttaatattaaaggaaaggaggacccattgaatacttaaaaaaawttttttttcattttattttgaagtggagtctcgctctgtcgctcaggctggagtgcagtggtgcgatctcagctcactgcaacctccacctcctgggttc

SEQ ID NO: 40025 - DNA, 201 bp, Homo sapiens
cttctaatcagaaagttgaaattatctgtggcaatgtagcccactaaaaacttgtatactatgaaaatatttcaataattaatgcatgctccatctagagkaatcgacagtgaggtcataaacgtaatgggccatctgtgtttgatttgtacgtgaaaatgcttaaagagatatgcaggtaattcaagcttccctggcaag

SEQ ID NO: 40026 - DNA, 201 bp, Homo sapiens
attgtatgcaatgctaacataacgctgagtttcaaggatagaggccaggattcctagtttggctttgttaaatgggaaaaaaaaaatcactactgtattcstagtgtttactacatttaagagattaattctcataaataaaattgtttataccagcttctaatcagaaagttgaaattatctgtggcaatgtagcccact

SEQ ID NO: 40027 - DNA, 201 bp, Homo sapiens
gcagagtttatgtattgtatgcaatgctaacataacgctgagtttcaaggatagaggccaggattcctagtttggctttgttaaatgggaaaaaaaaaatyactactgtattcgtagtgtttactacatttaagagattaattctcataaataaaattgtttataccagcttctaatcagaaagttgaaattatctgtggc

SEQ ID NO: 40028 - DNA, 201 bp, Homo sapiens
tgtaacacttctatcaattaaaaataggtaaaatgtgttaaaaaataatgaaaagttcatgctttaattgaactggcttttttcaaaagcctatattttttacgaagcttaatgaaacaaaaattgaaatggtgcccattatgaaatctgtgttaattgttattattcccataaagttcacatgactaaaaaaatgcatac

SEQ ID NO: 40029 - DNA, 201 bp, Homo sapiens
tctgcatccttaagagactcccaggtgacactgatgctgcaggctcatgggctgtactttgaatagcaagattttagaccatgggcccctaatacagcttkctaaaaaccagatttatgccctctatgtccaaagtgtctgattccataggtacaagactctgcttttttccaggtgtccaaggtaattgtattgcatgat

SEQ ID NO: 40030 - DNA, 201 bp, Homo sapiens
aaaatatctggcaaccattcaaggtttggatgaaaagaaggatgtggaaacatgttacagctagaaatgattactttattgtaactgccatttgatatctrggggcttctctcttctctgcacaaatctctgttcttaaaagtccttttggggaagctccgggctccccacaccatcccctcctccaccaaatagctgctg

SEQ ID NO: 40031 - DNA, 201 bp, Homo sapiens
cacaaagagtgaataagaattaaaggaaatctgtgaaagatcaaaataacaaggagatcatcatggtatttttccggggtggttcagatattggagaggcrtgggagtgttcagtagtcagtgacttctgcatgatatttgcatagagagaactttaaaaaggttgcatttcttttctgctttcatatttactttgggtta

SEQ ID NO: 40032 - DNA, 201 bp, Homo sapiens
tgaatctagaaagtatttgcagcttcatctatgtcggcaagttttcctttcccctaagtaaaacacttgtttcagctcacatgttttgttcagtgtgaaayatcttagctgctaaaatgtcacttctgtggcaaatatttcctcaaggaaacatttgtaaatatcttcaaaaagaaggactcatcccttacaccaacaaaa

SEQ ID NO: 40033 - DNA, 201 bp, Homo sapiens
caggcactggacagggagctcttataagcattgtttaatttattaagtgatttttgtggatctttttgtataaacctggatacaagcagcctaaggagggrcatggcaggtactctggtgaaatccagataaccatcaagggagcaggtggctttgtctagatctctttcccaatttagatgttttatatacttttcaggg

SEQ ID NO: 40034 - DNA, 201 bp, Homo sapiens
cattaatagagccatcagagtttcatcgggcttgactggtattggacacaccagtgattcacccggggggtgaggtttgcagtttgcatggagaaactgtrcttgccagatggcagctgttaatctgcttgcatcaggggtgcgaggaggcctacgtttgcctggcccctagccagtggggctctccctcacctctgatta

SEQ ID NO: 40035 - DNA, 201 bp, Homo sapiens
taaataaataaatggagcaatacaaaggagctgccttcatatacctgcagatccctcaggatgaggttcatctcctggtgatctttcaaaagaatagattygtgctttgagaagaagaataaacatttatgaaaagttttctgtgagccaaacagtgtaaatatgttatctcatttaattcctacagccccaagtggtagg

SEQ ID NO: 40036 - DNA, 201 bp, Homo sapiens
ccacacccagctaatttttgtattttttgtagagacgaggttcgccatgttggccaggctggtctcgaactcctgacctcaggcgacccacccacctcggmctcccaaagtgctgggattgcaggcatgagccactgtgcccggccttcacgtgtgatcttttaacctccaagaaatgattgaaccatagggataatacat

SEQ ID NO: 40037 - DNA, 201 bp, Homo sapiens
ctcataacaacaaactgaagtagacgtgaatatgtccattttacagggatgaaactgagtctcaatatttgtaaccaccttgctctaggttactcagtcagtaactggacaaggtgggatttgaacccaggtcaatctaattccagatctcaggccttgagcttctacatgacactagtttaatcccttcttgccaagaat

SEQ ID NO: 40038 - DNA, 201 bp, Homo sapiens
agcctcagtataagggtagaactcatcatagctattcctgctactaaaaacacacccagatatcctgattttttatagattgattatcttatgagaggacraagaaaactagccaatgggattgccaatgcaccttactagtctttgaggaattgtaaaaaatggaagaattagtggaaatttagagacatgcaaatgagg

SEQ ID NO: 40039 - DNA, 201 bp, Homo sapiens
gcaacccctgcctcccgggttcaagtctcagcctcccgagtagctgggattacagggacctgccaccacaaccagctaatttttgtatttttagtagagasggggtttcaccatcttggccaggctggtcttgaactcctgacctcatgatccacccaccttggcctcctaaggtgctgggattacaagcgtgagccattg

SEQ ID NO: 40040 - DNA, 201 bp, Homo sapiens
tcctcataacaacaaactgaagtagacgtgaatatgtccattttacagggatgaaactgagtctcaatatttgtaaccaccttgctctaggttactcagtcagtaactggacaaggtgggatttgaacccaggtcaatctaattccagatctcaggccttgagcttctacatgacactagtttaatcccttcttgccaaga

SEQ ID NO: 40041 - DNA, 201 bp, Homo sapiens
attttccactccacagtctaaaacagaatgtgagaatgtaatctagttgtagctgtattaaaatgttatgctacagttaagtctctgttcagctcctactstagtgcaggcatctaatcaggaaatggcctcctgtataacccatggattgtttgtaactcaggaccctaagtgcaacgaagctaaccctatatatattaa

SEQ ID NO: 40042 - DNA, 201 bp, Homo sapiens
tggttcattgttgagtctctgaagatgggcatggcacttggcataaaacaagggcccattcgtccctttgtaataagttagtgttgattgtgaagcctaaytaaaactccagtttgagaactgttattcctatgatggctgagagaggaggtggagagagggctagaccacgaagtcacaggaaatggctgcatgaccctg

SEQ ID NO: 40043 - DNA, 201 bp, Homo sapiens
aatcctcataacaacaaactgaagtagacgtgaatatgtccattttacagggatgaaactgagtctcaatatttgtaaccaccttgctctaggttactcagtcagtaactggacaaggtgggatttgaacccaggtcaatctaattccagatctcaggccttgagcttctacatgacactagtttaatcccttcttgccaa

SEQ ID NO: 40044 - DNA, 201 bp, Homo sapiens
tttttgtggatatggggtctcaccatgttgcccaggctggtctccagttcctgggatcaatccatcctcccaccttggcctcccaaagtgctgagattgcragcacgaaccatccttcctggccccaatctggttttgattggctattgtttaacatagcttcttactactcatgccctttatgctgccattcaaagtcct

SEQ ID NO: 40045 - DNA, 201 bp, Homo sapiens
tcaagcaattctcctgtctccacctcccaggcagctggaattgcaggcatgcactaccacgcccagttattattattattattattattattattattatttgtatttttagtagagatggggtttcatgatgttggccaggctggtctcgaactcctgacctcaggtgatccacctgcctcggcctcccaaagtgctggg

SEQ ID NO: 40046 - DNA, 201 bp, Homo sapiens
accttttctctattacaaatagcactttagtaaatatcccggtacatacttcctatgtactctagtatttctcatatgctcatatgcataatacaatactyatatgccatgagtacttctctagtatgggcacttaaagtgaaactgctgggtcataagtatacatattttatgttttactagttactgccacattatcca

SEQ ID NO: 40047 - DNA, 201 bp, Homo sapiens
ctcaagcaattctcctgtctccacctcccaggcagctggaattgcaggcatgcactaccacgcccagttattattattattattattattattattattatttgtatttttagtagagatggggtttcatgatgttggccaggctggtctcgaactcctgacctcaggtgatccacctgcctcggcctcccaaagtgctgg

SEQ ID NO: 40048 - DNA, 201 bp, Homo sapiens
tgatgcaggtagaccatgctctctgagtttttctcctatgatgtgtgtgtagattccttctaccttttctctattacaaatagcactttagtaaatatccyggtacatacttcctatgtactctagtatttctcatatgctcatatgcataatacaatactcatatgccatgagtacttctctagtatgggcacttaaagt

SEQ ID NO: 40049 - DNA, 201 bp, Homo sapiens
taaccagagttagagatgaaataacattaaatattttatatatatagaaacttgcctacacacacataaaattccctattagttgtagttgaggtttagtsatgttgaatcgataaaaaatgatttagagcggatggtttcaaaagctggttgtgctttcagtcttccataaagaagttaaaattaattttaatatgttga

SEQ ID NO: 40050 - DNA, 201 bp, Homo sapiens
gctcaagcaattctcctgtctccacctcccaggcagctggaattgcaggcatgcactaccacgcccagttattattattattattattattattattattatttgtatttttagtagagatggggtttcatgatgttggccaggctggtctcgaactcctgacctcaggtgatccacctgcctcggcctcccaaagtgctg

SEQ ID NO: 40051 - DNA, 201 bp, Homo sapiens
aaagtgctctttgctatgacttctctgcctcccttgatgtgatctatgttaccaaggatgtgcatcttgccagtcccttttctgtccaaatgagtcaccawaatgtgctatatcgtatgtatcattgcgcatttgttattttcacttatccatgtcttggagatcttacctggttaggagaaacaggtataccccattctt

SEQ ID NO: 40052 - DNA, 201 bp, Homo sapiens
actcctcacttattggaactaatatgtttctcctttttggttttagttggtttcagttgactttttactcatggcaaaccaaagattttttttttttttttgagacacagtctcattttatcacccaagctggagtgcagtggcgcaatcttggctcactgcaacctccacctcccgggctcaagcaattctcctgtctcc

SEQ ID NO: 40053 - DNA, 201 bp, Homo sapiens
atattaaggtattagaggataaggctaaagtgctctttgctatgacttctctgcctcccttgatgtgatctatgttaccaaggatgtgcatcttgccagtyccttttctgtccaaatgagtcaccaaaatgtgctatatcgtatgtatcattgcgcatttgttattttcacttatccatgtcttggagatcttacctggtt

SEQ ID NO: 40054 - DNA, 201 bp, Homo sapiens
aactgaactctctaaactcctcacttattggaactaatatgtttctcctttttggttttagttggtttcagttgactttttactcatggcaaaccaaagaytttttttttttttttgagacacagtctcattttatcacccaagctggagtgcagtggcgcaatcttggctcactgcaacctccacctcccgggctcaagc

SEQ ID NO: 40055 - DNA, 201 bp, Homo sapiens
gctgggtctgatgttagaaagtacttctgccccctccattgacagtacttcccccgtcttttctagctcacggggctccagatggccatagctgtggtagycatctttgtccccgtactggctatttctgaaggtgaaaggttggggatatgtattacagagggcaggtcaggaaggatttaagcacattactggttgtaa

SEQ ID NO: 40056 - DNA, 201 bp, Homo sapiens
aaatataaaaattagctgggcatggtggcgggcacctgtaatctcagctactcaggaggctgaggcagagaattgcttgaacccaggggggagaggttgcrgtgagccgagatcatgccactacactcccggctggatgacagagctggatttccatatcaaaaaaaaaaaaaagaagatgaaaatttcttaacctccctt

SEQ ID NO: 40057 - DNA, 201 bp, Homo sapiens
gaacaggtactcataaaaaaagaaagaaacctgggttttgctaagtgagattacattgtgttttcatatatgagggataattccagtgcaatacttgcctrtacccagaaactggctgcataagcagacgggcattgggctgggtctgatgttagaaagtacttctgccccctccattgacagtacttcccccgtcttttc

SEQ ID NO: 40058 - DNA, 201 bp, Homo sapiens
cttgaacccgggaagcagaggttgcagtgagctgagatagtaccattgcactccagcctgggcaacaagagtgaaactccatttcaaaaaaaaaaaaaaaatgtgagctttaataaattcccctttggtgtgcttccattgtcttttctaagtccctaaaaattacagacattattttccatatgataatataccctaagt

SEQ ID NO: 40059 - DNA, 201 bp, Homo sapiens
taagatggcaacaacctgttggtagaagctagttcttttatatattgtatagtaaggaacctcttcctttattctaatgtatcaaaccctctgtgtctggygtcaggattcattatgtggtggcttgacgccagcaaaaaggttcatgtaacactcaccaaagagttaaataagttgtccagttgttgatggtttggttaa

SEQ ID NO: 40060 - DNA, 201 bp, Homo sapiens
tagggatctttgctttgtaaagggaaatgtgtcaaagcattaagcaagcattaatttttcctcagagctttattcacatattggacgatgctgaataaccrgagagttgtgcgattatgcacaacattattaatgcaattatgtctggatgtcctgtgatgttgtgggactggtgctccaagcccattatgattgctgttg

SEQ ID NO: 40061 - DNA, 201 bp, Homo sapiens
aaattcctcaatattccaaatattttggcatccaaagaggctccctctctctttgcaaaggcagagagaggtatgttagatgtatccattgtctagcaaaraatggtcttcctcccagagagagaaagcctgttgctgtgactgccacattccctgcattttctggtccatccagattgtaatagtgaatttcacaagcaa

SEQ ID NO: 40062 - DNA, 201 bp, Homo sapiens
aaattgggatgttgatcataatgtatggggcaaccactaagaaaataaaaaaaaaaaaaagtaaaacaaacagcaaggacattaaaacaatatactatatmatatgtatttaacataaaataaggcaataatggatgaacagaggaatcaaatatggtagaagatatatagaaaataaatagcgaagtggaagataaaaac

SEQ ID NO: 40063 - DNA, 201 bp, Homo sapiens
gcccactcagtgcagattgcagttggggctcactctcgtatatgatcacatacatcatttcaggtagtcttctcaaccaccccctcggcctagcaaggcasgtgttatcaatctcccctttgtagattaaaaagctgaagatctgaattgtttgatattttattactcttattaataagatccattcaaaataaaacttgc

SEQ ID NO: 40064 - DNA, 201 bp, Homo sapiens
agccccagagggttgatggaaaatggggtggaagaaagggagagcagggcagctcacatgagagcagttaagggacaagggtaaagcaagtgaggccaccygagagagagcaccccctcacttgtctcatctgaggtgcctgctcaagaatgggttgttctccaactttccttcttgagttcagttcaacaagtatcagtg

SEQ ID NO: 40065 - DNA, 201 bp, Homo sapiens
aaatgcaaaattagccgggtgtggtggcgcatgcctgtaatcccagctactcgggaggctgaggcaggagaatcacttgaacccgggaagcagaggttgcrgtgagctgagatagtaccattgcactccagcctgggcaacaagagtgaaactccatttcaaaaaaaaaaaaaaaatgtgagctttaataaattccccttt

SEQ ID NO: 40066 - DNA, 201 bp, Homo sapiens
gatttcaataagatagtcaataacatggaacacacaaacacacacacacagatctatgcaaatgtgtgtgtgtgtgtgtgtgtgtgtgtgtgtgtgtgtgkatcaaggtactctacaggaatttttatctttatctgtgtccataaagcatttgtaaaagttaataggtaactgaccacacaaaaaaactaaatgaaattt

SEQ ID NO: 40067 - DNA, 201 bp, Homo sapiens
ggatttcaataagatagtcaataacatggaacacacaaacacacacacacagatctatgcaaatgtgtgtgtgtgtgtgtgtgtgtgtgtgtgtgtgtgtgtatcaaggtactctacaggaatttttatctttatctgtgtccataaagcatttgtaaaagttaataggtaactgaccacacaaaaaaactaaatgaaatt

SEQ ID NO: 40068 - DNA, 201 bp, Homo sapiens
aagacatctaaaagtgcacatcaaactcagcattaaaaattattgagatcctttgccgtaaaagtgatttccttatattttctagaaactcaaattggatycatattaaagaagagaaggatggatttgtttagacaacacaaacctaggaagggtttgagaggtgaaacaaactgggttatggatgaacgggggcaattg

SEQ ID NO: 40069 - DNA, 201 bp, Homo sapiens
cttgaactcgggaggcgtggaggttgcagtgagccgagatcatgccactgcattccagcctgggtgacagagtaagaccccctctcaaaaaaaaaaaaaaaccaaacagtaaacaaagatatagtggatttcaataagatagtcaataacatggaacacacaaacacacacacacagatctatgcaaatgtgtgtgtgtgt

SEQ ID NO: 40070 - DNA, 201 bp, Homo sapiens
tgacaaacaactatctcacatattaatttcaaaatgtaagacatctaaaagtgcacatcaaactcagcattaaaaattattgagatcctttgccgtaaaartgatttccttatattttctagaaactcaaattggatccatattaaagaagagaaggatggatttgtttagacaacacaaacctaggaagggtttgagagg

SEQ ID NO: 40071 - DNA, 201 bp, Homo sapiens
ctttgggagcccaaggcaggaggatcaatgggtcaggagtttgagaccagcctggccaatatggtgaaactccatctctactaaaaatacaaaaattagcygggtgtggttgcaggcacccgtagtcccagctactagggaggctgaggcaggagaattgcttgaactcgggaggcgtggaggttgcagtgagccgagatc

SEQ ID NO: 40072 - DNA, 201 bp, Homo sapiens
acacaaaatatcaaataacacaggagacaaacacataaggtaaaactgcactccagcctggacaacagagtgagactctgtctcaaaaaaaaaaaaaaaaagaatacaattgtagggggtatatttaataaagcattttcagtatctggtagattaagaaaacaacaggccaggtgtggtggctcatacctgtaatcccag

SEQ ID NO: 40073 - DNA, 201 bp, Homo sapiens
acctgacctatgacactttatactaaacaaagcaaaacaaaacgaaacaaaaatccaaaaacagaaacgaaacaaaattctcccttaaaaaaacccctaamataatgacattttctaatagagcaatctgattagttgaaaataaaggagagctgggtgtggcagctcatgcctgtaatcccagcacttagggaggaagag

SEQ ID NO: 40074 - DNA, 201 bp, Homo sapiens
tcatctataccccaaacatcagcatcacacagtatacccatttaactaacctgcatatgtagcccctaaatctaaaagctgaaattgctaaaaaaaaaaaatagcataaataaataaacttagatatgcccccctccaaaaaatgaggagagtttggtggtggaatgaggagggagaaaatgccctcaagtgctataccgc

SEQ ID NO: 40075 - DNA, 201 bp, Homo sapiens
atgtaagtgggagccaaatattgagtatgcatggacataaacaatgaacactgtagactgctagagcaggagggaggaaagggagcatgggctaaaaaaaactacctattgaatcctatgctcactacctgggtgatgggatcatctataccccaaacatcagcatcacacagtatacccatttaactaacctgcatatgt

SEQ ID NO: 40076 - DNA, 201 bp, Homo sapiens
tgagataccatctcacaccggtcagaatggctattattaaaagtcaaaaaataacatgctggtgaggctgtggagaagagggaatgcttctgcaatgctgrtgggaatgtacaatttcagccactgtggaaagcagtttggagatttctcagagaacttaaaaatggaactagcattccactcagcaatcccattactggg

SEQ ID NO: 40077 - DNA, 201 bp, Homo sapiens
tcaatctcccctttgtagattaaaaagctgaagatctgaattgtttgatattttattactcttattaataagatccattcaaaataaaacttgctgtcacraatgtaattgcagcgaacatgtgcaaagatttagaccaagtaaaaaaagctgtagtagatttacacattcatatttcacttatcagagtctgttttctaa

SEQ ID NO: 40078 - DNA, 201 bp, Homo sapiens
ttcgtaatcgttgagggttgggatgggggctggggagaagataagcatcctagggccgctcttgtcgcctgcaccattcattcggctccagtggcatcggygaggcgatttgtgtaggctgagtgtgtaatgtgtttccttcaagcctgccttgatggttctgtctatgctgtacttcatgcacataaatgcctctcaggt

SEQ ID NO: 40079 - DNA, 201 bp, Homo sapiens
tattcatatcaaaatcaagcaagtttcatttttcaggatccaagatcttcctgccttcctttcctggtaggactcaagggattcttcctgggctcatagayactaggtgtgaaaccatgcaaaaggacaggaaatgggtgtcactcttctttattgaggagattctggaattatttttaccggagttgattagagaataaa

SEQ ID NO: 40080 - DNA, 201 bp, Homo sapiens
atcaaatatggtagaagatatatagaaaataaatagcgaagtggaagataaaaacttaccttatttgtaattacttaatagaaatgtattaaccactccartgaaaaggcagagattggcaaaatggacaaaaaacataatccagctctatgctgtctacaagagacaaactttagattcaaagacacaaattcattgaaa

SEQ ID NO: 40081 - DNA, 201 bp, Homo sapiens
gtcattgaaacaccacaaagatcttctggacctacgttcatgatgtctgcactgaaatagctattagatgaatgagggaaaaatggcataattcttgatarcaactgaattagagagctgcaggattaagtaaaaggaaatacaacatgccgcaaagatggaaacacatgagtgaaaacgtaggtgacttaaagcacagat

SEQ ID NO: 40082 - DNA, 201 bp, Homo sapiens
cctgacctatgacactttatactaaacaaagcaaaacaaaacgaaacaaaaatccaaaaacagaaacgaaacaaaattctcccttaaaaaaacccctaacmtaatgacattttctaatagagcaatctgattagttgaaaataaaggagagctgggtgtggcagctcatgcctgtaatcccagcacttagggaggaagagc

SEQ ID NO: 40083 - DNA, 201 bp, Homo sapiens
gtttggctatgtaggatcactgataaatctggggattctaagattaactcatacaattctagtcgtaattagaaatatcaaatacattttcacctgtgcartaatcacgtaatgttcatttatttgtcatgagggggtgataattcagcactcacaggtatatctttaaatattttcagacgaaatgagcatggatttaag

SEQ ID NO: 40084 - DNA, 201 bp, Homo sapiens
tttggctatgtaggatcactgataaatctggggattctaagattaactcatacaattctagtcgtaattagaaatatcaaatacattttcacctgtgcagkaatcacgtaatgttcatttatttgtcatgagggggtgataattcagcactcacaggtatatctttaaatattttcagacgaaatgagcatggatttaagg

SEQ ID NO: 40085 - DNA, 201 bp, Homo sapiens
agcagaacaacaaaagggatctaatttaattttcttaaaacacaaactcaaggtgaattgcagttggagaaaaatagtttaaggagcgatttccattctaytggtttttataaggttttttttgggggggggacagtttcaatataaaggagtaagtaggtggacagagacagacatactgtcataatagggaaacatgca

SEQ ID NO: 40086 - DNA, 201 bp, Homo sapiens
gtgtgaaaagtgagtttaagtacttttgggaagaagaaccactttctgcttggagaagagatgaaaatggatccttcatttatggagcccaagctcttgcygtacagcccctgaaacctcctctaagtgggattggcttggacattatcctttaaccactctagatctgacagccactgggctaagcagcctctttaagat

SEQ ID NO: 40087 - DNA, 201 bp, Homo sapiens
attttccaggcgcgctttcgccccccttagctggttgcaggggccgtaaatcagcggccggcggcgagggcgggaggagccccctcggcgagctcggcgcrgccccgcccggaccgtgcgcacctcccggtgggccccgaatcgatccgaagcccagctaaggatgtcagcgcactaaatatttactgatcacacacaaat

SEQ ID NO: 40088 - DNA, 201 bp, Homo sapiens
ctggtcctctcccacctccacccttcctatgaaagcaggtttccattcagatagacaacagtctcatccatcacccgcagcacactccatggagatggacyttagggaataagaaaatataatatagtgaaatattttcttgtatttaactgaccgtctagtccatttaaaaaatatttctaaccatgtctacagcagtag

SEQ ID NO: 40089 - DNA, 201 bp, Homo sapiens
tggagccacatggcccgggctcttattcagcttcactgccttctgtgtgggtaatctctggttacttagttcactttgctaagcttcagcttccttctctktgcaaagaggatttaagaaggtaatcaattctgctagaatctatacctggcagaaagagagtttagttttccctcccaaagcactacaaatgcttagaaa

SEQ ID NO: 40090 - DNA, 201 bp, Homo sapiens
tttttattgttctttaacagtgaatggccccagcattttgtttatcatgccagagataaaccagggcaccattaaaagtctaaacccttccatggacttcyacatcatctaaagtgtttattgacttgaactaaagtagatgcaacaatttgaagcttcaaccaagtttagtctttttttctttttttactgtttacaaaa

SEQ ID NO: 40091 - DNA, 201 bp, Homo sapiens
ttccagagcttaattgtttgttctacatacaagttagcccagctcagaacacctgtgggctaagttcttttgatgcaccaaagcctgtcttttattaagcyctttgcgagcagtcaaaataagaccaaatgtccatgtgtcgctgcgtaaccatgtggacatgaaacaagccagccagcgtgaggagtgcacagtaagtgc

SEQ ID NO: 40092 - DNA, 201 bp, Homo sapiens
aacaaaattatatctcaataatgaatatatttttaagtttatacacaataagcagctggtcaattgcaaaggttggcagtatttcagagagggtatgaagscttcttggaggtcatcatttaacatttcataaaatgtttgtgtgtgtgtgtgtgtgtgttttaacttttagatctttctctctcttagttggaaggcaaa

SEQ ID NO: 40093 - DNA, 201 bp, Homo sapiens
tctagaacttgccttggttaggactgcaaaatggatattcagttcagtcgctcttagcttctcgattgccccaaaatgccagaaaagggattttaagcttrtgaggagcaataatacatatctgaactcagcatccttgccaaacctctcttatttgaagtaaaagcagataatgagtagtgtgggtacttacaaacaagt

SEQ ID NO: 40094 - DNA, 201 bp, Homo sapiens
caccgactatgcttctaggtcatagaacagttgagtacggacttcattgttcctcaagttccttttaagcattcatatagtcattaaaacgcacccagagrttctgccccaaatgggaaataatactagtacaggtcacaagaaccaaacccaagccatattctacctcaagaagtcactgcaaaaagaacaacttcatag

SEQ ID NO: 40095 - DNA, 201 bp, Homo sapiens
aataagcaggatctaactaaactaaagagcttctgcacaacaaaagactccatcaacagagtaaacagacagcctgcagagtgggaggaaatattcacaarctatgcatcctataaaggtctaacatccagaatctataaggaacataaacaattcaacatgcaaagaacaaacaacccattaaaaaatggacaaaggaca

SEQ ID NO: 40096 - DNA, 201 bp, Homo sapiens
aatttgagttcattcaaatgacaaactcaaagtaaaacacagatgaacttaccaaatttcatttggcgtccacctgaaactgtaaatcttctcttggcatytgagagtagaaaggaggttcacctaaaattcaaaccaggttttcttaaacctaacccagacttactaactttggggtaaactacggttgcattttgggtt

SEQ ID NO: 40097 - DNA, 201 bp, Homo sapiens
acattaaaagagactttatttgtcaaattattattattattatttggatagggtttcaccctgtcacccaggctggcgtgcaactatgtgatagtagctcmctgcagtcttatactcccaggctcgagagctcctcacacctcaacctcctgagtagctgggactacaggtgcatgccaccacacttgactaattaaaaaa

SEQ ID NO: 40098 - DNA, 201 bp, Homo sapiens
tacatagggttttctagaaagcagaatgaggatgaaatattattaactcacatttcttgagtgcttacgataatcaggccccgttttaagcattttacacrtattaactcagtttcgtttaccatagaaagtactaggcaaatactatcactcccattttgcacaaatgagaaagactactaggcatagggaagttacgta

SEQ ID NO: 40099 - DNA, 201 bp, Homo sapiens
tctttttttttttttttgagacggagtctcgctctgtcgcccaggctggagtgcagtggcgcaatctcggctcattgcaagctccgcctcccgggttcacrccattctcctccctcagcctcccaagtagctgggactacaggcgtccgccatcacgcccggctaattttttgtatttttactagagacggggtttcacca

SEQ ID NO: 40100 - DNA, 201 bp, Homo sapiens
atcttgaacatgtaatttaaaactccagcgctactgtaaacgctagccttatttatttaaaacatcactctctgaaactgacattattttcttaataggayaacactgggtagaaagaagtttaaaggcactctctgacttcttggtgaatttttcactaacagttccccgttgctcataattgcatcctctcttccaaaa

SEQ ID NO: 40101 - DNA, 201 bp, Homo sapiens
tggacgattctcttcctctttcctctccatcaaggcgattcacaagttctgccagcgctgtttatcatcgcctgactctgcttccttctctttatccctasctgtacagccacagtcttaattcagttcctaaaaatttttttgcctagaatcttgcaacagcgtccagtattaattccttaccattctattctccatact

SEQ ID NO: 40102 - DNA, 201 bp, Homo sapiens
tgaagaattaaaggagaacaggctatagctagagatgatggcataagggggctctctgcccatttaaccaagtgtgatgtgggctatacatgcttttaatrctaatattatattgtaaggcaaatcctgctgagaaagttccaaagacatctaaagccatgtggacatcagctcatacttagtagtggacagagtgaggaa

SEQ ID NO: 40103 - DNA, 201 bp, Homo sapiens
gttatttatgcagcatttctccataaagactaccataatttggtacttcctcctcctatgaggaagggggaaagaaaaaaaaatgctttataaattttggycgactcctagtacagcagtcccccgtatccgcagttttgctttgcatggtttcagctacccgtggtcaatcacagtctaaaaatattcagtagaaaattc

SEQ ID NO: 40104 - DNA, 201 bp, Homo sapiens
aagtgacccactttacccctgagagatacataaaggtgcatttatggagagactggatgagtgaggctgagacattcgctcagcagcttagtcctagatartctcccatgaacgcagtatcgaatcttactttttacctaaggcacattgagtacggtttctagaaaatgatatgcgaaacactgctaaagtgaagaagaa

SEQ ID NO: 40105 - DNA, 201 bp, Homo sapiens
ggtgtttggcatcatgttcagaaatgcgaaaaataaaattcagcaccgttattactgaattagataaaatgattgtatttaattaatccgtaaatattaastaattattctgtttacaataacatgtaatgaatataattctccaccaggcaaataaagaaagaaagatgtaattaggtgatttaagcataaaacttggct

SEQ ID NO: 40106 - DNA, 201 bp, Homo sapiens
agatatcccattaattggacacacaacccagatgaaaaggctgaaacccaagagtatataaaaaaacataaggttgttgcaatttaagtgccttcaaaagrtctaatttgatttctaaaagcaattttgcagatgtgaaaattaaaggcacgcagaaacaagatatgatttaatgaacgtgtaggttaagaaacatttaga

SEQ ID NO: 40107 - DNA, 201 bp, Homo sapiens
ttctggctcttcaaaataagttgcatcaaacagagcaacatgctaatgagcgatttgtgccttcaaagttgaagaactaaaacttgattattcatcccgtyttctctatagtcatataattgagcaaacagttgggctaaactttgaaagaaatttcttgatgtgtgagtttttgtttttgttttttgactgtagcatctt

SEQ ID NO: 40108 - DNA, 201 bp, Homo sapiens
tcagaaatgcgaaaaataaaattcagcaccgttattactgaattagataaaatgattgtatttaattaatccgtaaatattaactaattattctgtttacmataacatgtaatgaatataattctccaccaggcaaataaagaaagaaagatgtaattaggtgatttaagcataaaacttggctgaaagcatatttaaatc

SEQ ID NO: 40109 - DNA, 201 bp, Homo sapiens
gccgccaggcctcggcgctttgtccccggcccgcccggggatgctaccacgctagagttgtacaccaaggtttgtcttcccaggaagcgctggcggctgcytttgggccgcctggcgcggagccccaggctgcaggcgccgcgtgtgcgggcgggaagttcccacagttgcaaagaggcagcgaagtatgtgttccaaact

SEQ ID NO: 40110 - DNA, 201 bp, Homo sapiens
agctgcttctgcacccggtacattgatcgatctgatgggctgcgcgcccggaagagctggagagatgaagccagcgtccagcttctcccccaaaccacagyacgccgagctttgtccccggggagcgtgaagtcaccagctccgggaggcgacaatatgagggcgatggacggggcagggacccccggaagccccagcaat

SEQ ID NO: 40111 - DNA, 201 bp, Homo sapiens
aattcccagaagtcgcctgcgaccgcctccctgcttcaaacaccagagagggcccggggtcctggccggagacaggccgaacctccggagctgcttctgcmcccggtacattgatcgatctgatgggctgcgcgcccggaagagctggagagatgaagccagcgtccagcttctcccccaaaccacagcacgccgagcttt

SEQ ID NO: 40112 - DNA, 201 bp, Homo sapiens
gaggcaggagaatcgcttgaacctgggaggcggaggttgccgtgagccgagatcgtgccattgcactacagcctgggcaacaagagcgaaactccgtctcaaaaaaaaaaaaaatacaaaattagccgggcgtggtggcacatgcctataatccgagctactggggaggctgaggcaggagaatcacttgaacccgggagg

SEQ ID NO: 40113 - DNA, 201 bp, Homo sapiens
gtggtggtcatggaggtggtttcggtgggaatgacaactttgatcatggaggaaacttcagtggttgtggtggctttggtggcagctgtggtggtggtggwtatggtggcagtgaggatggctataatggatttggtaatgatgggagcaattttggaggtggtggaagctacaatgattttggcaattacaacaatcagt

SEQ ID NO: 40114 - DNA, 201 bp, Homo sapiens
ggctttgcctttgtaacctttgatgaccatgactccgtggataagactgtcattcagaaataccacagtgtgaatggccacaactgtgaagttaggaaagyctgtcaaagcaagagatggctagtgctccatccagccgaagaggtcgaagtggttctggaaacttaggtggtggtcatggaggtggtttcggtgggaatg

SEQ ID NO: 40115 - DNA, 201 bp, Homo sapiens
gaagacactgaagaaatcacctaagaaattattttgagtagtatggaaaaattgaagtgattgaaaacatgactgaccgaggcagttgcaagaaaaggggmtttgcctttgtaacctttgatgaccatgactccgtggataagactgtcattcagaaataccacagtgtgaatggccacaactgtgaagttaggaaagcct

SEQ ID NO: 40116 - DNA, 201 bp, Homo sapiens
agtgtgaatggccacaactgtgaagttaggaaagcctgtcaaagcaagagatggctagtgctccatccagccgaagaggtcgaagtggttctggaaacttwggtggtggtcatggaggtggtttcggtgggaatgacaactttgatcatggaggaaacttcagtggttgtggtggctttggtggcagctgtggtggtggtg

SEQ ID NO: 40117 - DNA, 201 bp, Homo sapiens
ggataagactgtcattcagaaataccacagtgtgaatggccacaactgtgaagttaggaaagcctgtcaaagcaagagatggctagtgctccatccagccraagaggtcgaagtggttctggaaacttaggtggtggtcatggaggtggtttcggtgggaatgacaactttgatcatggaggaaacttcagtggttgtggt

SEQ ID NO: 40118 - DNA, 201 bp, Homo sapiens
ccacaactgtgaagttaggaaagcctgtcaaagcaagagatggctagtgctccatccagccgaagaggtcgaagtggttctggaaacttaggtggtggtcrtggaggtggtttcggtgggaatgacaactttgatcatggaggaaacttcagtggttgtggtggctttggtggcagctgtggtggtggtggatatggtggc

SEQ ID NO: 40119 - DNA, 201 bp, Homo sapiens
gttgaattctggataatggaaaaacaaaaggctgagaaaatagaacttcaagttccatgttgcaactcaagttccaatagacatcagtggactttgataartgcaccacagagaaacaaataaataactgactaattgcctgtatagatgacttatctagaaagcagaaatggatctatatcatttttctgtcattttttt

SEQ ID NO: 40120 - DNA, 201 bp, Homo sapiens
aaagatactttttgttacccctttcttgtttcttttcctactcatttttttttctattggtaaatttactagtgatatacttgcttgaacatttttttttwaatcaaaggcactagaaatttccagaaaactaattatcagctggttgaattctggataatggaaaaacaaaaggctgagaaaatagaacttcaagttcca

SEQ ID NO: 40121 - DNA, 201 bp, Homo sapiens
tcgaggctcctgaaagagaaagggcctgctggtctcatcctctgcttcctttgcctttaccctatacctctctgcacgtcccaccccgttttgctgtgtgstcacccccaggatgtgtacccggttgtagtaggagctgaaatccatgctgagctgtaccaggaacttgcatatctagagacagagactgagtcactggcc

SEQ ID NO: 40122 - DNA, 201 bp, Homo sapiens
tgctgctgtggaccagaccctgtttcctgggaaggtgcacagcttgagctgggccctgcgtggttatgaggagctcctgttgctggcatcgggccctggcrgggtagtagcttgcctagagatctcagccgcaccctctggcaaggccatctttgtcaaggaacgttgtcggtacctgctgcccccaagcaagcagagatg

SEQ ID NO: 40123 - DNA, 201 bp, Homo sapiens
gcgctctggcctgtggaacatgtctgactggatttgggatgcacgctggcttgagggaaatatagccttggccctgggccacaactcagtggtgctatatraccctgtagtagggtgcatcctgcaagaggtgccctgcacagacaggtgcaccctctcttcagcctgcctgattggagacgcctggaaggagctgaccat

SEQ ID NO: 40124 - DNA, 201 bp, Homo sapiens
cccaggatgtgtacccggttgtagtaggagctgaaatccatgctgagctgtaccaggaacttgcatatctagagacagagactgagtcactggcccatctstttgctcttgtgccccaggccagaataaagaatagagtgtagagtgtcctggttgtctatgcctcaccatctctgtgcgtacagcaatgtggagccccgg

SEQ ID NO: 40125 - DNA, 201 bp, Homo sapiens
gaccctggggtgggaggcaaggctcgggctggtgctggggcacctgtagtgggtagtggtagtagtgggggtgggaatgctttcactgggttgggcccagygtctaccctgccctctctgcacgggaagcagggtgtgacctcagtcacatgccatggtggctatgtgtataccacagggcgtgatggagcctactaccag

SEQ ID NO: 40126 - DNA, 201 bp, Homo sapiens
gtgatcacatgtagtgaggacactactgtctgtgtcctagcactccctacaaccacaggctcagcccacgcactcacagctgtttgtaaccatatctcctyggtacgtgctgtggctgtgtggggcattggcaccccaggtggccctcaggatcctcagccaggcctgactgcccatgtggtgtctgcgggggggcgggct

SEQ ID NO: 40127 - DNA, 201 bp, Homo sapiens
tgtggtcgaggctcctgaaagagaaagggcctgctggtctcatcctctgcttcctttgcctttaccctatacctctctgcacgtcccaccccgttttgctrtgtgctcacccccaggatgtgtacccggttgtagtaggagctgaaatccatgctgagctgtaccaggaacttgcatatctagagacagagactgagtcac

SEQ ID NO: 40128 - DNA, 201 bp, Homo sapiens
caaagaggtgtggtcgaggctcctgaaagagaaagggcctgctggtctcatcctctgcttcctttgcctttaccctatacctctctgcacgtcccaccccrttttgctgtgtgctcacccccaggatgtgtacccggttgtagtaggagctgaaatccatgctgagctgtaccaggaacttgcatatctagagacagagac

SEQ ID NO: 40129 - DNA, 201 bp, Homo sapiens
gggtcaggggcttgaggtttacaactggtatgactgaggtatcctgcggtggctggcgtgctgggcatggggcctgctcacagacagcatggagcagggawgggctgtctgtgcccatgctcagcatgccttgaggggaggaggtggtggccgtgggttcctgatgtcggtgcaggagctgaaggtgagtggagtgctgcc

SEQ ID NO: 40130 - DNA, 201 bp, Homo sapiens
gactgctgttgtagctcacattttgactgcaacctcatgagggactttgagccagaatcatccccaattcctaacctacaaaaactgagagataaaaacatttatcactgcttaggcaaccaagttttgcattattttattatgcagcaatagataactaatacaaaatcatgattattgctatattggcctaccattgat

SEQ ID NO: 40131 - DNA, 201 bp, Homo sapiens
ttgataatgttacacattaatgcatgtcaatgcatttaaatggtttattctttcaatttaaatagatttattttaagaggaaaagttttatgttgtaaatraaaaataagcatcactagccacaaaataaaaataactcagaatttaatttccttttcctgtgactcattttttatttttatgttttaaaataaattttat

SEQ ID NO: 40132 - DNA, 201 bp, Homo sapiens
tttattttaagaggaaaagttttatgttgtaaataaaaaataagcatcactagccacaaaataaaaataactcagaatttaatttccttttcctgtgactsattttttatttttatgttttaaaataaattttattgcatgtatttaaggtatacaacatggtgttatggaatacatatagatagcaaaaaggttactaca

SEQ ID NO: 40133 - DNA, 201 bp, Homo sapiens
ttttgttctctaactctgtatatttgattgtttttaaaagattccacatataaatgagatcatgcaataattttctttatttttctgtctatgtctggctyatttcactaagcttaatgtcctccagacacattcatgttgtggtaaatggtaagatcttgttctttattgggctgaataatattcccttgtatacatata

SEQ ID NO: 40134 - DNA, 201 bp, Homo sapiens
tactgtggcaagcatttgagctcaggtcatgggtctccaaagccattttacacaatgatatgtgtgatggttttctgggatggcccagctagcaggtgggkgagggatcactgaggtaggggacagtgtaattgacaggcttcatagaagctaagcaagggacacatttagttcaagttcagtggcaaggggaaaaaaact

SEQ ID NO: 40135 - DNA, 201 bp, Homo sapiens
tttccctcttgaaacaccattcctttctttgttcaggatctactgtggcaagcatttgagctcaggtcatgggtctccaaagccattttacacaatgataygtgtgatggttttctgggatggcccagctagcaggtgggggagggatcactgaggtaggggacagtgtaattgacaggcttcatagaagctaagcaaggg

SEQ ID NO: 40136 - DNA, 201 bp, Homo sapiens
gttctagactgagtgacagcattggacaaagatgtgtggagcaggatggtagctggaggagtgccagagagagacccgggatctcaccaaggttacagtgyctgtggctttgcgaagattcctcctaaaattctgctcatggaaggatttcaaagaaagactgagtgaacttgttcctgagaatgcttgaagggacgggga

SEQ ID NO: 40137 - DNA, 201 bp, Homo sapiens
tttctgctgagagcagcaattctgtctttatcctctttcccatgactacagagcctccaacatctgactgagttgacagaagagtgagggggacactggaraaagtcccaggctggaggccaggggacctggaggccgatattgtcattgcctctgactagtcctatgctcttgagcaagctgctccagtgtctgagtctc

SEQ ID NO: 40138 - DNA, 201 bp, Homo sapiens
ctgatcatagctctcctgcttaccttaaaggactactgggggaattcagtgagagcctttacttactgaacatctactgtaaagtagacattggctttaaracaagtgggaacacattgtcatttataagatttatgtaaagtaaataaaagaaatttttattgttgtagttattctattggagaaaattaaagttgggta

SEQ ID NO: 40139 - DNA, 201 bp, Homo sapiens
acaagtgggaacacattgtcatttataagatttatgtaaagtaaataaaagaaatttttattgttgtagttattctattggagaaaattaaagttgggtayacaatcacggactgtacctgattaattcttgcatctgattcttatgcctctgtcttcagaatatttgtaataatctacaattgtccattttggactgtga

SEQ ID NO: 40140 - DNA, 201 bp, Homo sapiens
ttgtcatttataagatttatgtaaagtaaataaaagaaatttttattgttgtagttattctattggagaaaattaaagttgggtatacaatcacggactgyacctgattaattcttgcatctgattcttatgcctctgtcttcagaatatttgtaataatctacaattgtccattttggactgtgaatcttttgaagttga

SEQ ID NO: 40141 - DNA, 201 bp, Homo sapiens
ctgaaatacctgaatccttaatgaggtcccagcaccttggacctttgcatagttttggctagaacatctttgttcctgtgacttcccacttaggttcaacyccaaaatatctctcagatttcaacttgaaagtcccttcacttcctctggggaatcttgcatgatattccttttttttctttttccttcctagctcattat

SEQ ID NO: 40142 - DNA, 201 bp, Homo sapiens
ttacagaagcagtcttccctgcatcccagaggctgccacagctgagagtttaaatttgcagcttcagaaaggaaagcagacacacaaatgtgcacacgaacacacacacacacacacacacacacactcactctctctctctctctaatgcccatgtgatatcaaatgtagccttgacaatgctccagcccccacagagat

SEQ ID NO: 40143 - DNA, 201 bp, Homo sapiens
tgaattctttcctttcttccataaatagtacgtgattttccactttgggccaggcacagtattcttaacgtgctcatatcttcatgcctaatatggtgccyggtacaaagcaagcaataaacatgaatgatggaatgagtcaaccagtgaatcaaaggtttagttcaaacaagttaagccctccctatggtctaggagctt

SEQ ID NO: 40144 - DNA, 201 bp, Homo sapiens
atcccagaggctgccacagctgagagtttaaatttgcagcttcagaaaggaaagcagacacacaaatgtgcacacgaacacacacacacacacacacacacacactcactctctctctctctctaatgcccatgtgatatcaaatgtagccttgacaatgctccagcccccacagagatgctagtctctcccacttctcag

SEQ ID NO: 40145 - DNA, 201 bp, Homo sapiens
tgcagtggtgtgatctcagctcattgcaacctctgcctccctggttgaagcgattttcctgcctcagcctcctgagtaaactgggattacaggcatgttcyaccacacccagctaatttttgtatttttagtggagacggggtttcaccatgttggccaggctggtcttgaactcctgacctcaaatgatccacccacctc

SEQ ID NO: 40146 - DNA, 201 bp, Homo sapiens
tcccagaggctgccacagctgagagtttaaatttgcagcttcagaaaggaaagcagacacacaaatgtgcacacgaacacacacacacacacacacacacacactcactctctctctctctctaatgcccatgtgatatcaaatgtagccttgacaatgctccagcccccacagagatgctagtctctcccacttctcagt

SEQ ID NO: 40147 - DNA, 201 bp, Homo sapiens
ccacccacctcagctgcccaaagtgctgggattataggcgtgagccactgcgcctggcctggctcattgtttttatatataaaacttacatattttctttyctatgggagtgttgtgattactaaatgagagaatgaatgcgtagtcattcttcaagggattgtcacacagggaagcttcaatatgtttgggtaacagtaa

SEQ ID NO: 40148 - DNA, 201 bp, Homo sapiens
taatcccagttacttgggaggctgaggcaggagaattgcttgaacccaggaggtagaggttgcagtgagccgagatcgcgccactacactccagcctgggwgacaagagcagaactctatctcaaaacaaaacaaaacaaacagaaaagaactgaagcacagctaagccggataagaatttatctctatctctaagtgtat

SEQ ID NO: 40149 - DNA, 201 bp, Homo sapiens
gcataggtcctgggggcaatgacagagtccagatgtccccatgggcatgacttgcaaattatgtactttgacagaatatggtgaggacaagaaccagaccrtgcagcactattttcacgccagctgcagagtctaaatgtgtttcctgacacctcagaaccttcttgggggagggcattctgggctgggtgatgggacatg

SEQ ID NO: 40150 - DNA, 201 bp, Homo sapiens
ctgaagcacagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctctattatctatcagctactatgtgcca

SEQ ID NO: 40151 - DNA, 201 bp, Homo sapiens
tctccaaccaaaccttatctaatgaagatgacattttaattcccttgtttaaatatgactctaatttcaaagtaggaagttggttctgactttgtgggtgrgaagaggatatggtgtctaaacatgtgccccttaaaaccaccataatagccaattacttattctttatggccatatgtcaggtatattttaaagttggaa

SEQ ID NO: 40152 - DNA, 201 bp, Homo sapiens
tgaagcacagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctctattatctatcagctactatgtgccag

SEQ ID NO: 40153 - DNA, 201 bp, Homo sapiens
taccctgtgttggtaattgtgctgggcacaaagaacataatagtaaatcacataaaattccatcctcaaggatcccatgttctatcatactagagaactgwgtacagctgctcctcgacttatggtgggattacatcccaataaacccatcataagttaaacctatcataagtcaaaaatgcatttaatacacctaaccca

SEQ ID NO: 40154 - DNA, 201 bp, Homo sapiens
gaagcacagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctctattatctatcagctactatgtgccagg

SEQ ID NO: 40155 - DNA, 201 bp, Homo sapiens
tgttcattcatgccatcatttgaaaaatactaattaagtatttaccctgtgttggtaattgtgctgggcacaaagaacataatagtaaatcacataaaatwccatcctcaaggatcccatgttctatcatactagagaactgagtacagctgctcctcgacttatggtgggattacatcccaataaacccatcataagtta

SEQ ID NO: 40156 - DNA, 201 bp, Homo sapiens
aagcacagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctctattatctatcagctactatgtgccagga

SEQ ID NO: 40157 - DNA, 201 bp, Homo sapiens
acagctaagccggataagaatttatctctatctctaagtgtatctctctgtcttatgtgtatttcctgtatctcagtttctacatctgtgtattatctatctatctatctatctatctatctatctatctatctatctatctatcatctgtctatctttctatctctctattatctatcagctactatgtgccaggaattg

SEQ ID NO: 40158 - DNA, 201 bp, Homo sapiens
agtttcctcatctgtaagaaggaggacaataataattcctatcttgtatgttattgtcagaatttaatgagttaacaaatatatgtaatatatatgttttwtatatatatacacattttggtttagtgtttggcatatagttaagtacaaaataaatattagctattgatattaattttggggttggaggtcaagaaataa

SEQ ID NO: 40159 - DNA, 201 bp, Homo sapiens
ttgaatttaatttatacctcataacaaactgtaaagaatgtactaccgttttcttcttctagaggggaagaaactgaggctcaacaagtttaagaaagttkctgggagacatatagcacacaaacataaaaccagaatttgaatacacatctatttcatgatggactacttttgtggaactgttaaaggaaacaagtaatg

SEQ ID NO: 40160 - DNA, 201 bp, Homo sapiens
attttcaagggaatgtttctaatgttccatcattatagaggccacatagcacactggttaaaaatgcaagatcaaggaggtttgaatttaggctctgtcasttaaaagttgtgtgatttgggccagataacttaacccctctgtgttcgtgtttttccattagtgaaatgaaaataaacaaaagcaacaacaacaataata

SEQ ID NO: 40161 - DNA, 201 bp, Homo sapiens
gcacactggttaaaaatgcaagatcaaggaggtttgaatttaggctctgtcagttaaaagttgtgtgatttgggccagataacttaacccctctgtgttcrtgtttttccattagtgaaatgaaaataaacaaaagcaacaacaacaataatatttatatcagaagaatgttgtgaggattaaacatatatgtgtgtatat

SEQ ID NO: 40162 - DNA, 201 bp, Homo sapiens
gggcaatgacagagtccagatgtccccatgggcatgacttgcaaattatgtactttgacagaatatggtgaggacaagaaccagaccatgcagcactattytcacgccagctgcagagtctaaatgtgtttcctgacacctcagaaccttcttgggggagggcattctgggctgggtgatgggacatgctgggattttgtt

SEQ ID NO: 40163 - DNA, 201 bp, Homo sapiens
acttctgtccattcactgctttgtcagcagcagtttacttgactgttaccttgggtaattccttgagcttatttatttactatttttgagatggagtctgrctctgttgcccaggctggggtgcaatggtgcaatcttggttcactgcaacctccacctcccgggttcaagcgattcttctgcctcagcctcctgagtatc

SEQ ID NO: 40164 - DNA, 201 bp, Homo sapiens
tgcagagtctaaatgtgtttcctgacacctcagaaccttcttgggggagggcattctgggctgggtgatgggacatgctgggattttgttgctctccttcycttgtgggtcttaatggaaaagctaagtcaccagcaacagagaaatagcggtgtcaggcattgttgaaactttccatgtattctcatgacacatcatttc

SEQ ID NO: 40165 - DNA, 201 bp, Homo sapiens
aacaaatatttatagagcccctggtatttgccgagtgccatggagatgagagctaccatggacaaaaggatggtcacccaatcctcggtggtacaggactwctgtaaatgccccaggaggtcttccctttttcccaggttgatgccttctgaatcacttctgtccattcactgctttgtcagcagcagtttacttgactgt

SEQ ID NO: 40166 - DNA, 201 bp, Homo sapiens
aatggaaaagctaagtcaccagcaacagagaaatagcggtgtcaggcattgttgaaactttccatgtattctcatgacacatcatttccagttataaaaargagtggaggtgttgggctctgttgcctaatcgtggtaagaagtcccttttactagaatgcattttttcatcacagcatcatggtcaatgatcaaccatgt

SEQ ID NO: 40167 - DNA, 201 bp, Homo sapiens
atagcggtgtcaggcattgttgaaactttccatgtattctcatgacacatcatttccagttataaaaaagagtggaggtgttgggctctgttgcctaatcrtggtaagaagtcccttttactagaatgcattttttcatcacagcatcatggtcaatgatcaaccatgtgaacttgtgtaagttgcataaacttttcagta

SEQ ID NO: 40168 - DNA, 201 bp, Homo sapiens
caaggtaccatatcttataacaggaacccagcctattatatgcatttatattgttgaatcttgtgatgttttttccttatatattaaataagtcagtcttktcataagacctgtcagttaattttgataaacacactagggaattcatcgtctttgcagtctaggtggcaaagcaattttacttactgttttttattacct

SEQ ID NO: 40169 - DNA, 201 bp, Homo sapiens
tattgacaggcttgcagcgaggaatgagcatctaccttgctggttagattgcttttatccagagtggtgatccctggggagatgttttgcacttggcctcrtggcagatgggtaacaagtgctggatcccagaggaatgatgcattcaacaagtcctgagttttatctatagtgccatgcagtgagttcctcctgctccta

SEQ ID NO: 40170 - DNA, 201 bp, Homo sapiens
acttgagtccctggacttttatttcctcatatgtgaaataaagataatgtctaacttataataacttagttagataattagtgtatggaaaatgcaaggtrccatatcttataacaggaacccagcctattatatgcatttatattgttgaatcttgtgatgttttttccttatatattaaataagtcagtcttttcataa

SEQ ID NO: 40171 - DNA, 201 bp, Homo sapiens
ggctgtcagaaatttagacttcagtgtggttccagaactagtgtgcagaaatataaggcaaagctcataaccatcctccagtgttcaggctcagcataagycctctaggaaaacctttgtacctttctttgggcctcccccaccatagccctcatcatgctatgattaattgctcaattatctttctctctacattgtcgg

SEQ ID NO: 40172 - DNA, 201 bp, Homo sapiens
tcgtaaatgaagagtctgaggcttgagacttggtttgcccaagtccagtagcattaatacaggcagccaggtcttcagatagctgcccaattcccttttcrcatctcaaatatgtgaggtcttcagacaccttggagataatatttgctctcacctctttcctcaaagaattaaatgtgacttgccatcttgagttttgtt

SEQ ID NO: 40173 - DNA, 201 bp, Homo sapiens
aggaaagaggtttaattgactcacagtttcacatggctggggaggcctcacaatcatgatgggaggcgaaggaggagcaaaatagtctcatcttacatggyggcagacaagagagagcatgtgcaggagaactcccccccatccttttttttttttctttttttgagagggagttttgctctgtctcccaggctggagtgc

SEQ ID NO: 40174 - DNA, 201 bp, Homo sapiens
gcctcacaatcatgatgggaggcgaaggaggagcaaaatagtctcatcttacatggtggcagacaagagagagcatgtgcaggagaactcccccccatccttttttttttttctttttttgagagggagttttgctctgtctcccaggctggagtgcagtggcatgatctcggctcactgcaacctctgtctcccaggttc

SEQ ID NO: 40175 - DNA, 201 bp, Homo sapiens
ttttacaaatacttgttagattcagacatgtatcacaccttggctgcaagtaatgggaccatgtcatagggattgaaagtgatccatccatggtggcgggygcctgtaatcccagctactgaggaggctgaggcaggagaatggcatgaacccgggaggcggagcttgcagtgagctgagattgcaccactgcactccagc

SEQ ID NO: 40176 - DNA, 201 bp, Homo sapiens
cctttagcagactccgtgtctctttcctttgatggaacagctaatgaaacacatcctttccttgagtcaatccctgatttcagaaaaatttttagacatcktgtgtgtgtgtgtgtgtgtgtgtgtgtatgtgtgtgtgtgtgtgtgtgtgtatgttggggggatggagggaagagtgaggaaatagtttccattcagtag

SEQ ID NO: 40177 - DNA, 201 bp, Homo sapiens
tcctttgatggaacagctaatgaaacacatcctttccttgagtcaatccctgatttcagaaaaatttttagacatcgtgtgtgtgtgtgtgtgtgtgtgtrtgtatgtgtgtgtgtgtgtgtgtgtgtatgttggggggatggagggaagagtgaggaaatagtttccattcagtagtctggagcctgatctattggaaaa

SEQ ID NO: 40178 - DNA, 201 bp, Homo sapiens
tgatggaacagctaatgaaacacatcctttccttgagtcaatccctgatttcagaaaaatttttagacatcgtgtgtgtgtgtgtgtgtgtgtgtgtgtakgtgtgtgtgtgtgtgtgtgtgtatgttggggggatggagggaagagtgaggaaatagtttccattcagtagtctggagcctgatctattggaaaatcccc

SEQ ID NO: 40179 - DNA, 201 bp, Homo sapiens
gatttaggaactaatagtggctcagggtgtggggaaggaaggcttgctagagaggattacacttgaacagaatcttgaatatgatttagagcttgggaggaaaagggaagaaaggaggcagtgggagagaggcagagatgtctatccataccagagtgtgaagaggagaaacagcatgctgcatttggggaaagtccatgg

SEQ ID NO: 40180 - DNA, 201 bp, Homo sapiens
atatcctaagaaatgatgcagctacatattgcttggcttgtgtttcctagataaggcattgattcctaggcactagaattatatactataattaaagagatttttttttaaatctatcaacaaagacctagagtttgaaaatctttcagttttctaatccaaattagggaaccagttacacagggtagcataggtcaaagg

SEQ ID NO: 40181 - DNA, 201 bp, Homo sapiens
cctcccttctcccctcccctccccttctccttttcctccccttccctccccttctcttcccttccctttcctctacccccttccccctttcccttcacttmcccttatttcttttctttctttttctttgtttctccctccctctctcctcttttttcttttctcctttctttccttcctttctcctttttttcccttctt

SEQ ID NO: 40182 - DNA, 201 bp, Homo sapiens
ttggtttaatttataatgatttaaaaaattctctactatagccctaattgtggtcccactttgttactatagtttaatttgtgatctctttttttttttgkttttgtttaataatctcttttgcttctttgttttcttgtacattaatatcagttgtttacctgtttctgtcagaggcatttgaaccagaacgactccatc

SEQ ID NO: 40183 - DNA, 201 bp, Homo sapiens
ggcaccaaatttcacttgcatccatggaagagaccaccaaacaggctttgtgtgagcaataaagctgtttatttcacctgggtgcagctgggctgagtccraaaagagggtcagccaagggagataagggtggggacgttttataggatttgggtaaataaaggaaaattacagtcaaagcggggttgttctctggtggcc

SEQ ID NO: 40184 - DNA, 201 bp, Homo sapiens
aatatttatatcagaagaatgttgtgaggattaaacatatatgtgtgtatatatacacatacatatattaatatatgtatgtatgtatgcatatatatttktgtacttagaacagtgcctagtacaaatttaatgctcaataagtatttaataatgataaaaagtgatatttactgaatactttttgtaaagattccttat

SEQ ID NO: 40185 - DNA, 201 bp, Homo sapiens
aggagcagcctggggaggaggggagaggtcagatgggtctgtagaaaaggaagattagaaagactcagcgacgcttggggttgggacagaggggacaggcrggagggaaagaaggaagatttgggatgagttgcactgggcacagagactaggaagggactgatgtgtaaaagaatgcctggacgtcaggcacctcagacc

SEQ ID NO: 40186 - DNA, 201 bp, Homo sapiens
tagcagtgcaagagctgatctgaactcaggggccctggagaagcaaagtcactcctccccattctgaagcagctgtggttccttacatttggacacaggcytgagaccttggctacagtgagctagtgctggggaatctacttattgatcaccggagcagctgctaagcctggctttcaagaacatccctcagagggtgct

SEQ ID NO: 40187 - DNA, 201 bp, Homo sapiens
gacgaatgaaactagaattattgaaactctctcaccatataaaaatcaactcaaaaagaatgaaagacttaaatgtaagacctgaaactataaaatgactmgaagaaaacactggagaaatactcgggacatttgtctgggcatagaattttttgagtaagacctcaaaagcacaggcaattattttactcattttggttc

SEQ ID NO: 40188 - DNA, 201 bp, Homo sapiens
tcaactcaaaaagaatgaaagacttaaatgtaagacctgaaactataaaatgactagaagaaaacactggagaaatactcgggacatttgtctgggcatakaattttttgagtaagacctcaaaagcacaggcaattattttactcattttggttcacaatttcctgttttttatgatctctgaaaattgcagccctacct

SEQ ID NO: 40189 - DNA, 201 bp, Homo sapiens
gatttttatgattgtgatctattttttatgtttattggattttggttttgctgtttggatgttgggctttcattttcaggatagctctatcacatatttcrtaattttgttttgtagaattatcttatattgaaggaatgttgttttgtgctaatacattttctctttctttagagcatatgtgatgttttcgtccaatgg

SEQ ID NO: 40190 - DNA, 201 bp, Homo sapiens
ttaaaatggaaatgtatttttccatgcaccagctaaaattatttctcaaaccatcagtgctaagcaaaccacatatatgcaaatgtcggggaaatgacaaraacacagactgagagattcaaacctagacttgagtgtatcacttgagtccctggacttttatttcctcatatgtgaaataaagataatgtctaacttata

SEQ ID NO: 40191 - DNA, 201 bp, Homo sapiens
acattgactaaggctttctgagaaatcttgcttcctgtagcctgcagccattcgttataaaacacagagagcagtctggcccagaacagagtttcccacayttcactcattcttaacaactttttccaaacctgtctttttaatgtttcaatttctgaatatttttctttaaatagactccagtaaaagtagcttcatcct

SEQ ID NO: 40192 - DNA, 201 bp, Homo sapiens
atagacacccagtaaatattacagaataaataaattaatgaagaggcaatttactccttcatcttagttcttccttgctgtccagacatagtcctgacttrcatgtgacatgggggaacaaactgttctatctgtaccaccagttaactaaggagtccttcaggctcagctatgaattccatcaggaaaattctgagcttt

SEQ ID NO: 40193 - DNA, 201 bp, Homo sapiens
ttgcattcctctggttttggggaagccgtacctttctcagcttctagaggttctccatattccctggctggtggccaagcatattccgaattctgcttccrttgccacatcttcgtgtctgcctgactctactgtgtctctctcacaagaacttttgtcccagatagtccaggacaatctccccatctcaagatccttaat

SEQ ID NO: 40194 - DNA, 201 bp, Homo sapiens
caagagctgatctgaactcaggggccctggagaagcaaagtcactcctccccattctgaagcagctgtggttccttacatttggacacaggcctgagaccwtggctacagtgagctagtgctggggaatctacttattgatcaccggagcagctgctaagcctggctttcaagaacatccctcagagggtgctttcactgt

SEQ ID NO: 40195 - DNA, 201 bp, Homo sapiens
tctttcctcaaagaattaaatgtgacttgccatcttgagttttgttacaaaagattgtaatgctattcaatagtggtatcatatgttatttaccatggaamaagatggcaaaaactccccctgaggaactgcactaaaagtaaaagatcaagaccaagggaagagaaaatacaaatattcgaaccctatgtatctaacatg

SEQ ID NO: 40196 - DNA, 201 bp, Homo sapiens
ttgaatgcgctgaaatctatgatgtttggggattgttaacaatcttcttccaggatttgatcggttttgtacttgtattttctcaatctactattctttayttgctctccttcctttagaatggacaaatttttgtaaacttttaagttttctctttccttgaggtagtaaattggagttgagctacacaggttcctcttt

SEQ ID NO: 40197 - DNA, 201 bp, Homo sapiens
gaagcagtgccttccaccataattgtaagtttcctgagacctccccagacatgtggaactgtgagtcaattaaacctcttttctttataaattacccagtytccggtatttcttcatagcactgtgagaacagactaatacagtcagtaatggaaaagagtaagatgatgggagagaatttgaaaggatttggtttagcta

SEQ ID NO: 40198 - DNA, 201 bp, Homo sapiens
aaacagtaggagtttgtttttcatgtaaaagtctggcgttacatggtcgaggattaatatgatggctgtttaggaattcaatattttttcaaccatccccrtatgtgaccttcagactcacattctaaacctataatcagggcaacaaggtggaaacaatggtaaataagaagagagttacacagaggtaccagtgttctt

SEQ ID NO: 40199 - DNA, 201 bp, Homo sapiens
cagtgccttccaccataattgtaagtttcctgagacctccccagacatgtggaactgtgagtcaattaaacctcttttctttataaattacccagtttccrgtatttcttcatagcactgtgagaacagactaatacagtcagtaatggaaaagagtaagatgatgggagagaatttgaaaggatttggtttagctagaag

SEQ ID NO: 40200 - DNA, 201 bp, Homo sapiens
tttaggattggatttgattgttagtaatgtgaaactctaaattaatactggcctaaaaacagtaggagtttgtttttcatgtaaaagtctggcgttacatrgtcgaggattaatatgatggctgtttaggaattcaatattttttcaaccatccccatatgtgaccttcagactcacattctaaacctataatcagggcaa

SEQ ID NO: 40201 - DNA, 201 bp, Homo sapiens
taaggacagtgtgttagtgtgaatttcagaggccaaggaggagaatagtctgggatgagccctgagagtagcaggagcccagtccccttccctgcagagcyttgctaatgttggtgagatgtggtctggagagagacattaaaactactgaaggatttcaagagagaaagtggctgtcagatttgcatttaagactattgc

SEQ ID NO: 40202 - DNA, 201 bp, Homo sapiens
aacgcatgatggacgtattgtttaggattggatttgattgttagtaatgtgaaactctaaattaatactggcctaaaaacagtaggagtttgtttttcatstaaaagtctggcgttacatggtcgaggattaatatgatggctgtttaggaattcaatattttttcaaccatccccatatgtgaccttcagactcacattc

SEQ ID NO: 40203 - DNA, 201 bp, Homo sapiens
tgttggtgagatgtggtctggagagagacattaaaactactgaaggatttcaagagagaaagtggctgtcagatttgcatttaagactattgctctggctrttggaaatgatagcaagaaaagtgggtgaaaacaagagtgcaagtctggaaactagaaggaggttatggaagaggcacctttgccagagattagggtgat

SEQ ID NO: 40204 - DNA, 201 bp, Homo sapiens
ttctatgtacttaattgcattaatagccctaacgtaccatgaagtaggtcttctattttaaagaagaagaagctgatactcagaaatggaaagagggttgmctaaggacacagcttttagatggcacagcctgaattcacatcaagacaagttccaaagacatagtttaaagaatcaacgaagttatactgaggcatctga

SEQ ID NO: 40205 - DNA, 201 bp, Homo sapiens
actgtgccccatttccataggcaatttatctgtatccatagagacaccagagatctgcttcttacttcaaatgtttcatatctaggttattcttcctgacrtgtgagtccagggcacaagtctaaagctcccacttacacagcccagagggactgagccctgctttccacagtcaggtcaggagcacactgactcctgact

SEQ ID NO: 40206 - DNA, 201 bp, Homo sapiens
tggcagtgggacctgggtccaataatttcaagaccagtgctccttcacctatgcatgttgtctactggagtgaagcaaaaatatgggtctatagggcagtrttatgcagaatgagtagtttctttccattattagcataagccatactctgaagctatttctgagacagtcatccttttctatgtgggtcaatgttcctgc

SEQ ID NO: 40207 - DNA, 201 bp, Homo sapiens
cagtgctggtgacaaagtggcttcttgcctgcttttttgtagttgctccagtgggcacatctgtgcccggaatttgtcatgagacaatgagggtttgttcyctgtatccgaaatgatgacttcatgattcttttatggcagagtaagagttggagcagaggagatagaggattaatggagttaaaggagcatattacaaag

SEQ ID NO: 40208 - DNA, 201 bp, Homo sapiens
atactttgaatattttcaaaaaatttctttcaatgttgttccttctttaggtatttctcttatcacttgggctcagcttgatgcttctctggaatttttctttttttttttcctcccatttataaaataccaaacatgtgtccccagtctggatccatgtaactgaaaatcatggggaaattctttatgtaaaaagcccta

SEQ ID NO: 40209 - DNA, 201 bp, Homo sapiens
ttgttccctgtatccgaaatgatgacttcatgattcttttatggcagagtaagagttggagcagaggagatagaggattaatggagttaaaggagcatatyacaaagattgagtttcatattggttaagatctggaatgctttctatctggcaaactgtaaaatccaaagcattaattacattgacaataaggacccaagt

SEQ ID NO: 40210 - DNA, 201 bp, Homo sapiens
gtatctcagtttctacatctgtgtattatctatctatctatctatctatctatctatctatctatctatctatctatcatctgtctatctttctatctctstattatctatcagctactatgtgccaggaattgtaggctgaggagatgtgacaataaacacaattgccagagttcctactctcatggatttttaataagt

SEQ ID NO: 40211 - DNA, 201 bp, Homo sapiens
gttgacagccagcatttcactgctggctgtgtatccatatacgtatgtatggatgcttagaaaagtggaatgctagtgatatatatatatatgcatatatmtatacatatatctatatatatagacatatttctgctttactaggtgagaagagttgcttgattttaagggctctcaatcaacaggcaccaaatgaactta

SEQ ID NO: 40212 - DNA, 201 bp, Homo sapiens
tttggttatctgagcccataaattgcccgttagccctgcgttatactatgatcatgcacaggggtctggaaaatgccttgatgttatactttccttcttcttttttttttttttttttttttttttttttgacagagtctcgcactgtcacctgggctggagtgcagtgacgcgatcttggctcactataacctccgcctc

SEQ ID NO: 40213 - DNA, 201 bp, Homo sapiens
tgaggcaggagaattgcttcaacccgggaagcagaggttgcaatgagctgagattgcgccactgtgctccagcctagaggacagggtgagattccttctcaaaaaaaaaaaaaaaaaaaaaacatgaaatttagttttatttctggctctgaagctttcttggaccatcaggcactcattaacttctctgagtctcatttt

SEQ ID NO: 40214 - DNA, 201 bp, Homo sapiens
tgttcctgtgacttcccacttaggttcaactccaaaatatctctcagatttcaacttgaaagtcccttcacttcctctggggaatcttgcatgatattccttttttttctttttccttcctagctcattatcaaacctgacatctagtaattgtagttgctattaggcagtgtctgtttcatttttaggtggttactagac

SEQ ID NO: 40215 - DNA, 201 bp, Homo sapiens
gtgacttcccacttaggttcaactccaaaatatctctcagatttcaacttgaaagtcccttcacttcctctggggaatcttgcatgatattcctttttttyctttttccttcctagctcattatcaaacctgacatctagtaattgtagttgctattaggcagtgtctgtttcatttttaggtggttactagactttgagc

SEQ ID NO: 40216 - DNA, 201 bp, Homo sapiens
aaatttagacttcagtgtggttccagaactagtgtgcagaaatataaggcaaagctcataaccatcctccagtgttcaggctcagcataagccctctaggaaaacctttgtacctttctttgggcctcccccaccatagccctcatcatgctatgattaattgctcaattatctttctctctacattgtcggttattttta

SEQ ID NO: 40217 - DNA, 201 bp, Homo sapiens
gtgagggtctctgagactgatatgattgagcagctttatgaataagacccaagaggaaaggctggagaaaatgagtaaaacaaagggaaattttacgtacrtttttttgcccatgagctagtcatgaaagggagaatcaaatgtgatctcatcaaagatgttcccccttgagatcataactatatatatatatatatatat

SEQ ID NO: 40218 - DNA, 201 bp, Homo sapiens
aattttacgtacgtttttttgcccatgagctagtcatgaaagggagaatcaaatgtgatctcatcaaagatgttcccccttgagatcataactatatatakatatatatatattttttgagacagcctctctgtcacccaggttggagtgcagtggcatgatgtcggctccctgcaacctttgcctcctgggttcaagcga

SEQ ID NO: 40219 - DNA, 201 bp, Homo sapiens
atcaaagatgttcccccttgagatcataactatatatatatatatatatattttttgagacagcctctctgtcacccaggttggagtgcagtggcatgatstcggctccctgcaacctttgcctcctgggttcaagcgattcttgtgctttagcactgagtagctgggattacaggtatgagccaccacacccagcccata

SEQ ID NO: 40220 - DNA, 201 bp, Homo sapiens
tagctctaccatttattagtgtttgaccttttttcaatttccttcacttatgtgaccccatcttgtatctgagtctgtaaaagaggagtgagaatacttaytttacagggataaaggaagggccatgggaaactgagtaaggattcccaagatgtgtgtttgaatccatggaatctgtgaatattatcttgtatggcaaag

SEQ ID NO: 40221 - DNA, 201 bp, Homo sapiens
gcacaacagggtgactatagtcagtaataatttaaatgtacatttaaaaataactaaaagagtgtaatcggattatttgtaacacaaaggataaatgcttmaggggatgaataccgcattttacatgacatgattattaaacaaaacctctcatgtaccctgtaaatatatacacctactatgtacctacaaaaagtaatg

SEQ ID NO: 40222 - DNA, 201 bp, Homo sapiens
tgctggataccatttttagaactttacatacattaacttcatttaatcttcataacatttctatggatagatactattattagtcccaaatgaaggcatgygcaagaggaagttacttgatcaataataaatagctggtgtcagatatgggattaggacccaaaactctttacatgttgcacaggatcctcttcactatgt

SEQ ID NO: 40223 - DNA, 201 bp, Homo sapiens
tggcaggaataatactgtgcagtggatagggagctctgaattcttaccttgggtgtgctaaaaacctagcctggacttggttacatcccctcctttctccrgtgttctcttggtgggtttataattttagattaaatcagtatttctcaaacttcaatgattggtgtattacagtgtggtagccagtctctgagatgatcc

SEQ ID NO: 40224 - DNA, 201 bp, Homo sapiens
cattcatgttgtggtaaatggtaagatcttgttctttattgggctgaataatattcccttgtatacatataccacatttttgtatccattcattcatcaayggacacttaggttgtttccatatcttggctattgtgaataatgctgcaatgaacatggaagtgcggatatctttatgaggtgttgatttcatttcctttg

SEQ ID NO: 40225 - DNA, 201 bp, Homo sapiens
catttagataatgttgcctgcagaagactctgagcctaaggcatctcatgtctttggaacaaaactgggactttatccttgaattaaacaaagtgactgayacgcaattgagcagggaataactttctcacagtgaaatttgatgttaaaatgccccctctctctacacccccaaactgtcttacagtcttccaaaaaatg

SEQ ID NO: 40226 - DNA, 201 bp, Homo sapiens
ataaaattccatcctcaaggatcccatgttctatcatactagagaactgagtacagctgctcctcgacttatggtgggattacatcccaataaacccatcrtaagttaaacctatcataagtcaaaaatgcatttaatacacctaacccactgaacatcacagcacagacaatgtcaggcactttattacatgtagtaaag

SEQ ID NO: 40227 - DNA, 201 bp, Homo sapiens
agtaattagtagggctggggttagaacctgggtcctctgggtcctccatcactctgtgtggcctgcacagaatccagtccatggactcttcacatgtgagkactctagctgcacatgtggggactcccaagcaggtatagtatatcagagcttgaaggaaggctggcatggcagggtctggggtggtttgggggcctgatg

SEQ ID NO: 40228 - DNA, 201 bp, Homo sapiens
aggcacaagaggagaccaagcatggctccagggacgctagtgagtcacctgcagatgagattattcaactgtataaatgaaatcatgtttcacctgcaacraaagaaagcacaaatcaccagtttttacttctttctcttcttttactagttttaaatggctaaatggatcacctcccttccattcccccactccatctcc

SEQ ID NO: 40229 - DNA, 201 bp, Homo sapiens
tagagatctggtgataaaggactcgtttcaggtttcacacttgaatacatttttacagcttgcttataaaattctgaaagctggtctcctagtagaagggmagatgctgtcaaatgctaaatggtgcagttagagggacattcagacctcctctctagcccttcctctttttctggcacccaaaggcacgggcctttcctg

SEQ ID NO: 40230 - DNA, 201 bp, Homo sapiens
agaaagaggttttccaggaagagggaattgtacaagcctgggcagaggcacaaaggggtggaagagcaagattcactcagggaattgcagtaaattggcaygactggagtccagactacatgtttggtcaggcagtggggtaggtatagaaaaggaaagaatggccaagagtgagagactcagagtatttgggatagagtt

SEQ ID NO: 40231 - DNA, 201 bp, Homo sapiens
agaaaagcaggatgtgatcctaggactaaaggcagacaaagtctatgccttttctctcctattgcagtttccacatatcagcaggtacttcctgtgaaagrggaagcacatttgttctcctggctccagagaagagaaagcagactggcagctctcccatgagggaaagaggagaactttgacaggaatttacgaccacca

SEQ ID NO: 40232 - DNA, 201 bp, Homo sapiens
agcattaattacattgacaataaggacccaagtgtcctcccatttagctgttttcaaaaggtattatgagtatccaagctgtcagggtgatgtgtgtagaytttttttcctttcctgtgtcaaaagcatgatgttgagcagtggcttttaacatttttgacaataacccatagtcagaagtaccttttttttttattgtga

SEQ ID NO: 40233 - DNA, 201 bp, Homo sapiens
caggtgtctgtaatcccagttacttgggaggctgaggcaggagaattgcttgaacccaggaggtagaggttgcagtgagccgagatcgcgccactacactscagcctgggtgacaagagcagaactctatctcaaaacaaaacaaaacaaacagaaaagaactgaagcacagctaagccggataagaatttatctctatct

SEQ ID NO: 40234 - DNA, 201 bp, Homo sapiens
gtgaagatgtgaagattgttccagggcaagctccgaggtgggcaaagtgactggtgatggtggggagagggacaggagggaggttgatgaggttagcaggkgctaggttatgtaaagccatgtgggttgctgtggggaattgagatgagaaaacagagacattgaaaggcattaagtctcgtttccaaggccacactgcta

SEQ ID NO: 40235 - DNA, 201 bp, Homo sapiens
ccagtaggagttgtatattctataatgtccttatcacaattcctttaagggcctccagcactttggaagcatagaaaaaagaaacaacattcctgcatcgyggggccattgatgaataagaatgtttataagaaggcaagcatctttgcactctatacatttccaaatcttttagaaacatatctaagaacttcttagttc

SEQ ID NO: 40236 - DNA, 201 bp, Homo sapiens
agtagtaccgctacagaaaacttttacttaatcaagttagacttctcaccttgaaaagctgtacttccttatgttgccctccctactcccttctgtttatytaaattttgttcattattcagggctctactctaacacctcctcagggtcctcttccatgactgtccaagctgttttcagaacccctaccccattaattgt

SEQ ID NO: 40237 - DNA, 201 bp, Homo sapiens
aaaatatttctgaatctttgtgcatcttgaatttgtccaggactaaagaaagaaaagtatattttgatgtacaggaatgcatggagctttgtggttctctrctcaagtggagtagtatttttatgtatattgggtgacaaaacattcagattacatggaaaccaaacatgtcaaagcattttggagaaataatttggtagc

SEQ ID NO: 40238 - DNA, 201 bp, Homo sapiens
aggagaaagaggcagtgagtattttgacaaggacacaatcttctacagtgggggcagagcttcatgtggaattccactcacataatgctctttgtctgtckgcatacccacactcgttctgaccagggaagaaggagggggccatctacttggtgattccaggagctggatgtgcagggcgttgcatctgtctctcctctt

SEQ ID NO: 40239 - DNA, 201 bp, Homo sapiens
atgtttattggattttggttttgctgtttggatgttgggctttcattttcaggatagctctatcacatatttcgtaattttgttttgtagaattatcttawattgaaggaatgttgttttgtgctaatacattttctctttctttagagcatatgtgatgttttcgtccaatggcccctggatctgctatccacaattgtg

SEQ ID NO: 40240 - DNA, 201 bp, Homo sapiens
tatctccataacagactttgcagaaatatcaggtcaggtcctgttactgatgtgttcattctcatgggcaggaagagacacttcagtgttgctgctgccasgattgtttcacttaaaggaactctctagctgtcagagaaagagtgatactctgaaaatagtctctaacatgctgcttcctgctctaggatcatcttatag

SEQ ID NO: 40241 - DNA, 201 bp, Homo sapiens
tcttatattcttcatctatccaatggggataatgataaagatgatgttctcccccgagggttttgatgactgctagttagaccagcactgaccactgttcrgtccaatgaaagtacttgtctcatgccctgctattcattcttcctcaatctcccgtagagaaagagacttcagctttaaactcagagtctttataatagg

SEQ ID NO: 40242 - DNA, 201 bp, Homo sapiens
catcagttcctagaatacctccttatacattggaggtgcttgatacctatttattgaatggatgaatgaatttcatgagcacctgtgttggacaatttaaygtacatgatgatatttaatattttaactctgtggggtatatatattatctttatttatagctaacgaaattgggtctcagagattaagtaatgcttccag

SEQ ID NO: 40243 - DNA, 201 bp, Homo sapiens
tcaacatccgcaaataattaatgcatagaggaagtttacggttggccacccaaatgcatctcaaacattaaatttaaaaaactaaaaggatgaacccagaraactgctataaacttcaaagaatctattaaggacttagacatatggtgttaaaagatatgtccaagatttatggcactgggcctacaaaaaagaattctg

SEQ ID NO: 40244 - DNA, 201 bp, Homo sapiens
agaataatcatggacaatgcccctcaaacctccacatccccaaaatcaggacatatagaaggttggagcaaaaatataaccttggctaaaataattaatartgttcttcttgattcaatttgcaggagacattcagagaaaatatccacactcaaaactgaaatatgagtgccacacagtcattgcagctcacatctggga

SEQ ID NO: 40245 - DNA, 201 bp, Homo sapiens
ctaagatgtgacatctcttctacactgttgccacccagcatccatctgtcatattccaaactgccaatgtgtgtcacccaaaacattagatgacctagttrttctccctgcctagagccttgcctcctctaattcacttcatttaaaaagaaagacatttatcttataaaagaatacaagcatacggaaaagtacctaata

SEQ ID NO: 40246 - DNA, 201 bp, Homo sapiens
tgcatcttacaaccagttggacttttaagatagtctaggccaggtgtcagttgtgatacagcagtcatatctcaagtaatgcccagtttttgagtgcttctttttttttttttttttttttgagatgaagtcttgttctgttgcccaggctggagtgcagtggcatgatctcggctcactgcaacctctgcctcccgggtt

SEQ ID NO: 40247 - DNA, 201 bp, Homo sapiens
tggctaaaataattaatagtgttcttcttgattcaatttgcaggagacattcagagaaaatatccacactcaaaactgaaatatgagtgccacacagtcaytgcagctcacatctgggaattttcaccaagcaactgaaaaaaaggctattttcagttctttcatatgctctttttgtcataagttgggttcggggggtgg

SEQ ID NO: 40248 - DNA, 201 bp, Homo sapiens
ctgaaaaaaaggctattttcagttctttcatatgctctttttgtcataagttgggttcggggggtggggttcagaacccacagttgctgtggtgagagaarcaaatttgacagcttctggcagagcaaagcacaagtatttcctgcagagtttttcaaagtaaatgggtctccctccctgggcagatactggcaatccttg

SEQ ID NO: 40249 - DNA, 201 bp, Homo sapiens
atccccacctcccccactgtacttcttaatgcttctttttattttttttttaaattttgagacagagtttccctcttgtcactcaggctggagtgcaatgrtgcgatctcagctcactgcagcttctgcttcctgggttcaagtgattcccctgcctccacctcctgagtggctgggattacaagtgcataccaccacgcc

SEQ ID NO: 40250 - DNA, 201 bp, Homo sapiens
gggtgatgtgtgtagactttttttcctttcctgtgtcaaaagcatgatgttgagcagtggcttttaacatttttgacaataacccatagtcagaagtaccttttttttttattgtgactctcaacacacacatgtagtggaaaaagtttaataaaaaataccactgcaataagtaacacacacagtttctatgatatttta

SEQ ID NO: 40251 - DNA, 201 bp, Homo sapiens
gactccatatgatgcagagatccaggctgcaggagccttcacatcaaccctactttctcctcatctgctgcaagagcaattttacttctagctctgactcttttttttttttttgctgtatggagctgggcaagtcatagaaccagggctgactttatgtgcatgtgacttaggcagttgtatagggcctggtgctcagaa

SEQ ID NO: 40252 - DNA, 201 bp, Homo sapiens
tggaaacttactgtattctatttttttctggaattttttcccttgcttttaatagaaagggagtctgatttgttccactttttcggtgccagtggttctcrttctcgacggggggcaattttgtcccccattgtttggaaatgactggagacattttgggctgtcacaactaggctgggtggagatgctattgacaactag

SEQ ID NO: 40253 - DNA, 201 bp, Homo sapiens
agatagtagggatgacaagttttttggggcacagtccaagttggtctggtgtctggaatgagactggggcctaataaaaatgagcgtctatacaggagctyaaatgggatgtaccttgtagcattctgaggacaggcctgaattctgagaagggaaagtggtaaaagtattatctagtcctttttaagttggtggctgagc

SEQ ID NO: 40254 - DNA, 201 bp, Homo sapiens
ctctaactaccatcacattggggattatatttcaacataattttagggggatacaaatattcagcctatagcaatgtaaaagagtcaaaatggctattaayttttgagcagttataataacataagtactgtgttatgtgtttaacaagtattgcctcatgtaattctaaaacgatgatgtgtagattagcttctccactt

SEQ ID NO: 40255 - DNA, 201 bp, Homo sapiens
gggatgacaagttttttggggcacagtccaagttggtctggtgtctggaatgagactggggcctaataaaaatgagcgtctatacaggagcttaaatgggmtgtaccttgtagcattctgaggacaggcctgaattctgagaagggaaagtggtaaaagtattatctagtcctttttaagttggtggctgagcttggtgag

SEQ ID NO: 40256 - DNA, 201 bp, Homo sapiens
tgctacacattctagtctctcatggctatgatgcatgccggagtgggcactgattctctacctacttaggtacgattctgttttgccaaggattctcctayacaatgatgtccttcctccctccatgctcagggaactagatagctgtttcctttcttcagagaggaagatagactcactgtatagttactatgaagagat

SEQ ID NO: 40257 - DNA, 201 bp, Homo sapiens
caagttttttggggcacagtccaagttggtctggtgtctggaatgagactggggcctaataaaaatgagcgtctatacaggagcttaaatgggatgtaccytgtagcattctgaggacaggcctgaattctgagaagggaaagtggtaaaagtattatctagtcctttttaagttggtggctgagcttggtgaggtgtgtt

SEQ ID NO: 40258 - DNA, 201 bp, Homo sapiens
atagcaagaccctgtctctgaaaaaaaaaataacaaaaatgagtaaaatggaggttctgagattttaaactcctggagggcttaaaatttatgcctttatytagctctgtatgctccaccaacgtgacataacagttctctgaatatggtaagaacaaagtgagttttattgaaattcttggactatttcttttccctact

SEQ ID NO: 40259 - DNA, 201 bp, Homo sapiens
ttttcatatttgatgaaacagcctaaatgctcactgatttgggagaggtctgataaagaaaaaggagcattaactttgactatgcctttagctttagccacctttttaagaggaaattgctgggcaggtaggggagggctactcacggaattaaactgtaaactggaccgggtgtgaggagaggaggtgataaaaagatta

SEQ ID NO: 40260 - DNA, 201 bp, Homo sapiens
ttggactatttcttttccctactgaagtaaggcaatctccatccaaggttcatcttatattaaaaaaaaatatgctaggaaatctcaacagtgttgtatcmaaggagtcagagcattaaatattttgggctcctgccacaggcatttactgtgaagtaaaggacatgtattgttctgtgcttcatcgtgatagaaagaacg

SEQ ID NO: 40261 - DNA, 201 bp, Homo sapiens
ttctctcttgacctttagcagactccgtgtctctttcctttgatggaacagctaatgaaacacatcctttccttgagtcaatccctgatttcagaaaaatytttagacatcgtgtgtgtgtgtgtgtgtgtgtgtgtgtatgtgtgtgtgtgtgtgtgtgtgtatgttggggggatggagggaagagtgaggaaatagttt

SEQ ID NO: 40262 - DNA, 201 bp, Homo sapiens
tctcttgacctttagcagactccgtgtctctttcctttgatggaacagctaatgaaacacatcctttccttgagtcaatccctgatttcagaaaaattttyagacatcgtgtgtgtgtgtgtgtgtgtgtgtgtgtatgtgtgtgtgtgtgtgtgtgtgtatgttggggggatggagggaagagtgaggaaatagtttcca

SEQ ID NO: 40263 - DNA, 201 bp, Homo sapiens
acctgtaccttcttggccttggtagcccccaatcctaacccagaacgtggcgcagagtaagtgtttaggaaaactttactgaatgaatcagtggataagcmgattcaagttaaaactgaaacaacagtaggtagatgacataccttttttcctcccaccaccttcttgctttgccttgccttcaccccagctcagcaatct

SEQ ID NO: 40264 - DNA, 201 bp, Homo sapiens
ggtagcccccaatcctaacccagaacgtggcgcagagtaagtgtttaggaaaactttactgaatgaatcagtggataagcagattcaagttaaaactgaarcaacagtaggtagatgacataccttttttcctcccaccaccttcttgctttgccttgccttcaccccagctcagcaatctgctcagaaaagagagcatca

SEQ ID NO: 40265 - DNA, 201 bp, Homo sapiens
ttttctgtaaggctgtggccacctacccctgaagatgagatgctgatgtagaaaatggacagccatctcttagaggatctgcaaaataatttctattctgrttagaaaaattaaatacattcactttatctttatgatcttgagatattccttggatagtaacaacagctcctgacatctggagactatttcattttagac

SEQ ID NO: 40266 - DNA, 201 bp, Homo sapiens
gacattctttttgggacaaggtagctgttgctcagagaagcagcaggaattgtccaaggacacacagggtgaatgaaagacttggcagtgggacctgggtycaataatttcaagaccagtgctccttcacctatgcatgttgtctactggagtgaagcaaaaatatgggtctatagggcagtattatgcagaatgagtagt

SEQ ID NO: 40267 - DNA, 201 bp, Homo sapiens
caagcatattccgaattctgcttccgttgccacatcttcgtgtctgcctgactctactgtgtctctctcacaagaacttttgtcccagatagtccaggacwatctccccatctcaagatccttaatttaattacattggcaaagtcccttttgccatgtaaagtaacaaatttgcaagttctggggattagaatttgggct

SEQ ID NO: 40268 - DNA, 201 bp, Homo sapiens
gtatattctataatgtccttatcacaattcctttaagggcctccagcactttggaagcatagaaaaaagaaacaacattcctgcatcgcggggccattgaygaataagaatgtttataagaaggcaagcatctttgcactctatacatttccaaatcttttagaaacatatctaagaacttcttagttcccctccatggtt

SEQ ID NO: 40269 - DNA, 201 bp, Homo sapiens
gtacttagaacagtgcctagtacaaatttaatgctcaataagtatttaataatgataaaaagtgatatttactgaatactttttgtaaagattccttataygtttgaggaaatttcttcatattcctacttttcctaaagttgtctttatagttgagagttaaattgtatcaaatgcttcttcttcacctaataagataaa

SEQ ID NO: 40270 - DNA, 201 bp, Homo sapiens
cactttggaagcatagaaaaaagaaacaacattcctgcatcgcggggccattgatgaataagaatgtttataagaaggcaagcatctttgcactctatacrtttccaaatcttttagaaacatatctaagaacttcttagttcccctccatggttactggatctacaaacttggaatttccccattggccctctgattgta

SEQ ID NO: 40271 - DNA, 201 bp, Homo sapiens
tccacatggtaaggaacagctagcaccaactcacaggtgaatgaaccaccttggaagcagatcctccagccccagtcaagccttcagatgactgctgttgyagctcacattttgactgcaacctcatgagggactttgagccagaatcatccccaattcctaacctacaaaaactgagagataaaaacatttatcactgct

SEQ ID NO: 40272 - DNA, 201 bp, Homo sapiens
agatctactgaggaaaggtaatagaggctggcaaggttcctacttttacatctatctgtaatatccactcattcttagcatcttgcacatccacagggccrtacaggagtcttcttgccttgtattattgaatcttgggataggggtaggaacagacagaggtattagcagagatccaacaggatgtaaaacatacatgtt

SEQ ID NO: 40273 - DNA, 201 bp, Homo sapiens
gtactaattttgacacaaaacttgcaaataacttcttcaagtctgtggtttattgtttacatctttttggagatatatttatcatttacaagatttttagytttaccatagtcaaatttataaaattttgaatgtttttatggtttgagctttgatgtctgactcaataaatccttgcttctgacagtcaagaagttattt

SEQ ID NO: 40274 - DNA, 201 bp, Homo sapiens
ttagagctggaagggagcaaattcttaattgagcaatacacgctgtcctttctttcaggctccttcacatttgatctctgtgcaatttgataagaggaggraatgggccgtcaattatgaagagactgaaaacctgaaaatactgagtatggtcttagttccctctccaaagggagctcaggaaaaatgccaagccataca

SEQ ID NO: 40275 - DNA, 201 bp, Homo sapiens
tgattatttcaagggaaccccagatctggatttttatgtgaaatattctaatttcacatataattagcaactcattaagaaaaaaactaaaaatgtcctgyttagggcaaaggagacatatctgtgggctcatcactgcctgtggacaatctgtttgcaaccttgggaatagatgacctctgacaccagattaatcatctg

SEQ ID NO: 40276 - DNA, 201 bp, Homo sapiens
tgtttacatctttttggagatatatttatcatttacaagatttttagctttaccatagtcaaatttataaaattttgaatgtttttatggtttgagctttsatgtctgactcaataaatccttgcttctgacagtcaagaagttatttttcatttatttatcatttatttcatctatttatcattttataagttttaaagt

SEQ ID NO: 40277 - DNA, 201 bp, Homo sapiens
caggaagcttgaccaaaactccacagtgaattattgccaggatgggtagaattacatatgttttattcaacatttggtggtcattgtaaatttggtaacayttgcaactggaaaatttggggatgttttagagctggaagggagcaaattcttaattgagcaatacacgctgtcctttctttcaggctccttcacatttga

SEQ ID NO: 40278 - DNA, 201 bp, Homo sapiens
tttccccattggccctctgattgtatttggagtctgttcttcatcttgtggatcctctgggctctgtcttgaactgttggaacattttgctcccacagctrttggaagtgacccattaaggtagccagagtcagtcactcagcatcttaatggcaagaccaaaaggggtgaaagaaatagaagtcacggttagtaagcgac

SEQ ID NO: 40279 - DNA, 201 bp, Homo sapiens
tcactgatcatgttgttatattattctgaaacaaaacatgtatataaattcatattaaaatttctttaatgttctgtaaatataagatgctaacaaaaccsaatttcttctggattaaattatcataacaattattagatgtatacaactgatcaatctaccatacacttattaaaattttgctaaatgtgatgtgaaaca

SEQ ID NO: 40280 - DNA, 201 bp, Homo sapiens
caatttacctaaaagagtcccatagaaaccttagcctcttcatccttctgccatgcccctcatggcattttcttcttacgctggagtatacatttctctgyttttcttttatccctttctttcttctttattcccatgtttttgatcacatactgtgtgtcagcctctgttaagctcatctgtgcagagtctatactcact

SEQ ID NO: 40281 - DNA, 201 bp, Homo sapiens
tcagttacatagacttctgagaagatagccttcccattctatctaaaatgccattacatcttctaatatgcaacaaaatgccacctgatccataaatcatycctccatatttagcccagaataccgctttatattttagttttatctctattccttgattaccctactttgccaggatcctaagtaattgctttcttatgt

SEQ ID NO: 40282 - DNA, 201 bp, Homo sapiens
tcttatattgaaggaatgttgttttgtgctaatacattttctctttctttagagcatatgtgatgttttcgtccaatggcccctggatctgctatccacarttgtgttttatgtcaactgtttgagattccttctccatggacataatgaggctgttttgataccattactcaagggagcatatagcttggttcagcttga

SEQ ID NO: 40283 - DNA, 201 bp, Homo sapiens
tacatgctagatgtaggttgtctaacccaggctatagggaggattagctgatttatctctgagttttgaaacatcctcaaagcaaagtagtttgggaaggrtaatctggtagaatatacagcatatgcaaaagcaaagaggcatagaagagacttcaggagcagtgagtagtttgggagagatgggcacatgatccatagg

SEQ ID NO: 40284 - DNA, 201 bp, Homo sapiens
gcatgactaatccaagatcttccagcaactgaggagtgatggaagcatttctgattcctcttgttgttgctctttagcaaatgggtgaaacaggtaaaatragttaccaaagcctctcatctctcacctgggcatgaattctatgcctttccaatatacacatgctgcctcctgcctcaaattccaggtgttcccttttac

SEQ ID NO: 40285 - DNA, 201 bp, Homo sapiens
cttactgtattctatttttttctggaattttttcccttgcttttaatagaaagggagtctgatttgttccactttttcggtgccagtggttctcgttctcracggggggcaattttgtcccccattgtttggaaatgactggagacattttgggctgtcacaactaggctgggtggagatgctattgacaactagtgaatg

SEQ ID NO: 40286 - DNA, 201 bp, Homo sapiens
agcagtggaattgttggattatgtggtagttctatttttaagtttttgaggaacctctaaactgtttttttttaccctaatttacatttccaccatcggcktttgagcattcctatttctctacatccttgccagcatctgttattttctgtctttttgatagtagccattttaactgaggtaagatgatctcattgtggt

SEQ ID NO: 40287 - DNA, 201 bp, Homo sapiens
agatttaaaataaattatttttagtaataataaatgacaaattgggagatttaagacaaagattcctggtagttgaatgcgctgaaatctatgatgtttgrggattgttaacaatcttcttccaggatttgatcggttttgtacttgtattttctcaatctactattctttatttgctctccttcctttagaatggacaaa

SEQ ID NO: 40288 - DNA, 201 bp, Homo sapiens
ggctctcacctgaaccatcaaagctagctgctcaacttttaattcatttctaaaactacataaggagttggaaacttactgtattctatttttttctggawttttttcccttgcttttaatagaaagggagtctgatttgttccactttttcggtgccagtggttctcgttctcgacggggggcaattttgtcccccattg

SEQ ID NO: 40289 - DNA, 201 bp, Homo sapiens
tctttattggaaggctctcacctgaaccatcaaagctagctgctcaacttttaattcatttctaaaactacataaggagttggaaacttactgtattctakttttttctggaattttttcccttgcttttaatagaaagggagtctgatttgttccactttttcggtgccagtggttctcgttctcgacggggggcaattt

SEQ ID NO: 40290 - DNA, 201 bp, Homo sapiens
gggagttcttaccttccagaaaagcagaaaaggggtcaaggcacagaaataaggggttggggcacggagataagaggtcggggtgtggaaataagggatgrgggcacagagataagaggtcggggtacttgcccctcctttagaaaagcgggacttgccgctaagggtgaaagagaaggggttgaggggttcttgcctctc

SEQ ID NO: 40291 - DNA, 201 bp, Homo sapiens
cagaaaaggggtcaaggcacagaaataaggggttggggcacggagataagaggtcggggtgtggaaataagggatgggggcacagagataagaggtcgggstacttgcccctcctttagaaaagcgggacttgccgctaagggtgaaagagaaggggttgaggggttcttgcctctccttcagaaaagcagagaaggggta

SEQ ID NO: 40292 - DNA, 201 bp, Homo sapiens
cccctcctttagaaaagcgggacttgccgctaagggtgaaagagaaggggttgaggggttcttgcctctccttcagaaaagcagagaaggggtagagacayggagagaaggggttggggtacttgcccctccccaagaaaagcaggacttgctgctaagggtgaaggaccaaggcaggcatccttgcatggtatgacacct

SEQ ID NO: 40293 - DNA, 201 bp, Homo sapiens
atagcatgaaagttggtttaatttataatgatttaaaaaattctctactatagccctaattgtggtcccactttgttactatagtttaatttgtgatctctttttttttttgtttttgtttaataatctcttttgcttctttgttttcttgtacattaatatcagttgtttacctgtttctgtcagaggcatttgaaccag

SEQ ID NO: 40294 - DNA, 201 bp, Homo sapiens
cagtaaagaagccggccaaaattaccaaaaccaagatggtgagagtgacctctggttgttgttatggctcattgtaagctaattgtaatgcactagcatgstagaaggcactctcaggagcagcatgacagttttcaaatgccatggcaatgtcaggaagctaccctataaggtctgaaaagggaaggagccctcagctcc

SEQ ID NO: 40295 - DNA, 201 bp, Homo sapiens
tattgcaacccaaacatttctttctattaatcccaggtcttaagacaaactcaaccaattgtcaactgtcagccagaaaatgtttaaatttacctatagcytggaacctacccccctccccaacagccccctgctttgagttaaccaaaccaaatatttcttaaatgtgcttgattgatgtctcatgactccctaaaatgt

SEQ ID NO: 40296 - DNA, 201 bp, Homo sapiens
ccaccttcttgctttgccttgccttcaccccagctcagcaatctgctcagaaaagagagcatcagaactgaccaaaaaaggaatgaatatcctaagaaatkatgcagctacatattgcttggcttgtgtttcctagataaggcattgattcctaggcactagaattatatactataattaaagagatttttttttaaatct

SEQ ID NO: 40297 - DNA, 201 bp, Homo sapiens
agacaaactcaaccaattgtcaactgtcagccagaaaatgtttaaatttacctatagcctggaacctacccccctccccaacagccccctgctttgagttraccaaaccaaatatttcttaaatgtgcttgattgatgtctcatgactccctaaaatgtataaaaccaagctgcaccccaaccaccttgggcacatgttgt

SEQ ID NO: 40298 - DNA, 201 bp, Homo sapiens
gccttcaccccagctcagcaatctgctcagaaaagagagcatcagaactgaccaaaaaaggaatgaatatcctaagaaatgatgcagctacatattgcttkgcttgtgtttcctagataaggcattgattcctaggcactagaattatatactataattaaagagatttttttttaaatctatcaacaaagacctagagtt

SEQ ID NO: 40299 - DNA, 201 bp, Homo sapiens
aatgtgcttgattgatgtctcatgactccctaaaatgtataaaaccaagctgcaccccaaccaccttgggcacatgttgtcaggacttcctgaggctgtgtcacaggtgtgcattgcatccttaaccttggcaaaataaactttctaaataaactgggacctgtcttacatgttctgggtctagagatttttatttttggt

SEQ ID NO: 40300 - DNA, 201 bp, Homo sapiens
tttctggaagtaagcacactatgtggcctgcttacaaatgaagaaacagaatataaacagccctctcatgcttcttccagtgataactccaccatcacctrgggtaacctctaccttgagttatagcaacacatatgcactcttcctgttattgaactagatgctcttttgtgtctgtcttctttggctcatcattatgtt

SEQ ID NO: 40301 - DNA, 201 bp, Homo sapiens
tgaatatgtgtatgcgtttttggggggttgtatacatctataagtggaattgctgggtcatgggatatgcatatgtatgtttaattttagtagatatgtgyaaaaagtattccaaagtggttaaattgatacaatttattgaaagttctggttgttctgtgtctttgtcaacactttgtattttctgtcttcagttttatt

SEQ ID NO: 40302 - DNA, 201 bp, Homo sapiens
gatgacattttaattcccttgtttaaatatgactctaatttcaaagtaggaagttggttctgactttgtgggtgagaagaggatatggtgtctaaacatgkgccccttaaaaccaccataatagccaattacttattctttatggccatatgtcaggtatattttaaagttggaaggagctttggagtggtctagctgact

SEQ ID NO: 40303 - DNA, 201 bp, Homo sapiens
acctttagcagactccgtgtctctttcctttgatggaacagctaatgaaacacatcctttccttgagtcaatccctgatttcagaaaaatttttagacatygtgtgtgtgtgtgtgtgtgtgtgtgtgtatgtgtgtgtgtgtgtgtgtgtgtatgttggggggatggagggaagagtgaggaaatagtttccattcagta

SEQ ID NO: 40304 - DNA, 201 bp, Homo sapiens
tgcctcccgggttcaagccgttcttttgcctcagcttcccaagtagctgggacttcaggcacctgccaccacgactggctaatttttttttttttttttgkatttttagtggagacgggggtttcaccatgttggccaggctggtatcgaacacttgaccttgtgatctgccagcctcaacctcccaaagtgctgggatta

SEQ ID NO: 40305 - DNA, 201 bp, Homo sapiens
agctatatgcttctaggcaagactttcacacctctgggcctcagagtccttacctatgacagggagatcagacgcctaccttcagtgttcttttgaggggycaatgagttaaagcgcttagcaccatgcctaggacacagaaagcactaagtagatggtacttattatcacttctaggttttcctctttattggaaggctc

SEQ ID NO: 40306 - DNA, 201 bp, Homo sapiens
acttatctattatatttgttaataaagtcttaggttagtggatatttctatactctttctgaaaatgacatgcatcttacaaccagttggacttttaagayagtctaggccaggtgtcagttgtgatacagcagtcatatctcaagtaatgcccagtttttgagtgcttctttttttttttttttttttttgagatgaagt

SEQ ID NO: 40307 - DNA, 201 bp, Homo sapiens
tgcacttcactccaagtcctcataagggagcctcatgagatatgagccaccacattcagagacagtttcactaatttattagaagcatgcttattaaaacscattctttctattcagcctgttatttactttatactcctttaacatctaccacccatataggggttaattatatactatctcatgttgatttataaatgt

SEQ ID NO: 40308 - DNA, 201 bp, Homo sapiens
ttattgactatagttatcctattgtgttattaaaaaatgtcttatacattcttctattttatttttgcacacattaaccatccccacctcccccactgtayttcttaatgcttctttttattttttttttaaattttgagacagagtttccctcttgtcactcaggctggagtgcaatggtgcgatctcagctcactgcag

SEQ ID NO: 40309 - DNA, 201 bp, Homo sapiens
cactttccttttgagcttaccttctagggcaatgtttctcaaccagggatggtttactctctagaggatatttgctaatgtctgcaggcattttggctgtyggagtttggaggtttgctatgggcatcaagtgggcagaggccagagattctactaaaagtctgcaatgcagaggatggtctcccacaacaaataattctt

SEQ ID NO: 40310 - DNA, 201 bp, Homo sapiens
agcagttgcttgtcttgcccactctgagctaaaatccaggtctgctcatttgtgaaactatgttccacatggaggaagaagcttgcctagattggtgtagraccagccaaaatcaaaggaatttattgcttaaaaaaaatcctttacacggattgggcttcttcacttagaaaggacataaaaaggggaccgagaggagta

SEQ ID NO: 40311 - DNA, 201 bp, Homo sapiens
attggcattatctcagtcctcacgccaggccattcccctaatacaagtgagaaagctgaggtgaggagggatcaagagacttgctgaaagtcacacagctkgtatgtggtctcacagaaggtccgcatatgaaaattactgagctactgggctcttcaggtttccattacagaaccatctataaagagtattattttatca

SEQ ID NO: 40312 - DNA, 201 bp, Homo sapiens
ccaatgcaatcatactgggaggtggggctgatggcaggtgtttaggtcgtgaaggcaccactctcatgaatggattaatgctgattgctaaagagcttgargctacaagttcgatctcttgttctgtcttgcccttccacctttatcgtggaataatacagcaagaaggctcttgctaggtgctgacttttcaatcttgga

SEQ ID NO: 40313 - DNA, 201 bp, Homo sapiens
ccctgtgtgctctaatattcttcataaatttcccctccatcctgctatacacatgcagtacacatgcacgcacgcacacacacacacacacacacacacasagagagagagctcattgaaatgagtattttactgaagggatgtttagtattgctctgagagagaaatagtttgaacttcctttgaaaagtagaactacat

SEQ ID NO: 40314 - DNA, 201 bp, Homo sapiens
ttcccattttgcagatggggggtgtgagacatggagaggttagggaaatgtccagggtgcatgggtaataaatagtagcaagaggattcaaacccaccaaraggactccagctcccagttgtctattattatgggtgctttcttatgtatttaatgtaacaattgcccaaaggcaaagatggcattctttgattcatgaac

SEQ ID NO: 40315 - DNA, 201 bp, Homo sapiens
ttgttttccttctctcttaggtttcttaagatttcttttgtggaccacaaagaataacagtggctaacactgattgagtattttctgtgatctaggcactyttgaagcagtttggatgtattaaattatttaatctttacaatgagcctttgggttagtcctatcattgttcccattttgcagatggggggtgtgagacat

SEQ ID NO: 40316 - DNA, 201 bp, Homo sapiens
agcttggttttatacattttagggtgacaggagacatcaattaatacatgtgaggtgtacgctggtttggtccagaaaggcccagacaaccggaagtggargcttccaagtcctaggcagattcaaagatattctgattggcaattgactgaaagggttattatcaataggaaggaaagtctgtgttgtggtaataagggg

SEQ ID NO: 40317 - DNA, 201 bp, Homo sapiens
gactccataattaccagaaatcttttccaaagccgggatggatctctgatcccacacagtgggccagtcatttaattaaatgcattttgttagagtcaagktttcccaacttgcttgcagatcattgttgagtggtcttttccaactcttcttgcttttccttcgacaacaaaggacaaaatcaagttcaaagaccatatg

SEQ ID NO: 40318 - DNA, 201 bp, Homo sapiens
gcatagctatattgtgtttatgaaagcacggaacccagcttctatctgaagcacttctgggctttgcaggggctggcagcagggagaggggagttgaagcyacctggtgctgtcttgttaaaatattcaaaaggctgcctcttcggaggttgaagggaaagaggaaaagtttaaaaaactagcattgcccaagctaaatta

SEQ ID NO: 40319 - DNA, 201 bp, Homo sapiens
agagaatatagcaaccacacattggctcttagaagcatcttcctagaagtgacacacatcacttctgcttatgcttccttggccaaaacaagtcttgtgamtctaccagaattgaacaggatgaaggtatataatcctccatgtgaggggcacaggatagaggcacaggataggtgagcagtaatatcatctcctacaaac

SEQ ID NO: 40320 - DNA, 201 bp, Homo sapiens
tggatatgtgggtttcccccactaaacggaacttggtcttatggcaattataaagccacattgaccatacttgaaagagagaggctgggggtggccctaaygagttaatggcaatgttcaagttcacttaacttttgtaatcatccagtttgcaaatgcatagcatctactaggagaatgtataatattcattaggagtta

SEQ ID NO: 40321 - DNA, 201 bp, Homo sapiens
acaggatttaggaactaatagtggctcagggtgtggggaaggaaggcttgctagagaggattacacttgaacagaatcttgaatatgatttagagcttggraggaaaagggaagaaaggaggcagtgggagagaggcagagatgtctatccataccagagtgtgaagaggagaaacagcatgctgcatttggggaaagtcc

SEQ ID NO: 40322 - DNA, 201 bp, Homo sapiens
tgctagagaggattacacttgaacagaatcttgaatatgatttagagcttgggaggaaaagggaagaaaggaggcagtgggagagaggcagagatgtctayccataccagagtgtgaagaggagaaacagcatgctgcatttggggaaagtccatggagtgagggtcaggaatggagggagggtttggatgagacagatga

SEQ ID NO: 40323 - DNA, 201 bp, Homo sapiens
ttccaaagtggttaaattgatacaatttattgaaagttctggttgttctgtgtctttgtcaacactttgtattttctgtcttcagttttattctgtacttyagtaggtatgcagtgatattgcattggtatttgatattggaagttacctaatgactgatgaggttgagcattctttcctgtgctattgatcatttgtgac

SEQ ID NO: 40324 - DNA, 201 bp, Homo sapiens
ctgttgtttgggcctggtagttccagcttaggaatagaggcaatcgaaacaaaaaaattctgttgtagacctggcctcagcaggaaaccgtgcctgtgctytccttatctccagacttggcctgccagcacatacatatatcaccctctcacttaagatggagctaacagcaggcaaagttcatctcttagaggcccttac

SEQ ID NO: 40325 - DNA, 201 bp, Homo sapiens
ctgtgtctttgtcaacactttgtattttctgtcttcagttttattctgtacttcagtaggtatgcagtgatattgcattggtatttgatattggaagttayctaatgactgatgaggttgagcattctttcctgtgctattgatcatttgtgactcagtgttttgaagaaatttttagtcttttcttcatttttctattgt

SEQ ID NO: 40326 - DNA, 201 bp, Homo sapiens
ttggttcattttctcttctcagtatataatactggatgcactttgtcttggggattcagagccctgctttctttaagggagaaagggaagttgaaaggtcrattaaagttttttggagaatctgtatcctgtgctgcattaggcatttttctcatgtcctctaacctcggattatcattctaaagtctttatctcatcatg

SEQ ID NO: 40327 - DNA, 201 bp, Homo sapiens
acttgtggggaaagaaaggcagatttattaaagaaaatacaaagatatattgcaaggtgcaatgggcagcacagcagagaaggggctgtctgcaaagatgyaggcactgcagggaagttttatagggccatagtggagggggctatgtgtggaacgagataattgggaagaggatgttgtgccaaggagttgtctgtgatt

SEQ ID NO: 40328 - DNA, 201 bp, Homo sapiens
taaaagtaatgacaaaaactgcaattacatttgcaccaacctaatacctccatgagatcaattttttttagcttccatatgtgagtgagaacatgccatakttgtctttctgtgcctggcttacttattttacttaacataatatcctccagttccatccatgttgctgcaaatggcaggattttattctttttatggctg

SEQ ID NO: 40329 - DNA, 201 bp, Homo sapiens
caagtgtccagttgcataagttgttatacaaagacggtgctttagcttttaactggaggaagagggggacatactgacatgtgggacagagggtagagaargaagaggtaaaattgagagggaataacgtgattaatttccactcagcctggcccgatgagagactgtgagggtgctatctaaagcttaaggaatcatgtt

SEQ ID NO: 40330 - DNA, 201 bp, Homo sapiens
ctggctattaatccatcagagagatagtttgcaaatattttctcccattccataggttgtctctttactttgttgattgttttctttgctgtgcagaagctttcacttgctacaatcgcatttgttaattttttcttttcaaacccacagctaatacaatactaaattaaaaagaaaaattgaaggcttttctcataagat

SEQ ID NO: 40331 - DNA, 201 bp, Homo sapiens
ttgagagggaataacgtgattaatttccactcagcctggcccgatgagagactgtgagggtgctatctaaagcttaaggaatcatgtttatgaaaaaactrtaagattttgggaagcagcagcgctctttggagattggcaacaaatatgacaatttactcaaaagatttttatttctggtggttctagactgagtgacag

SEQ ID NO: 40332 - DNA, 201 bp, Homo sapiens
catttacaaaataaattgaagaggacacaaagaaaatggaaaagtatttcatgtttatgaataagaagaattaatattgttaaaatgttcacacttttaartgataaacagattcaatgcagcctctatcaaaatatcaatgacagaaatagaaaaaacaatcttaaatctcatttggagccagaagaccctggatagtca

SEQ ID NO: 40333 - DNA, 201 bp, Homo sapiens
ccctttccagtaacatttcccattcttttaatttttattgttttattacctttactttcttgagttgaatgctgaacttattttcaatcttgctttttttwaaaaaaaaaactaataaatgttttttaaggaatacattttctcctgttgacaaaaagcatcaaactccgtaaaatatttgaagagatttattctgaacca

SEQ ID NO: 40334 - DNA, 201 bp, Homo sapiens
atgaaactagaattattgaaactctctcaccatataaaaatcaactcaaaaagaatgaaagacttaaatgtaagacctgaaactataaaatgactagaagraaacactggagaaatactcgggacatttgtctgggcatagaattttttgagtaagacctcaaaagcacaggcaattattttactcattttggttcacaat

SEQ ID NO: 40335 - DNA, 201 bp, Homo sapiens
ttcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattggattttggttttgctgtttg

SEQ ID NO: 40336 - DNA, 201 bp, Homo sapiens
tcacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattggattttggttttgctgtttgg

SEQ ID NO: 40337 - DNA, 201 bp, Homo sapiens
tctgatatctaattttgtgtaggatttttgtttgtattgatgtcaatattgattgtttctatggtttccataaagtattttatttatgctacattttcaartttgcatatttggaaaagctatgaaatctacaaattgaaaaatctacaaaaaatagcatgaaagttggtttaatttataatgatttaaaaaattctctac

SEQ ID NO: 40338 - DNA, 201 bp, Homo sapiens
tttgaaattattattttgctttccatttataagtgagattgggcttttttttatttttgtactgcctttttacattttgaacaagaaaaggattgtttgtyctttggtgattagtaaaatgtgactgtatgaatttatctgggtattgtttctttttggtatgaaaactgcttatcaattaaaattatctgatatctaatt

SEQ ID NO: 40339 - DNA, 201 bp, Homo sapiens
gtgagggaggctgtctactccagtgttggagtcagctggaggtgcagcagcgcttgagctatccaaactgctaggatgttgttaataaaagaaccttctcrttctcgagtcaacatggctaaaacagccagccatgagatgtatgggaaagaagtgcagagcaagttgttatttattgaatgtgtagttaggaattactat

SEQ ID NO: 40340 - DNA, 201 bp, Homo sapiens
catggtacagatgagaatgggctcagagaagggaagggccttgctcagactcacacaaaggctagggccagaatagatggtgcctgactctcagttcaggrtgcttattctgacaaggcccgtcacttcacatggatatttaatgtattttgctagttggttaaaaataatgtaatgtatggcagaaccatctctctttct

SEQ ID NO: 40341 - DNA, 201 bp, Homo sapiens
gtggacaataatcccagtttatagcttctagtgcaatgacttttgccagcacccagcatatcagaagataaacccactgactttctttagtgaagattgcraattgtttaaatcagagcatgtgtgcaaagtccagggtactatctaattcaacacttctgtaatttgaaagctaataattataagaattattgtccttgt

SEQ ID NO: 40342 - DNA, 201 bp, Homo sapiens
tgttaagtgttttatatgttagcttaactgattctcactgcaatctatgaagcaggtactgttataatttctattttttagatgaacaactgagacacagygaagctatgtaacctttctaagattacccaactagtaagtggtggagtcaacatctgagctttggttatctgagcccataaattgcccgttagccctgcg

SEQ ID NO: 40343 - DNA, 201 bp, Homo sapiens
cacaatttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattggattttggttttgctgtttgga

SEQ ID NO: 40344 - DNA, 201 bp, Homo sapiens
atttcctgttttttatgatctctgaaaattgcagccctacctactaaaaatcttttattagattagaaatttgtttttgtttgtagttgatttattgttgattattagttgattatagttgattattgtttttatcttgatttttatgattgtgatctattttttatgtttattggattttggttttgctgtttggatgtt

SEQ ID NO: 40345 - DNA, 201 bp, Homo sapiens
ttgtttgtagttgatttattgttgattattagttgattatagttgattattgtttttatcttgatttttatgattgtgatctattttttatgtttattggrttttggttttgctgtttggatgttgggctttcattttcaggatagctctatcacatatttcgtaattttgttttgtagaattatcttatattgaaggaat

SEQ ID NO: 40346 - DNA, 201 bp, Homo sapiens
aaaaaagcagatcaggcattgtcagcacatctgattatttcaagggaaccccagatctggatttttatgtgaaatattctaatttcacatataattagcamctcattaagaaaaaaactaaaaatgtcctgcttagggcaaaggagacatatctgtgggctcatcactgcctgtggacaatctgtttgcaaccttgggaat

SEQ ID NO: 40347 - DNA, 201 bp, Homo sapiens
cagtgttctcttggtgggtttataattttagattaaatcagtatttctcaaacttcaatgattggtgtattacagtgtggtagccagtctctgagatgatycttattccttgtttttgcttccttgtgaagttccctcccatatggaataggagtgatttatgcaactaattagagattgcagaagtgagtgtgtgacttc

SEQ ID NO: 40348 - DNA, 201 bp, Homo sapiens
agtgtctgtggctttgcgaagattcctcctaaaattctgctcatggaaggatttcaaagaaagactgagtgaacttgttcctgagaatgcttgaagggacrgggaaacattaaaaaataaagactgggttattggaaattgatggtggtgttggtgggggttgttaagaactaccgttatttacacactgatgaacttgtg

SEQ ID NO: 40349 - DNA, 201 bp, Homo sapiens
ccttgatctctcagatcacttgctctggaagtacactagctgctatgtcatgaggacacttaagcaacactgtggagaggtccacatggtaaggaacagcyagcaccaactcacaggtgaatgaaccaccttggaagcagatcctccagccccagtcaagccttcagatgactgctgttgtagctcacattttgactgcaa

SEQ ID NO: 40350 - DNA, 201 bp, Homo sapiens
tcctcccactacacagtgcagcctgctgagtttttgctgtattcaggtagagaaacaagtgccaatattatctaatcttgccctaaacattaggactggtktgtgtgtgtgtgtgtgtgtgtgtatgtgtgtgtgtgtttagtatgccaagcacagataataacccctcactcctaaagatgctgaaaaatcaacctgctg

SEQ ID NO: 40351 - DNA, 201 bp, Homo sapiens; identical to SEQ ID NO: 30339

SEQ ID NO: 40352 - DNA, 201 bp, Homo sapiens
atcttttatatctctgaaatttgaagcttttatgctcagcagagcatccagaatctcttacaattttatcattaagacctcatcatttatttcccagaatygctctaaggcagaatctgagattttcccaacataggtgtgtttgttagctgtgtctgtatctggaaccatggagccccagcactaccaatctgtgttgct

SEQ ID NO: 40353 - DNA, 201 bp, Homo sapiens
ctgggcatcaaggcaagaccccatctctacaaaaaaaaaaaaaagccaggcatggtagtgcacacctgcagtcctagctactcagaaggctgaggtaggargatcacttgaacccagcagtttgagattgcagtaagccatgatcacattactgcactccagcctggctgacagaacaaaacaccacctctaaaaataaaa

SEQ ID NO: 40354 - DNA, 201 bp, Homo sapiens
  misc_feature (1)...(201): n = A,T,C or G, or insertion/deletion polymorphism (see Tables 1-2)
atcctcttactacacacagaatattataacaccatctcattgtccacatgagctcagaaattggtcatcaaagcagaaaagtctttaaaacattgatctcnggccgggcgtggtggctcacacctgtaatcccagcactttgggaggctgaggcgggcggatcacaaggtcaagagatcgagaccatcctggccaacatgg

SEQ ID NO: 40355 - DNA, 201 bp, Homo sapiens
ttcatttcctgttcctctgtttcgatttttaattggagctatcccacttatctcatcccaccaccccgtcgcttttaagaagagcttttcctggcattgasttcttttccagcctctttcaccatggcttactatagccctttaaccctggcactcctccctcccggcacccctgcccctgctgcccttgctgtttcccta

SEQ ID NO: 40356 - DNA, 201 bp, Homo sapiens
gctatcccacttatctcatcccaccaccccgtcgcttttaagaagagcttttcctggcattgacttcttttccagcctctttcaccatggcttactatagccctttaaccctggcactcctccctcccggcacccctgcccctgctgcccttgctgtttccctagtcccctgaccttcatacttgaattctggtcttaggg

SEQ ID NO: 40357 - DNA, 201 bp, Homo sapiens
  misc_feature (1)...(201): n = A,T,C or G, or insertion/deletion polymorphism (see Tables 1-2)
ttttaattggagctatcccacttatctcatcccaccaccccgtcgcttttaagaagagcttttcctggcattgacttcttttccagcctctttcaccatgncttactatagccctttaaccctggcactcctccctcccggcacccctgcccctgctgcccttgctgtttccctagtcccctgaccttcatacttgaattc

SEQ ID NO: 40358 - DNA, 201 bp, Homo sapiens
atgcacattctatacaaatagttgttacactgtattgtttagaggataatgccaagaaaaaatgtcagtacttatttagtacccatgctgccatccctttyttccccctgaatattttccacccatagttggttgaatacacagatgtggagctcaccaatatggagggtcaactgtagttttttcactttatcctcacaa

SEQ ID NO: 40359 - DNA, 201 bp, Homo sapiens
attatttcaaactaccaattattccccatataatggaagatccaggttttgctggcaattaaatcatctagaagagcagaaggagttttgatttggaagtygggacactaggttctggcccctgctctgctactagctttgtaaccttagcaacatatcacaacctatgaggaagttttaagtttccttctagctctaaca

SEQ ID NO: 40360 - DNA, 201 bp, Homo sapiens
agcacagataataacccctcactcctaaagatgctgaaaaatcaacctgctgagaaattaacaccatatttccttctttgatggaggcccacaattagacytcaagctgctttcccttctccattttaggtatgttcctcatctctcaacatgtgtgtttaggatagatcagtgctgtgactctacagtgttaaggaaaac

SEQ ID NO: 40361 - DNA, 201 bp, Homo sapiens
tggggaagaataagaacatgatttttaagaaaatccctaggtacagttgataaatactgaattttgtcagctatcggattattccattatttcaaactacyaattattccccatataatggaagatccaggttttgctggcaattaaatcatctagaagagcagaaggagttttgatttggaagtcgggacactaggttct

SEQ ID NO: 40362 - DNA, 201 bp, Homo sapiens; identical to SEQ ID NO: 30346

SEQ ID NO: 40363 - DNA, 201 bp, Homo sapiens
tgaagtggctcatgcctgtaatcccagtgctgtgggaagatcttttgaagctaggaggtttaaaatcagcctgggcatcaaggcaagaccccatctctacaaaaaaaaaaaaaagccaggcatggtagtgcacacctgcagtcctagctactcagaaggctgaggtaggaggatcacttgaacccagcagtttgagattgc

SEQ ID NO: 40364 - DNA, 201 bp, Homo sapiens
aaggctgaggtaggaggatcacttgaacccagcagtttgagattgcagtaagccatgatcacattactgcactccagcctggctgacagaacaaaacaccwcctctaaaaataaaaatataaaataaataaaaaaatttaaaaacctaaacatagctgcactttactcaatatatttacagttctacatatgtaaaaactt

SEQ ID NO: 40365 - DNA, 201 bp, Homo sapiens; identical to SEQ ID NO: 30365
  misc_feature (1)...(201): n = A,T,C or G, or insertion/deletion polymorphism (see Tables 1-2)

SEQ ID NO: 40366 - DNA, 201 bp, Homo sapiens; identical to SEQ ID NO: 30366

SEQ ID NO: 40367 - DNA, 201 bp, Homo sapiens
aagagcagaaggagttttgatttggaagtcgggacactaggttctggcccctgctctgctactagctttgtaaccttagcaacatatcacaacctatgagraagttttaagtttccttctagctctaacattccataattcaattatatcggcagttgtagctttttattttttacatgctacatatcttttatatctctg

SEQ ID NO: 40368 - DNA, 201 bp, Homo sapiens; identical to SEQ ID NO: 30367

SEQ ID NO: 40369 - DNA, 201 bp, Homo sapiens
tttggttttgcctctagcacatcaggtattctttaagaaggctatgcctctgaggttgcatgatcattaactaattcataatttcccttgcatatatttgrgtattttggtgtttcagcctttcccacactttttttatttgcatgtcttcacgatcaccattatatctttgttccacctgtactattatttactcactct

SEQ ID NO: 40370 - DNA, 201 bp, Homo sapiens
tatcccacttatctcatcccaccaccccgtcgcttttaagaagagcttttcctggcattgacttcttttccagcctctttcaccatggcttactatagccytttaaccctggcactcctccctcccggcacccctgcccctgctgcccttgctgtttccctagtcccctgaccttcatacttgaattctggtcttaggggc

SEQ ID NO: 40371 - DNA, 201 bp, Homo sapiens
tggctcacacctgtaatcccagcactttgggaggccaaggcgggtggatcatgaggtcaggagtttgagaccagcctggccaacgtaatgaaaccccgtcyctactaaaaatacaaaaaattagctgggcgtggtggcgggcacctgtaatcccagctacttgggaggctgaggcaggagaatcacttgaacccggggggg

SEQ ID NO: 40372 - DNA, 201 bp, Homo sapiens
  misc_feature (1)...(201): n = A,T,C or G, or insertion/deletion polymorphism (see Tables 1-2)
tgagattttcccaacataggtgtgtttgttagctgtgtctgtatctggaaccatggagccccagcactaccaatctgtgttgctttcttttaaaaacttanactcaattcctacaaacacatccagaccccactaggctttctatcttgattctccttgttgctgcattttatttcattttctcactctgttgccttaaat

SEQ ID NO: 40373 - DNA, 201 bp, Homo sapiens; identical to SEQ ID NO: 13212

SEQ ID NO: 40374 - DNA, 201 bp, Homo sapiens; identical to SEQ ID NO: 13215

SEQ ID NO: 40375 - DNA, 201 bp, Homo sapiens
gtcgtttaaagagctgaaatgcgttgcgagaatgagtttggatgacagaaataaccgtgacagcctgcataagaatgaattgtgtttgccatgaccggccmcactgtgacaaaatttcaaagcataaagtaggcatagagaggtaagcgctaataaagtgattggctccacaaaaagcattttgctgggcgcagtggctca

SEQ ID NO: 40376 - DNA, 201 bp, Homo sapiens; identical to SEQ ID NO: 13217

SEQ ID NO: 40377 - DNA, 201 bp, Homo sapiens; identical to SEQ ID NO: 13222

SEQ ID NO: 40378 - DNA, 201 bp, Homo sapiens
aaaaaaacccaaaggcccttttcagggccgctcacaaagtcgtttaaagagctgaaatgcgttgcgagaatgagtttggatgacagaaataaccgtgacakcctgcataagaatgaattgtgtttgccatgaccggccacactgtgacaaaatttcaaagcataaagtaggcatagagaggtaagcgctaataaagtgatt

SEQ ID NO: 40379 - DNA, 201 bp, Homo sapiens
acaaaaaaacccaaaggcccttttcagggccgctcacaaagtcgtttaaagagctgaaatgcgttgcgagaatgagtttggatgacagaaataaccgtgayagcctgcataagaatgaattgtgtttgccatgaccggccacactgtgacaaaatttcaaagcataaagtaggcatagagaggtaagcgctaataaagtga

SEQ ID NO: 40380 - DNA, 201 bp, Homo sapiens
gccaccgccaaccccagggagggggaggacagggagagagggggcggggtagggagcggcacgcggcgtggggcaggggagggccacgacaggctcgccckgggcgtgggggggtggtggcacctcgtccagtggcggcacgcacccagcccttacagccaatacttatcccaaagttacggatccagcttgctgacttcc

SEQ ID NO: 40381 - DNA, 201 bp, Homo sapiens
aaggcaagactgggacatctagtccataggaagacctgcaccactgtcaccttcacacaggttaactcggaagacaaaggtgctttggctaagctggtggragttctcaggaccaattacaatgacagatacgatgagatccgccatcactggggagacagtgtcctgggtctcaagtatgtggtttgcattgccaagctc

SEQ ID NO: 40382 - DNA, 201 bp, Homo sapiens
aagcagaggctgttggcccgggccaagaagaaagctgctggcaaaggggacattccccactaagagtccacctgtccttcgagcaggagttaacaccatcrccaccttggtggagaacaagaaagctcagctggtggtgattgcacatgatgtagatcccatcaagctggttgtcttcttgcctgtcctgtgtcataaaat

SEQ ID NO: 40383 - DNA, 201 bp, Homo sapiens
tcacccaggcaccagacagccaaacagctactctgctgcttaagctggcccacaatacagaccagagacaaaccaagagaagaagcagaggctgttggccygggccaagaagaaagctgctggcaaaggggacattccccactaagagtccacctgtccttcgagcaggagttaacaccatcaccaccttggtggagaaca

SEQ ID NO: 40384 - DNA, 201 bp, Homo sapiens
caaaggggacattccccactaagagtccacctgtccttcgagcaggagttaacaccatcaccaccttggtggagaacaagaaagctcagctggtggtgatwgcacatgatgtagatcccatcaagctggttgtcttcttgcctgtcctgtgtcataaaatggggtcccttactgcattatcaaagggaaggcaagactggg

SEQ ID NO: 40385 - DNA, 201 bp, Homo sapiens
tgctgtcgtgaagaagcaggaggccaagaaagtggtaaatcccttgtttgagaaaaggcctaagaattttggcactggacaggatatccagcccaaaagasacctcacccactttgtgaaatggccctgctatatcaggttgcagcagcagagaaccatcctctataagtggctgaaagtgcctcctgagattaaccagtt

SEQ ID NO: 40386 - DNA, 201 bp, Homo sapiens
gaaggccaaggagaagaaggtggctccagcccctgctgtcgtgaagaagcaggaggccaagaaagtggtaaatcccttgtttgagaaaaggcctaagaatyttggcactggacaggatatccagcccaaaagagacctcacccactttgtgaaatggccctgctatatcaggttgcagcagcagagaaccatcctctataa

SEQ ID NO: 40387 - DNA, 201 bp, Homo sapiens
gtcaccttcacacaggttaactcggaagacaaaggtgctttggctaagctggtggaagttctcaggaccaattacaatgacagatacgatgagatccgccrtcactggggagacagtgtcctgggtctcaagtatgtggtttgcattgccaagctcaaaaaggcaaagggtaaagaacatgccactaaattgggtgaaatg

SEQ ID NO: 40388 - DNA, 201 bp, Homo sapiens
agacctgcaccactgtcaccttcacacaggttaactcggaagacaaaggtgctttggctaagctggtggaagttctcaggaccaattacaatgacagataygatgagatccgccatcactggggagacagtgtcctgggtctcaagtatgtggtttgcattgccaagctcaaaaaggcaaagggtaaagaacatgccacta

SEQ ID NO: 40389 - DNA, 201 bp, Homo sapiens
cgatgagatccgccatcactggggagacagtgtcctgggtctcaagtatgtggtttgcattgccaagctcaaaaaggcaaagggtaaagaacatgccactraattgggtgaaatgtatgctgttgagttttctgtatgtaaaaataattaaaataatataaattttccttcaaaaaacaaaaacaaaacaaaaacagaaaa

SEQ ID NO: 40390 - DNA, 201 bp, Homo sapiens
  misc_feature (1)...(201): n = A,T,C or G, or insertion/deletion polymorphism (see Tables 1-2)
aaggaatccaggagtatcatgactgagacctgggttcaagggtcttggaggaggcttcagcttgagaaaaatgttctctaggaaactgcgtttatttaccnttctattctccttgtcagaaacacagctatccccagaaatcaaagtctgccagcagcagcctaaactatatctatgcaaacacttatgtgaatctcaccg

SEQ ID NO: 40391 - DNA, 201 bp, Homo sapiens
  misc_feature (1)...(201): n = A,T,C or G, or insertion/deletion polymorphism (see Tables 1-2)
gattcagaagtggttatgacggtaggtgtaggtgtagaatgggtataagtgtagggaaataggacataagacaagcaaaagttggggtacacagagccaanttaaggttatcatcaaaggggcaaggagagtggtggtggaaagggaactaaagaaggggcaggaagactagagacagtgacagtgagcagaagagaggga

SEQ ID NO: 40392 - DNA, 201 bp, Homo sapiens
  misc_feature (1)...(201): n = A,T,C or G, or insertion/deletion polymorphism (see Tables 1-2)
gcttgagaaaaatgttctctaggaaactgcgtttatttaccgttctattctccttgtcagaaacacagctatccccagaaatcaaagtctgccagcagcancctaaactatatctatgcaaacacttatgtgaatctcaccgagattgtcaagcaaataacatatgctgttctacctactgtgggaatgtttgcatgagca

SEQ ID NO: 40393 - DNA, 201 bp, Homo sapiens
acaatatattttttcttttcttttttccataaaacattttgtaattagaaagcagaaataaatgatatctttcattctatcggcaagaacacaagactggytatgtgaaaggaggaggcgtcattcctgcggaagccctatcccacatgacgaacgacaaggccaggggcaagcaaaaagaggaaggactctcttgctctg

SEQ ID NO: 40394 - DNA, 201 bp, Homo sapiens
caaaggggcaaggagagtggtggtggaaagggaactaaagaaggggcaggaagactagagacagtgacagtgagcagaagagagggagagacaagaggcawgttgatcctcatctctgaattctactattcagagactaggagagagtttgaaagatgtctcatgcttctttgagctctcaggatcagactgtagattctt

SEQ ID NO: 40395 - DNA, 201 bp, Homo sapiens
  misc_feature (1)...(201): n = A,T,C or G, or insertion/deletion polymorphism (see Tables 1-2)
cttatgtgaatctcaccgagattgtcaagcaaataacatatgctgttctacctactgtgggaatgtttgcatgagcatcctgtgagtgggagagtgggctnggatgtgcatcctgcttcccaactcctctatccaagactgtgcccacatccgaagcacaaggacctcaagtcaccagcataagaacatcaacaggaatgc

SEQ ID NO: 40396 - DNA, 201 bp, Homo sapiens
  misc_feature (1)...(201): n = A,T,C or G, or insertion/deletion polymorphism (see Tables 1-2)
catatccagctctgaccacaatgttgtgtagactctggactgtccctaaaccatggccctccagccccttagctggccctgggaatagtaatgggaatgangaagaaacctgcatattttgctgttccttctcaatacttagagagaaatggcacatcccatagtgaaaggcgcaccagggctgagaatccagtggggaaa

SEQ ID NO: 40397 - DNA, 201 bp, Homo sapiens
gggacaaataagaagaacaaaggcagacgtggagatgatagtaggggttgccaagctttctggaaaggagcagagagtattttaggctttatgggccatayagtctccatcccaactactcaactttgctggcatagtgcaaaagtagccacagatagcttataaatgaaggtgtgtagggctgtgttccaataaaactac

SEQ ID NO: 40398 - DNA, 201 bp, Homo sapiens
gggcagcacgagcacagtcaaaccagaatggctgctgcaggagccatcagcatgactgtgtggcagctgctcacagagcagggactaacatgggaaccagrctagcttttgcgtccctttctgagtctccagtctatccgggtttgcagaacattaatcaaggttaattaggcccacctgtgacataaaaatttctaccta

SEQ ID NO: 40399 - DNA, 201 bp, Homo sapiens
ctttttctatgaaccaatcaagcagatttatgtatttttttcagtgccgtaaaaaaaatttgatgattttgaggcttaacatcaaataccagtgagatcamaagttagatatgacatcatacacatcatttctgctgaaaaagtacctttagttaaaaacagaaaccaatttgtaaatgtgaattaaatgcatactccaca

SEQ ID NO: 40400 - DNA, 201 bp, Homo sapiens
tgtgaagggtctacacgttcaacctcttccttgtaagttaatgagttagctaccaagttttgaggaagctagcagaaaacaggagacccaggatcagatayagaggacttcgttactcatggcagagcaaacagcatgagctttatttctgcactgattcccattgccctggcccctagtcccacagggaggatgtggaac

SEQ ID NO: 40401 - DNA, 201 bp, Homo sapiens
gtaaactacttgaaggcaattcctgtgcttaaaatggccacgtgaaaggtgtccctgacatggaaaggacaaaccatgaaatgacccttgaagctcttaakgtgtctgtcaaaaaagcaaagccaactgtcaaactgaaaagccaaaatcatcacaaaaacacctattcttcagaggcctcaaatctcaaactatctccca

SEQ ID NO: 40402 - DNA, 201 bp, Homo sapiens
tcccatctcggcctcccaaagtgctgggattacaggtgtgagccaccgggcccagccgtaggaacacagatattatcatcatgggacaagtcatccattcycagattccatgaccctctctggtgtccactgtggatttcagcacatgtttaactatgaaactctagtcacgctttttgatatacaggttcatggttacta

SEQ ID NO: 40403 - DNA, 201 bp, Homo sapiens
cctgggttcaagtgattctcctgcctcagcctcctgagtagctgggattacaggcatgcaccaccacaccggctaacttttgtatttttagtagagatagsgtttcaccatattgatcaaggtggtcttcaactcctgacctcgtgatcctcccatctcggcctcccaaagtgctgggattacaggtgtgagccaccgggc

SEQ ID NO: 40404 - DNA, 201 bp, Homo sapiens
ttgattcatttgtggtttcctgttttccataaggagatagttacaggattaaatttctcctcccttttccctatgcactcacacctgggtcccaggacagmaggaccaatcgtcaggaaaatacatccatactgcatcccctgatacttcatctcaggttgggcaggagggttagcagaagagttatttccctttgcgaag

SEQ ID NO: 40405 - DNA, 201 bp, Homo sapiens
ctcggctcactgcaacctccgcctcctgggttcaagtgattctcctgcctcagcctcctgagtagctgggattacaggcatgcaccaccacaccggctaayttttgtatttttagtagagatagggtttcaccatattgatcaaggtggtcttcaactcctgacctcgtgatcctcccatctcggcctcccaaagtgctgg

SEQ ID NO: 40406 - DNA, 201 bp, Homo sapiens
tgggaccaagtgaaagcacttggctggatcagagggataggagcctggctgctcctaaaacaagacactacttgcctttgatgttcaagtcatttaagaaygcaattgcttcctactcaatttttcaaaaccaaaataacaaatacgatatgagccataacttagcaaaattacgtgttttaaacagtctctttcaaaaaa

SEQ ID NO: 40407 - DNA, 201 bp, Homo sapiens
tttatgacactgaaatcagaattccatatcattttcctccttcaagaaataatattctcctctttattcttttttgcagatgattgaaaatgtaagaactrttctgagcctgcaggccatagccaaagaggtaccggctgtattttgtccatgggcaggagcttgtgactgctggtctaggtcattccaggtcaaccaggg

SEQ ID NO: 40408 - DNA, 201 bp, Homo sapiens
tcatgcctcagcctcccaagtagctggaattacaggcgcacaccaccatacccagctaattttgttatttttagtagagatagggtttcaccatgttggcyaggctggtctcgaactcctgacctcaagtgatctgcctgcctcggcctcccaaagtgctaggattacaggcgtgagccactgtgcccggctggctttcat

SEQ ID NO: 40409 - DNA, 201 bp, Homo sapiens
aaacgtgactcaagatggcacagaacagcgtccacagatgtattcttggttacttaaaaacacaatttaaagtaattagcttaatgttgatgtaattctaragatcgataaataaacctaaaaatcttaatttgatattgaatcgccccaaattaaacaacatattttcaaaccactaaatattgattcatttgtaagatg

SEQ ID NO: 40410 - DNA, 201 bp, Homo sapiens
ctgaagtgccagtccaattcatcctccagcatagcaccactgactgaccccagtcaacaccacaaggggcagaagagtcactccactgagccctaacttasagaaatcacaagataaaacaaaatggttgttgttttaagcctctaagttttggggtaatgtattatgcggctatacataaattggaacatccacgtttta

SEQ ID NO: 40411 - DNA, 201 bp, Homo sapiens
ggaccagctgaagtgccagtccaattcatcctccagcatagcaccactgactgaccccagtcaacaccacaaggggcagaagagtcactccactgagcccyaacttagagaaatcacaagataaaacaaaatggttgttgttttaagcctctaagttttggggtaatgtattatgcggctatacataaattggaacatcca

SEQ ID NO: 40412 - DNA, 201 bp, Homo sapiens
tactttcttttggaatcctctgggagccctgagccaccatgtaagaaatctgatggccctatatctgccatgcaggaaaggccatgtgtagggctctgggyaagagtccctcagctgagccaagcatcccagtcatcctcgtgaaagtgccagacccatgggtgaccatcctggaccagctgaagtgccagtccaattcat

SEQ ID NO: 40413 - DNA, 201 bp, Homo sapiens
caataaaaaaagtgatctattctgagttccataccaccccaaaacactgatcagcttggggaaacttagaaagttcaaccacctggggataaagtttggamaactaggctagggccaattcagggtacaggtggaggctaggaagtttggcataggatatcattaaaggtcttctaaggatgaaggcaattggagctacac

SEQ ID NO: 40414 - DNA, 201 bp, Homo sapiens
gggacaggtcaaggaaggtattacctctgcatagttctaggtgtcctgcttaactcattcaggaatttcgggccagagggatatccaacaggaattctaamctgaagagtttagaaaccagtaggagaatcaggatgaattcagaaattactataatatgcattttcaagtgataaatcccatcaaaaacagaaaaagtgc

SEQ ID NO: 40415 - DNA, 201 bp, Homo sapiens
aaactgacccagaaaagggacaggtcaaggaaggtattacctctgcatagttctaggtgtcctgcttaactcattcaggaatttcgggccagagggatatycaacaggaattctaacctgaagagtttagaaaccagtaggagaatcaggatgaattcagaaattactataatatgcattttcaagtgataaatcccatca

SEQ ID NO: 40416 - DNA, 201 bp, Homo sapiens
gaaatcatgaagggcaaactgacccagaaaagggacaggtcaaggaaggtattacctctgcatagttctaggtgtcctgcttaactcattcaggaatttcrggccagagggatatccaacaggaattctaacctgaagagtttagaaaccagtaggagaatcaggatgaattcagaaattactataatatgcattttcaag

SEQ ID NO: 40417 - DNA, 201 bp, Homo sapiens
aactttcagacattaaatatcctagcccccgtccctcaccaaattgccaggtgtgggtggaaagcaacagattttatttttaatgggctaaaattttacartcttaaagcacaattcatgcaagcaactgagagatcacagctacaaacactggactttctattttctccatgcgatcccaatttcagctgcagagccaga

SEQ ID NO: 40418 - DNA, 201 bp, Homo sapiens
gagcacaggtcagaaggatgaatacacagagggagaaaactgcaacttccctcaaggagagaatgctagaaatggcaatgggcaggaaagaaaggatcctkacatcattttatagagagtcgttcatcccttacacaaacctggccaaaaatctacagaatgctgaggaaacacggctattcaacaagaaaatcggagctt

SEQ ID NO: 40419 - DNA, 201 bp, Homo sapiens
atatttattaaatatcccatcacagagaaactttgctgactcttgcacaaaacttcgcattttgtcagccagtaatgaccctttcctcttaagctagtttraatttggagctttttgtgtgtaagaggaaactcctgatctactaaaagaaaaagctattcttagtccttcccagatatccctgaacctccacccacccag

SEQ ID NO: 40420 - DNA, 201 bp, Homo sapiens
ctctgagctgtgaacacactactgcactccagcctgggtgatgaagtgagaccttgcctcaaaaaaacaaacaaaacaaaatgaacattcacactagaaasgagaaacagggacgctaaagctgaagtcaaatttcaccaccaaataaatttgctataaatatacaataaatttgtttttgcttttcagatctctttgggt

SEQ ID NO: 40421 - DNA, 201 bp, Homo sapiens
gtggggaatgaggagagtaaacagcagtgcctcccacggagctccctgcaggttctccttgtaggagtgagattttgctggtgatttatattgtttgagasatacccaaagagtcttgtgtcactcaatccccagctccatccctggctcggaggagcctgcaccgcctcacgggagcctgtaactgtcaaatggcattcc

SEQ ID NO: 40422 - DNA, 201 bp, Homo sapiens
tacaaaattagccgggtgtggtggcacatgtctgtaatcccagctactcgggaggctgcggcaggagaatcgcttgaacctgggaggtagagatcacggcragccaagatcacaccactgcactccagcctgggcaacaagagcgaaactccatctcaacaacaacaaaaaaagtaatttagcacatatactgcatattac

SEQ ID NO: 40423 - DNA, 201 bp, Homo sapiens
cattgccctggcccctagtcccacagggaggatgtggaacagcccggtagatgccgtgctcatagtacgtttcagtcatggctgaggagccccaagcttasaaaccccaacctttatcaagcaaatctgccaaaccgttgtcctggaaggaggcactgtctttattatactggaaagaaagccatcctgtcctctgctcct

SEQ ID NO: 40424 - DNA, 201 bp, Homo sapiens
tcttccttgtaagttaatgagttagctaccaagttttgaggaagctagcagaaaacaggagacccaggatcagatacagaggacttcgttactcatggcasagcaaacagcatgagctttatttctgcactgattcccattgccctggcccctagtcccacagggaggatgtggaacagcccggtagatgccgtgctcata

SEQ ID NO: 40425 - DNA, 201 bp, Homo sapiens
ggaggtcaggacgttgagagatccccaaattgcaagttgtcatcctgagacaagcgataccttgctggacactaattcattcttggagtctctccctctcrgccctttggcttcatgttctggagagaatgaccagagagacccatttactcaacgcttctcaatgagacagggatcttctaaagggcactgtcttatata

SEQ ID NO: 40426 - DNA, 201 bp, Homo sapiens
agccgagatggcgccactgcactccagcctgggtgacaagagtaaaactccctctcaaaacaaacaaacaaaccaaaaaaacaaatagcaacagcaaccayaatcatcatcaccatcaaggctggaacaaggatgaggcaggcaggctctgatagcaacaggaggaagcagaccaaggagggagagaaaggaaggcagaga

SEQ ID NO: 40427 - DNA, 201 bp, Homo sapiens
tgaatctgagcaatgatgtcataataatcatcaatagcaacagtggctgcgcgtgaggggcgtggtggttcacgcctgtaatcccaacactttgggaagcygaggtgggcagatcatttgagctgaggagttcaagaccagcctggacaacatgctgaaaccccatctctactaaaactacaaagaattagccaggcatgg

SEQ ID NO: 40428 - DNA, 201 bp, Homo sapiens
gacagataataaatacccctcatcagctgatcaattgctcgcacttccaggcaagcacccatcactccccaccaaacacaccgccccacgccacctgaacraggttaaaagaacggactcatgactgatggtcggggggaactggcttcagaagaggaagttgaaaatattaagaaatcaacacgggcatttaaaagcaaa

SEQ ID NO: 40429 - DNA, 201 bp, Homo sapiens
cctcaaaccctggttccacgtctccctcactcaaggatttatgtctcattttcaatggaatgttacatttggtcagaccacgaagaaaactcctcattatraactaggaaatgtgtggagagagaattatttacccaaggcagtgctcaatcagtgttgcccgaatatttatttagcccacacacggagaagttgtgttaa

SEQ ID NO: 40430 - DNA, 201 bp, Homo sapiens
acccagtctgctgggatcctgatatagtttggatatttgtccccgctcaaatctcatgttgaaacatgtccgtaatgggaggtatttgaatcactggggcrgagccctcatggcttggcgctgtcttcaccatagtgagtgagatctctggagatctggtcattttaacccttttcccatttgccccaagaatacttactg

SEQ ID NO: 40431 - DNA, 201 bp, Homo sapiens
ctggggtccaaggatttatttcctctctcgggagtcagggacagataataaatacccctcatcagctgatcaattgctcgcacttccaggcaagcacccakcactccccaccaaacacaccgccccacgccacctgaacaaggttaaaagaacggactcatgactgatggtcggggggaactggcttcagaagaggaagtt

SEQ ID NO: 40432 - DNA, 201 bp, Homo sapiens
aacccccatcgggaagagactattatcatctccttatcacccacagggatgctgaggttacgaggtatcaagggacctacccaccattgcacaggcagaamacaggagagccaagactgacacccccagcaggaggtgttccagccaccttggacaccttccaccacaggctgagccgcagtgaagggctttcagaggggc

SEQ ID NO: 40433 - DNA, 201 bp, Homo sapiens
tggagttagcctttgggccataattggttcattcctaccttttcataatctcagttattgatcaggtgatttttcaaactgtgaagggtctacacgttcamcctcttccttgtaagttaatgagttagctaccaagttttgaggaagctagcagaaaacaggagacccaggatcagatacagaggacttcgttactcatgg

SEQ ID NO: 40434 - DNA, 201 bp, Homo sapiens
aatcagtcagactttgaatcattcctgcagcctctgaacatttaccatggagctcaataagccaggcaagaacacagatttttttttttttttttttttttgagacggagtctcactctgtcacccaggctggagtgcaatggcgtgatctcggctcactgcaacctccgcctcctgggttcaagtgattctcctgcctca

SEQ ID NO: 40435 - DNA, 201 bp, Homo sapiens
gagcaaacagcatgagctttatttctgcactgattcccattgccctggcccctagtcccacagggaggatgtggaacagcccggtagatgccgtgctcatrgtacgtttcagtcatggctgaggagccccaagcttacaaaccccaacctttatcaagcaaatctgccaaaccgttgtcctggaaggaggcactgtcttta

SEQ ID NO: 40436 - DNA, 201 bp, Homo sapiens
actaaaagaaaaagctattcttagtccttcccagatatccctgaacctccacccacccagtctgctgggatcctgatatagtttggatatttgtccccgcycaaatctcatgttgaaacatgtccgtaatgggaggtatttgaatcactggggcggagccctcatggcttggcgctgtcttcaccatagtgagtgagatct

SEQ ID NO: 40437 - DNA, 201 bp, Homo sapiens
aacctccacctcccgggttcgagtgattctcctgcctcagcctccccaatagctgggattacaggcacgccaccacacccagctaatttttgtatgtttgstacagacggggtttcaccatgttgcccaggctaggttcaaactcctgacctcaagtgatccacctgcctcagcctcccaaagggcagagataactaattt

SEQ ID NO: 40438 - DNA, 201 bp, Homo sapiens
tctactaaaagaaaaagctattcttagtccttcccagatatccctgaacctccacccacccagtctgctgggatcctgatatagtttggatatttgtcccygctcaaatctcatgttgaaacatgtccgtaatgggaggtatttgaatcactggggcggagccctcatggcttggcgctgtcttcaccatagtgagtgaga

SEQ ID NO: 40439 - DNA, 201 bp, Homo sapiens
aatttatatttaaattttaatcaataacttttttttttttttttttttgagatggagtcttactctgtttcccaagctggagtgcagtggtgtgatctcgrctcactgcaacctccacctcccgggttcgagtgattctcctgcctcagcctccccaatagctgggattacaggcacgccaccacacccagctaatttttg

SEQ ID NO: 40440 - DNA, 201 bp, Homo sapiens
gtgacacatgaaaatgtatatgaaattcaaattccagtatccataaataaagtttctcgcagccatgcctgctcctttacatatcgtttatgcctgttttygcactatgagggcagagttgagtagttggcaacaaacactacaaggccccaaaatatttattaaatatcccatcacagagaaactttgctgactcttgca

SEQ ID NO: 40441 - DNA, 201 bp, Homo sapiens
ttctgcactgattcccattgccctggcccctagtcccacagggaggatgtggaacagcccggtagatgccgtgctcatagtacgtttcagtcatggctgargagccccaagcttacaaaccccaacctttatcaagcaaatctgccaaaccgttgtcctggaaggaggcactgtctttattatactggaaagaaagccatc

SEQ ID NO: 40442 - DNA, 201 bp, Homo sapiens
ctccttctctcttaaaaaagaaggaacatgatatgccacttgcaagattaggatattctgtttaaaaagaggggataatttaagcagggctggcggtgggrgcggggagacaatggaaaaggctgacatctcctgagcatggctcaagaaggcataattcttccgcatgtataagaataaaacctcttaactcatctccca

SEQ ID NO: 40443 - DNA, 201 bp, Homo sapiens
gggaaagaataatattttgtgacacatgaaaatgtatatgaaattcaaattccagtatccataaataaagtttctcgcagccatgcctgctcctttacatrtcgtttatgcctgtttttgcactatgagggcagagttgagtagttggcaacaaacactacaaggccccaaaatatttattaaatatcccatcacagagaa

SEQ ID NO: 40444 - DNA, 201 bp, Homo sapiens
aaagtttcagttagcctcagtccctgatgatctgcaggaatttctccttctctcttaaaaaagaaggaacatgatatgccacttgcaagattaggatattytgtttaaaaagaggggataatttaagcagggctggcggtgggggcggggagacaatggaaaaggctgacatctcctgagcatggctcaagaaggcataat

SEQ ID NO: 40445 - DNA, 201 bp, Homo sapiens
tatctgtagtctcctggctgatgaggtgtgcagcctggattagaacctccatctgcctgacctggctgcacacaatgcttgttaagttatcccggaaaacrtaaggccatacaggtgtggcagactaattaaattcaccatgctctttgggctgtgtgactgctaccaaaatgtcctaccctacctcacatattcccttgt

SEQ ID NO: 40446 - DNA, 201 bp, Homo sapiens
gccaagatgggacagtgctcgtctgccagtggcagccccattcggagagaattttccctttgaagaatataacccataaaagatcatcaaaactaagggawtaaataaagaggggacctcgatgacatatttaagctctgaataaagctagactctaagcaggggttggcaaactataaccgctgggccaaacacggctgt

SEQ ID NO: 40447 - DNA, 201 bp, Homo sapiens
ctgtggcttttgggccaagggtagtggggaaaacagcttcttgtcactgggggaacaagccaagatgggacagtgctcgtctgccagtggcagccccattyggagagaattttccctttgaagaatataacccataaaagatcatcaaaactaagggaataaataaagaggggacctcgatgacatatttaagctctgaat

SEQ ID NO: 40448 - DNA, 201 bp, Homo sapiens
caagggctgcgcccgggaaatgtgggagcaaaggtgccagaccttccagttttttaagagaaaccaagaatccaggtttttatgcgaactttaaaaaaagrggatgtgggggtgggggcagcaaacacatgcctgcaggctgaattcaccacccccctccacgttttagatcttataattacatcttctctttaggatcct

SEQ ID NO: 40449 - DNA, 201 bp, Homo sapiens
ctaggccaatcctggttctccctgtggcttttgggccaagggtagtggggaaaacagcttcttgtcactgggggaacaagccaagatgggacagtgctcgyctgccagtggcagccccattcggagagaattttccctttgaagaatataacccataaaagatcatcaaaactaagggaataaataaagaggggacctcga

SEQ ID NO: 40450 - DNA, 201 bp, Homo sapiens
tagaagctatagatttgtgtgtccagaatgtttccccaggtgcctccttttgcaaaattggacctcatttttccattagggaacggggcctctcagactcygtggagaagcagagaattatctccagccttgactgcccaggctgcagagaaccgcatcatccggggacatgactgattcagggataggtgtctgcctaaa

SEQ ID NO: 40451 - DNA, 201 bp, Homo sapiens
accataaaaggatcatagcagattgacggtagaagctatagatttgtgtgtccagaatgtttccccaggtgcctccttttgcaaaattggacctcattttwccattagggaacggggcctctcagactctgtggagaagcagagaattatctccagccttgactgcccaggctgcagagaaccgcatcatccggggacatg

SEQ ID NO: 40452 - DNA, 201 bp, Homo sapiens
ttgctgaccactagtaagagaccatccaacaggctcctttctgaagccacatcccgaaaagatcccctcctgatgtctctagaaacatgcaaaaataaaaytgcaacgtcagaaccataaaaggatcatagcagattgacggtagaagctatagatttgtgtgtccagaatgtttccccaggtgcctccttttgcaaaatt

SEQ ID NO: 40453 - DNA, 201 bp, Homo sapiens
tccctccaggtgaaggtaatgattaagaacacaggtctggagtgggtttgaatcactgtgtgttcagccgctcactggggacctggcctcagccctctgaytactgcagggctttattactttctgagttctctttgctatctcactcgccctttcctcccatttctccttctggtgccccttctccccttccaggccccc

SEQ ID NO: 40454 - DNA, 201 bp, Homo sapiens
atgtacccaataagcagtccttacaataccaatagtttctatctgttgggcactgccaattagccaggcatgtcaaatggaagatctcacttaatcttgcmaaaaaaaaaatgttgttcgttgttgttccttctattacagaggaaaaaacaaaggcagatggaggttacattatttgcctaaagttacacagctagaaag

SEQ ID NO: 40455 - DNA, 201 bp, Homo sapiens
tgttcccaaagcatcggggttcagcggtaatgtttttgaatcttctcgggtgtaagtaaatatatttcagacagcttttagaatgaagttagctagaagarttttgcagcaatagaagctgatttgatgtagaccttcaggtttcttatctatttattggtgctgctcagttggatgggaaagagaggagaagctgagaga

SEQ ID NO: 40456 - DNA, 201 bp, Homo sapiens
tctgcttaagcaacaaagagagaagtaaccgcaaacgctaatttatccagcggaatttacatttctctttctcggcaatatagtttcttagtgtcttccamgtttttaaatcctttaggtttattcattatgttcctttttcctgcttctaaaaggtagctgttcttgcccactgttttggaagtaagaaaacctaggagc

SEQ ID NO: 40457 - DNA, 201 bp, Homo sapiens
cttttttttttttttttttttttttgagatggagtcttgctctgtcgcccaggatggagtacaatggtgcagtctaggctcactgcaacctctgcctcccrggttcgagtgattctcctgcctcagcctcctgagcagctgggactacaggcacatgccaccatgcccgactaatttatgtatttttaatagagatggggt

SEQ ID NO: 40458 - DNA, 201 bp, Homo sapiens
ttctcaagagaagctggaaggtagggtcagagagattacagtgagaagtgaagcggtagaggccagtaggtttagaaaccagtgctgtgggctgacagggrgtgacaatttccagctttggttctcctcatttaggagagacatgaagtctcatggtgtggtagacaggccacacaagactggaagtctgaagtgtgctca

SEQ ID NO: 40459 - DNA, 201 bp, Homo sapiens
gtttgctgccaaataaataccctgctgctctacaggttgcaaatatttcaatcattgtgcagatctgcacaaacttggaaagaaaactcatgcaatctcawggccttatttccccttcctacataagagaaacatacatgcctaaaccttcactttccaaatgtttactagaagattagaaaaacaacagatgacaggcaa

SEQ ID NO: 40460 - DNA, 201 bp, Homo sapiens
ctcagccctctgattactgcagggctttattactttctgagttctctttgctatctcactcgccctttcctcccatttctccttctggtgccccttctccycttccaggcccccagcccccagcccccaccccacagccatctctgtattaaatgtttgtggaatgttcaccgttcaaaagccacgttctagtttgaggct

SEQ ID NO: 40461 - DNA, 201 bp, Homo sapiens
agtgaatgagttctctgcatacatgttgttctctgcctggtaccgtggaggtcaggctcgcacagaagcatacttatggtcagagttagtcaataaaaaaagtgatctattctgagttccataccaccccaaaacactgatcagcttggggaaacttagaaagttcaaccacctggggataaagtttggaaaactaggcta

SEQ ID NO: 40462 - DNA, 201 bp, Homo sapiens
tatttttaccccctcttaaattggaatcatggtatagcaggcaggatacaaacttctcatttccattacacattttcagtgccatcattaatctgaatgayatcaacaaaatgcccaatgcacataaatcagtcagactttgaatcattcctgcagcctctgaacatttaccatggagctcaataagccaggcaagaacac

SEQ ID NO: 40463 - DNA, 201 bp, Homo sapiens
agtctctttcaaaaaacaatagattaaaaagtgcaatatttttaccccctcttaaattggaatcatggtatagcaggcaggatacaaacttctcatttccrttacacattttcagtgccatcattaatctgaatgacatcaacaaaatgcccaatgcacataaatcagtcagactttgaatcattcctgcagcctctgaac

SEQ ID NO: 40464 - DNA, 201 bp, Homo sapiens
aaaactttatgacactgaaatcagaattccatatcattttcctccttcaagaaataatattctcctctttattcttttttgcagatgattgaaaatgtaaraactattctgagcctgcaggccatagccaaagaggtaccggctgtattttgtccatgggcaggagcttgtgactgctggtctaggtcattccaggtcaac

SEQ ID NO: 40465 - DNA, 201 bp, Homo sapiens
ggagacccaggatcagatacagaggacttcgttactcatggcagagcaaacagcatgagctttatttctgcactgattcccattgccctggcccctagtcmcacagggaggatgtggaacagcccggtagatgccgtgctcatagtacgtttcagtcatggctgaggagccccaagcttacaaaccccaacctttatcaag

SEQ ID NO: 40466 - DNA, 201 bp, Homo sapiens
taaaataaaggagaaactcattggagaggctaatgcggcgtgcactggaggtagctactatcactaagcattaagataaacaatacgagtggcattctggyccacgcctggcaaagtgcaggagtccctggaggaaaaggaatgagagtgcatcagcgacctcgtgaggcagtgcagctttgcattaatgcctgcagctct

SEQ ID NO: 40467 - DNA, 201 bp, Homo sapiens
atagcttaccatacattaaaagtatcctcttacctaattttatatgtatgtatgtatgtatgtatgtatgtatgtatgtatctatctatctaccttaccayacattaaaatcttacatttctacacgtgcaggactagaatgaacacacataaagcatgataccaatctgcttttttggccaccatataaacattctatgc

SEQ ID NO: 40468 - DNA, 201 bp, Homo sapiens
ggctagaatgcagtggtgcaatcatagcttaccatacattaaaagtatcctcttacctaattttatatgtatgtatgtatgtatgtatgtatgtatgtatstatctatctatctaccttaccatacattaaaatcttacatttctacacgtgcaggactagaatgaacacacataaagcatgataccaatctgcttttttg

SEQ ID NO: 40469 - DNA, 201 bp, Homo sapiens
ctcaactttgctggcatagtgcaaaagtagccacagatagcttataaatgaaggtgtgtagggctgtgttccaataaaactacttcagatctctctggaayttcaataaaagtttttaaaatttagttatgaacactgaaatttgaatttcatacaatttttacatgtaataaaacattattctattggttttttccccca

SEQ ID NO: 40470 - DNA, 201 bp, Homo sapiens
ttccctttacttccagtgtgttgatgaagcaataatggtatgagttaatgctgctgctgcttaacctatgtttaaacaactgacatagtacatattgtaawgtttgtagttcctagcaggcaaggcgctatggcagtgcccacatctaccagttaaatgagactacgagaaagatatgtatttcaaaagcacacaagagcc

SEQ ID NO: 40471 - DNA, 201 bp, Homo sapiens
taatcacagaaataaaaaaattaactactatgagattttaagaatgaaatcacgacatactaaaaatgaggggatatgcatgctcaggctaaaaatccatkttgctagtcatggttacttttactctcagaacattttcctagtcaagatgttttgactacttactgattttcagctagagttaaccaatgggagaaaatt

SEQ ID NO: 40472 - DNA, 201 bp, Homo sapiens
gtattgtggaactcttccctgagaaagtgatgttagcgtcatagtatgatgctggtataaagatagacatagaaatgaagcagaaatagagccaaacatawatgatcaatttatttttgacagcaattccaagattatttaaaaagaaaagaaaatcattttgactaaatgatgcttgaacaatatctgtatatgaaaaaa

SEQ ID NO: 40473 - DNA, 201 bp, Homo sapiens
gatgttagcgtcatagtatgatgctggtataaagatagacatagaaatgaagcagaaatagagccaaacatatatgatcaatttatttttgacagcaattmcaagattatttaaaaagaaaagaaaatcattttgactaaatgatgcttgaacaatatctgtatatgaaaaaaatgtactgcacattactccatatacaaa

SEQ ID NO: 40474 - DNA, 201 bp, Homo sapiens
tgcttccactaaatgttttatgaaaagtttgcattaaaacttagcacaaatttaaaaaacaatataattacaacttttttttctactacacacaagagagwtaaagagatgaaattcgaaagaaaattttaaaaatgttagcagtttttgctttggcaaagaaagaagatatttgttttttcttcttttttttctaaattt

SEQ ID NO: 40475 - DNA, 201 bp, Homo sapiens
aattataatctgcaatgaagaaaacaataagaaaaatcataatatgttataaattaaggaatatgcttccactaaatgttttatgaaaagtttgcattaamacttagcacaaatttaaaaaacaatataattacaacttttttttctactacacacaagagagataaagagatgaaattcgaaagaaaattttaaaaatgt

SEQ ID NO: 40476 - DNA, 201 bp, Homo sapiens
ttttagatggagtataatttgtttcaatcttttggaaaagccctttaacaatacaaattaaacaaataaaaaatatatacatatatatttgtgtgtgttcrtgtatacatatatactttaaaataaaaacatacatatttattctttgactcaacacttctcctaggaaagtgttatctgaaaagttgatcatcttaatta

SEQ ID NO: 40477 - DNA, 201 bp, Homo sapiens
aacaacaacaacaaaaaccaaaacactgcaaacaaacaaaaacagtccaaggccaaatgaattcacagccaaattctaccagacatccaaagaattggtamtaattcaattgaatctattccaaaagattgagaagaagagaatcctccctaatacattctacaagcccagtatcaccctggtaccaaagcaaaggaaaga

SEQ ID NO: 40478 - DNA, 201 bp, Homo sapiens
tatataaaacttgtactttttggtaaaacatgtcataaataaaattaaaactaattatatctgggaaaatatttgcaataaatgtggccaatataaagttyatatttttaatatgtacagcactcttagaaattgttttttaaagattacctaatagttttatcatggtttattttacacacaataagccattgaaaagaa

SEQ ID NO: 40479 - DNA, 201 bp, Homo sapiens
agagagaagaaaagagagagaagaaaattaaccatttttggaatgagtaataaaattcaataagtaaaagaagtttctttaaaaagtcaatatttttttttaaggaatgatgagaattatgtggagctttgagacaaataccatggaaatttatcagaagtgaaaaataagaattgaataaaaaatattggttaacatctt

SEQ ID NO: 40480 - DNA, 201 bp, Homo sapiens
aagagtggaaataaggaagataattactggagaagaaaaacaacttaaaaggtgttgtttagattatatgtttagagagagagaagaaaagagagagaagwaaattaaccatttttggaatgagtaataaaattcaataagtaaaagaagtttctttaaaaagtcaatatttttttttaaggaatgatgagaattatgtgg

SEQ ID NO: 40481 - DNA, 201 bp, Homo sapiens
caatattaaggtgaatcaagaaagcatttagaaaactttcactgttgcctagtctgttatacagaataacttactttaataatatataataaaaaatattrttttatcaataaaagataaaaaagatatttaatcaaaaaatgctgacaatattgaacatcttatctataaaacaaattcataagaactttttgcaaagct

SEQ ID NO: 40482 - DNA, 201 bp, Homo sapiens
tcttagtatgtttgaaggtctcagaagccatttttctgagaaaatatacactacctaaattgagccagaaaataaaaacattcttaatgtaccattagtcrtgagtagtatcaaaatgttagttacctctaaataagaatttggtcccaaagtatttagggtttttaaaagaattattcctatgctatagaatttgttgta

SEQ ID NO: 40483 - DNA, 201 bp, Homo sapiens
tatctacctgacatcacttaatgtagtcttaaatattgagtaatcgaggatagtaaaattgcttgtgcttttggtggctttcttttaaaattttcctcacrtgattgtattataggctctcaaagagtaaaggatagaggaggacttagcattacttaaaggagataaacgtgctgctggaaaagtaaagctggacttggg

SEQ ID NO: 40484 - DNA, 201 bp, Homo sapiens
atttttcgttcctgtatatgcatacgaaaggcagagctgcccagtggaaatagccaaagatacataggttctaatgctatttctgacttttactagctttrtgacttgagcaagtgccttaactgaagagcaactcatttctttcacttgaaaaaataaaatacaaataacccttcccccactaatttattgtaaacgtcg

SEQ ID NO: 40485 - DNA, 201 bp, Homo sapiens
ataaatatttacagattgtgtctttcttttttacaatgtcattactccaagaagctcctggtataaggaagtgaaatatttcaattattgttttatgactyagtaatttgaaacttggaatgcattttcccaaagggaaggaaggtagaatggtatttttcgttcctgtatatgcatacgaaaggcagagctgcccagtgg

SEQ ID NO: 40486 - DNA, 201 bp, Homo sapiens
gtgagatgctatgatgtacaaagtatgtattcttcaggagctcacagttagttcgggaagagagagcccacagtgacagacttagagtaatggatgtctargtcctaatggaatgaggtctagaatgacttcccagggcacatgaagtgaaagcctaaatccaaaaaggctaaggacgttacccaagtgaagaggatggca

SEQ ID NO: 40487 - DNA, 201 bp, Homo sapiens
catttacctttgtgtattttataacttttgatgctgtttcaaatagcattatgtttaaattcaattatccatttgcttattggtgttgtataaaaatatamtttaatgttgaccttgcagcctatgatctggctaaacttactagttataatattttgaagattaatttcacatgattttactttgttgtctgtaaattcc

SEQ ID NO: 40488 - DNA, 201 bp, Homo sapiens
ttaattctaccaacaacctttgtaacaagcattttaatgatcattacagattaggaaattgaggctcagagagtaagcaatttgtctaaaaccacacaaarctaagtaatggagctggattaaaatgggagtcctcactccaaattctatttttattagtctacaaaccctacgtattggtgattttgttttatcatcaca

SEQ ID NO: 40489 - DNA, 201 bp, Homo sapiens
caactgagaaaaggatgaacagagttagagcattgaatttgatgccattactccagttgctagaattctgaaattatgatgatgttaccaatttaagtggwtgttacataaattcacctcacatacaaccttagatgtattcgaggcatcatatatctagttattttaattttctctacttgccgtgccactgaggtaatc

SEQ ID NO: 40490 - DNA, 201 bp, Homo sapiens
ctcttcaattaaaaaagtagaagaaaatggaggaaagacaatgatggagataaaagcaagaatttatttattagaagaaaggtatcagaagagttgataasttaatcaactctggttatttcaaacaaaacaagactgacccatagtgaatcaaatagtaagagtaaatatatataaagttataaatgttataaattaaaa

SEQ ID NO: 40491 - DNA, 201 bp, Homo sapiens
agaccagcctgggcaacatggtgaaacccagtctccactaaaattaaaaaaaaaaaaaattagccgggtgtggcggcgtgcgcctgtagtcccagctactygggaggctgaggcaggagaattgcttgaacccgggaggcggaagttgcagtgagtcaagatggcaccactgcactccagcctgggcgacagggcgagact

SEQ ID NO: 40492 - DNA, 201 bp, Homo sapiens
cttattattaataaacaggtaagatggagcataaagaaggggttcaatttataatgatagaaagaataatgtaaaattgtattagttgcctgggtgcggcrgatcactcctgtaatctcagcacattgggaggccgaggcaggcagattgcctcagctcaggagttcgagaccagcctgggcaacatggtgaaacccagtc

SEQ ID NO: 40493 - DNA, 201 bp, Homo sapiens
ttagccttattattaataaacaggtaagatggagcataaagaaggggttcaatttataatgatagaaagaataatgtaaaattgtattagttgcctgggtrcggcagatcactcctgtaatctcagcacattgggaggccgaggcaggcagattgcctcagctcaggagttcgagaccagcctgggcaacatggtgaaacc

SEQ ID NO: 40494 - DNA, 201 bp, Homo sapiens
tttagccttattattaataaacaggtaagatggagcataaagaaggggttcaatttataatgatagaaagaataatgtaaaattgtattagttgcctgggygcggcagatcactcctgtaatctcagcacattgggaggccgaggcaggcagattgcctcagctcaggagttcgagaccagcctgggcaacatggtgaaac

SEQ ID NO: 40495 - DNA, 201 bp, Homo sapiens
aaatttttggcccatttacaaagctgtacacagtggcataattttagccttattattaataaacaggtaagatggagcataaagaaggggttcaatttatwatgatagaaagaataatgtaaaattgtattagttgcctgggtgcggcagatcactcctgtaatctcagcacattgggaggccgaggcaggcagattgcct

SEQ ID NO: 40496 - DNA, 201 bp, Homo sapiens
ttattttacactagtgtgtgttgggggatgaaacatgcacaggccaatgtttttgtatttttcataaatttgttaatcagaggaaatggtttaagaatgcrcttaaaaatttaggaggatatgaatgttttggttttgtatcactgaagaaaattaaagcacacagtgcagagataaagtgaatcttaccagtcatcataa

SEQ ID NO: 40497 - DNA, 201 bp, Homo sapiens
aatgcggcaactaagaactagagaattaaataacatatatacagtggtgtgggcatgattccagttcaacataaagatttttaaaaacttttgcaacactrgccacggaatattttgcaaatgttaaaaaaattcccagagaataaatatatgaaaagtttggccattaaacagtcataatcaacaactgtatcctcaaaa

SEQ ID NO: 40498 - DNA, 201 bp, Homo sapiens
tgtaatcccagctactcaggagttgaggcaggagaatcacttgaaccaggcagtcagaggttgcggtgagccatgatcacaccagtgcactcgagcctggygacagagcgagactccatctcaaaaaaaaaaaaaagtacaacttttaagttagattcaaagtttgcaccataataaatgctagaagaagtcacttatatg

SEQ ID NO: 40499 - DNA, 201 bp, Homo sapiens
tatatttttaattttaattttcacctgttattagtatatacaagtaaaatcgatttttgtatgtttatcttatatcctgcaaccctcctgaaatcacttaktagttcaggaattgttattattgtcgttttggtggattccttgggattttctacatagaaaattatgtcatgtatagatagtaggaatagttttatttct

SEQ ID NO: 40500 - DNA, 201 bp, Homo sapiens
ttgtttgttacataaaataaaactaggtcaaatggtagaaatgacaggaatatagtaagaatcaagaatcctggcatgaagtattagttctaacttggacraaatataagggtcctgagcctagtagagttcctaggtgggagctgatggtagaatgaagagtgattgttgtcttagatcatatacactagaacagacttg

SEQ ID NO: 40501 - DNA, 201 bp, Homo sapiens
tgaaaaaaaaatctgttaaaggcatccatttctcaccagttaataatgtaaaaaagactggattggcatgtttaaattaccagaatcatcagttaaggatwgattaaatgcctgatatcatcacttagaaaagtgtcttgaacttgatggagcttatggtaacaaagtttatatttaaaaaactcactctgcaataataga

SEQ ID NO: 40502 - DNA, 201 bp, Homo sapiens
tggattggcatgtttaaattaccagaatcatcagttaaggattgattaaatgcctgatatcatcacttagaaaagtgtcttgaacttgatggagcttatgrtaacaaagtttatatttaaaaaactcactctgcaataatagagggagtaggaaaattttaaaaataaaaattattatttatacctatataatttatacta

SEQ ID NO: 40503 - DNA, 201 bp, Homo sapiens
acaaaagggagtctatgagctctctcaatagcattttctattggtaatcataaggaaaaatttcattccatttttatcactcattctgaagattgataatrtagttgcttgagaaacattacttatgctgtgtgcttattatttctgctgctctcaacgtgaagcatagcatgtgtttttgtgaagaatgttggtacttga

SEQ ID NO: 40504 - DNA, 201 bp, Homo sapiens
aaataatctaattttaatacacttaatgtattgaaataaatcactgagtaaatgttctacatctttacagatttttttaaattccattttttatgtttaayatgaatgagtataatttaattaattttattttattgttttaatattttttatttattttatatatttaggaattataagtgcagatttcttacatgaata

SEQ ID NO: 40505 - DNA, 201 bp, Homo sapiens
atcttgctaatttagtttattgttcacattttgccttcttaaaattttttttatatctaaagcttctattctttagattaagtagaaatgcattaaaacargaaatatactagacaaaagggagtctatgagctctctcaatagcattttctattggtaatcataaggaaaaatttcattccatttttatcactcattctg

SEQ ID NO: 40506 - DNA, 201 bp, Homo sapiens
catacttttgcttggtattcgtagtagttaactagtgttttataatatcctgataagaaaagtctggagcggtgttcagtgatgggatttttcttgatggmattatgtattgttaaatttaaaggatatagtttatgctctttaatagcacatcccactgcataacgtcaatatctacttgaaaaatagtctagttatgta

SEQ ID NO: 40507 - DNA, 201 bp, Homo sapiens
atggtgccaggcaagagagcgtgttcacgggaactcccttttataaaaccatcagatctcgtgagacttattcactaccaggagaacagtatgggggaaaytgcccccatgattcatttatcttcacttggccctgtccttgacacatggggattattacaattcaaggtgagatttgggtggggacacagtcaaaccata

SEQ ID NO: 40508 - DNA, 201 bp, Homo sapiens
gctaaggtgtagacataaacaattaccagccattattctggaggtcacaagatttgcaactcccgcaattactcctgcagataacatcactattacagagmgagcctaagattggccttttgagatatcttttcaggtttttacatttctgaggacagtctacccctgcccatctgtcatgtggccccacccaaactgact

SEQ ID NO: 40509 - DNA, 201 bp, Homo sapiens
atacatttatttgtttatgcatctgtctttgctattggatgaattatatgagtagaggaataatgccttattcatatttatattgtcaccgcctagcaagktgccaggtacatagtaattgctttaaacatatttattgaaaaagcaatgaattgttgatatttcagaacctagtgtgaggttttaatgcatctaataaat

SEQ ID NO: 40510 - DNA, 201 bp, Homo sapiens
atatgaaattggtgaagcaagtgtgaaacgatgctacacaggtcagataagtaaggaaattcacatgccaatctaatttatgaaattagatgcaaaaattscaaacaaaatgtgaataaactgtttagcactagataaaaaagtcattatgacaaagttgaatttattccaggaatgtaatgttagttcaacattagaaca

SEQ ID NO: 40511 - DNA, 201 bp, Homo sapiens
taaatactctgttgggagtaagtctcattaaatgtttatagtgtggaatgtatcagagtgcttactcaacaaccatgctgaagcttttgttaaatttttcrttctggcccttggctgggtgtgagtatgaaacctgaaatttatgagtggagaaaatagaagttgaattggaacactatactggctaaatcaattgattta

SEQ ID NO: 40512 - DNA, 201 bp, Homo sapiens
attttattttattctttctatatgttttagctgtgatttttctacaaagaaaagctgtttcaatttctctctcactgttacagatgggattgatgaaatgrtttaatacattaacactactgaaatcattaatttttttagctaatttgtcccaaacatttttaggggagaacttttaaactagcttctctgtgtttttag

SEQ ID NO: 40513 - DNA, 201 bp, Homo sapiens
aatttagcatccattgatgattcttgctttaatcaattagtacattactggtagcaaaatagtgattttattttattctttctatatgttttagctgtgayttttctacaaagaaaagctgtttcaatttctctctcactgttacagatgggattgatgaaatgatttaatacattaacactactgaaatcattaattttt

SEQ ID NO: 40514 - DNA, 201 bp, Homo sapiens
ctatagtttgttatacatcatgaattgctgaaaacgatcagccattatcatttcaatgtttcttttgcttcattttcttttttctttcttctattacatgyaatgtatgttacaccttttctaattgttccacactccttggatgctctttattaagtaattttttttctcttcacatttcaatttgggaagtaggtaatg

SEQ ID NO: 40515 - DNA, 201 bp, Homo sapiens
aaaaggatgaacagagttagagcattgaatttgatgccattactccagttgctagaattctgaaattatgatgatgttaccaatttaagtggatgttacawaaattcacctcacatacaaccttagatgtattcgaggcatcatatatctagttattttaattttctctacttgccgtgccactgaggtaatcagacctat

SEQ ID NO: 40516 - DNA, 201 bp, Homo sapiens
tataatatgcttggctgtactttcttggtatttatcccgtttggtcttctctgaggttcatctatctatagtttgttatacatcatgaattgctgaaaacratcagccattatcatttcaatgtttcttttgcttcattttcttttttctttcttctattacatgtaatgtatgttacaccttttctaattgttccacact

SEQ ID NO: 40517 - DNA, 201 bp, Homo sapiens
atatacatcagcattaaatcaaatgttaaaatctgaagaacctctaaggcatgagctaattcaaaccctgtctccacaccccacctcagtgtatgcatacmtgtatttctgtgaaaataggtcctggagaggtaatatgactttttttatgggcataaaatcagtttaaagcaaagtgaaactttaacttgagcctcttgg

SEQ ID NO: 40518 - DNA, 201 bp, Homo sapiens
ttaaacattttctcagaaatttttctttctttctttctttttttttttttaatctgagacagagtcttctcactctattgccaggctagagtcaagtggcrtgatctaagctcactgcaacttccacctcctgggctcaagcaattctcatgcttcagcctcctgagcagctgggattacaggcatgcaccaccatgccag

SEQ ID NO: 40519 - DNA, 201 bp, Homo sapiens
ttcagcagcttgttgcaaagccaattcttttagatggtttatgaaacctttaaaacaagcataaaagcctgctttatttctggtagatttattaaacaagktattatgataccactccaaattgaggtacattccagggaagacatgccatagcagaatatatgatgtgaatatgattctatggccaagacactagcttca

SEQ ID NO: 40520 - DNA, 201 bp, Homo sapiens
aaggtgacataataaaatgagaaacaaatacatagtgtttataaattgacacataaaatgtaaattatggcaaattattcatgatacagttttaagaaaayttatttaaaagccaatcacaattcttttcacactctctttctaaatatcaatatacacaatggaaaaaattttaataatcatattatagggtcctaagaa

SEQ ID NO: 40521 - DNA, 201 bp, Homo sapiens
ctgaacacatttaatatgagttagtgtactttttgaatatgaatctgccctttctaccaatcccatagatggaggccaaattgtaaggtatttataagtastacctgtgccaaatgtcgagtagcatcatctgccttatatgaaactcttattggttatgtagatgaagaaggtgcataaagagtgatgagagcattgtaa

SEQ ID NO: 40522 - DNA, 201 bp, Homo sapiens
ctgaaagatcacaaattgacagcctaacaatacatctgaaggaaccagagaaataagaaaaaaacatacctaaagctagcagaagaaaaggaataataaaratcagagcagaactaaataaaattgaaacaaaaaaaatccaaaggaccaatgaaacaaaaaatagctccttcgaaaagataaaattgttagaacactagg

SEQ ID NO: 40523 - DNA, 201 bp, Homo sapiens
caatttttgtattaggaaatttttatttaatcccccactaaaaacaagtttattccagatataatggccagtacgttacaaattagtcttaacaatgtacytttaatggttctattagacaatgaaacacatttcatttccaactagcttttaaatagctatctatatataagataatcttaaaaagaaatctaatagtaa

SEQ ID NO: 40524 - DNA, 201 bp, Homo sapiens
ttgtataaactttagcaagtctctcagatatatatgtatacacatatgtatatattttatgtatatgtttgtgtctacacacacacacacaaacacacaamtgtactttccccaatcagacttagctcaatttttgtattaggaaatttttatttaatcccccactaaaaacaagtttattccagatataatggccagtac

SEQ ID NO: 40525 - DNA, 201 bp, Homo sapiens
tagatacttagtgtggcagattaatttattgagacattaatttgtattttgttcttactgctgttggaattacatttacctcctgtatcattaaaaataawttttttaaaagggaccccgtaatgtggtcttttacctcagaggcttttgtgctgcaggtttaaagcagaagttaccagatacccataagccaaataagtc

SEQ ID NO: 40526 - DNA, 201 bp, Homo sapiens
aaggtggaaatttaaaaaatttttgaaatgaataacaacagtgacacaagttatcaaaacctctgggatacagcaaaagcaaagctaagaggaaagtttayagtgcaaaatgccaacatcaataattctgaaagatcacaaattgacagcctaacaatacatctgaaggaaccagagaaataagaaaaaaacatacctaaa

SEQ ID NO: 40527 - DNA, 201 bp, Homo sapiens
ttcaggtctgggctcatttatgggatttatgatgcacagttcaagcaggagtatgggagttcttggatttctaggaaaggtgactaactagagacttttgwgggcttataccagattggttctaggtccttgagagagtggaggttgaaaagcagctctctgctccctcacaatgccctggggagcggtgtatctagtgaa

SEQ ID NO: 40528 - DNA, 201 bp, Homo sapiens
agtaaagtctcaccatgtctggtcactcttagggaaacaactttcaagatattaacaggactaaaacattaataccattttctttttaataaagtcccccrctcttgtttaataactcaaagcaacaaagagaaagagaaacacagtgacccacaattctgcactcaagacatgattccccaaatgatctgaatctggcca

SEQ ID NO: 40529 - DNA, 201 bp, Homo sapiens
aagggacactaaataccaatgttttggtctccagtaagtcaccatattttgtcaaaagtctcttttcctaaggttgacacttaagtgcagctggcaacatrtattcagcaggattcttgttcttcccaaatgtccagaatggagatactcctgccaactccctcccgccaaccaggatttgttcttttcctggtacttgtt

SEQ ID NO: 40530 - DNA, 201 bp, Homo sapiens
tgtattagtttatcctgaaggtctcttcagctctgaaaatctgaatttgtgttttcccagccgtcagtttagatgacttgtaaattgaaattacccatctyggcccagccttatataaattgctctgtgaggcctcccctcactcttgctggtatcagacgttttcttccatggtactcacaaagtactttggtaatgtct

SEQ ID NO: 40531 - DNA, 201 bp, Homo sapiens
aaaatgaagatgatagtgataagaatggtcatagtgatggtcgataagacttatatatcaggtgcgagactaggcattttatatgcaatgctgcgtaaaasctcacaacagccccacaacgtaggtataatgtaggtttgatgatgggtcaaaatgtcagctttattactggagctgcattggagagtgcaatgaattctg

SEQ ID NO: 40532 - DNA, 201 bp, Homo sapiens
gtagaacccagcaaaggccaaacactcatccaacctgttgtagaggaggaatccatgcattgtgtagtgaattgtattagtttatcctgaaggtctcttcmgctctgaaaatctgaatttgtgttttcccagccgtcagtttagatgacttgtaaattgaaattacccatctcggcccagccttatataaattgctctgtg

SEQ ID NO: 40533 - DNA, 201 bp, Homo sapiens
cacaaataaatactctcttcctttgaagagtgggagtaagaagtgaaagatgttttttggtgttttatgtttgtttgttttcttttatccagttacaaatygcatttgaatgctagtaacagacattccaaacagtagattaaccaatgtaattgttttatttttgtctaatgacaagaaatttataggtgtatggttggt

SEQ ID NO: 40534 - DNA, 201 bp, Homo sapiens
tcacaagggtattgattggggaagtgataagtgcccatgaaatcttcacaatttatgttcagagattgcagtaaggacaggtgtaagaaattataaaagtrttaatttggggaactaataaatgtccatgaaatcttcacaatttatgttcttctgccatggcttcagccagtccctccattcggggtccctgacttcccg

SEQ ID NO: 40535 - DNA, 201 bp, Homo sapiens
cacagggtcctgaggcgacatacatcctcctcagcttacgaagatgacgggattaagagactaaagtaaagacaggcataggaaatcacaagggtattgaytggggaagtgataagtgcccatgaaatcttcacaatttatgttcagagattgcagtaaggacaggtgtaagaaattataaaagtgttaatttggggaact

SEQ ID NO: 40536 - DNA, 201 bp, Homo sapiens
ggacagaaacccagaggagcatttacttaataacaaaatgctaatacacatggagtttttgagttgtttcagagagaaaacttgcatgctgaagataatgraaatgtatatagttattgtattattctgttttcacactgctgatgaagacatacctgagactgggtaatttataaagaaaaagatgtttaatggacccac

SEQ ID NO: 40537 - DNA, 201 bp, Homo sapiens
tgatttggtaaattaaatggttgcacttttcattatttacaggaagctgtattggtaaaggatccaaaataacctttgctctattttgctcctgcaaatayaatactatgaagtaaattgatgtagtaaatactctgttgggagtaagtctcattaaatgtttatagtgtggaatgtatcagagtgcttactcaacaacca

SEQ ID NO: 40538 - DNA, 201 bp, Homo sapiens
agaaaaccatctggggatggagatttcttttccaggagtttttatattatgaattccacttccttaataattatagagctatttaaattatctgttgcatrttgagttagttgtgatagcttttgcttttgaaggaattggtttatttcatctaacttgtcaaacttacatgttaaagttgtttgtataatcccttattgt

SEQ ID NO: 40539 - DNA, 201 bp, Homo sapiens
accattgttaaatcaagtcagggaccatctgtagtctgtatctggggagtgccgagtgtgatacattgaaatttgttagagtagatagataggatcatacrggttgagcatcccttatctgaaatgcttgggaccagaagtggtttggattttggaattttttggattttggaatatttgcatatacctaatgaattatct

SEQ ID NO: 40540 - DNA, 201 bp, Homo sapiens
gtctatagtatttttgagtatatatctttatatagctattttagtagtttatcgaggtatggcattatatacacataattatcataatttaataaagttgrcattttaccagtttgaggaaaatgtagaaccctttatgtaattttatctcactcatttattatataaatatattaaatatttgttttatgtatattgaga

SEQ ID NO: 40541 - DNA, 201 bp, Homo sapiens
ttcacaagggatccagaatatgacaaccccaccagaacctcaggcagcaaccctgggaagtgcccttgatgagctggaggtaagtcgggagaaagataaastgtgatctgatgtcctaatacagtaataataataataaaacagaagaagatccacatgttggcgtttagagcatgagaaaataaaaaatccagattagtc

SEQ ID NO: 40542 - DNA, 201 bp, Homo sapiens
taccagtttgaggaaaatgtagaaccctttatgtaattttatctcactcatttattatataaatatattaaatatttgttttatgtatattgagaaacacrtaagactgttttaatttttgcttcaactatcaaacataatttagaaaactgaagaaagaagtgtatttttattcatatttttacttttttgttatttctt

SEQ ID NO: 40543 - DNA, 201 bp, Homo sapiens
aatgcacttaataatgtgaatgccagagtattttagctacttataaggatttgactgacaaggacttgactgaatagtaatggatctttacacatctgctytacggggacctttacttattaactgtgtcattgtttatactgcagaatttttaacagaaactgaaagaatgtagaaataatagatgcccttgattataac

SEQ ID NO: 40544 - DNA, 201 bp, Homo sapiens
tagttcattgtttgtctgtaggccctttccccccaaaagaaagaagaacaaggtccttgtaggattttttcatatctgtacactggagtccagcacaaggrctagaatatgctaagtgctcagtaactaattgttgaataaatatcaaagaaagaatgatataggattaatttattagtatttctgaaaaagaaaaatagc

SEQ ID NO: 40545 - DNA, 201 bp, Homo sapiens
tatgtgtgtctctgcgtgtgagatgggtttcctgaatacagcacattgatgggtcttgactttatccagtttgccagtctgtgtcttttaattggagcatstagtccatttacatttaaagttaatagtgttatgtgtgaatttgatcctatcattgtgatgttagctggttattttgctcgttagttgatgcagtttctt

SEQ ID NO: 40546 - DNA, 201 bp, Homo sapiens
agattcttctccttattgtaatattcaccctggatgcaggtcctgtagccttcacacacatggctttagctcccaactgtgagctggtgtttcacatatcyctatttctggcccagactctcctctgaagtctagattcatgtgtattgtattttcatttggatcttgtgctgatatattacatttggcagattacaaaat

SEQ ID NO: 40547 - DNA, 201 bp, Homo sapiens
atttttaatcttgtagttttgacctgaggtttttgtatcagccttgttctaaaactgaattcaggaaaatgtttctaacttagttgtattagttacaacarttctttgtcaggaagatatgcctgaaatatatattctctattgggtcaccgcagatgggcagagttaaaggagagttttttgacaggctttaagagcaga

SEQ ID NO: 40548 - DNA, 201 bp, Homo sapiens
aataccgtaagaatagtgggctgaggggcactatcaggagctcaaattttgatacagaatgtctgagatgcctactagcaagccaactgactttcataccrgttttctggactagcttttacgtggtacatttagaaatgtgcatcttcctctctctgaagcatttcttaagcttttcatgctttccttataattcctatg

SEQ ID NO: 40549 - DNA, 201 bp, Homo sapiens
aattggctttgtgcagtgggcaggaagaacccattgggtcgtttccggactgtcatgtcagtttgattaatcagtagatcaacatactttgttttagatcycataaattcagctttcttattagtagctgtattagtctgttcttgcactgctatgaatacctgcgactgggaaatttataaagaaaacaggtttaattgg

SEQ ID NO: 40550 - DNA, 201 bp, Homo sapiens
ttatagtactctttgataagcaaaattttttagttttcatgaaatgtgatttatctatcttttcttttgctgtttgtgcttttgttgtcatatctaataarttgccatctaaaccaaaatcacaaagatttactcctatgttttcttctaagtgttttatagttttagctcttatattaaaacccatttatgcctgaggtt

SEQ ID NO: 40551 - DNA, 201 bp, Homo sapiens
ttccttacaagtactggtaagtcagttgccaataacagctgcacaatttctcttatttgaatctacatagctacgaatattcatacatgtgggaaagattytagtctgtgttgcttcttttgacatacattgctatacagtgcttgcacactttggttatgcgatttgaaatttatcactgagaagtaaatatattcattg

SEQ ID NO: 40552 - DNA, 201 bp, Homo sapiens
gttggtggcattaaaatatcagggcaaaggattttgtgattcttttagattttccctggaagctaagatatagctgcttaaacaattatgttcatattctrtgttctagaaaagcaaaaggcaaagtgttgcaaacaagtttagtttatccctacatcccatcccctatcttatatgaagagcttttctctgcatttctac

SEQ ID NO: 40553 - DNA, 201 bp, Homo sapiens
aacttcaagttccattaatatcccaccgtaacacaagcctaccagctttctggcgatataagaaatatcttcccagtttttcctcaggtgctttacactcrttcctctcttctgcctgacacatcccaggaaattttttcatctctaaccactcaacttcagtctcaaatcatataactctatggaatatctttcatctcc

SEQ ID NO: 40554 - DNA, 201 bp, Homo sapiens
atatagctgcttaaacaattatgttcatattctgtgttctagaaaagcaaaaggcaaagtgttgcaaacaagtttagtttatccctacatcccatcccctrtcttatatgaagagcttttctctgcatttctacccaaggacttctacgtacatcttactgaccaacatcacatggttatccctagctgaaaagtaggctt

SEQ ID NO: 40555 - DNA, 201 bp, Homo sapiens
ttttgaaaatatatgattaaatgtattcttaaaccagttttcaggaagtttctttccatgtatatagtcccataattttcccagaaattattttaaattgktattttatttattattctgtctcagcatttatgcccggcttgcaaggatggaaccagggggtggttatgtggaatctgtagatccgtctttttcaatgat

SEQ ID NO: 40556 - DNA, 201 bp, Homo sapiens
agcaagaccgtgaacccaccggaaggaagaaactctggacacatctaaaggaacaaactctggacacaacatctttaagagtggtaacactcaccacgagkgtctgtggcttcgttcttgaagtcagtgagatcaagaacccaccagaaggaaccaattctggacacactcttacctatatgcatgaaggcagagaattgg

SEQ ID NO: 40557 - DNA, 201 bp, Homo sapiens
ccttgtgccatatacaaaacttaactcaaaatgaatcaaagacttaaacatagtgactaaaaatatagaactcttagaagaaaacatagagtgacacttcrtgacatcagatttggcaatgtgcatatgacaccaaaagcacaaaaaatggaaaaaaaaattggacttcatcaaaatttaaaacttctgtatatcagagga

SEQ ID NO: 40558 - DNA, 201 bp, Homo sapiens
cagatttcatattgttcaaacacacatgctctacaaacaatttgtgcagttaacacaatcatcacagggtcctgaggcgacatacatcctcctcagcttaygaagatgacgggattaagagactaaagtaaagacaggcataggaaatcacaagggtattgattggggaagtgataagtgcccatgaaatcttcacaattt

SEQ ID NO: 40559 - DNA, 201 bp, Homo sapiens
agaccgtgaacccaccggaaggaagaaactctggacacatctaaaggaacaaactctggacacaacatctttaagagtggtaacactcaccacgagtgtcygtggcttcgttcttgaagtcagtgagatcaagaacccaccagaaggaaccaattctggacacactcttacctatatgcatgaaggcagagaattgggatg

SEQ ID NO: 40560 - DNA, 201 bp, Homo sapiens
agttcttttctgtattccctaagtgtcagccggtctgagaaataaagggacagagtacaaaagagataaattttaaagctgggtgtccgggggagacatcmtgtcggcaggttctgtgatgccccctgagccgtaaaaccagcaagtttttattagtgattttcaaaaggggagggagtgtatgaatagggtatgggtcac

SEQ ID NO: 40561 - DNA, 201 bp, Homo sapiens
agcatgagccgaagcagggtgaggcattgcctcacccgggaagcacaaggggtcagggaattccgtttcctagtcaaagaaaggggtgacagacggcacckggaaaatcgggtcactcccaccctaatactgcgcttttccaatggtcttagcaaatagcacaccaggagattatatcccgcacctgtcttggagggtcct

SEQ ID NO: 40562 - DNA, 201 bp, Homo sapiens
tagatatcttcctaatgtatgagagaatcctggtgtattgggtgaaattcacccccgatatttcacataagttcttttctgtattccctaagtgtcagccrgtctgagaaataaagggacagagtacaaaagagataaattttaaagctgggtgtccgggggagacatcctgtcggcaggttctgtgatgccccctgagcc

SEQ ID NO: 40563 - DNA, 201 bp, Homo sapiens
tcctccaacttgtgtttaatatgtaaataaaccattcagctactggaatctcttgagatgacattgattctgtcatgtgttgccctgaaataagaggaaamtaagcattttcccaattgacccttcagcaatttctccaggctttttttttttttcaggagcccctttccaatttcccatcatttttcaataagatgtggg

SEQ ID NO: 40564 - DNA, 201 bp, Homo sapiens
acatgttacaatccaattaggtggattatagttttccttaaagcagaaataggcaagtcaggtctgttcaagaatatactctagtatctccccaaaatggstttagagtatctcagataaacccagataaagtctcatattttcagaaaatatttgcaatatctcatattaagggttaatttacatataagtaaatgtcta

SEQ ID NO: 40565 - DNA, 201 bp, Homo sapiens
ttccctggttcaagtgattctcctgcctcagcctcccaagtagctgggaccacaggcacacgccactgtgcccagctaatttttgtatttttggcagagaygggatttcaccatgttgaccaggatggtctccatctcttgacctagtgatccacccgccttggccttccaaagtgctgggattacagtcatgagccacca

SEQ ID NO: 40566 - DNA, 201 bp, Homo sapiens
tattcttgtacaaaaaaaactctcaaacttgttactgcacatgtcatactctctggattttgaatctctttgggtatttttctcatggaaatgattacttytaaagatcatcctgataattcaattttcttaagattgcaactgtttcaaaatagaaaagttagcgtagttgtgaaatttgtgaatggctttggaaagaat

SEQ ID NO: 40567 - DNA, 201 bp, Homo sapiens
ataacattatcctgaaataaagtcaaatatttaaaatataaatgcaaggcaaacaacttttctctactaacctctaagaagccagtgatcattagatactrtctagaaataggtgatatggagcactggaaatagagttgtcctgaatcacaagacaggacaaccccaatgtcctaaccccaatgctctcattaactagtt

SEQ ID NO: 40568 - DNA, 201 bp, Homo sapiens
ttgccttacacctgggtgtgattctctctaactctctttatgctacttttagctagtgcaacttgccataggaaaaaaatactgaaaacctaaaatgaccrtaagagcaacaaactttctgatttctgtcattcttttaaccaagataattttgaaggtagctatctatgtgtttggatacttggttcctaattagtgacg

SEQ ID NO: 40569 - DNA, 201 bp, Homo sapiens
aatatttgtctttgtcttcactaataatttttaccttgaaatttgttttcctaatattatctagtattatttgttagcatttgctcccaatggcaaaaccractttgttacgtctgattggaccgaagacagccagagagatggaaaagcttaacagaccttctagtttgcatttctttttcatttggcaaacaagaaaat

SEQ ID NO: 40570 - DNA, 201 bp, Homo sapiens
ggataaatctacttgattctttgtagatttatttatgactatttataataaaattatttatatactaaaagaattagtatataattccttttatacataaytcaattagttttgttaacattttcttaaaaatcttggcatttatgttcgtaagaaatattgatctgtaattttcctttctttcaatgtctttggttttgg

SEQ ID NO: 40571 - DNA, 201 bp, Homo sapiens
cttttgttttctattatacctttcataaaatatttgtctttgtcttcactaataatttttaccttgaaatttgttttcctaatattatctagtattatttrttagcatttgctcccaatggcaaaaccaactttgttacgtctgattggaccgaagacagccagagagatggaaaagcttaacagaccttctagtttgcat

SEQ ID NO: 40572 - DNA, 201 bp, Homo sapiens
tgccatgaataatccctactaattactaatcgcagttccatgacactgcattcctttgtgcacatgtgtgtgcacgcacacacacacacacacacacacactgcatccatttttggcaacatagaaaaggaatatttttaaagttgtgagtgcagacattttaggattgactcttattgggagaaaaatagttgtgcaaaa

SEQ ID NO: 40573 - DNA, 201 bp, Homo sapiens
atgccatgaataatccctactaattactaatcgcagttccatgacactgcattcctttgtgcacatgtgtgtgcacgcacacacacacacacacacacacactgcatccatttttggcaacatagaaaaggaatatttttaaagttgtgagtgcagacattttaggattgactcttattgggagaaaaatagttgtgcaaa

SEQ ID NO: 40574 - DNA, 201 bp, Homo sapiens
gagccatgattacatcactgcactccagcccgggggacagagcaagaccctgtctcaaaaaaaaaaaaaaaaaaaaagatgtgatgaatatgagagtgcakatatctcttccagctactttttattttcttcatgtataaacccaaatgcgggattgctggatcatatagtatttttatttttaatttttttgaggaaatg

SEQ ID NO: 40575 - DNA, 201 bp, Homo sapiens
tccagctactttttattttcttcatgtataaacccaaatgcgggattgctggatcatatagtatttttatttttaatttttttgaggaaatgccatgctgytttccatagctgtgacatcattttacatttatatcaatagtgtacaagcattccttttccttcacatcctcctcaatatttgtgatctttttttgtttat

SEQ ID NO: 40576 - DNA, 201 bp, Homo sapiens
ccacagttgaatgaaactaaatattaaatattagtagcagaagaaaaactggaaaattcacaagtatgttgaaattaaacaatatactcttgcataaacarcaagttaaagaataaatctaaagcaattgaaaatattttgagactaatgaaattgaaaacaaagcacaccaagctcatggaatgcagcaaaaccagtact

SEQ ID NO: 40577 - DNA, 201 bp, Homo sapiens
ttttaccaaaatgctgataatgatatggacaatgaaatccaggctgaggtggtctcagatggagatgaggaacttgttgggaactggagcaaaggtgactyttgttatgttttagcaaagagactggcagcattttgcccctgccctagagagatttgtggaactttgaactttagagacataatttagggtatctggcag

SEQ ID NO: 40578 - DNA, 201 bp, Homo sapiens
catgaacatacttgtgtagattaatttgttacaggacctaagcccaggcagcatgacctcagggaacagttggggaatatcttctttctctgaaggtagaytttgtagcctggtcctctgagggctatggttgatatcaggaagaggtgctgaatacaagttttacctattccatgatttcataagtgttcttctttagaa

SEQ ID NO: 40579 - DNA, 201 bp, Homo sapiens
gtgaattgatattagctttaggtattttgggttttatccttattaatcctcttaacttcagagctttgtccatcagtaatatactaaatgtactgtgtgtrcactattgaggcacagccaagaattgcagtggcagaactttagtgaataggaacagaaaaggtttgagaagcaaacttttccattgagagagacctacac

SEQ ID NO: 40580 - DNA, 201 bp, Homo sapiens
attaattaaaagacaatcattatatgttttacttgtaaaactgggtgagttatgatgcatagaagttagatcattgaattgatagaacttgtgctaggtargcatattcactcagtgcataattactgagcatctactatgtgccagaaacatatttgagaggccgaatcagcaggacatagtgattgattgattgaacat

SEQ ID NO: 40581 - DNA, 201 bp, Homo sapiens
gcagaacagcccacaccagagtagttattcatcacaggcccaggtgactctgcttttggagtcctgttttctaaatcccccagtatatgaaaaccacattyccatgaccaacccacatgtaatttctggaatttgtggtcagtcttagacattttctgcggggagctaagaaagattagatctgagttatgactggaaggt

SEQ ID NO: 40582 - DNA, 201 bp, Homo sapiens
agtcaacaaaagaggtagaaagtataatagagcttactaggtactagggggaaggaagaatgggaagctattgtttaatgagtacagaatttcagtttgakgtgctaaaaagttctggagatggatagttgcacagctatgtgaatgtacttaatgccactgagttttataaatggttaacttagcgaattttatatatat

SEQ ID NO: 40583 - DNA, 201 bp, Homo sapiens
aagagacccccaatcaggaagtttgatgtcaagcctcaacataccacacattactgctttcacacgtgtaaatcactagcaaaataactggtacttagtamgtgatcagatgtttgtcttctcttatttccaaacgatcagatattatgatggacactgtcatataggttatcatattttgtaatcctgatctgaggcttt

SEQ ID NO: 40584 - DNA, 201 bp, Homo sapiens
atacatgttattattgtcaatccgcatgcaatgtacaacaccaggagaatatctttctttctttctttccttttcttttttttttttttttttttttttttgagttggagtttccctgtgttgcccaggctggagtgcagcggcacaatcttggctcactgcaacctctgcctcccgggttcaagtgattctcctgtctca

SEQ ID NO: 40585 - DNA, 201 bp, Homo sapiens
tagcaaaataactggtacttagtaagtgatcagatgtttgtcttctcttatttccaaacgatcagatattatgatggacactgtcatataggttatcataytttgtaatcctgatctgaggctttctgtctcaggaataaaatgcagctgatacaagtcactttcattttcacaagagaatatcaatttacatcattagca

SEQ ID NO: 40586 - DNA, 201 bp, Homo sapiens
aacttatgtccacactagaacctccacatggatgttcatagaagctttattcataattgccaaaacatgaaagcaatcaagatgtccttcagtaggtgaakgaataaataaaccggggtatatccagacaatgggaatattactcaacacaaaaaaatgagctaccaagccatgaaaagacatggaagaaactgaaatgca

SEQ ID NO: 40587 - DNA, 201 bp, Homo sapiens
ggtaagggaaaattttcctccagtgtttggaaatcattaatgagatccttatcattttgtgtctcagatactagcgtaaaagggtctttttctaacttgasaaagcttgccctttctagtcttgtttcagctgcagggctggtcaacactggggagactggaggaaatttgtagaatctgggagccttcaaacaggagaag

SEQ ID NO: 40588 - DNA, 201 bp, Homo sapiens
cctgataaacctgaatgaccatcctacaagaagtaactcactgttgacatcaatttcgaataatttgtgactcacttctgtcaaaagccatgttgagatcrtttattcatttatgcattgactttctctctagaattcaaatcaagacctatttctgtatgttatatcaggtaggtgcaaatcaaaactctagtactttaa

SEQ ID NO: 40589 - DNA, 201 bp, Homo sapiens
ataaacaggtaaaagacacagaatagccaactcaatattgaaagagaagtacaacattggaggactgacattacctgccttcaggccttattgtaaagctrtaatgattgaaccagtatggtatttgaacaaaaaaggtaaatagataaatagtatagaatagagagcatagaaatagacccacataaagacagtcaacca

SEQ ID NO: 40590 - DNA, 201 bp, Homo sapiens
atttgtgactcacttctgtcaaaagccatgttgagatcatttattcatttatgcattgactttctctctagaattcaaatcaagacctatttctgtatgtyatatcaggtaggtgcaaatcaaaactctagtactttaactctctgcagacgataatctgatattgtaaaaaataaatagtcttatgaagaatgcttttgc

SEQ ID NO: 40591 - DNA, 201 bp, Homo sapiens
ttttgtattgtttaaaagttgtttatgtatttagaatgcaagttttttattatttatgggatttataaatatgttctctatttctatggcttgtttttctratctcttcagagtatcttgtccatggcagaacatttaatttcaatgaaatcaaacttattaaatttactatatatggattatgcttttatgacttagata

SEQ ID NO: 40592 - DNA, 201 bp, Homo sapiens
attgtaaatggaattatttcttaattccattttcagatttttttattgcagtgtattgaaatataatttgttatttgtgtgtgtgtgtatatatatatatwttttcttttttttttgagatggagtttcattctttttgccgaggctagagtgcaatggtgcaatctcggctcactgaaacttctgcctcccaggttcaag

SEQ ID NO: 40593 - DNA, 201 bp, Homo sapiens
ctattgtaaatggaattatttcttaattccattttcagatttttttattgcagtgtattgaaatataatttgttatttgtgtgtgtgtgtatatatatatwtattttcttttttttttgagatggagtttcattctttttgccgaggctagagtgcaatggtgcaatctcggctcactgaaacttctgcctcccaggttca

SEQ ID NO: 40594 - DNA, 201 bp, Homo sapiens
tttcagtctgcacttatttcattaaatttattcagtaaattttattatcaataaattttattctatttgatgctattgtaaatggaattatttcttaattycattttcagatttttttattgcagtgtattgaaatataatttgttatttgtgtgtgtgtgtatatatatatatattttcttttttttttgagatggagtt

SEQ ID NO: 40595 - DNA, 201 bp, Homo sapiens
cacaatcagaagaaatatactctacctctttgaatcctagcatttaggaggagctaaataaaagtaaatggcaattgtgtatggttgtaattactgggtcytatgggaacttatatgcagattgaattagtttaggattaaacattccaattttgagaagtgggcttctaaactatgaactaaagagaatttgggggttaa

SEQ ID NO: 40596 - DNA, 201 bp, Homo sapiens
ttcctaatagaagtatagactcgaagggcattttgttatgaatattcttcctaatctaaaatgcatttagagttgccactccctatcactcagccccctcycagccctaaggtggagacagaaaattcaaatgcttacagtaggttaccaagaagtaatgagtgaaagaaagggctcaggagcatgaggctgtgctgaaat

SEQ ID NO: 40597 - DNA, 201 bp, Homo sapiens
aaatcaaaggaacaagaataagttatatactcatttaaaagattaggttaatcattagtgctgtctatccaatattttattttctcctcttggttgaggtsatgagtggtcgtgtgacgtgttttgttaatgaaatgtgaaagtgacatttgtgactcctggctagaagatttaagagccaataaataattcaccacactc

SEQ ID NO: 40598 - DNA, 201 bp, Homo sapiens
cctcagtcacctgccttaagccgcctaatatttaaaaattgagattctttaagcaagagagaagggataagaaattatcgaatagatgacaaacaatctcytacaatatatttactactaaaggaggatagaaatttcaatcaaatactaattataccatttatgcctcactaaatttactgatcaaatgtaattttcagg

SEQ ID NO: 40599 - DNA, 201 bp, Homo sapiens
attatctataaatggaagatgtgagattaaaataattttctccattcctggcattgaaagttctaaaaaccaaaggggagagttcttttatttgtttcatrcatgtaggtaatttgatggtgaatggaagaggctagttaaccagacatactgcaggagtggttattttatggcttttataggatgaaaataactttaaaa

SEQ ID NO: 40600 - DNA, 201 bp, Homo sapiens
catagtcatccctttcagttcctcagtcacctgccttaagccgcctaatatttaaaaattgagattctttaagcaagagagaagggataagaaattatcgmatagatgacaaacaatctcttacaatatatttactactaaaggaggatagaaatttcaatcaaatactaattataccatttatgcctcactaaatttact

SEQ ID NO: 40601 - DNA, 201 bp, Homo sapiens
agtagcactacctctagactaagtctaatgccctgaagttcagatacaaactaatatgccagtgggattgatgtcaaagtgatagaattgcagaatagatyttagtgacaatttttcaggctagttctaattgattgagtagaattccaccactgcagttctgttgctgatgattattgttaaaaatgactgaaaacaaaa

SEQ ID NO: 40602 - DNA, 201 bp, Homo sapiens
tacccaaagttcttttgttgtcgtttgtttgtttgtttgtttgagacaagtctcaccctctgtcacccaggctggagtgcagtgacgtgatctaggctcayggcaacctctgcctcctggattcaagagattctcctgcctcagtctcccaagtagctgggattacaggtgcctgccaccacgcatggctaatttttgtat

SEQ ID NO: 40603 - DNA, 201 bp, Homo sapiens
agcatagtcatccctttcagttcctcagtcacctgccttaagccgcctaatatttaaaaattgagattctttaagcaagagagaagggataagaaattatygaatagatgacaaacaatctcttacaatatatttactactaaaggaggatagaaatttcaatcaaatactaattataccatttatgcctcactaaattta

SEQ ID NO: 40604 - DNA, 201 bp, Homo sapiens
tatttaatgaagcatacattattaaagcccactgtaagacgaaatttttgttctctatcttttgatagaggctactaattcttgtctcaaactggctaaayattctttcatttccaaacagtagcactacctctagactaagtctaatgccctgaagttcagatacaaactaatatgccagtgggattgatgtcaaagtga

SEQ ID NO: 40605 - DNA, 201 bp, Homo sapiens
atgaataaaggtacagtgctcattcctgtgttccaggaatactgtagaaaggaaatctagataggtaagttggcaggagcatgagatgggatagaggcagytgaacagccttaaatatttgattatcaggctgcacgggttagacttcctcttgtatagctggcagtaacatatctggagaactgtggtagcttctcacca

SEQ ID NO: 40606 - DNA, 201 bp, Homo sapiens
agtcaagagttggatagttggaattatggctcagcacatttgcaaggatacggaggtcaagacaggagaaagaactacaattaggtgaagggtacctggaygccagtgtacaggtggaggaggagtagaaacataagcagagttaaaatttttaagagtcttcatgcatgtcaaagaaacatgaccttgctaaatggcgag

SEQ ID NO: 40607 - DNA, 201 bp, Homo sapiens
aaaagtaggactaaacacaaagcagaaaatgaaatattaaaaaagtatgtgggtaataatttgaaaaacaagaagttctggggaattcaaaaaaacaaacrggaatgaggaggacagtggccgaagaatttggtctgaacatgcctgttccttggtggtgacacatctgaggtgtcccgctatactaataatacaggagga

SEQ ID NO: 40608 - DNA, 201 bp, Homo sapiens
attggattggaatatagtaaagcaatacttggttagatttcatgtgatttaccttctgaatgaagtggaaatatgttaatgtgcaatatataaaacataartcacagaaaacaaccaatactgagatttgtattttgttctgacaaaattttatatccagggctgttttcacttcccctaatatgtttttaatttttttta

SEQ ID NO: 40609 - DNA, 201 bp, Homo sapiens
ttacaatttcaattggccttagatgtaaataaagatatataacccaaaccaagctaattagagttggagctaatttccaggttattaaactaaatgagagkttgactcaaaaacctttgggcctcttcatagtcattgacattgttaatgaaacatttcaggataatttttaattaattgaattatttattatttatctgc

SEQ ID NO: 40610 - DNA, 201 bp, Homo sapiens
aatagtctgtctaataatcagcacgtgaattagaatcacaccattcaatataacatctactgaaaaagagaactttcctaacatctttaacgtggatccayggggaggaggtttccaatgcagctagcatttgcgctataaactctctttctggatctcaatctccagaactagaagatgaaaggagtggatgaatgcatg

SEQ ID NO: 40611 - DNA, 201 bp, Homo sapiens
ttggaaactagagacatgggaatgcaccatgatttttggaacaggatagcatattgctgaaggagctgtgaagtgctgatagcttcccaggagagagataatagaacttactgtattatggatgtcaataacacaagtatatttaagagacagcctgaatggaggaatttctaatacaaataagatgacagtattcacaag

SEQ ID NO: 40612 - DNA, 201 bp, Homo sapiens
gttaataatactaaaaaatatacatagataggcagcttaatatattggaaagagctctgaaatggaaaccaagacttgtggctttgccattaaactaattrttgccttgaggtcaccctgaaatcctctactttcttgtttgtaaagtagggaaataattctatccacataggttgttgggggattaaattggatagtggg

SEQ ID NO: 40613 - DNA, 201 bp, Homo sapiens
aactcctgacctcgtgattcgcctgccttggcctcccaaagtgctgggattacaggcatgagccactgtgcctggcccgatattatgatctttaaagactygatattatataaacacaatgaattaatttttcagtgcagttttaaatctcagaaaatatctgctgactagagtaattgcctaattgtcattaataagctt

SEQ ID NO: 40614 - DNA, 201 bp, Homo sapiens
gactggaaaaaaaaagaaagaaaacaaggcagcagggcaatgattgatagacagggcttcacctgtcagaaagggctggaggtgctatttctgagtgagcrttttcaattctagaaagaacttaatgcctgagttcctcctttgaaagtgcctatatagaaatggagtatctggagactgtatgtatgttgtatatgtaat

SEQ ID NO: 40615 - DNA, 201 bp, Homo sapiens
aaattcgtgaccttatgcctgacttccctggtgtacttcctatagacagcaaacacattattcattcagttaaggtctcccctttgccttgtaaccccttrgcactctatactttgtcctaataagtgctcagtaaatattagttgccactagtaatttgcctttctgcatactaagcagaatccttccttggggatcttc

SEQ ID NO: 40616 - DNA, 201 bp, Homo sapiens
ttaaaaaatgcccccactctgagaaattagaaggaatctctacttttctcttcagtatctgaaacttacacaacctgtagttcccagctcaaataaattcrtgaccttatgcctgacttccctggtgtacttcctatagacagcaaacacattattcattcagttaaggtctcccctttgccttgtaaccccttagcactc

SEQ ID NO: 40617 - DNA, 201 bp, Homo sapiens
atagtttgtttggggggtgtttcagaaaggagagcacatataattaggacaggcaaagtctctattggttctatcatgatccgatgtcaataccacaagtwtgaaggtggtaaaaaatatagggaagtgactgtaaaacacctgaaattacccactaaacacaaactaaatgtatcctcaactcaacttccccttagctgg

SEQ ID NO: 40618 - DNA, 201 bp, Homo sapiens
gttggtaaatcggtattagtgtttttccattatttgcatttattaatgtatttgccgtatctccacaattacaatcaaataactttgagtcaaggtactamcaatgttttgttttgtcttttccatctatttagaaagctaacacaagagtaaactgaaaagatataactacgcagtcccagtctaacatcccgttaaaat

SEQ ID NO: 40619 - DNA, 201 bp, Homo sapiens
ttataaacactgctggcagtatttctttaagattccagatattctaaagtctagtgttgattgtaggttatagtgatttaagaaaggttatacaaattccyttaccacatgcctcaaaatgcttatgtaaaaagaggaattaaagtatggatgttgataaaaaatgaaattatttttgagggaagaagaagtaagttaaaa

SEQ ID NO: 40620 - DNA, 201 bp, Homo sapiens
tctgaaccaatctagcttttgcaaacaaaatgtgctgctactttcagtctgttctctggactatagatttataaaattctactttggctgtagaaagccartgatttaacattttgttttcactgaattttgtttgttttctactttccctggggcaatagatttgacctttaaattctggctttaactgttgaaaactgg

SEQ ID NO: 40621 - DNA, 201 bp, Homo sapiens
attctcaagctagtttttgcttagatctttctgtgggatattatttaatttggaaaccaatcatcatagtcaaactcctgacaaacaaattctgtaagtasatagataagcaacaattaactcacacactaatgcattctatttgctttttagtttcatgtatgttgggtaaatgggaaagaaaaattactgtattcttgt

SEQ ID NO: 40622 - DNA, 201 bp, Homo sapiens
aattttgactattgtattgggcggaataaaagacaataaaatacaaagtgctttattttctggttactagattgtgaatcctttgcagacagggactgtastttatcttttatatcgtctacattttctaacatatattaagactttggaaagaagagacagaagaaaggatttaggaggtaaagaggaagaagggacttt

SEQ ID NO: 40623 - DNA, 201 bp, Homo sapiens
atctgtaaataatgtatgtaattgaatatttttattcctattttagaagctgaacagtgcttatttaaggtctaaaatggacttgacactgaatgtagaakgtttgaagaacatcctttattgttactattgatgaaccaatactgatacattattattatgtaaatcctaccgtttacagtaggcttcaccttgtgttgt

SEQ ID NO: 40624 - DNA, 201 bp, Homo sapiens
tccgtctcaaaaaaaaaaaaagaaaaagaaaaaaagacataactattatcaacagaagcaacaataacaaaaattaatccttactagcgcttgttatataycggaaaatgttttaagttctttatatattttactttatttaatctttataataattgtagcaatctctgttgttttaccacaactttgcaaattaaaacc

SEQ ID NO: 40625 - DNA, 201 bp, Homo sapiens
tgggactatttgtggtttgttttgggaagggtgatttgaaagccgagaaaaattgtctgctaattcatacaagaggacttaagaatcttcctttgccaacytttcagactttaaaggctttctcaagaagaaaggattttgctttagcaacaattcctagggacatttatagaagaggtatttgcctacatataaaaatgc

SEQ ID NO: 40626 - DNA, 201 bp, Homo sapiens
tctgtgcaaatattgggactatttgtggtttgttttgggaagggtgatttgaaagccgagaaaaattgtctgctaattcatacaagaggacttaagaatcytcctttgccaacctttcagactttaaaggctttctcaagaagaaaggattttgctttagcaacaattcctagggacatttatagaagaggtatttgccta

SEQ ID NO: 40627 - DNA, 201 bp, Homo sapiens
tcttagcctgaggcaggtgtgccaaagccacaatttaaaaaactggatgataaataaaactaatcagtcaaaggggaaagatcagaaagactgaaaattcrccaagcaactgcaactcagcttcaacagaaatcaaggggccatgttcattcaattaggaaagataggaaacagcaataattcagctattgaccaaaagag

SEQ ID NO: 40628 - DNA, 201 bp, Homo sapiens
tcctcttcagctttgcagtaagattgttttatttccaggcaccttaccacagtcaggttaaggaagacatggcaaggatgctgatgtccttttgatagggraagcaaaagctttaccgtctcattggccagaattctttcacatgccattctgagttgcaaagaaggctgggaaatcaaatgtcctgcctccatagcagag

SEQ ID NO: 40629 - DNA, 201 bp, Homo sapiens
ttattctgaggggaaaaaataaataaaaacttagtaaaatttaccaggttatcagcaactcatttattcttaattttatctgtacatttgcattctatctrtgcatttgcatttattgtactttatttgtttagggtttcttttctgctatatgtgtcatatacctctagggggttattttaaacagtactgggatttgct

SEQ ID NO: 40630 - DNA, 201 bp, Homo sapiens
caactcacggtacataatgcaatgatgtacacatgtggaaaaagtaagtatgtcattggaaaaataaatggtctagcattgtttacccatgtacattatgrcatttatcatgttccttggagtcatttctttagttgcttatttctacgactagactgtgagttcttttaaagcaaagacagtgagttatttatcttgaaa

SEQ ID NO: 40631 - DNA, 201 bp, Homo sapiens
tgttacctttcttcctgattttattatcactggcctcattacagtacgtccactggtttctcctactgtgatccttattatatggttgtgtgttctatgcrttactgtctttcatcatgtttgagtcctggcaagaatttcttctaaatacaataccatagatacattacactgatcccatgcaatcgttgtaactgctgg

SEQ ID NO: 40632 - DNA, 201 bp, Homo sapiens
aacatgattaaattcactacatataactattcattgaaaatataatgatattaggtcttatacagcaatgttttttagatgacagcatagatctgtatagwaggataaggaacaaaggaattttgcattttggctttgatagctgatgacagagtaagtgtgagaaaaatagtccagttcttatttagttcctttaatgtg

SEQ ID NO: 40633 - DNA, 201 bp, Homo sapiens
ttctcacacatgccaatatcgacagcttgaagtgcttagtgtgggtatattgatttcatttgccattaggcccctcagtcaataacccatttataatataygctcttcaaagctatccactggggcaaaagagcttgacaaagagaatatttaagttacataaaaagcaaatgataaaaattactaattatctcatgttcc

SEQ ID NO: 40634 - DNA, 201 bp, Homo sapiens
ttgcaaaacacattacataattagcataagagttaattgaacataatcacttatccatctagatacaaaaaaatgaggcagaacttattgatttatgtttkggcatagacaatattgagcagcttattgtgacattaatagactatcaggctcagttatttttatttttattatttatttatttttttatatggggtttca

SEQ ID NO: 40635 - DNA, 201 bp, Homo sapiens
tagaacaagtaccttggacaggaaaaagcttttcaatgaacataaaaacccccacagtattttgtattccattcttattctttgtggtggtgatgaaaaasagtgcctaaaaatgaagagatgaaagaatctcaatcatcacttcttcatcaaaccactgagttatgtttcatgcccattctaaatgatggtcctcaaaag

SEQ ID NO: 40636 - DNA, 201 bp, Homo sapiens
gatttaaagataaatgttatgtacttccatgtcctagaacctataatgtgatttgtttatggttcttctttgccttattgatatgtgtattgagacccagrttttaaaatttaaaaatgttttgttatgaaatagtcttaatctaaatgtctttaaatggtttggggcctataagggtgactgagtacttctatttgctct

SEQ ID NO: 40637 - DNA, 201 bp, Homo sapiens
agtagagagagaagtgagctaagaaatattaaatattgccaaatattatcaaaatggtagaatgatcgagattgaaagagttgaaaattataggtacgtgraaatatctgtggtctggaagctctgcatgggttgtaaaactaatgtcatttggtcttttagtttcacgcagcctagttgttccttgcttatggtcaagaa

SEQ ID NO: 40638 - DNA, 201 bp, Homo sapiens
tgcatttgagatccttatagcacatctaagtgtaaatttccaaaaggcaattggaaatatgataataatggaacccaaatgtcagagctgaagatgtggawttcttcagcgtatgaatgttcattggagttgtagacactgtccaacaaataatgtataattttattggcccaaatgagagtaatagggacttcaagacag

SEQ ID NO: 40639 - DNA, 201 bp, Homo sapiens
atatacatctaatctgtggtgctctatagcagatctgtggatgcctgatacctggggtgggaaggatcttgactgataataggcttaaggaaaccagttgwcataaatagaacactgatgtaacaatactagaattcacattcctttctagtgtacctaaagcatatgatatttgattatacgtcataaacaaagcatcca

SEQ ID NO: 40640 - DNA, 201 bp, Homo sapiens
tatgtaattaagcattcaagaatgagaaataattgatcttataaatgtgatttgattgaaagaaaacagttatgcaggttaccaattgaaaaatttcacayatatgttatatatttaacatgtatgtaatctattatatatttagtatctattatatattatataatacatctagcatacattacatattaatatataaga

SEQ ID NO: 40641 - DNA, 201 bp, Homo sapiens
tattgaaccaggaactccatgggtggggccttaatgggcctttctggtgattctgatgcatggtaaagtttgaaaactactgtgttataataaagtttacygagcaatgaatttactgtttgcacaggactacagccttgtaaaacttcagagaaaacacaatgcatataaaatgcaatgagaaaatgcaatcagggaaga

SEQ ID NO: 40642 - DNA, 201 bp, Homo sapiens
atagcattattcatgataactttcttcgagttaatacggatatgttctgaaattctaaaattaaaatatattcattttctttttcttttctttttgagatkgagtctctctctgttgcccaggctggagtgcagtggcgcgatctcggctcactgcaagctccgcctcccagattcaccccattctcctgtctcagcctcc

SEQ ID NO: 40643 - DNA, 201 bp, Homo sapiens
cttcataattctcaagagtattttagaatattaggcacaattccctcagcattcattaaaatagcattattcatgataactttcttcgagttaatacggayatgttctgaaattctaaaattaaaatatattcattttctttttcttttctttttgagatggagtctctctctgttgcccaggctggagtgcagtggcgcg

SEQ ID NO: 40644 - DNA, 201 bp, Homo sapiens
ccagacctagctctgaagtacattactcacatgtttttttttaaaaaatgatattccataatgtgatggatgtatttctcaaaaagagttttgattaaatrtagaagaaaatccctgaaggctttttcctatataaacctgcagtgcagattgagggcagagtccagtgcatatacagagtgttatgcagcaaaacataca

SEQ ID NO: 40645 - DNA, 201 bp, Homo sapiens
taatattttgatatacattaattttttttcttttcttgcatctaatatctgttttgaatttttttttttgagttctccccctgtcacccagactgaagtgyggtggtgtgatcatagctcactgaagcctcaaactcctgggctccagtgatcctctcaccccagcctcctgagtagctgggactacaggtgtgcaccacc

SEQ ID NO: 40646 - DNA, 201 bp, Homo sapiens
ataggaattatataataattgggaacagaatttaatattttgatatacattaattttttttcttttcttgcatctaatatctgttttgaatttttttttttgagttctccccctgtcacccagactgaagtgcggtggtgtgatcatagctcactgaagcctcaaactcctgggctccagtgatcctctcaccccagcctc

SEQ ID NO: 40647 - DNA, 201 bp, Homo sapiens
aaataaactgagttgttctgtgatgttgactgtagcctttatataaactttatctaatatcacttgctctcagactctcaaattcaaccaaactccctcayagatatctgagctattttggagaggcaaaattctacatatgagaagggcccttctacaaaaactaagggcagagaagccaagattcttattgaagttggt

SEQ ID NO: 40648 - DNA, 201 bp, Homo sapiens
agaatttttaatttttattttacttatctcatagatctacttaaatcacataaacaaaatcataaagcatattttatatattatatatatatatatatatwttttcaaaactgacttccagatggttaggtgctacgatccttagatttatttcaactggctgttctaaataaactgagttgttctgtgatgttgactgta

SEQ ID NO: 40649 - DNA, 201 bp, Homo sapiens
ataggtagatgtagagatagacatatagtttgtctaggtatgtatgcctgtttgtgtgtatatgtttgcttagattcatattcagatttttttttttttttaagacagagtctcctctgtcaaccaggctggagtgcagtggtgcgatcttggctcactgtaacctccgcctcccgggtttaagcgattctcctgcttcag

SEQ ID NO: 40650 - DNA, 201 bp, Homo sapiens
ctgatcctaccacttctctaagcagctttccctggcaactccaatgccatggtggttgaggaatttcatcctgccagtattccagaggcccaatgtgagartaggttgctgcttgcctgtaccttaatagaagttttttgtttgtttttgttttttgagacagagtttcactcttattgcccaggctggagtgcaatggca

SEQ ID NO: 40651 - DNA, 201 bp, Homo sapiens
tgagacagagtcttgctctgtcgctctgttgcccaggctggagtgcaatggcacaatcttggctcgctgcaagccaagtgcaatggcacaatcttggctcygcctcccgggatcaagcgattctcccgcctcagtctcccgagtagctgggattacaggcacgcgccgccacgcccagctgacttttgtatttttagtaga

SEQ ID NO: 40652 - DNA, 201 bp, Homo sapiens
aggttacatttggtacaacggttacatttttggacaaagatgaattcaccccaatgtatatggatctttttaggaggtttctcaaccaccacctatctctyaaccacactttgaaagtagagtttagtcagcatatatttgccttgtggctgagatatattgaagaaagtgctggcatgaagattttctttgagatggaat

SEQ ID NO: 40653 - DNA, 201 bp, Homo sapiens
tccacacttcaaattctttatctgtcatttccaagtttccactttgctggggaccatagctggagaactagtatggtatgttgatggtatcactacatttwgaattttcatggtgctagaattcttacactggttctttctcatcttgaagcattgatacttcaaatttttgtaattatatttgtgcagatataatttttc

SEQ ID NO: 40654 - DNA, 201 bp, Homo sapiens
aagatagaaggatactgaagagaatatttgtctactttataattttaacaagaccttgtgtgccaatgagaatgattaggtgccccttctgtcatgtggtygaggttttgtgactaaaatatgacatatactctatgaaaataaataaatggtttaatgaactataattttatagttgaaggagagaaaaaaggccaccat

SEQ ID NO: 40655 - DNA, 201 bp, Homo sapiens
tggcctgctcatatagaaaaagattagtatgaagaactctccaattgaaaaatatctctccattccagtgtataaattatatattcatttcagctaggttytatacactgttcttttaaaatgtttaatgtactcattagacatctgaattacagtcattgacattttagtgtgaatttctttaatccaaacattgattgc

SEQ ID NO: 40656 - DNA, 201 bp, Homo sapiens
gaatctcacaagtgtaatattgactaaaataagcaagaaataaagctgctgtttttgtaaatttcagaaagaaataaaattatactgtttagaaagggacrtttatgcagtaacattaaaaagaaaaattagcatataagggtgtgtaatttatgataatattcttttccacaacttgggtattggttataattatttgta

SEQ ID NO: 40657 - DNA, 201 bp, Homo sapiens
tcaaatattctagttcaacttaagccatcaggattctgtcaagaaaatgagatatgtgtggttgtggcctgctcatatagaaaaagattagtatgaagaaytctccaattgaaaaatatctctccattccagtgtataaattatatattcatttcagctaggttttatacactgttcttttaaaatgtttaatgtactcat

SEQ ID NO: 40658 - DNA, 201 bp, Homo sapiens
ggcagatcacgaggtcaggagatgcagagcatcctggctaacaaggtgaaaccctatctctactaaaaaatacaaaaaattagctgggcgtggtggcgggygcctgtactgtagtcccacctacttgggaggctgaggtaggagaatggcgtcaacccgggaaccggagcttgcagtgagcggagattgcgccactgtgct

SEQ ID NO: 40659 - DNA, 201 bp, Homo sapiens
taaaatttaatacatatatagatatgcacacatatctataattgtgcttatttcaatagatatatactgctatgaaatttataatatttagttgctataataacaaattttgtcatgaaaacttttaaaatatatagaaaaatatattattcatctcacattcattctgcatgaagaagtgttaccgaatactcaatagta

SEQ ID NO: 40660 - DNA, 201 bp, Homo sapiens
gagagatatgtagaatacccagaaaatgtcaatagaagtggacttgatagaaaaataatttggctgataggataactccagaaatttaataattttgtttyggtatactgtacctattagcaaaaaagtatgccaatgctctttgaagttatttcaaatattctagttcaacttaagccatcaggattctgtcaagaaaat

SEQ ID NO: 40661 - DNA, 201 bp, Homo sapiens
attttttttttttgggaacagttagaaaattctctgtagaattagattgaagaggatgagatgaggtgaagtgaaaattcagaaggcatgttaagtagacmaaaaacatgaagcaaagttagagcaatctaaattctcaaatcccaaaatttctctttgaccacttctcattgctcagactttcccaggaatttcccattg

SEQ ID NO: 40662 - DNA, 201 bp, Homo sapiens
ctattgtatagttatggtctcactgccatcagagtatatccgttgagttctggatttcccaaagcatttccaatttaaaattccacaaaatcagacttgayaatagatgtcatattcatcatactgcaccactatgtttggctatatttattttattatgattatattatctctcctggtttccccacagtaactattgaa

SEQ ID NO: 40663 - DNA, 201 bp, Homo sapiens
gacctaactattaaaactataaaaatattatcgatcctgtcttgttttgtgtttaatacataaactaaatgtctctttagtaatttcagctagaagacaawgtgacctattgtatagttatggtctcactgccatcagagtatatccgttgagttctggatttcccaaagcatttccaatttaaaattccacaaaatcaga

SEQ ID NO: 40664 - DNA, 201 bp, Homo sapiens
tcagaagttaaccaggttaaaggtagaaacaggaaggttcaggaagagggaaaggcatacaagaagtcccatggatgatgaaatgagagcatggacgctakcaagaggaggctagagaaacagatgaggaaggccatgactggtgaagtccttgtactatgggtgtggcctggaagattctcactggcccagaaagggaaa

SEQ ID NO: 40665 - DNA, 201 bp, Homo sapiens
gtttattgcttgcttttagcacagattacttaatcagaataacagtggagcaagccaggccactgaaggagtagaaaacgcaactggtagggagagagaaytgggaaaggtctagggcacttggtgcttcctgagtatggagatttcccagagcagaactggcagtatcagaacactctaaaagacttccttaggagaaaa

SEQ ID NO: 40666 - DNA, 201 bp, Homo sapiens
tttctgtgcctggcttatttcacttaacataatgacctcaagttccatacatgttactgtgaatgacatgattttcttttatggctgaataatattccatygtgtatatatacgacattttttttatccattcgtctgttgatggacacttaggttggttccttgcctaatatattttatgtgtccttgataaccttcttt

SEQ ID NO: 40667 - DNA, 201 bp, Homo sapiens
gaagttcttttgcctgataaacctgaatgaccatcctacaagaagtaactcactgttgacatcaatttcgaataatttgtgactcacttctgtcaaaagcyatgttgagatcatttattcatttatgcattgactttctctctagaattcaaatcaagacctatttctgtatgttatatcaggtaggtgcaaatcaaaact

SEQ ID NO: 40668 - DNA, 201 bp, Homo sapiens
ctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaacactatgcatttaggtatcaagcatatatata

SEQ ID NO: 40669 - DNA, 201 bp, Homo sapiens
ctctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaacactatgcatttaggtatcaagcatatata

SEQ ID NO: 40670 - DNA, 201 bp, Homo sapiens
agcagcagcagatggatcgggtttaatcaaggagctgacaatggcttttgttttgctcaatataaaccaggtaaggaagccctgagaggcaagtagacagyctttccagcagaaaactgtgggaatcttatgcttgggaagctgtagcgttgtttaacccccatttgaaagagtgggaatgtcagagagaatcacacaaga

SEQ ID NO: 40671 - DNA, 201 bp, Homo sapiens
tgtttctctactattgttgctatatatatatctaccattgtgtgtgtgtgtgtgtgtgtgtgtatatatatatatatatgtatgtatgtatgtatgtatcyaccattgtgtgtgtgtgtgtgtataaatatatatatatatatatcaggcaatatgctctagctaaggctatagaacactatgcatttaggtatcaagcat

SEQ ID NO: 40672 - DNA, 201 bp, Homo sapiens
cagtccaaccatttaccttctgtgtttctctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaacac

SEQ ID NO: 40673 - DNA, 201 bp, Homo sapiens
tcagtccaaccatttaccttctgtgtttctctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaaca

SEQ ID NO: 40674 - DNA, 201 bp, Homo sapiens
atcagtccaaccatttaccttctgtgtttctctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaac

SEQ ID NO: 40675 - DNA, 201 bp, Homo sapiens
aatcagtccaaccatttaccttctgtgtttctctactattgttgctatatatatatctaccattgtgtgtgtgtgtgtgtgtgtgtgtatatatatatatatatgtatgtatgtatgtatgtatctaccattgtgtgtgtgtgtgtgtataaatatatatatatatatatcaggcaatatgctctagctaaggctatagaa

SEQ ID NO: 40676 - DNA, 201 bp, Homo sapiens
tgttgtgacacaaaagatttactctcattgtgaagcggggattatgctcagctgaaagactatatttttgttatgtcagagatacaaggaaacacatgaarttagtaccaccattcttttattccctgccatctgtgtcaacctaacaaaatacaagctccaggagtcacccatattcattaatgaacttatcattatact

SEQ ID NO: 40677 - DNA, 201 bp, Homo sapiens
gaaggcaggagagccccgtaccgcgcacacgctcagctcacttctgcagactgtcattctgaaagctgctcggactgttgctttggtttcagtgaatgcartcttatgtaaagctgcccccagtggtgaagaacattatgggcatgtgcagaaatgtctctcttttatcttgcaaatgagcaggctctctgctggaaaatg

SEQ ID NO: 40678 - DNA, 201 bp, Homo sapiens
ggttcaggaagagggaaaggcatacaagaagtcccatggatgatgaaatgagagcatggacgctatcaagaggaggctagagaaacagatgaggaaggccrtgactggtgaagtccttgtactatgggtgtggcctggaagattctcactggcccagaaagggaaaaaaaggaaccttttaggcaggagttaggttttata

SEQ ID NO: 40679 - DNA, 201 bp, Homo sapiens
atattaacatgtctttcttaattttcaaacactgttagcaaataggacattattattttcaaattgacagaagaaattgaagttgagagaagctaaatatktgttgaatgttgaaattcaaattaatctaatcacagctttgccagttacatattatgccatcttgggtaattcacttcactctttagatctctatactct

SEQ ID NO: 40680 - DNA, 201 bp, Homo sapiens
ggcatttacaattagcaaaatgaaagaagtgggttttcattggtgaaattagtggcctgttaattagtataatggattttagaagtgggctctcactggtraaataagtggaattcaaggtatatagattagttagactatcgcaaagatagccttgcctaggctttatctctaactcatctatgtccatgcatgagggag

SEQ ID NO: 40681 - DNA, 201 bp, Homo sapiens
aacataacttgctttatattatttttcttaatattctggtctatactttaagaatcaatgattttaccaaagatgtgaggaaaaaatgtgaacacaggacrcattatttactcaaggcctactttatgccagaaaaataattttaggcatattaacatgtctttcttaattttcaaacactgttagcaaataggacattat

SEQ ID NO: 40682 - DNA, 201 bp, Homo sapiens
tgacttcaagaatatattggattttttcactttaaaaagtttagaaggaaaaatatcactgttgaattctacttcttggttatttcaaattatttcaaatrggaagccccctgtaaaagtgtccagacttactataaatgcattatagttctcatctattggtttataaataaaagcatccttgaacgttttccaaaagag

SEQ ID NO: 40683 - DNA, 201 bp, Homo sapiens
atgtttttcattcctcacgtttttgtttcctgtcttactcagcttagatttcatgttctattgtgataattactcttgtacttggatccacaattttgccrtaggaaacttctaggcccaaagttataccctttcaagtgatggctttcatcagcgactgacggagatggggataggtcatctccttgccccaatttggta

SEQ ID NO: 40684 - DNA, 201 bp, Homo sapiens
ctctcttttaagatgctattttctgaccaccactttattatctttctgattatgtattctctaatccttcatgccaaattagctttttatcttgctggaayatcgaatgcatgtttttcattcctcacgtttttgtttcctgtcttactcagcttagatttcatgttctattgtgataattactcttgtacttggatccac

SEQ ID NO: 40685 - DNA, 201 bp, Homo sapiens
ataataaattgtttgaagagggaagattatccatgaggctagttgagaaatccaaaacaaaataatgtgattctaagccacactgaatacttgaggctgcrgaagttactgcaaagacatagagtagtccctcaagagaaaaagaaaagactgtgttctaaaagattttagtaatttgcctgtatactttttaaaagtttt

SEQ ID NO: 40686 - DNA, 201 bp, Homo sapiens
caactgacattcactcttgctttgcagataagaaaataattacgtaagagtttaacaaaagtaatcatgaaacttcattttttcattgtttttcttctctwatactagactttttcttttagcataaagagttagtaggctagtgatattttgaaactgaatcacatactcaaagaaagagggcattactactgagaaaga

SEQ ID NO: 40687 - DNA, 201 bp, Homo sapiens
aatttatctgtgaagatttaatgcacagaaaatattgtcctatattcttttctgtatctccccatttgatattttaaaagtcttttttggcaaacaaagtkgtacctattgttgattgtggatatttaaacgtgggaaattgtgatcagacataaatctctcaaggaaagaccttgtgtcctctctgttattaagaatcca

SEQ ID NO: 40688 - DNA, 201 bp, Homo sapiens
ctgagaataatatctcaaatgacatttaaatgttttgctctgtgagattggattagcagatttactatttttttattttaaagctttttattatgttgtcrtattattgaataactaccttccatatggtccaataataattaagatgttggattgatagattgaatcagcaagaggcttaaagcaagtgaggcttaacct

SEQ ID NO: 40689 - DNA, 201 bp, Homo sapiens
ctgcacttgtccttcatagcactgtggcagctgcagtttcaggtttgtttgcgtgaaccttggctaaagtatttcttcctactagactgtaagccaaatgraggcagaagtaggaatagtgtctgtttctggttccctagcatggattccagcacagagttttacatatttgttgaatgaataacataaatgaacgaataa

SEQ ID NO: 40690 - DNA, 201 bp, Homo sapiens
ttagattgtgtaggataatgtatgctattgtaaattcccaagttttgcagtaaatttaacattacaataaaatattgtccattaatagccgtagcaaaacrtccgttggtatagtttactgcatcattgcgtttttgcaaatctgaagtggagaataggatagtaatgactagcatcagaaattgttgctaatttcctaat

SEQ ID NO: 40691 - DNA, 201 bp, Homo sapiens
taaaaaaaaattctcagctgaaacatggcctaggtgcttggccaagctgggtggtacgatgtttccttgggatactgccatggtaaatcctataaaaattktaaacccttttaattggaattatcaaatgttaacctgacagtagtatgttagaagtgaatatagtgttgtgaaatattagtagtcttggtttttaaatca

SEQ ID NO: 40692 - DNA, 201 bp, Homo sapiens
tcattatgaaatatatgaatacatatatgattaaataatgttatgtttataaatacatttaaattttaactatatataattaatttaatatatatatatakatagatagatagatagatagatagggcctcactctattacccaggctggagtgtagtggcatgatcaaagctcactgtagcctcaaactcctgggctcaa

SEQ ID NO: 40693 - DNA, 201 bp, Homo sapiens
acatagcattatgtgtgaaccagccgaggcagtaaaacacagttctctttattatcacatctgaattctaaatgcaaaaacaaaataacatttgtttttcrtaaaagtgaaatgccatggagctctaaccatacaaatgtgttcttctcttagaatttaattgtcctgaatccactcacagtaactgaggaggaaatacga

SEQ ID NO: 40694 - DNA, 201 bp, Homo sapiens
gctaaaaagcactccttttagaaagctccttctaggttgaaaaattcttctagaaggatttacatatgatatggataatttttgctctccttaattttttrtcttccttactttcaatttctggtggccatgtagctttggaaaccagtcgtgaatttcacggtgaaaatgacatgtttttaaaggctgcgaaggttcacc

SEQ ID NO: 40695 - DNA, 201 bp, Homo sapiens
gctgccatttgaaccctctggttgaaaggaataatttttagaagaggagtgctgtacgacaagacaatgtctactttaaatagctttattttaatgagcaygtatgtgagttgtgtcagggacagtgctgggcacttattagccattgtttcagaagagagaaaataaacaaatgctaaaactgattaagaaatatttgat

SEQ ID NO: 40696 - DNA, 201 bp, Homo sapiens
aattgcttgaatccgggaaggggagaggttgcagtaactccatcttaaaactccatcttaaaaaataaaaataggccgggtatggtggctcgtgcctgtgrtcccagcactttgggaggctgaggcgagcggatcatgaggtcaggaaagcgagaccatcctggctaacacagtgaaaccctgtctgtactacaaatacaa

SEQ ID NO: 40697 - DNA, 201 bp, Homo sapiens
agcagcagatggatcgggtttaatcaaggagctgacaatggcttttgttttgctcaatataaaccaggtaaggaagccctgagaggcaagtagacagtctytccagcagaaaactgtgggaatcttatgcttgggaagctgtagcgttgtttaacccccatttgaaagagtgggaatgtcagagagaatcacacaagaggc

SEQ ID NO: 40698 - DNA, 201 bp, Homo sapiens
gtctttccagcagaaaactgtgggaatcttatgcttgggaagctgtagcgttgtttaacccccatttgaaagagtgggaatgtcagagagaatcacacaakaggccctctaggatttattagagctctgcagagagaagatagctgaaatatttgccctggtgcttcttccacttggtgtcatcggcattctaaatgcagt

SEQ ID NO: 40699 - DNA, 201 bp, Homo sapiens
ttcatttaaaagactacaaattgcaatttgaacagggtcaatttatgattttttaaacttagcaaggagaaagatttaaatgtagaaagaggtggatgtayagtcatgtgttgcttaacagtggggatgttttgagaaaagtgtcctttggcaattttgtcattgtgtgaacattatagaggggacttacacaaacctgca

SEQ ID NO: 40700 - DNA, 201 bp, Homo sapiens
gctgtagcgttgtttaacccccatttgaaagagtgggaatgtcagagagaatcacacaagaggccctctaggatttattagagctctgcagagagaagatrgctgaaatatttgccctggtgcttcttccacttggtgtcatcggcattctaaatgcagttggagcttttcctacccactttaactttgctttttctcttt

SEQ ID NO: 40701 - DNA, 201 bp, Homo sapiens
ctaaatgttcaatctatacagcttcaatattagcaaactgctatgaaagtaatgtttacacatttttttcacatttttgtaattttgagttcaatgttgamccaaaatttcctgggactagaaaaaaaagagcctgattatgagaaaagaagagcaaaacaacagaagacaaatacaattgtagtgtaaaatgtactattt

SEQ ID NO: 40702 - DNA, 201 bp, Homo sapiens
gtttattccattgtttttaaagtgaaagactataaaaatggatgatactcagcttaatttaatttataaagaactgtaattttaataatctgaaaaagatrcataagaatgtaaactacaaactaattttacttatgattaagaatgctaccattctaaataaagtaaaagtatatcaaattttacagtgcaataagaata

SEQ ID NO: 40703 - DNA, 201 bp, Homo sapiens
cgtttactttgaaaaatatattttatgtcaggcccctgcttttcttgcctttcacattacctgagtgttgttaacaatggtcacagtggagggctgaattwggatgttgaatttagccataagacaatttatactttgaagattagatttaagctttatttttcattatttaatatgctgaagataagaggagccaaaatg

SEQ ID NO: 40704 - DNA, 201 bp, Homo sapiens
ggagtgcagtggcgcaatctcggctcactgcaagctccgcctcccgggttcacgccattttcctgcctcagcctcccgagaagctgggactacaggcgccygtcaccacgctgggctaattttttgtatttttagtagagacggggtttcaccgtgttagccaggatggtctcaatctcctgacctcatgatctgcccgcc

SEQ ID NO: 40705 - DNA, 201 bp, Homo sapiens
aacaaataaactacttggtatttaagcaaatggccaaaataaagtcatattctgattaaaattagtgtttctgtacatgctgattcattcatatttatttwtttcctacatacagcatatgtcttaagtatattcaaggtaattcatttcagacaaattaaaagtagatattgaagtaccttatatgtgaggtttgcaaat

SEQ ID NO: 40706 - DNA, 201 bp, Homo sapiens
atttaccattacaaataaatacaagggcctgatacttttatggtttaattttttttgctataataatgagatagtttattccattgtttttaaagtgaaakactataaaaatggatgatactcagcttaatttaatttataaagaactgtaattttaataatctgaaaaagatgcataagaatgtaaactacaaactaatt

SEQ ID NO: 40707 - DNA, 201 bp, Homo sapiens
atttcatctaattgcattatgaaataaatccacatttatagattactaattatgacactaaacgtaatgtatgcttttcccaatttattgatttctatcartggtgttatctttctcccagtgtaacgggcacataatttttaggtcaactttgattcatcttctcttatttcttaaatacaaaaaagtacctaatttggc

SEQ ID NO: 40708 - DNA, 201 bp, Homo sapiens
ttggaggactctgtaaagtaatggcagactggagaggaaatcagagtttgaaggataaccccatacaataatatgttccctggactcccctttttttccccatatttcctggcttagactcttctgcaagctgaatctgggaagtgcacaccaagcatggacaaaaaacctccaagcaaaacactttctcaggccagagga

SEQ ID NO: 40709 - DNA, 201 bp, Homo sapiens
ttgtggattagaaagattatgaaataataatccaagtccattgttaactcaaggacatttagaaaccataaagaaggaaaagaaaaacttttattgaagtktggaaaaacatattgaagaatatttaccattacaaataaatacaagggcctgatacttttatggtttaattttttttgctataataatgagatagtttat

SEQ ID NO: 40710 - DNA, 201 bp, Homo sapiens
gcatgcaattacatcacaattagaagatcactttaaccttcattgaactatactgatgcacaagcactgtacctatcaaataatgaataaagacaaaatarataagacataattctttctctcaagaagaatgaatgtttgggggggatgacagatgtgaacctttaatgcaaaacagaacagaggtatgcatgtatctcc

SEQ ID NO: 40711 - DNA, 201 bp, Homo sapiens
aaatattacatgtagcccataaatatgtatgactattatatatctataaaaattaaaaataaaaaaatagaaaaaaattaagctatttttttaaaagaccrtaatagatatattttggcaaacaccattgtattagtctgctttcacactgctgataaagacatacccgagacgggcaatttccaaaagtagaggcttaag

SEQ ID NO: 40712 - DNA, 201 bp, Homo sapiens
ttattttatttattaatttaatttaatgtattgagacaaagtctcactctattacccaggctgcagtgcagtggcatgatcttggctcactgcaacctccrcctcccgggttcaagtgattctcatgtctcagcctcctgagtagctgggattacaggtgtgcaccaccacactgggctaatttttgtattttaatacaga

SEQ ID NO: 40713 - DNA, 201 bp, Homo sapiens
gcccgaccaacatgctgaaaccccgtctctactaaaaacaaaaaaaaattagccaggtgtggtggcatgcacctgtaatcccagctactcaggaggcttargcaggagaatagcttgaacttgggaggcagaggttgcagtgagcagagatcaagccactgcactacagcctggatgacagagggagacccatctcaaaaa

SEQ ID NO: 40714 - DNA, 201 bp, Homo sapiens
aaggataacaaagtttcagtagggcactttagaaggctggaaaatgtagtcaaagctcatggtagtgtacagcattgccagaagaggtgataataggaaaragtcatactttcttttttatttcaaaaatgctcttgagggtcataggcatagtttgcacagcattttgaaaattaccaagaatcttagtttaaaaactta

SEQ ID NO: 40715 - DNA, 201 bp, Homo sapiens
aacaagtgtatcatagccttaagagaccaggatgctgataatttagaccgtgctgcgggtgctatcagaggccgggcagcaagagttgctcacatcgtcaygggtgaaatggacagttacgagccaggggcttacacggaaggtgtaatgagaaatgttaacttccttacaagtactggtaagtcagttgccaataacagc

SEQ ID NO: 40716 - DNA, 201 bp, Homo sapiens
tctttggaggaatattagagaatgcagaaataatgacttggatacaatacagactggcttcacattcaaagaaaaaatatatgattaacagagtccaaccytgagacgacccagatgttgaaatttcagataaagactataaatcagccaataaatctatgcttaataaaataaacttaataaataaataggaaatctcag

SEQ ID NO: 40717 - DNA, 201 bp, Homo sapiens
tttaaacagttctgccatgggagtgccagaaaatttataatacctcgtggctcctacccaataccctacaattaccattcagtgtgagttcttggtagatrtgtacataacacattttatattttgtagagtcaaataaaatacgtgtttcaaatattaagtctcaattttgcaataaggtattcaaccagttgtcattag

SEQ ID NO: 40718 - DNA, 201 bp, Homo sapiens
aacagcctactggtaacatagacataaacagtagtcctctaaattaatacgtaattacgaatggagtagaaatgaaagaaatatacagggtgctaaaaaaragaaacaatttgaatttaaagggaaagaggtgatgtagaaaacctctctatgttagaggccaaaaggataaggtagatgttatccaggagaagtaggagg

SEQ ID NO: 40719 - DNA, 201 bp, Homo sapiens
taatactgggaggcattgatgaatatggccatttattattcatttgaaaatgcttaagttttatgataagctttagaattctttgtcatttcataagtcaycatctttatatgcatttcatctaattgcattatgaaataaatccacatttatagattactaattatgacactaaacgtaatgtatgcttttcccaattta

SEQ ID NO: 40720 - DNA, 201 bp, Homo sapiens
ctagagcttctgctctttacctctcttccttagtatccagttaattcattcatttgataaatatttattgagcttctgttatgcacctggcattgtaaaagtgctgaggatatattaatgaactaaagagacatgcttcttgttcttgggaagccaacagcctactggtaacatagacataaacagtagtcctctaaatta

SEQ ID NO: 40721 - DNA, 201 bp, Homo sapiens
gtgttctccttttttctaccttgggtttaagggatttgtaattattaatttcaaggggttgtagcttccactcatacaggaggggctgccttctccctttyggaactaaacaggacctttttcaccttttttaaagtagtctagatgacacaagaccagtaattacacatgtttgcacatgagcttaattcatggcagata

SEQ ID NO: 40722 - DNA, 201 bp, Homo sapiens
agatgccacctgtacttattacaatgattatttgtaattgctttattattacttaactctggtatatttttaaataaactatagtcaaattagtcgtatataagaggaagtataggtgcataattttcttaaatcctccatgtttaactaaaagttggtccatgccaattcagtcagacataatcaaacatctgacggtaa

SEQ ID NO: 40723 - DNA, 201 bp, Homo sapiens
tgacattaacttttgtgtatggtgtgagatgagaatctagatgatgtttttctcatacatatatccacttgacctagtgcaatgtattaagatggtcctcygctccccacagcaccaaagcttcatattattgttgttgctgtagatcaggaacgtgtgtgggtttgtttctggacttttttccattgatcagtttgccat

SEQ ID NO: 40724 - DNA, 201 bp, Homo sapiens
aatgcttcacaagggatccagaatatgacaaccccaccagaacctcaggcagcaaccctgggaagtgcccttgatgagctggaggtaagtcgggagaaagrtaaagtgtgatctgatgtcctaatacagtaataataataataaaacagaagaagatccacatgttggcgtttagagcatgagaaaataaaaaatccagat

SEQ ID NO: 40725 - DNA, 201 bp, Homo sapiens
atacaatgtctggaatctgtgaataacatcgatttttaagttatgagttgatttttaactactgggtttaggccaggcaggcccaggcctggtttcaggcstggctctgggctgcctgtctttggttttacttccttgttgttttttttaaaaacaggtactgagtataaaacaatataaaacaatatgagagggtctctc

SEQ ID NO: 40726 - DNA, 201 bp, Homo sapiens
aggttcaggaagagggaaaggcatacaagaagtcccatggatgatgaaatgagagcatggacgctatcaagaggaggctagagaaacagatgaggaaggcsatgactggtgaagtccttgtactatgggtgtggcctggaagattctcactggcccagaaagggaaaaaaaggaaccttttaggcaggagttaggttttat

SEQ ID NO: 40727 - DNA, 201 bp, Homo sapiens
agagggagcccgtatcaaccactaggatgggcaatctaacgctgaacgcatacatatgaacagataataaagtattacccgtcattggagagaatagggakaaagctgggaattagaacaaatgaaatatagatattacaggtagacaaaagataatgatttagaattctaattgatgtcctcattgatatttgggaggtt

SEQ ID NO: 40728 - DNA, 201 bp, Homo sapiens
acttgacatttttattgtttgtttattgtctgtttccctaactagattgcaaacatcttgaagagatggtgttggcattgctcactgcttatttcctagcwtctataattgtacttggcacacagaaagcattgaataaatattttaaattaactttctaattttaactgtatattcacctgtgaatttaagaagtaatag

SEQ ID NO: 40729 - DNA, 201 bp, Homo sapiens
agggttgtgattgatttgagcaagcaaggggtacacgacaggggctgcatgcgctggcggtcagagagaaacagaacagggcagggagtttcacagtgttsttctatacaatgtctggaatctgtgaataacatcgatttttaagttatgagttgatttttaactactgggtttaggccaggcaggcccaggcctggtttc

SEQ ID NO: 40730 - DNA, 201 bp, Homo sapiens
tttggagtcatacccaagaaattattgccaatccaatgtcatgaagtttttcccctatttttttctaagaattttacagtttcaggtcttatgtttaagtctttaatccattttcagatgatttttgtatatgttgtaaggtaaaggtccaaattaattcttttgtatatggatattcagttttcccagcatcatttgttg

SEQ ID NO: 40731 - DNA, 201 bp, Homo sapiens
atctcctggttttgatttcattttcctgatgactagtgatgttgcacattttttcatatactctgagtatctgtattttttctcttgagaaatgtctattygggtcctttgccattttttttattgggttatttgttttcttgctattgagctgcttgaattactgatctgttttagatattaactccttatcagatagat

SEQ ID NO: 40732 - DNA, 201 bp, Homo sapiens
ttttctcttttgcagattttcctgttgtctttcaataatcaattttctattttgatttgattgtgcgcagagaacacactctttgtgactaatttttttttacatatattgaggctattttatggcccaggatatggtctatcttaatatagtttaatgggcacttaaaaataatatgtatttacccttattgtcctttgc

SEQ ID NO: 40733 - DNA, 201 bp, Homo sapiens
taatgaagatatacaaatgattagatatgagagtaacttttattcatagatttcctctttcccaaacaggtggaaacccttattttcaatgtacagatatygaataatgtaaagctacatgatagagggatgagaaattgactgagtttaaaaaaaaaaaagttcagtgtttttatatatagatataatgctttaaaagtt

SEQ ID NO: 40734 - DNA, 201 bp, Homo sapiens
taaaaaagcaataatatttttaaatttcttaattgtgttagcagctgttctccaatttataatcatattatttataatcataatgctttaaaaattttcayataacttactactgcaaacttcacagtgccttgagatacaataaatccattttgcagaataaggaatctagactctaaaagttaacaaaaaaagacataa

SEQ ID NO: 40735 - DNA, 201 bp, Homo sapiens
gattactgatgtgagatattttctgtttctctgcctctttttttaaaaactcaagcccagtgagagctggaatgttttctcttttgcagattttcctgttrtctttcaataatcaattttctattttgatttgattgtgcgcagagaacacactctttgtgactaatttttttttacatatattgaggctattttatggcc

SEQ ID NO: 40736 - DNA, 201 bp, Homo sapiens
agaaaagaaaatcccattttctgaggagaaatgcaagccagctgcagaaatttgcgtaagtaatgaggagccaaatgttaagcaccaagacaatggggatratgtctccagggtatgtcagaggtcttcatgggagccccttccatcacaggcctggaggcctaggaggacaaagtggtttcgtgggccaggcccagggtc

SEQ ID NO: 40737 - DNA, 201 bp, Homo sapiens
taaaattgctgctttataaggtacctgccatgtgaatactgtatttactcaccttgatctaactattatttattctgctgtatctatttttatctttgatkcatatttagtgcccagatccatcttgtaaacaggacttgttggcctacctggaacagattaagttctactcccaccaactgaaaatctgcagtcaagtta

SEQ ID NO: 40738 - DNA, 201 bp, Homo sapiens
attgcttgatttacatctttaatccattttgagttgatttttacatatggtgtgtgaaaagggtctaatttcatcttctgcatgtagatatccattttccycaacaaaatttattgaagagacttatcttttccacattttctattcttggcaccctcatcagagattagttgatcatatatacatgggttcatttttgga

SEQ ID NO: 40739 - DNA, 201 bp, Homo sapiens
tcagggttctccaaccaaccccagttcactctgtttctgttaatactttatctttcaatcacagctcatcttttcctcaatgaattcagactgattccatwgatacccacttctaacttagctttaggatataattgttctcttataaactgattgtgtgggcagccaggtgatgcagactgataagccaagatacacctg

SEQ ID NO: 40740 - DNA, 201 bp, Homo sapiens
cttgggacccttagcctgccatgcaggagcactgccccccaacccccctccccacgcaaggcccgagcctccccgatgggcgctgcccccttctctgcggygcccagtcccattgaccccccaagggctgaggagtgcggcacttggtgtgggactggcaggcagctcagcccagggatcctgcacgtgatccactagagg

SEQ ID NO: 40741 - DNA, 201 bp, Homo sapiens
ttatgtgtttgacacgtaaatctctttgctttgttatgccatctgtgtggcacagagggctggtggaattggagagggatctacatgtgctttgttactgyccctcaatagttcggagtaatggcttatgttagcagtggttgtttatctaacaaacaaacaaaaccctaaattatatttttaaaaaggttatggttattt

SEQ ID NO: 40742 - DNA, 201 bp, Homo sapiens
tttacattttccttaaaaattatggatagttctgactttagatttcccaaatgcaatatattttataaaaactgacaggtgacattccctctaaaaagaakaaattgtgcttcctcaaggaaacctaccaaaatatcttacagattaaatattactaaatatttagataattgtggcagcttcaaaatatattcaatctgt

SEQ ID NO: 40743 - DNA, 201 bp, Homo sapiens
tcactgcaacctctgcctcctgggttcaagtgattctccttcctcagcctcctgagtagctgggactacaggcatgtgccaccacacccggctaatttttrtatttttagtagagacagggttttgccatgttggccaggctggtcttgaactcctgacctcaaatgatccacctgcctcggcctcccagagttctgggat

SEQ ID NO: 40744 - DNA, 201 bp, Homo sapiens
tggcctcccaaagtgctgggattacaggcacccacgtagttttggcagctcttaatctttttcaaatgtgacagtgtctagttttttttttttttttttttgaagttttagctatcagaaatattgtaaatgtctaaatttagggcaaaaatatttgtttcaaagtccattttgtttcactgtatttatacatatatatga

SEQ ID NO: 40745 - DNA, 201 bp, Homo sapiens
ttcactctaatcaaacttcagtcgcattctccactgaaatcattgcaatgtttgcaagtattgttcaatcattcctcctttaaacactcttttcttctggmacctattatgccacactctcctgattttccttctacctctctggccatttcctatgaatctactttgtgggtgtttttctactgcctatgttagcgttcc

SEQ ID NO: 40746 - DNA, 201 bp, Homo sapiens
tttattcaatgtatatgagcattctttggatcttatagacaatgataaatggacattaaaataaaacataatctgaaatcttgctaaatctggccctacawttgtcagattaatagctttgttcatttttatcataactatctgggtatttgcctttcacactccaatatcggatatgttcatggcggatctattttctta

SEQ ID NO: 40747 - DNA, 201 bp, Homo sapiens
cagttgatatatgatatcatcctcttgaaaccttttcttctcctggtctccatgacatcacagtattgtgggcaacctttcttatctctggccactttttstaagtctcattgaaggagtaacctcatgtttctgcctaataaatattaatatcttatatacctccaagaactctttctcctcacataatcatatctaatt

SEQ ID NO: 40748 - DNA, 201 bp, Homo sapiens
cttatctatttctttgccttaacaacccagctatatgcagatggatctcaaatacacatctcccatctgtaatgatttttctcctgaatttccaacctgtrtataaaccactatgtaatatatatacccaaaaatcagcatatctaaaggagaacttctgtcctcatctaattccgctgccacgcctgtacttttttctcc

SEQ ID NO: 40749 - DNA, 201 bp, Homo sapiens
agggaaacaacaggcactggtgcctaatagagggtggagggtgggaggagggagaggttcaggaaaataatgaatgagtattaggcttaatacctggtgasaaaataatctgtaaaacaaaccctcatgacacaagtttacctatataacaaacctgcacaggtactccgacttaaaaggtttaggaaaattatgtttagt

SEQ ID NO: 40750 - DNA, 201 bp, Homo sapiens
tttttctcctgaatttccaacctgtgtataaaccactatgtaatatatatacccaaaaatcagcatatctaaaggagaacttctgtcctcatctaattccrctgccacgcctgtacttttttctccattacctctcgatgaattgtatttatgttcatctggtttcccaaacaaaagtctgggaatcatctttgatttttt

SEQ ID NO: 40751 - DNA, 201 bp, Homo sapiens
aatgaacatctatagtgccttctctttgtaaataaatactatatatttcaccatttttcctctatcctatatatgagcttttgagaagactggcattaggrctcattgggtttttagaaatgatgactaaccaacaccatataaatatttagcacatactattttcttttgttttttataatttcagcttttattttggat

SEQ ID NO: 40752 - DNA, 201 bp, Homo sapiens
aaatagacatattaataaagtcatttaatttaaaaagtaataagtaagttttaatcaaatgccaacaatacaatttgtagatggaacctgagtggtcctgwgaccaagctattaaatatccattcctcttccctactgtctttgaaacttgtttctttcttacgcttatttgtaaaaaaaaaaaaaaaattggaaagtgac

SEQ ID NO: 40753 - DNA, 201 bp, Homo sapiens
atatcttttcaggtttttacatttctgaggacagtctacccctgcccatctgtcatgtggccccacccaaactgactccttgtcccaccaaactatccttgaaaaaccctagcctctgaattttcaaggagattaatttggtaataactccatctctcacatggcatagctgaccttgtgtctattaaaatctttattgca

SEQ ID NO: 40754 - DNA, 201 bp, Homo sapiens
aaggagaacttctgtcctcatctaattccgctgccacgcctgtacttttttctccattacctctcgatgaattgtatttatgttcatctggtttcccaaacaaaagtctgggaatcatctttgatttttttacaatcattttttcttgtatgtagctagaatatttcttataatgtgcaaatcttaatttgtcaatgttct

SEQ ID NO: 40755 - DNA, 201 bp, Homo sapiens
ttaaatttccaagaataccagtggtgttttctgtggctatttttttttttttttttgagacagagtcttgctctgtcacccaggctggagtgcagtggcaygatctcggctcactgcaacctctgcctcctgggttcaagcaagtctctgcctcagcttcccgagtagctgagattacaggcgcctgccaccaggcccagc

SEQ ID NO: 40756 - DNA, 201 bp, Homo sapiens
ttttcttgtatgtagctagaatatttcttataatgtgcaaatcttaatttgtcaatgttcttcagaaaacattttagtgtctccccattactgtttgtatraattaaggatcacttgtccccggtctttaggtaggattcgcatattcgactcttttttagagatcatggctacaattcatagctatcttgggcaaattcc

SEQ ID NO: 40757 - DNA, 201 bp, Homo sapiens
ttcactcaggttaataatttcatcatgatctgactgttctcttagccttttccagcttcctcctgattttaatcccatgagatgtctgcttctcagaggayatagattaacaaagtaataaagtagatcaacttgtttttgatgtctctttaaataactttctaccttgccaaaaattaaagtaaaataatattataaaca

SEQ ID NO: 40758 - DNA, 201 bp, Homo sapiens
atattgtggaaaagattgagttgatccagtagcattaaacctagcaggaggaagagtagttgctgaataacaactacatttagattctttagttgaaaaawttagacttattatgatcttactggaaataattttagttgaaattttccattgtaaaataatacatgttcattggaaaaaactgaaacaaagtttaaagtt

SEQ ID NO: 40759 - DNA, 201 bp, Homo sapiens
agctattttcattccgctctttaagtcttcaactgtctagtttttatttttgcaataccattttaaatttccaagaataccagtggtgttttctgtggctwtttttttttttttttttgagacagagtcttgctctgtcacccaggctggagtgcagtggcacgatctcggctcactgcaacctctgcctcctgggttcaa

SEQ ID NO: 40760 - DNA, 201 bp, Homo sapiens
gctttgttcatttttatcataactatctgggtatttgcctttcacactccaatatcggatatgttcatggcggatctattttcttatttacttgcttccartttaactaaatatgtgaccaaactacttagaactatccacgaaaattctacaaatatacttaaaattagttgactcttctttggaatgtgaaactagtca

SEQ ID NO: 40761 - DNA, 201 bp, Homo sapiens
catcttctctgatctatataactagactaagccttttatatgcagttttccctacttggtgccttttttcttcaaagccctatctcagtttgtgatattcrtttctttgcatattgtgtatatctctctttccaagtaaacactaagtctgtaaggattttatctgtttggatctgcattgtatctccattttttcaaaac

SEQ ID NO: 40762 - DNA, 201 bp, Homo sapiens
acagttttcagataatcttgttttccctaggtagacaattttgagacctgggaataaatatagttatttgttaacaatatttgcatctattgcttttttttattcatttagatttactagaaccttgagtaaaatattgattaacctcacttatagtgggaatgcttatcttaatcttgaattttgagcatgacacttgct

SEQ ID NO: 40763 - DNA, 201 bp, Homo sapiens
aatgttcaatcatccttcacacacatatcttgaatccagcaatattttccaggcatgtgtgtgtttggctgtatgtgaatgtgtttgtctgtgtgtatgtktgtatcttcaactctaaggagcacaggagtcctgctgtttagtagggggagacagattcttgttgaagaaccatacctgatttatgaccaaatatatata

SEQ ID NO: 40764 - DNA, 201 bp, Homo sapiens
ttttttggagatagagtcttcctctgtcgcccaggttggagtgcagtggctccatctcggctcactgcaatctctgcctctcaggttcaagtgattctcgygccttgtcctcccaagtagctgggattataggtgcctgccaccacacctgctaatttttgtatttttagtagagactaggtttcaccatgttggctgggg

SEQ ID NO: 40765 - DNA, 201 bp, Homo sapiens
gaactaaggaagaaaatcagcattaccactttacaagttcatatttgtaatctagctgaatagagagcttatgtttaaaagttgagatcttatttttttttaatgaggctggccgccaacttcagaaaaattctccattccaattagcctgtaagagacaaattgttaattccagtttaataatcttattttcctgaggtg

SEQ ID NO: 40766 - DNA, 201 bp, Homo sapiens
aaatttaatacatatatagatatgcacacatatctataattgtgcttatttcaatagatatatactgctatgaaatttataatatttagttgctataataacaaattttgtcatgaaaacttttaaaatatatagaaaaatatattattcatctcacattcattctgcatgaagaagtgttaccgaatactcaatagtaat

SEQ ID NO: 40767 - DNA, 201 bp, Homo sapiens
attcaactatgacattttgtttagtaaagattcatccattttccttactggaaaagcattctaagtttttaacaattattaataatgctgctatgaacatycttatacatgtgctttaacacacatttaagtacattttcaattccacctgggagaagagttcttagatcatcatcaagtataacatatttagctttagaa

SEQ ID NO: 40768 - DNA, 201 bp, Homo sapiens
ttacaaactttacaaggacttacacatattatggttccttattttctttcaggtcattgtgagatatttcttttttttggagatagagtcttcctctgtcrcccaggttggagtgcagtggctccatctcggctcactgcaatctctgcctctcaggttcaagtgattctcgcgccttgtcctcccaagtagctgggatta

SEQ ID NO: 40769 - DNA, 201 bp, Homo sapiens
aaaatttaatacatatatagatatgcacacatatctataattgtgcttatttcaatagatatatactgctatgaaatttataatatttagttgctataataacaaattttgtcatgaaaacttttaaaatatatagaaaaatatattattcatctcacattcattctgcatgaagaagtgttaccgaatactcaatagtaa

SEQ ID NO: 40770 - DNA, 201 bp, Homo sapiens
tcacaaatacatgtgcgcacacgtatgtgtgtgcacacatgcacacagacatcaactgaacttgttttaaagccggtgctatggccacaatgaaagggctmtgcagatttctttacaattataatgattatcaccaattacgtttcctgaaatacagaaaataaaactgttcacattttatgattaatctccagctgactg

SEQ ID NO: 40771 - DNA, 201 bp, Homo sapiens
aaactaagtcagaggggtctccagcagtcagatcatgaggaatttataggtcacgttatggattttcaatgacttactgtgatgagaggtccttgcagggrtgaaagtatattggtcggagttctccggggaaacagaaccaatagattgtgtgtgtgtgtgtgtgtgtgtgtgtgtgtgtgtgtgtgtgtgtgtataggt

SEQ ID NO: 40772 - DNA, 201 bp, Homo sapiens
tcatttaattgtataattatactctttcacaaatacatgtgcgcacacgtatgtgtgtgcacacatgcacacagacatcaactgaacttgttttaaagccrgtgctatggccacaatgaaagggctctgcagatttctttacaattataatgattatcaccaattacgtttcctgaaatacagaaaataaaactgttcaca

SEQ ID NO: 40773 - DNA, 201 bp, Homo sapiens
cctactatagctgtattctttatgaatcattgtaaaaataagaaagatataataatactagatatgcattgatatatgttgtaagacatagatatacattrtaaaaatatgatagagataatactagaaataaagtgtcaaattattagaagcattctagaatttttaattgactttataattacaaaaaatgctactttt

SEQ ID NO: 40774 - DNA, 201 bp, Homo sapiens
cttttctttactttcagaccatcaactgtcacattctcttaagaatctttttacttcttcatttaattgtataattatactctttcacaaatacatgtgcrcacacgtatgtgtgtgcacacatgcacacagacatcaactgaacttgttttaaagccggtgctatggccacaatgaaagggctctgcagatttctttaca

SEQ ID NO: 40775 - DNA, 201 bp, Homo sapiens
atggttgaaaggtctcagaaaactataatcatggcagaaggcaaaggggcagcaaggaccttcttcacatgtcggcaggagagagaagcatgaggagcaargcaggaagaacctcttataaaaccatcagatctcatgataactcactcactatcacaagaacagcatgggagaactgcccccatgatccagttacctccc

SEQ ID NO: 40776 - DNA, 201 bp, Homo sapiens
ttaatgggtgcagcacaccaacttggcacatgtatacatgtgtaacaaacctgcacattgtgcacatgtatcctaaaacttaaagtataataataaaaaargaaagaaatacctgagactggataatttataaaggaaagaggtttaattgactcacagtttcacatggttgaaaggtctcagaaaactataatcatggca

SEQ ID NO: 40777 - DNA, 201 bp, Homo sapiens
gaaaccctgctttaatggaatatacccagaaatggtcatttatctaaattgttaagcattctcttactatcttttctcctttctcgtttatcaatttcatytcaagattgttggtacaatctttttattttaaagaccattctccttgggagacaagatgaaagcaaagtaaaaatattgttattttgctttctctctatt

SEQ ID NO: 40778 - DNA, 201 bp, Homo sapiens
tatttaagatgaagttgctctggttcaaaggcctctgacactaccatgctgccaaggagattctttacactttagtcttctcaggactaagaagcattcaycttccccagcttctgactacctttcctctaggttatcattatccaactttaggtttcttttccctctattttacctaataatctcctatctttattcaaa

SEQ ID NO: 40779 - DNA, 201 bp, Homo sapiens
ctttcctctaggttatcattatccaactttaggtttcttttccctctattttacctaataatctcctatctttattcaaactgcatacaaccacccatcartgtgctcagccaataaaggacctttctggtgtactgggagccagttgcatcagaaggcagtgggcattgaacaaataaccacagggattgccatggtaga

SEQ ID NO: 40780 - DNA, 201 bp, Homo sapiens
gatcagagacaaaggtaaaatattaaaaaattataatataaatacaaaatgtttagaacaaaataggaaaaaatattcgggatctagggctaggcagagtycttgataccacaatcatgaagtgtgaatttaaaaaattgatgaattagacttcatcaaaatgtaaaatgctaactttgtgaaaaccatgtgagaataaaa

SEQ ID NO: 40781 - DNA, 201 bp, Homo sapiens
tagggctaggcagagtccttgataccacaatcatgaagtgtgaatttaaaaaattgatgaattagacttcatcaaaatgtaaaatgctaactttgtgaaarccatgtgagaataaaattacaagctaaagaatgggagaacatatttgtattgtacatatataccatggaatactactcagcaataaaaaggaataaactg

SEQ ID NO: 40782 - DNA, 201 bp, Homo sapiens
aatttaaaaaattgatgaattagacttcatcaaaatgtaaaatgctaactttgtgaaaaccatgtgagaataaaattacaagctaaagaatgggagaacayatttgtattgtacatatataccatggaatactactcagcaataaaaaggaataaactgttgataaacaccttaggttgaataaatctccaagaattatgt

SEQ ID NO: 40783 - DNA, 201 bp, Homo sapiens
aaaacagggatttcttcttggtttggatccattgctggtgaggtagtgtgctttttgggggtgctaaagagccttgttttgtcatattaccagattttttyttctggttccttcttatttgtgtaggctctgttagagggaaggtctagggctgaaggctgtttttcagattcttttgtcccaaggggtgttcccttgatg

SEQ ID NO: 40784 - DNA, 201 bp, Homo sapiens
ctagtttatctgcataaaggtgttcacagtagccttgaatgatcttttgtatttcagtggtatcagttgtaatatctcctgtttctttctattttttttttgagatggagtttcactcttgttgcccaggctggagtgcagtggcacgatctcagcccactgcaacttccaccttccggtttcaagcgattctcctgcctc

SEQ ID NO: 40785 - DNA, 201 bp, Homo sapiens
ttttgggttcttggtgatgaaatctttgcctaagccaatgttatcgtatagagtttttataatttcaggtcttagatttaagtccttaatccatcttgagwtgatttttgtataaggtgagagatgaggattcagtttcattctcctgcatgtggctagtcagttatcccagcaccatttgttgaaaagggtgtcctttcc

SEQ ID NO: 40786 - DNA, 201 bp, Homo sapiens
tattgcattattgctacttgaaaggaagatttgactatttggttaatttgtttcttcttttacctaaatgctttatctattcaaacactttatgaacttaraagcagtgtctgactcacacaagtcttgaaggcattcaaaattaactaccttttgtttcgagaagttaaggcaagatatgagaagtatttccctggggcc

SEQ ID NO: 40787 - DNA, 201 bp, Homo sapiens
attcttaatcctgagttctagtttgcttgcactgtggtctgagagatagtttgttataatttctgttcttttacatttgctgaggagagctttacttccamgtatgtggtcaattttggaataggtgtggtgtggtgctgaaaaaaatgtatattctgtcgatttggggtggagagttctgtagatgtctattaggtccgc

SEQ ID NO: 40788 - DNA, 201 bp, Homo sapiens
taccaataaccaaattgaatatagtttaaaaaagtaataatcaaaaatgtttcttatttaacaaatagttggaatgtttacattatgcatagattttttarttacccatcgatgttctaaaggcactttttatcaaaatggcctacttctgactagattctgggtaaatcacagaatatttaaaacatgtatataggtacc

SEQ ID NO: 40789 - DNA, 201 bp, Homo sapiens
tttattgagagtttttagcatgaaggttgttgaattttgtcaaaggccttttctgcatctgttgagataatcatgtggtttttgtctttgcttctgtttawatgctggattacatttattgatttgcgtatattgaaccagctttgcatcccagggatgaagcccacttgatcatggtggataagctttttgatgtgctgc

SEQ ID NO: 40790 - DNA, 201 bp, Homo sapiens
taataatgctgctatgaacattcttatacatgtgctttaacacacatttaagtacattttcaattccacctgggagaagagttcttagatcatcatcaagyataacatatttagctttagaagatacggcaagttccaaagttttatatatatgtttaatccaccagaagtgaaatagtattgctttttaagttggtccac

SEQ ID NO: 40791 - DNA, 201 bp, Homo sapiens
caaaattatgaaaagaaatatgcctgccttaaactaaattttaccaataaccaaattgaatatagtttaaaaaagtaataatcaaaaatgtttcttatttracaaatagttggaatgtttacattatgcatagattttttaattacccatcgatgttctaaaggcactttttatcaaaatggcctacttctgactagattc

SEQ ID NO: 40792 - DNA, 201 bp, Homo sapiens
attcagtatgatattggctgtgggtttgtcatagatagtgcttattattttgaaatacgccccatcaatacctaatttattgagagtttttagcatgaagrttgttgaattttgtcaaaggccttttctgcatctgttgagataatcatgtggtttttgtctttgcttctgtttaaatgctggattacatttattgatttg

SEQ ID NO: 40793 - DNA, 201 bp, Homo sapiens
tctgtggataattggataataattgctagtctatttagttttgcatttagcttctctagtaaagagggaggataaaataaagtaactttattaatttaaartatatacccattcccagatattttattttgttttccctttaccctgaaatgaatgtgctgactaaaaccactaattacattgtataaagctatcttagtg

SEQ ID NO: 40794 - DNA, 201 bp, Homo sapiens
acagtattccaaccagggtgctgatattgatacaattaagatacaggcgattttcatcaccataaagattgctcctattgaccctttatagccacatatamttccctccaactcccaacccttcctcaaccagtgtcaaccattaaagtattctctctacaatttttcatacagtatatagcctttttggattgacttttt

SEQ ID NO: 40795 - DNA, 201 bp, Homo sapiens
tttttatttttttattttttatttattattattatactttaaggtttagggtacatgtgcacaatgtgcaggttagttacatatgtatacatgtgccatgytggcgcgccacacccactaacttgtcatctagcattaggtatatctcccaatgctatccctccccaccccccccaccccacaacagtccccagagtgtga

SEQ ID NO: 40796 - DNA, 201 bp, Homo sapiens
acactcattccccagaatccaagagccacctgcccagggctttccatcaccatcagggaccctgcttcatccaaaatggggccatcacaagactgtgcacrctctccataaacttgaggactgtcccatgaggagcctgtcaccaccacaggcaatcttgacccctccacaggcaacgtgactgtgcacctctgtgggctc

SEQ ID NO: 40797 - DNA, 201 bp, Homo sapiens
atagaacattgtattgatgtgaacacaggaatgaaactgtatcttaaaaatattttagattacaagcatattatattttgtctttcttattaccacagcartataagtttcccgtagaaaaacttaaaaatttaaatgaaaaatggaaaaaaaatctcaaaaacctagaagagctttcctttgtgattgcctttatggaga

SEQ ID NO: 40798 - DNA, 201 bp, Homo sapiens
tcaaaactttcttttacctgaagcctactgttgtttcaccatcttatatccttcagctcagttaagactaagtttccatttcctaatttaagttggccaaraacattaaattagcaggtgtttgtgttattttgtttcctaatagaacatgaagctgcccaatgaccagtgaagcaattggtatgcagcatcttggcagag

SEQ ID NO: 40799 - DNA, 201 bp, Homo sapiens
ctggataaatctttgttgaacgcttcctacttgtattagtcagagttctccagagaaagagaaccagtaggagattgtttatatatatgaagatttattamgagaaattggcttacatgggagctggtggtgtaaatcagttggagtttgaggacctgagaaccaggggagtcaatggagtaaatcctactcccagtgtct

SEQ ID NO: 40800 - DNA, 201 bp, Homo sapiens
ataattgttaattatgctttagaggaaaaattttctgacctatggatttttttttttttgaaacagtctcactctgtcacctaggctagagggcagtggcrtgatcttggctcactgcaacctctgtctccaaggttcaagtgattcttatgcctcagcctcccgagtagctgggattactggtgcacaccaccatgccca

SEQ ID NO: 40801 - DNA, 201 bp, Homo sapiens
taacatacttaggtagtttaaaaatgctaaacttcctttctcctgcttggcattattctttagacatgtagagttttattccttacttattttccctcgtytatattaacttttcctaatgtccagaaacattacaaacaaaatattgtccaaaagatgcatttcagggatgttcttaaaggtcagcttaaggaaattata

SEQ ID NO: 40802 - DNA, 201 bp, Homo sapiens
cacacattggaatgccgtattttgaagtacatgggtcttggcataatcagtcttaggaaccacatgagatgttcttatttagaaataaatgtatccggccrggcgcggtggctcacgcctgtaatcccagcactttgggaggccgaggcgggcggatcacgagatcaggagatcgagaccatcctggctaacatggtgaaa

SEQ ID NO: 40803 - DNA, 201 bp, Homo sapiens
cttaccttagtctttcttaaatgtatgtgtggctcacatttatttcaatgtttaatattagaaatgttttggtctttatttacaagctcggtaatacatacggtagaaagttaacccttgtttatatcaattagcctatagtaaattgattttgttacattgttttgcttaaagtcacagttcccaagaaccaatcaaaaa

SEQ ID NO: 40804 - DNA, 201 bp, Homo sapiens
ataaaattgtataccataaaaataaaatttaggtaagtttaactacattaaagttaaaattttctctttttttgtttttgagacagagtcttgctctgccrcccaagctggagatcagtggtgcaatcttggctcactgcaacctctgcctcccaggttcaagtgattttcctgcctcagcctcctgagtagctgggatta

SEQ ID NO: 40805 - DNA, 201 bp, Homo sapiens
aatacataatgataagaggtttgatttgacaggatgatataacaattttatatctgtactgataagcacaacattggctaaaagtatacaaaggaaatacrgaattaaaagattaagcattgtcacgttgttccaatgagaacagtctgaaataatagagtccaggaaaagactttcatatctatggaaacgtgatttata

SEQ ID NO: 40806 - DNA, 201 bp, Homo sapiens
ttgctgtgtatgcttgagtaacaaataacacaaaacttagcttcttaaggaatctggcagtgtcttagctagttgagtttggcttagggtctcttaaaagrttacagttgaagtgtttgctagagttgtagtctctgaaggcttaactggggctgaacgattcactttcaagtttgctcatgtggtttttgcagaaggctt

SEQ ID NO: 40807 - DNA, 201 bp, Homo sapiens
acttaccttagtctttcttaaatgtatgtgtggctcacatttatttcaatgtttaatattagaaatgttttggtctttatttacaagctcggtaatacatacggtagaaagttaacccttgtttatatcaattagcctatagtaaattgattttgttacattgttttgcttaaagtcacagttcccaagaaccaatcaaaa

SEQ ID NO: 40808 - DNA, 201 bp, Homo sapiens
agtaatgatattaactctactagaaataagaagatgcccttaagtagtcttccatttagagcttatgatgccaatatagctatgctcacaaagatttcagkttctaaaataaatgttgacagggagtagattttattaaggaatgaagattttaagtagattaataacatgcttccagtcacaaacatggtcttcagttac

SEQ ID NO: 40809 - DNA, 201 bp, Homo sapiens
tacttaccttagtctttcttaaatgtatgtgtggctcacatttatttcaatgtttaatattagaaatgttttggtctttatttacaagctcggtaatacatacggtagaaagttaacccttgtttatatcaattagcctatagtaaattgattttgttacattgttttgcttaaagtcacagttcccaagaaccaatcaaa

SEQ ID NO: 40810 - DNA, 201 bp, Homo sapiens
gatgccaatatagctatgctcacaaagatttcagtttctaaaataaatgttgacagggagtagattttattaaggaatgaagattttaagtagattaatarcatgcttccagtcacaaacatggtcttcagttacccagcagagccaagttgctattttcatgtacaagatacattgaattcagatcagtatacaattaaa

SEQ ID NO: 40811 - DNA, 201 bp, Homo sapiens
atacttaccttagtctttcttaaatgtatgtgtggctcacatttatttcaatgtttaatattagaaatgttttggtctttatttacaagctcggtaatacatacggtagaaagttaacccttgtttatatcaattagcctatagtaaattgattttgttacattgttttgcttaaagtcacagttcccaagaaccaatcaa

SEQ ID NO: 40812 - DNA, 201 bp, Homo sapiens
gtaggagagcaagcttctctgtgaataaaatacattactgaaatcttgatattttcagacagattcctgatgtaaagttttatgtctttctgtcatttttsgtgcagtattattatatagatttttttcaaatgcattgttttcatgaattcatttataacttttaatagctcatttcaatattttgttacttatggaggt

SEQ ID NO: 40813 - DNA, 201 bp, Homo sapiens
agaaatgagtgaaagttttatttcctccacatccttgccaacaagtgttattgattatgggcatttttatcatagccatcttagtgggcgtgaagtgatawctcactgtggttttatttgcatttctctgatggctactatgttgaatatctttcatgcatatgtgatctatttgtatagagatggccctccatatgcgct

SEQ ID NO: 40814 - DNA, 201 bp, Homo sapiens
tttaagaacccactgcttgcaatatcttagaaccaaaaagaggagtaagatggtttctgtcttcaaggatttcacaatttaaccttgtgcaaatagaattmatatgttggtttgctctaattatggaaggttagtatacaagatcccttcttactcctccctcctcccttctagaactactaggaaccataaataatatat

SEQ ID NO: 40815 - DNA, 201 bp, Homo sapiens
aatattgcaagctggctactgttctagaaaaaaacaggttcttgtcatatggcccagaaaatttaggcatgcggacacattgcagggtgagtaggacaggyttattaggtgaaaagaaaaaaggaaagaggaactttcagcaaagtgagagactcctgttggcaggtctcctgcctcacagattgaatcccaggccaccac

SEQ ID NO: 40816 - DNA, 201 bp, Homo sapiens
tggccttggtattgtgctttgttctgccagtcatggttcatcatcaccatcgtttttcatttatgatttcctttggtgttgctgcattggaggaaactgcrgggaacagctacaatctcccatggtattggcattgccggttacctcctgactctgcattctctactcccaacagttgaatcccctgatggcctccattat

SEQ ID NO: 40817 - DNA, 201 bp, Homo sapiens
ttatgttagttttttaaaaatccagttaatttgttatgatgcttggtagtaaaaacaaaacaaaacaaaaaccttttatgctgttctgcaatagctagatmtgtgcaaatttatccccaaagtctaaggaggctaagaggccaaaggaagaggctgacatatccagttcctcagaaagaaacatttactatggatttccaa

SEQ ID NO: 40818 - DNA, 201 bp, Homo sapiens
cttctgcatattatttgactaagatacaattagagaattttggagttgtaatagattttagaaattattgtagttttttaaattaattaattaatttattwatttatttatttatttttgagatggagttttgctcttgttgcccaggctggagtgcaatggcattatctcagctcactgcaacctctgcctccctggttc

SEQ ID NO: 40819 - DNA, 201 bp, Homo sapiens
gattttctatattttctgtctctttatttctaagtctttgttttgtgagacttacttccataattttctttgaacatattcaaaattgcttaaagtctttrtttagtaagtccaatgtatgagcttccttagggacagtttctattcactgctttttttctccctgtgaatggccctttatttgtttttctcataattcct

SEQ ID NO: 40820 - DNA, 201 bp, Homo sapiens
cagatccaggtcttatataccacagtactgttgatcttgatttgtagacctgtaaactaaagatataagttgtctcttcccgcataaccaacatacaaagrtcggattgaagttgacagatttccaagggaaaagcaagaatgctatgtaaatttgcctaaggacaggatttatggtcaaggatgtttggcctaagggcag

SEQ ID NO: 40821 - DNA, 201 bp, Homo sapiens
tttccttctgcatattatttgactaagatacaattagagaattttggagttgtaatagattttagaaattattgtagttttttaaattaattaattaattwatttatttatttatttatttttgagatggagttttgctcttgttgcccaggctggagtgcaatggcattatctcagctcactgcaacctctgcctccctg

SEQ ID NO: 40822 - DNA, 201 bp, Homo sapiens
gtatcttttaggtttctggggcactctgttcattttcctttattctttttacttctgttgtcaggttaaataacctcaattgatctgtcttcatgtttgckgattcttttttctctccatttaaatctggtttggggcacctctagttaattttcaagcttagtgatagtatttctcaactccaaaatttctagttggtga

SEQ ID NO: 40823 - DNA, 201 bp, Homo sapiens
aatctctaagcttcaaaggtcttagtgtaatctagtccagtttggtgatagagaaaataatataatttaagggtctaagaattttaaaggagagaaatccktttttttttgctgctgttcttattgtctcttttatctgttatatatactctatatctattatatttaagtgattatttctctggtggtgctggttttcag

SEQ ID NO: 40824 - DNA, 201 bp, Homo sapiens
ctcaaaaatatgtatataagttcttagatttagaacctctgggtccttctttgttagtgtcaaaatgctcttttgaatgtaaagtcctgtccacctgcctyttgtcacatcacactagaaagtataatattctgacttgatccagaaatctcactttttgcattcaatataacatgaataattctggattaatgatcatct

SEQ ID NO: 40825 - DNA, 201 bp, Homo sapiens
cgtaattccaaatttgataatttataagacaatatcaaaaggaattactaatgtaacaatacaagaaacaagagagtgactggagcagaagttgaggaaayagtggtcttaaatttttttgaattgatggaagtcttaagtttatagcatcaagaagctcagcaaaccccaaacagtataaccaaagaaaaccatagacac

SEQ ID NO: 40826 - DNA, 201 bp, Homo sapiens
gtttttcagaaaacctttcagatatattcacaaaaatttacacaaaacctcaattctttattctattttatattatctgtaatattattttccattattgkttttaattaaagaaaaaatttggtttttcttatccaacttgtcaaaaaaaccaaaacaaaaatgacgcaagacaaaacaagaccaaaaaaacatgcacga

SEQ ID NO: 40827 - DNA, 201 bp, Homo sapiens
tttgaagcatttagaattcttctgatatgaatattcttgctaagaacatccaattgctttgtgtgtgtatgtgtgtgtagctaagaaacaattatagatckatatttttacacacaaatggcagttctttaaaatattaatttatagttcactactgtggcaatggctaacatgtgttcacccagcaggatgttgcttttt

SEQ ID NO: 40828 - DNA, 201 bp, Homo sapiens
agctccaaaacagtacatcaaacctactgagagctaaactgaaatttaatccctatcattctcagaaggtaaaacagaacttacaaacggaacttgagttraatgcctactaaaataaaaatatcaacattcttcagagtattacaagatccacatgttacaaagtattttatcaaacacacacaagacgtaattccaaat

SEQ ID NO: 40829 - DNA, 201 bp, Homo sapiens
ttttgaagagggattgcatatgtagaaggaacaaggaaaggacttatccttgttaatctgaaacccaggtgactggcagattgtctgacacacacattaggcccttaataaatgttgggagtataaatgatttcatgaactcttgggcaagaagtcagttttgttaaactttgtgatgatgtaaggagagtctaaacagct

SEQ ID NO: 40830 - DNA, 201 bp, Homo sapiens
ccccattcttttaataactacatagaatttttatgtaaacattatattattttcttttaataatttcctcgtttgaagcatttagaattcttctgatatgmatattcttgctaagaacatccaattgctttgtgtgtgtatgtgtgtgtagctaagaaacaattatagatcgatatttttacacacaaatggcagttcttt

SEQ ID NO: 40831 - DNA, 201 bp, Homo sapiens
gttggtaagcataggtctttctgtatcaccttaagcctggaggcttacatgaagctggtgtttgtcttaggaagaacagcgcaccataaaacagctggccyttactagtcttgcttttatttccataatccctggacctcaaatgaaactaaaattctttgtgacatgtttttgagaatttctacttaaggacattcttct

SEQ ID NO: 40832 - DNA, 201 bp, Homo sapiens
agccttggacaaaacaaacaaacaaaaaaacaaggtgaccccagaccagctgtctttagcataaggcccatatctggaccatgaaaaatgctcaaatgttrgaattcattcacatctttttctgcttattcatcagcaagtagccgacctcctttcactagttagatttcttgggagagagttcacaagtgtccactgaat

SEQ ID NO: 40833 - DNA, 201 bp, Homo sapiens
tcatgtggccccacccaaactgactccttgtcccaccaaactatccttgaaaaaccctagcctctgaattttcaaggagattaatttggtaataactccayctctcacatggcatagctgaccttgtgtctattaaaatctttattgcaatgctgtggtcttagtgaattggctttgtgcagtgggcaggaagaacccatt

SEQ ID NO: 40834 - DNA, 201 bp, Homo sapiens
gtggccccacccaaactgactccttgtcccaccaaactatccttgaaaaaccctagcctctgaattttcaaggagattaatttggtaataactccatctcycacatggcatagctgaccttgtgtctattaaaatctttattgcaatgctgtggtcttagtgaattggctttgtgcagtgggcaggaagaacccattgggt

SEQ ID NO: 40835 - DNA, 201 bp, Homo sapiens
gcagcatataccttccatcttttcttaagaggctgtagattatctcgacttctattacctgaagatatgtctaatggaaaccttaaaaataccgtgtcagkttctaatagctggaaatagctggaagttataatagatcaacaggaagaagcagttttgttttaaattaaataattaaaattcagaatttactttgatatg

SEQ ID NO: 40836 - DNA, 201 bp, Homo sapiens
tctcccatatataactcaaattaacagtaggaattatcactgtggacattatactttgcatttatacataattttaagtaaataatttttttttttgagayggagtcttgctctgttgcccaggctggagtgcagtggcaggatctcggctcactgcaagctctgccttctgggttcacgccattctcctgccttagcctc

SEQ ID NO: 40837 - DNA, 201 bp, Homo sapiens
aagggcatagcacgttgcttgggttggctcaaacactgaaaaaatagtaactcaatatcccagcatctatttcttcccctgctgatgttcccttcagattkgatcatgcacgtgttgcttcctacaccgcctcctggtggcatccagtgtccacagttgagccacatcttttgaatattttcacctctcattggaaaccat

SEQ ID NO: 40838 - DNA, 201 bp, Homo sapiens
tgaacccaggaggcagaggttgcagtgagccgagattgagccactgcactccaggctgggcaacaagagtgaaactccacctcaaaaaaacaaaaaaaaaacaaaaaaacaaaacaaaacagtgaaagtcacgtagcatgttatgattcaatgttatttatacctgcaatgcttgcatttcaaggacggcattattggtag

SEQ ID NO: 40839 - DNA, 201 bp, Homo sapiens
gctggcactacaggcatgagccgccgctaacggctgattttttatttatttatttaatttaatttaatttaatttaatttaatttaatttaatttaatttwtttttgtagagatgggagtctttctatgttacctagtctggtatcaaactcctggcgtcaatcaatcctcctgccttcgcctcccaaaatactgacttta

SEQ ID NO: 40840 - DNA, 201 bp, Homo sapiens
tcagtagcttcatcttctctgagtcctcttaaacagttttctagaggataacactctgaaatactcaagtgtatgaatctatgggtgatattatcactggraaatttatttcatgagtgttgtcccacgaaattaggccattcccgttcactcatttattctgtagacacatatacatgatctctacaagatagctgctta

SEQ ID NO: 40841 - DNA, 201 bp, Homo sapiens
ttcaagttggtaagcataggtctttctgtatcaccttaagcctggaggcttacatgaagctggtgtttgtcttaggaagaacagcgcaccataaaacagckggcctttactagtcttgcttttatttccataatccctggacctcaaatgaaactaaaattctttgtgacatgtttttgagaatttctacttaaggacatt

SEQ ID NO: 40842 - DNA, 201 bp, Homo sapiens
aaactcttgacctcaggagattcacccacctcagcctcccaaagtgccgggattacagacgtgagccaccgtacccagcccattccccatttttataaaayttatttgccagcctttcatatattcttccagatgcacattaaaatttacctaagttcagtatagctctataaatttaatagacaaattttatgagagata

SEQ ID NO: 40843 - DNA, 201 bp, Homo sapiens
agaatgagaggaaaagtatgagggattttgtattctacaagatgggataactagtgggaagggaaagaaactatgtgacaagaataacgaatgggcgggggagaaaagagaaaagaatgatagttcagagcccagaaatcaacaaaggtaggtcaactgtgattcctggagataccagaaagtaccagctgtgatcacagc

SEQ ID NO: 40844 - DNA, 201 bp, Homo sapiens
gcattttatttaatatttctgctgtgtacctaagtgatactcatctatgtttttattttcttgttttcttcttgtctggttttgctacaaggactacaccrattcaccaaattaatcaggtagattcctcttataattaatcttccatgaaagaatttgcaaaactaagggttgtccttccgatagtttcagatgacagat

SEQ ID NO: 40845 - DNA, 201 bp, Homo sapiens
ttggttccaagtctttgctattgtgaatagtgcagcaataaacatacgtgtgcatgtgtctttattgtagcatgatttataatcctttgtatatatacccrgtaatgggattgctgggtcaaatggtaattctagttctagatccttgaggaatcgccacaatatcttccacaatggttgaaccaatttacacacccacca

SEQ ID NO: 40846 - DNA, 201 bp, Homo sapiens
acccagcccattccccatttttataaaatttatttgccagcctttcatatattcttccagatgcacattaaaatttacctaagttcagtatagctctatamatttaatagacaaattttatgagagataacattatattttgcaatactgagtttttccatccaggaatctgatatttctcactattcattccattctctt

SEQ ID NO: 40847 - DNA, 201 bp, Homo sapiens
agatcttgaaataataaaatgtttttttcaaaactatcttaaatactcactgtaactcataatatttaactggagaagcaattataattgatttctttttctatggttcaactaatgtaccatagcctttgaggcttttccctcatgaatttgtggctcccaaaacagtgatttcaggtacacttactgcattatagcaaa

SEQ ID NO: 40848 - DNA, 201 bp, Homo sapiens
atttatttagccaaaacttggtgattgacacaagaggaggctaccgtctgtttacaattccatttaggttttagttcacggtgtactgagaaacctttagsctgaacttgatttaacagtgttgaggggagattgtatggaactgtgaaataaaagcaatgtaggatgtttgaaataaaagagagtacataaatgttaaac

SEQ ID NO: 40849 - DNA, 201 bp, Homo sapiens
cattatattttgcaatactgagtttttccatccaggaatctgatatttctcactattcattccattctctttttatatcattaagtaaaatttaatacatrtatagatatgcacacatatctataattgtgcttatttcaatagatatatactgctatgaaatttataatatttagttgctataataacaaattttgtcat

SEQ ID NO: 40850 - DNA, 201 bp, Homo sapiens
atggccactgtaactaggatgcagatcttgaaataataaaatgtttttttcaaaactatcttaaatactcactgtaactcataatatttaactggagaagmaattataattgatttctttttctatggttcaactaatgtaccatagcctttgaggcttttccctcatgaatttgtggctcccaaaacagtgatttcaggt

SEQ ID NO: 40851 - DNA, 201 bp, Homo sapiens
ttttataatgaaattcatttagtctttatattgttctctaaatggggattgacttggattctttactgattcatctaacgtcattaatgatttcccctttstgttctgaagcatcttattgaccttttcaagtgtggccataatgcttgtttctcattaatggttggatcttctatcagaaaacagtgatggacatagatc

SEQ ID NO: 40852 - DNA, 201 bp, Homo sapiens
ccttccagtgggctgaactctgagcactacatctagttgttaatttcctatagaagtaaagatgtcctaaggtatcaatatgcagtaattcatggatggtscctagcaaactgattggctggtcagggagttggaaagaaaatatttgtgaagttggtgacaaagaggatctggaggacacctcttggaactgtcatggag

SEQ ID NO: 40853 - DNA, 201 bp, Homo sapiens
acattccatagtcttaaaagtgctataatagaagtatgaatggatgtaagtacaagggaggaagtggtcacctttgggtcactaagagcacagggatactmgtcatttataggtgccaggagatagtattaattcctatgaggagatacacgtctggagctgaaggctggggcagaatcttggaggacatttgtagcatgc

SEQ ID NO: 40854 - DNA, 201 bp, Homo sapiens
cacagtgttgcatagtgacttctaaataaatacttcaagttttatctttttactggagaatatgaaagagtggagagttagaaggatttaaagttatattwttgagtcatactctaaaatatgtgatgtgtttccactaactggacatatttgaggggaccacaaatatgaatccctttgggttagtcatcttcatggaag

SEQ ID NO: 40855 - DNA, 201 bp, Homo sapiens
gacattagtaattccagcaggaataagctgtagttcctgtactcagactagtaagaggagacagacatttaaactgataaattccattctacattccatartcttaaaagtgctataatagaagtatgaatggatgtaagtacaagggaggaagtggtcacctttgggtcactaagagcacagggatactcgtcatttata

SEQ ID NO: 40856 - DNA, 201 bp, Homo sapiens
acactgatttttaagacaaattttatctcaaaatttattactttcttttttattgatattgatagattcttagcttaattctgtggattggtaataaagcrcagtcttcatttctgccattaattatataataatatgtgccattagttatgtatgtgtttcttcatttgtcaaatgcatattgggcttccaccaggtgcc

SEQ ID NO: 40857 - DNA, 201 bp, Homo sapiens
ttaaaagagtatgctcatacaatacttctgggaatgtaaattgttacaatctcagtgaagaacaaaataacaatatgtggcacctgggttatgttgccagraatccccctctaggtttattgaagaaacttgtgcacatattcataaggaaaacccggtacaagtatgatcattatagagttttttttttccatcaatggg

SEQ ID NO: 40858 - DNA, 201 bp, Homo sapiens
caacaactattttccatttaaaaagcagtttttctggcttgcttctggaccctacatgaccgcaggatgcaaagtatgtgacctgacctgtccataatgarcaaggtgttatcgaatccagtgaaccttaaaataggatgtgcctaagagcattccagtagtaatcagatgtggcatattaagagcagcctgagagaccca

SEQ ID NO: 40859 - DNA, 201 bp, Homo sapiens
aaaaactggaagcattccctttgaaaactggcacaagacagggatgccctctctcaccacttctattcaatatagtgttggaaattctggccagggcaatyaggcaggagaaggaaataaagggtattcaattaggaaaagaggaagtcaaattgtccctgtttgcagatgacatgattgtatatgtagaaaccccattgt

SEQ ID NO: 40860 - DNA, 201 bp, Homo sapiens
agaaaaatactaatctaaatgctggggtcatgagaagataggctgatttggatttcttaaatcattatttgtaggtgaaatgttttctacaaagtgcaacytaaagcaatttgccttatagcaaaatattgcctaagctttagctattaaattatattttatatgctgggtaatgtttaatacaaccagatttcagtaaaa

SEQ ID NO: 40861 - DNA, 201 bp, Homo sapiens
actgcccgtataatttgatcagttattagatactgctttctgctagttgacaagttgatttcctttacttttctataagacactgaagagagaaccgaaaatgtagcaatagaatccatttgcatttttttgcatttattaattatttaatcaacataataaaagatatttttttccatactttcctgatgaggaaaatga

SEQ ID NO: 40862 - DNA, 201 bp, Homo sapiens
tcactaatgttttcagcaagttcttggaaactgtgactttagtggccctcaaataatgttgttttattcaacattgttttcttacaatgttgatgattttwaaaaaatgggtgtcatcatacattgtttcaattaaagtcacagtttccaagaactatggaagaatttaaataaggacttactgtactatagaaattaaac

SEQ ID NO: 40863 - DNA, 201 bp, Homo sapiens
ttttagatgacagcatagatctgtatagtaggataaggaacaaaggaattttgcattttggctttgatagctgatgacagagtaagtgtgagaaaaatagtccagttcttatttagttcctttaatgtgattttataatatatagcatcttcacttcacacgcatataccacagaataaattaggatggaatgtagggtgc

SEQ ID NO: 40864 - DNA, 201 bp, Homo sapiens
aatccacattattatcaaaatagtggtgtgtataatgaaaaattacaaaatatagtacagcaagttctcactaatgttttcagcaagttcttggaaactgygactttagtggccctcaaataatgttgttttattcaacattgttttcttacaatgttgatgattttaaaaaaatgggtgtcatcatacattgtttcaatt

SEQ ID NO: 40865 - DNA, 201 bp, Homo sapiens
gatcaaaataaaataatttagagcacacctagtaaaaggactaaatttctcacttctcacttctaagtaatatttatgtaacaaaagtacttctcttatarttgagtatatccactaaatttttggtcaaattagagggtaatgatattgctgatttttctggagtgtaacaaggtttaaattgacataatgtggttagtt

SEQ ID NO: 40866 - DNA, 201 bp, Homo sapiens
ttctaccagtcaagataggctagtctatgctgcactgtcaaaaacaatttaaaaaaactagttaaagtcatagcttaaaacaaaaatgtatttctttttcmtgtcatatatgtacacaaccatttgtactgggagacacacctagttttaaggaccatagtcactcaggaacctaggctgacagaggcaccacagttttct

SEQ ID NO: 40867 - DNA, 201 bp, Homo sapiens
tagttttaaggaccatagtcactcaggaacctaggctgacagaggcaccacagttttctagctacatcatctggaatgatgcctagactcctcactggccrtggtagaagaagagagagagagagagacaggaacccatggtaaagaaagagaaactgccaacagcacatgagatttttgctaccttaacccagaagtgac

SEQ ID NO: 40868 - DNA, 201 bp, Homo sapiens
ttggactccctacctcacaactacttaaaagaagtattggtgaacagtttgggttactgagttggtaccattaagagagataagatctctccccaaagacrcctagaaaattgagaagtgttgtacttcgattgtatagaaacaagagtaagtggtgccagatctcattcttagtgcctctcccactttgtgacattgttt

SEQ ID NO: 40869 - DNA, 201 bp, Homo sapiens
tataaaaatgttcttcaagtctgccagaaaataagaattactagagatactcttaaaaaaattccaacttcttctatctcacctcagatcaatggaatcakatttttccagtaatgtcctgcaaatttgtatttgtatttgtatagtgttctaagattagcgtatttggaaaacactgcatcctagtgtgtaggtagcctt

SEQ ID NO: 40870 - DNA, 201 bp, Homo sapiens
aatcccaacactttgggaggctgaggtggacagatcatgaggtcaaaagatcaagaccatctcaggtcatgaggtcaaaagatcgagaccatctcctgatygaggcaggagaatcgcttgaacctggaaggcggaggttgcagtgagccgagattgcaccactgcactccagcctcggtgacagggtgagactccgtcacc

SEQ ID NO: 40871 - DNA, 201 bp, Homo sapiens
tgccgtatgaattaagactgtagcccaaggttgaaaatgggagctgaagatctttgtaaaagtgagatgctgtcctcctttgttatccatatcctccaatstattttgcactagtgtcattttaaggtctcttactatgtactcatttcttttttctttttctttttttttttttttttttttttttttgagacggagtct

SEQ ID NO: 40872 - DNA, 201 bp, Homo sapiens
atcgaggcaggagaatcgcttgaacctggaaggcggaggttgcagtgagccgagattgcaccactgcactccagcctcggtgacagggtgagactccgtcmccaaaaaaaaaaaagaaaaaagaaaaaagaaaaaagatgtgtaaggaaattagatagcatttcttggcttattagctgttaaaatgtccaagggaaaata

SEQ ID NO: 40873 - DNA, 201 bp, Homo sapiens
acacatatctataattgtgcttatttcaatagatatatactgctatgaaatttataatatttagttgctataataacaaattttgtcatgaaaacttttawaatatatagaaaaatatattattcatctcacattcattctgcatgaagaagtgttaccgaatactcaatagtaataacagttttcagataatcttgtttt

SEQ ID NO: 40874 - DNA, 201 bp, Homo sapiens
tgctgagctctgatattcatcactatgtttgtaccctggccatgctctctgagggctgttcacagacaatgactgagcacagcaggagttctaaggtacayttgttcctgagactcatggacccctctcattgacccctgtgacttgaggactcccaaatggctttattaaccttctttagaatgtgaattctaggaggct

SEQ ID NO: 40875 - DNA, 201 bp, Homo sapiens
atttagttgctataataacaaattttgtcatgaaaacttttaaaatatatagaaaaatatattattcatctcacattcattctgcatgaagaagtgttacygaatactcaatagtaataacagttttcagataatcttgttttccctaggtagacaattttgagacctgggaataaatatagttatttgttaacaatattt

SEQ ID NO: 40876 - DNA, 201 bp, Homo sapiens
tttagacttgccacaaacatcagccaggagatgctgctgtaagatgacatagtatttcacttgatgatggtgagtgagtagtataatttttttacttggtwaatttatgtaagcaagcactcaagaaaaagtttgtgcatatttttttcaaactgagtcacaataaaggaagtgagagattttgtggctcttgtgacagcc

SEQ ID NO: 40877 - DNA, 201 bp, Homo sapiens
ataaacaacattgtcttgctttattattattttttattacacagttgaattaaattggctaatatttcatctacaaattcatgtttaaattaataggaacrttgcctgatagctcttctcctttgtctaatttctgtctaattttgttatcagttacataagcagtaaaacaaaattattgaaatggaaagaggtctagaa

SEQ ID NO: 40878 - DNA, 201 bp, Homo sapiens
tattcttactttactcatgtaaagtgtccttcaacaggacatgagatttggttttctcagaagccacctaaggggccaggtgatgtaacctgaaagtgagrgagttagttcctgagttaatcctaatgtgaatcagtaagggagggaagaagacatctagagttagcaaataaattccattcctttacttcctctgatata

SEQ ID NO: 40879 - DNA, 201 bp, Homo sapiens
gcttgaaccccggaggcagaggctgcagtgagccgagattgtgccactgcactccagcctgggtgacagagcgagactctgtctcaaaaaaaaaaaaaaaagtaatttaaatgtatatattttttcacaagccttgcagacttaacactttaaaaaatcagctcggtgtggtgtgattgtagtgaggtgaggtggtacgtg

SEQ ID NO: 40880 - DNA, 201 bp, Homo sapiens
caaagttcaagagaatatgaatttcctaagtaataatttgtctccatgtaacactcttactacagtcatctctatgaagttcacctacctctatcttcttrtagtatttggagacagagttttagtttttgatcctttcacgtgtccctttaaatagattgtgcttgttgggattcactttcattgattttgacttctatc

SEQ ID NO: 40881 - DNA, 201 bp, Homo sapiens
aataggtgcataatcaatatttgttagttgatgaaattgtttccctgcaatttgctatgtgcttttacagcacagttatattagttaaatattctacagarcccataattcataatcatttcttattactaccaagggaagcagagcagcgctgcttcactaggagaaagagaagggctgacttgttagccagaggtcatt

SEQ ID NO: 40882 - DNA, 201 bp, Homo sapiens
cccataattcataatcatttcttattactaccaagggaagcagagcagcgctgcttcactaggagaaagagaagggctgacttgttagccagaggtcattyggtgccaacatggggagatcacagctctttctgcaattatcagaagcagagcatatattacattctgaaatagacaatgaagctcttggatttgtcgatg

SEQ ID NO: 40883 - DNA, 201 bp, Homo sapiens
tgccacacttgccaacatttggcatccagcttgggccctttaagagttactttacttgattaaaaataaataaattaaaagctaaattgggacctattcartagttccatatttgatatcttaagtgaaggtaaaacttgaaagaagctgccccccaagccttgttaaggatgatggccagactagaagaaaaacaagtac

SEQ ID NO: 40884 - DNA, 201 bp, Homo sapiens
tagaattcttttcgtttctctttcccttgtttgagtagctacaaaattactaagtcctgtacaatctccctctctctctgtctacttaattcttaccccgsagatgagaaaccaagatcattagtcgttcttcaccttttcctgagcctcatctattgcctaggaatcttgaaactataagtgggttggaaaattgagccc

SEQ ID NO: 40885 - DNA, 201 bp, Homo sapiens
tcccttaaaacccatttttcttctatttgtcatctcatgttcatcaagaagatgatacattctcaagcatactgattcaggcattcatgcattcattcacyccccaaagaactatttatagactgtctactgtgtgtcaggtactggcactgtaggctgaatgatgagcaaatacaggggtggtccctgcttttataaatc

SEQ ID NO: 40886 - DNA, 201 bp, Homo sapiens
tctcagagtagcagagcattctcaggtctaaaagactactcttccaacagacacacactttcgtttccatcagttgaattatatgtcaactaagattcaayactgttcccctggatgaagaattcttgtttgacaggtttgtttttatttctctgccccaggactttgaccttgtcatctcattgtattcctgcctctatg

SEQ ID NO: 40887 - DNA, 201 bp, Homo sapiens
ctcttctaaactccgctttcagtgatgtcacattaatagctggaagtaggccattgtgcagtaattacattgcaagaattggcaaatgctacacatcagarcatggtttatgatactgattgtcagaaagtgatggagaaaagtgttaataatgtagactaaacttatattttgctgtgtgtataacaattaccttgtaac

SEQ ID NO: 40888 - DNA, 201 bp, Homo sapiens
agtattcttaggatggttttggtgggatgcaatggggtacattgaagtggaggagactaaagctatccactccagtgtcccctgggccctttggtgactargatggaagaaatcctcatgttattaaaacagtggtacttatgtgagaatgtggagtgggtgaagtatatctgcggctgagggctgagggctggtggtggt

SEQ ID NO: 40889 - DNA, 201 bp, Homo sapiens
ctctcttctagctattttgaaatacacattagttcagactatagttaccttactgtgcagttaaacactagaacttattcctcctaactataactttgtayccattgaacatatatatttttatatgtgtgtatgtgtgtacatatccgtgtatatatatgtgtatgtgtatatatatatagagagagagtgtgtgtgatg

SEQ ID NO: 40890 - DNA, 201 bp, Homo sapiens
tgtgtatttaaaggtcccatgggggaaaacagtacaatcattagattatactatgacatattttaaacttataattgagttattaataaagcagccatccktttaattaagcacctaaatcaagattacatttttacattagaaatgtcatatggtttaaagttttaagataaatcagactctgaaaattgtaacatatat

SEQ ID NO: 40891 - DNA, 201 bp, Homo sapiens
agagaaccaggagcaaacaaatcccaaagctagcagaagataagaaataaccaaaatcagagctgaactgaaggagattgagacacgagaaagcatttaaagatcaatgaatccaggaaccatttctttgaaaaaattaataaaatagaccactagctagactaataaagaaggaaagagagaagattcaaataaacataa

SEQ ID NO: 40892 - DNA, 201 bp, Homo sapiens
atcccaggtatcgtctgaggaaggtttggggagtgatctgtatgtttagattttctgcctaactttattaatgtggtatgaataaggagctttttttttttagaaaatgacactttatacaagtcagttcctctctattttctttatggacggtactggggtggcagcaggactcaccatgaaaactgtagtggtaactct

SEQ ID NO: 40893 - DNA, 201 bp, Homo sapiens
ttcaataaataaatatttgttgttgtgggggctgatttgtgggactccccaacctctgcaaataatgtgatttgtgctgtcaccatggcaaataaagaatmatttgtgctacgtatgtaagtaatccaaacaaaactttgcataaatattttaagaaactgaaatatcagaatagatgagccattgaataaaaatcaacat

SEQ ID NO: 40894 - DNA, 201 bp, Homo sapiens
catttctgctttcaatctgagaggaagtcagtaaattccttttgctgttacaaaagtagtttaaattccatgcaggacacgagtctgggcaatcacatcascctcagcgtaccaaagagcctagagagacagcagaacaatgtctcccactcgagctacagagggaaggtggtcttaggttttgctgcagtaactggaagc

SEQ ID NO: 40895 - DNA, 201 bp, Homo sapiens
ctcaggccattttcataccattcatcatctgtgggatgttgccatatctggtgttcttggcacacttcaagtatgtgagctatagggagaaaagttggaartggacccagatcttattgcacagaaaaaaaaaaaaaaaaagaaagaaagtgagccttgaggcatgaaatctcccaagagctagccctcacacctgcaggt

SEQ ID NO: 40896 - DNA, 201 bp, Homo sapiens
ttgttctctctccatcacaaaatttcatgctatttatctgtgagaaaatgcctgaggactttcacacagtaattcatcttatctggaacccttaggatcasatgtagaccgagcaaatgtcaagttcacagagaacacctgtgtcttcagaacattaaagggcaccattagagcttgtttcccttcacttaacatgcacat

SEQ ID NO: 40897 - DNA, 201 bp, Homo sapiens
ctaatatgctttatgacagattggtgggttggctatctccaaaacttctaagacatagaaattcagattgaggtcataggtattcagattaatctgtaackgtcttggaagattattatataacatagcaatcaataattatcttttaaacaaagcagtgctgatttctgaagcagtggactaagcaagtagatctaaaca

SEQ ID NO: 40898 - DNA, 201 bp, Homo sapiens
taacactttgcctcagagagaaagccttatacaaatagaacttgatttcaaaatagctcaaaattcaagaggacttgaagatcatatatttgaaagcaatratctctaaaattaaaatcagtcggtttccttcaatttatttttgttaaaatagttcttttaagaatttcgagtttccaaaatcctcctggaaaaaaatag

SEQ ID NO: 40899 - DNA, 201 bp, Homo sapiens
agaattctgagattaaaaagtaattgctaaagttattgttactattgataaagactggaattagaatgccattattgcatggggataagcatgttttgtgkcccaataaaagaggctgctcaaaatgacctctgatctgtccttcttgattcaggattttatgatcttgtgacattgcagaactctaagaacagagtaatt

SEQ ID NO: 40900 - DNA, 201 bp, Homo sapiens
atgtttattacagcactattctcaatagccagggtatggaatgaacctaaatgtccattaacagatgaataaataaagaaaatgtaatatatatatatatwcacaacagaatattgttcagctatttaaaaaatgaaatattgtcgttggtaacatggatgagcctggaggacattatgttaagtaaaataagtcagacgt

SEQ ID NO: 40901 - DNA, 201 bp, Homo sapiens
aatatacattgaaaaaaatgacaccctcttcaacaaatggtgctctgaaaactggatattcatatgcagaagattgaaactagaagaccatctctcactayattaaaaaatcaactcaaaatggattagagaattaaatatcagactgaaactataaaactagtaaaaaaagataaaggaaatgttgcaggacactgatcc

SEQ ID NO: 40902 - DNA, 201 bp, Homo sapiens
aacctttcttatctctggccactttttctaagtctcattgaaggagtaacctcatgtttctgcctaataaatattaatatcttatatacctccaagaactytttctcctcacataatcatatctaattaccatcaataaactagtaacttcttaattaatatctctactgtagaccccctcttaactacacatctaactat

SEQ ID NO: 40903 - DNA, 201 bp, Homo sapiens
aatccactcggggcagttaagtttaataacctaaggactttcttttctcaggtgtttccccccataacctaaagcaataattcttacctttatattcatayggtacagaattaggatcatttttattaggaaggagtggaagaaaggacacagcttccaacgaacaaattaagttgtacacaggactttaaaaaatagaat

SEQ ID NO: 40904 - DNA, 201 bp, Homo sapiens
atttatttaaaatagaatatctttaccagattagaacaaagtaatgatgaaaagcagacttaacctatagtatggtagatcttttttaaagggtcattgaraaaattttccatctcaaaatatctgtttcattgccgtccctggctctaccactggtgactcatccttttgtttcaagcctgatcatcctcctgaccttga

SEQ ID NO: 40905 - DNA, 201 bp, Homo sapiens
acaaagtaatgatgaaaagcagacttaacctatagtatggtagatcttttttaaagggtcattgaaaaaattttccatctcaaaatatctgtttcattgcygtccctggctctaccactggtgactcatccttttgtttcaagcctgatcatcctcctgaccttgatagagagtgagggacagaactagcctaggtgtcag

SEQ ID NO: 40906 - DNA, 201 bp, Homo sapiens
ggcagttttttgcattcaaaccatgtctatggagataccaaagagcttcaggaaagaccagataaatttcacaagattttttattttttacttcattttttcttcataaatttgagaagattttaacattatttttcttacctttgacttttattttggaatattctggtaatattatttaaacataattttaaatgaaat

SEQ ID NO: 40907 - DNA, 201 bp, Homo sapiens
ctatagtatggtagatcttttttaaagggtcattgaaaaaattttccatctcaaaatatctgtttcattgccgtccctggctctaccactggtgactcatycttttgtttcaagcctgatcatcctcctgaccttgatagagagtgagggacagaactagcctaggtgtcaggattctacaaggccaggctccacaacagg

SEQ ID NO: 40908 - DNA, 201 bp, Homo sapiens
ggagaataaaaacccaggtaattcaccatcatgctgttccttgggtcccaagatgcctgaccagtctaacttctgtctacctttcagagtttcagcatacrtaatctattctggtggatgtgtaatggtatagcatgactttaatttgataactaattaacttgaagtcttcttaaaatatactattttggccatttggat

SEQ ID NO: 40909 - DNA, 201 bp, Homo sapiens
acccgggaggcggagcttgccgtgagccgagaccgcgcctttgcactccagcctgggcgacagagtgagactctgtctaaaaaaaaaaaaaaaaaaaaaaagaagaaaaataaataaattaaaagaataaaaaatatatactgggaaactacgaatcaaaagaaaactggaatagctatgttagaatagatggagtttgag

SEQ ID NO: 40910 - DNA, 201 bp, Homo sapiens
gtaaataaaatgaacttgaactaggaaccagaaggaagggaacaaacattaacatgattgttcagctgaggaattgtctggctaggcattctcatctacartgttttttagagcccaaatagggcaataaggtcagccatgtttaaagggcctagaatataccatacattttagagggcagaaggaatggtgggaaggaaa

SEQ ID NO: 40911 - DNA, 201 bp, Homo sapiens
gtttatttaatttggtggcacaagtataacacagatactgattttccagttgagtaggacagcagaaattccataatttgtatctctcgccaagtgtcttmgtcacttggcttatggaatcactgaaataatgagttctcatatcaatacctaggaagttactgttaagatacaagagttaagttgcctttaagatgcaag

SEQ ID NO: 40912 - DNA, 201 bp, Homo sapiens
aatctttcataaaaatgaaagaacattttgtcccaggtttttcttttcaataaatgtgtaaatttaaataactaccttttgtcccatttatttaagataakttagattctgctttttgtagacttggttaaggatgtagcaaaataccaataaaaagtctggtcaatcatttcaatgccagaatgcttttcaagactttct

SEQ ID NO: 40913 - DNA, 201 bp, Homo sapiens
gcactctgtaaaatggaccaatcagcaggacatgggcggggacaaataagggaataaaagctggccactccagccagcagtggcaacctggtagggtccgyttccttgctgtggaagtgttgttctttcacgcttcaaaataaatcttgctactgctcactctttgggtccatgccatctttaagagctgcaacactcact

SEQ ID NO: 40914 - DNA, 201 bp, Homo sapiens
aaaagaacaacactgagattttggctgtctccctccataggcacacaaagtatgtaatttgagcctaaccaattaattgccttctaatataaaaatagtawctttctttggaggaatattagagaatgcagaaataatgacttggatacaatacagactggcttcacattcaaagaaaaaatatatgattaacagagtcca

SEQ ID NO: 40915 - DNA, 201 bp, Homo sapiens
atataaaatacacatgtaaaatatactatatgtaaaatatatataatatatgtaaagtattattttatatatatatatatatagagagagagagacagacagacagacagacagacagacagacagagagaccaagtctcttattccgtcactcaggctagtgtgcagtagcatgatcatggcttactgaagcctcaacct

SEQ ID NO: 40916 - DNA, 201 bp, Homo sapiens
tctacaaaacctctgagagtatgaaatttctttttttcttttctttttctttccattagttgagagatagattaaatggaaggcaattcatacatggtgarggccaccaggcttcagactctccccatacattatctcgtttaattctcaaagcatcccagtgaggtcatcattatcatactcattttataggtgacaaaa

SEQ ID NO: 40917 - DNA, 201 bp, Homo sapiens
aatataaaatacacatgtaaaatatactatatgtaaaatatatataatatatgtaaagtattattttatatatatatatatatagagagagagagacagacagacagacagacagacagacagacagagagaccaagtctcttattccgtcactcaggctagtgtgcagtagcatgatcatggcttactgaagcctcaacc

SEQ ID NO: 40918 - DNA, 201 bp, Homo sapiens
acatggtgagggccaccaggcttcagactctccccatacattatctcgtttaattctcaaagcatcccagtgaggtcatcattatcatactcattttatargtgacaaaacaaggtcaaataatttaatatcttgctcataatcagaagcttattaactgtaggaactgggttcaaacccaaatctgtttgtctccaaaaa

SEQ ID NO: 40919 - DNA, 201 bp, Homo sapiens
aaaataaaaaatataaactttatttctcatcataaactccatcaagttgaagacacttttgtaaataatgatactagccatttagttcatccctaaagaaytgaatgtcctggaatttaaccgtgccaatgcagtcttttttacattatcaactgaagaaaaatgagtgccctttaaatattttttgagatttggaaacaa

SEQ ID NO: 40920 - DNA, 201 bp, Homo sapiens
taaaatataaaatacacatgtaaaatatactatatgtaaaatatatataatatatgtaaagtattattttatatatatatatatatagagagagagagacagacagacagacagacagacagacagacagagagaccaagtctcttattccgtcactcaggctagtgtgcagtagcatgatcatggcttactgaagcctca

SEQ ID NO: 40921 - DNA, 201 bp, Homo sapiens
tttatcatgtactttgacttttgtattccacttctgccatagccaggtgggagacaagctgttgctttggttagggttgccagataaaataatacagaatkcccagttaaatttgaatttcatatcaatgatgaataattttctagtagaattatgtctcaaatattgcatggggcacacttatgctaataaaaatattta

SEQ ID NO: 40922 - DNA, 201 bp, Homo sapiens
atatgtaaaatataaaatacacatgtaaaatatactatatgtaaaatatatataatatatgtaaagtattattttatatatatatatatatagagagagasagacagacagacagacagacagacagacagacagagagaccaagtctcttattccgtcactcaggctagtgtgcagtagcatgatcatggcttactgaag

SEQ ID NO: 40923 - DNA, 201 bp, Homo sapiens
ttcttaattcttgatgggttagtctgtctttctgaggcagcccaattaggccaaatagaatggaaaatatttaatccctagaaaatttcgagagggtaacstatttagtagcttgttctagaacacacaaatagtaaatggcagcatcaggtttttgcaggtccaaatagcctccacaatacacattcaaaatttaaaaag

SEQ ID NO: 40924 - DNA, 201 bp, Homo sapiens
aaaatatatatatgtaaaatataaaatacacatgtaaaatatactatatgtaaaatatatataatatatgtaaagtattattttatatatatatatatatagagagagagagacagacagacagacagacagacagacagacagagagaccaagtctcttattccgtcactcaggctagtgtgcagtagcatgatcatggc

SEQ ID NO: 40925 - DNA, 201 bp, Homo sapiens
taaacttctattctaacaatgaaaaacctgactcccatcaccatcatttgtttacctaactgtttaatttcagtacactagtataacattatgagaatcawtaacctgtacccttatggaaagtagctttatcaagtgcagcatattgcttactggtaattccttttgacttcagtcttatggattacattaattttcaaa

SEQ ID NO: 40926 - DNA, 201 bp, Homo sapiens
cagcaactttcaaattataaagcaattaaaaaaaccctcagttttcttcttcagtggaatccatagtgattgtatgaagcatttcatctggtttggatagytgggtttcagcatctattttgagatcccagagtcacaaaaagtatgctatccttaaacttagttttctcttgtgcccagaataatcctgtattctgaatc

SEQ ID NO: 40927 - DNA, 201 bp, Homo sapiens
caaaatatatatatgtaaaatataaaatacacatgtaaaatatactatatgtaaaatatatataatatatgtaaagtattattttatatatatatatatakagagagagagagacagacagacagacagacagacagacagacagagagaccaagtctcttattccgtcactcaggctagtgtgcagtagcatgatcatgg

SEQ ID NO: 40928 - DNA, 201 bp, Homo sapiens
ttactctttgtgctgtaaatttctatggcttttgacaaaggtatgtcatgtatccaccattaatatatacaaaattgatttaccagtcaaaaaaggcctgygcttcacctattcaatcctcctcctctcgccttgaatcattggcagtctctcattgttttactgttcctctagttttgttcttttcaacatactgttcaa

SEQ ID NO: 40929 - DNA, 201 bp, Homo sapiens
gaagtacttgttctataaatctaggtgctctactgttgagtctgtatatatttaggatatttaagtcttgttgaatcaaaccttttatcgttgtgtaatamccttctttgtcttcttttactgtagttggttttatctgataaaagaataccaactcccgccgtttttttgttttctgtttacatgatagatcttttccca

SEQ ID NO: 40930 - DNA, 201 bp, Homo sapiens
atgctcaaatcctttctgtggaggagttcagcatttggggtatggcaaacattgttggttggctgagtcgaaagctcttgctaacactcttctttcttgcmtggctatacaaaagcattggaaaattcctagcagctactgatatgtgagcagaaacttgctggaagtgatagtggtggtggcggtggtaaagatgcttct

SEQ ID NO: 40931 - DNA, 201 bp, Homo sapiens
tctaaatccaacaagcttgtaagagccagacaaatgaatggggctatcctagaccatcaatccccttcaaaactggcagatgacttcagagatgagccagrccagccccgatgagaattgccttgctaactcacacaattatgaacaaatacattattgttcttataagtaaaaaaaaattgaatagccaccctgtaaaaa

SEQ ID NO: 40932 - DNA, 201 bp, Homo sapiens
tttttttttaaaaatactatttttattaatatattcagtatggaatagaacctttctactatacttatttgtaataaattatggattttaaaatggtgggwaatgttgagtggtctttgaaggctgtaacatttacagggaaacactggcaagggtttcagaaaaaagcctttaccttatgttttcaggttttccctttta

SEQ ID NO: 40933 - DNA, 201 bp, Homo sapiens
ttttgccactgcactccagcctgggcaacagagcgagactccatctcaaaagaaaaaaaaaatttaagactgtaattttgaggaaataaagagaacaaatrtatcaaacagaatttgaacattcaaagatatttattttaaatatttcaccattaaaatgtttacatcttatagtgtgctgatggcatcataattactcaa

SEQ ID NO: 40934 - DNA, 201 bp, Homo sapiens
gctgaataatttcaaaataaataatcaaaaaaatcatggagtaggttgggtgcgatggctcacgcttgtaatcccagcattttgggaggccaaggcaggcrggtcacctgagaacaggagtttgagaccagcctagccaacatggtgataccctgcctctactaaaaatagaaaaattagccaggcatagtggcatgcacc

SEQ ID NO: 40935 - DNA, 201 bp, Homo sapiens
ttatctcgtttaattctcaaagcatcccagtgaggtcatcattatcatactcattttataggtgacaaaacaaggtcaaataatttaatatcttgctcatratcagaagcttattaactgtaggaactgggttcaaacccaaatctgtttgtctccaaaaactcccgatatccttgtttccctcagtgagcagaaacattc

SEQ ID NO: 40936 - DNA, 201 bp, Homo sapiens
ccagtgaggtcatcattatcatactcattttataggtgacaaaacaaggtcaaataatttaatatcttgctcataatcagaagcttattaactgtaggaaytgggttcaaacccaaatctgtttgtctccaaaaactcccgatatccttgtttccctcagtgagcagaaacattctacagagatcttatgaataccaacaa

SEQ ID NO: 40937 - DNA, 201 bp, Homo sapiens
acactgatgtaacattagaaaatatgtcataaaatcattcaaatttgaaatgtaaagatattttatttctaacacttttctgttttgtcacagatattacktatcttaaaattcgaccttgtttgtacacaatagcactaaaactgcacatgacttgaaatatactctattacctagtaactttgacagaacagttctggt

SEQ ID NO: 40938 - DNA, 201 bp, Homo sapiens
aaagcaaagactgtaaatccatttaaataacattttgtggtacttttaaaatagtgatccaaagtcatatgttgtttatttccactgcatgtggctaatgsgtagtttctccgcaactggatgtattttagatcttagcaggaaaaactgcaatgcgttaaagtataaaacaactgacagagatattttaaaagttagaaa

SEQ ID NO: 40939 - DNA, 201 bp, Homo sapiens
tatttattttgaaatttcaaatcagctgaaagaattgactctttttttcttttatcaaagaaggtatcggtttgaaaaaagttaagaaatattttcttgtyggtaattcagatgtttcttaaaatctgaagagtgacacacttttagggaattatttctacatgacaaatggttttgaagccatgaatcaagatacacata

SEQ ID NO: 40940 - DNA, 201 bp, Homo sapiens
ttttgacaaaggtatgtcatgtatccaccattaatatatacaaaattgatttaccagtcaaaaaaggcctgcgcttcacctattcaatcctcctcctctcrccttgaatcattggcagtctctcattgttttactgttcctctagttttgttcttttcaacatactgttcaattgggatcatatagtctgtagccttttca

SEQ ID NO: 40941 - DNA, 201 bp, Homo sapiens
tttctttcacttatgaagattaatttagtgggatatgaaattcttggttgaaatttctttttagaatgctgaaaatgagctcccaatctctcctggcttayaaattttctgctgagaagtctgctgttagcctgatgggattcccctttatgtgatctgatgttttttcccagctgcccttaagattttttttataacatt

SEQ ID NO: 40942 - DNA, 201 bp, Homo sapiens
gatacacatagagaaattttaaacactcttatctgagaagaagcaggatataatacggatacttcctaataaagaccacaaatgttataaggatgagaaawataacaaagattagggactttaagtctctggacgtctcctgagattctcagtctacaaaaagtagggcatgtgttaaattattgatttgccttgctgaca

SEQ ID NO: 40943 - DNA, 201 bp, Homo sapiens
aactctcaaataaccacagatctgatttctgccactacagattgactggcaagttttagaatgttatataaatggaatcatgcagtgatatggtttggctstgtatccccacccaaatttcatgttgaattgtaatccacatgtgttggaggaggggcctgggggggtggtgattgaatcgtgtgtgcggacttccccctt

SEQ ID NO: 40944 - DNA, 201 bp, Homo sapiens
catggacattaatttcgtttattccccaatattattagtcataagcataggcactgtgcctgaataattggggcagtctgattcagcaggcatcctggtarggaatgaagtcactgtggcgggatgcatagattatttcaatggaaaggggcattgtaattatgtttgagtgttgtagctaaaagactgcatatgtttgtt

SEQ ID NO: 40945 - DNA, 201 bp, Homo sapiens
ctatcattaaaaattaaaacatttctcacttttacagaaagcctttcaatatgtatagaatgtaaacaatgatcctagatgacttgcactgctctgagaawtagtagttatttgaagttatttgtccactgagggctttggcaaaggcgagggcagtttgatatataagtagaatattatagataagaaataattacttat

SEQ ID NO: 40946 - DNA, 201 bp, Homo sapiens
ttttataagacctctgcctatgaataggatatgtgagtcacaactatggaaaattaggcctctgaaatgctgaaataatacaaagggttgttttgccaaaygcttgacactaagcaaagacgaaaaagctgtttgatgtgcagatcatcttctgctcttattcttgccatcacatctaaaagttttgggaactgtttgact

SEQ ID NO: 40947 - DNA, 201 bp, Homo sapiens
ataatcctctgtgccatgaaaatgaattttctgaggaaattcactcaaaaacccatctagaggtaaattcttttaaaatttaaataagtagtcttattatrtaaagactgttacgttaggtaagctattcactcatatatagaaaaagttctttcagtatgtatatatatacacatctctttacccactccttttgtttgt

SEQ ID NO: 40948 - DNA, 201 bp, Homo sapiens
atgaaaacagaaacaagacataccaaaaaacctatggaacacagaaaaaatagtacaagagggaagtttaaaggaataagcacctatataaaaaaaaaaaagatttcaaataacctagtgatacacctcaaaaaatagaaaagcaagaacacgccaaacccaaagttaatagaggaaaataaataataaagatcagcacag

SEQ ID NO: 40949 - DNA, 201 bp, Homo sapiens
ttgttgaattttgtcaaaggccttttctgcatctattgagacaatcatgtggtttttgtctttggttctgtttatatgctggattacatttattgatttgmgtatattgaaccagccttgcatcccaggatgaagcccacttgatcatggtggataagctttttgatgtgctgctggattcagtttggacaacttctttta

SEQ ID NO: 40950 - DNA, 201 bp, Homo sapiens
tgaaccagccttgcatcccaggatgaagcccacttgatcatggtggataagctttttgatgtgctgctggattcagtttggacaacttcttttatgttcastttatgaggactcagcttaaatatcatcttctcagagatcaatctcccttctccctaaatcactcctccagctgtgacttattatgttaccatatttatt

SEQ ID NO: 40951 - DNA, 201 bp, Homo sapiens
atttattttagagtctatatcacaacctgaagttatattttatattaatttgttacctttattatatataacacactcacacagaaagttcatgaagtcartgatttgatctcccttattcaccattaatatcccctgtacctagcagaaataaaatatatattggatgttcaataaatatttgttcagtgtataaatcag

SEQ ID NO: 40952 - DNA, 201 bp, Homo sapiens
ggactatgatgtgaatgacttgttctgaagggccccgaggggcaaaatacaacctatgagcagatgttagaagaatgcaaattttatctcaatatagagawgagttttttaacagagctatcctgacaggaattggactttattgagaacacaggatttggagtttctcaacactgcagacatttaacacaaggagagtga

SEQ ID NO: 40953 - DNA, 201 bp, Homo sapiens
gatctgtctgttttatgaaagagagaaatgtgatctggatgattgctggagtactacaggtgtgtgaacagttatactcaacctggtggaaggataaagcsatctatagggcttaatccttgctccactttaacaagtgacttggaagaatactgaaaaagtaaacattttatatttgtgtaaggcacaaaactgagaaag

SEQ ID NO: 40954 - DNA, 201 bp, Homo sapiens
caagtgacttggaagaatactgaaaaagtaaacattttatatttgtgtaaggcacaaaactgagaaaggtagaatggtctaatgtttgaaaactcataagytgaaattaaataagggcaaatataaagtcagggccttagcttaaatacaacctattgcacgagcatatagtgaaacgattgcacatcaaaagcacatggg

SEQ ID NO: 40955 - DNA, 201 bp, Homo sapiens
gggcccatagtttaaaggataggcagaaaaagaataagttgttttaagccatagtgagctatcacctcattactggaagtgtttaaacaaaagcaaaatarggtgtaccttgacaaaaatattggagagagaatttcattattgagaagtagaagaattagatcctcttaagtgttctttccataaataagattcactaat

SEQ ID NO: 40956 - DNA, 201 bp, Homo sapiens
ttgcatgggacatgacaataattacttcatttagaaagtttagagcaaggccgtacaaaaatactcttccagtgaatattcaacaacagtctaattcatgkcataacagtgttgttctgcacatcagatttctctgaatacaaatattaaaagtaaagagataaataaaggtgtatctggtgaacactacccataataata

SEQ ID NO: 40957 - DNA, 201 bp, Homo sapiens
tcttcttttgagaaatgtttattcaggtctttgggacttttttttccccaacatgtctaaataaactgttattgaaacacagccatgtgagttcctttatktattgtctagggttgctttcatacaacaaggaaagagaccatccacctaacctaaaatagttactatctgacctttttaaaaaaacttttaagttcaggg

SEQ ID NO: 40958 - DNA, 201 bp, Homo sapiens
ttgctttcatacaacaaggaaagagaccatccacctaacctaaaatagttactatctgacctttttaaaaaaacttttaagttcaggggtacatgtgcggktttgttacatagggtaagctcatgtcacggggcctgaagcattgctccaggaacatagcccccccatgggtatttttacacaaaaactggaggctattca

SEQ ID NO: 40959 - DNA, 201 bp, Homo sapiens
tacagatccagaatgttaacattaccagagcatagtcaatgtaagctttgcagaattaaaattatccttctaaaatgcatagatgattatcttatgctcartgaaaattaatgtgaaaacttataatgcattcagctatagattactatagcataaacaatcttttgtaccatttctataaaatttagaaaatattttaaa

SEQ ID NO: 40960 - DNA, 201 bp, Homo sapiens
gagaccatccacctaacctaaaatagttactatctgacctttttaaaaaaacttttaagttcaggggtacatgtgcgggtttgttacatagggtaagctcrtgtcacggggcctgaagcattgctccaggaacatagcccccccatgggtatttttacacaaaaactggaggctattcaaaagatacacatgaagtctatt

SEQ ID NO: 40961 - DNA, 201 bp, Homo sapiens
gcaagaattgaaaaattacctattgggtaccatttttgctacgtgggtgatgggtatgctaggagcccaaacctcaccattacacaaacctgcacatgaamcccctgaatctgaaacaatataaataaataaataaaaattacagagagtatcaagaaatagagaactcttaagagaacaattactgatgctggtgaaatt

SEQ ID NO: 40962 - DNA, 201 bp, Homo sapiens
aacattaaaaacaagacatttaaatattataatttcaacgatagtcatttcatatttcattgtgaccaggttatactacatttttaaagatacattatttstcatatatactgatgaccccaaattacagaaattgtaatatgcagtctttgcttgatgactaaggtctgtcatgtgtttaacattatattcacttaagag

SEQ ID NO: 40963 - DNA, 201 bp, Homo sapiens
aagtatatttttgcaacaattagaacttctgtgatttaagcctaaatctctctcctcttccattgatttatagagtagaacgttggtattcaaaaatgccmgttttccaccttataacatggacaaaaaaaccaaagttctatatctttagtagtttataatgccaccaaggcatgaatttaagtggtatattgtgatata

SEQ ID NO: 40964 - DNA, 201 bp, Homo sapiens
ttttaatgttcttttttttcccatgatgtattcccccacacttagaacagtgtctggctagtaaatgtgctttaaatatttattgagtcaataaataaacrgtgttaaccatatatgtgctttgggaaaagagacctgtgcagaaaatttgggggtggtggggttgtttcagatacagcacttgaatccaaccaattataa

SEQ ID NO: 40965 - DNA, 201 bp, Homo sapiens
gatcaaaatacataccttttagaagtatatctatatatagataggtagatatcattagatagatcattagatatatatctatatattaaataaatgatatattagaaaagcttattctttttcttccttagttagtcttataatctttctcttttaaagtgaattgtgttagataatattcatttgcactcactgaatcat

SEQ ID NO: 40966 - DNA, 201 bp, Homo sapiens
tctctctaaaataattgcttcaaggatgctgcccatatctgctgtccccatatctggagccctttagagcttttgtgtgacaaaggttgaagtgtaacatyactcatatgtagtatttcagtttttatgtgctgcttgaagtctagcacctcctttggaactctgcatccattatatgttcacgccttggccaaaatgtcc

SEQ ID NO: 40967 - DNA, 201 bp, Homo sapiens
aatctgaaaagctctctgcctactttgttttcccttatgaataagactaaaaacacatattgaaaagaattttattttgtaaactcattcactgaatgaaygaaatatgaaaggattttttaaaatatatttgttaccccccaaagaggaagatactagagactatgattaaacaaaaagaagttgcaacaatctgctagc

SEQ ID NO: 40968 - DNA, 201 bp, Homo sapiens
ccacttataagtaagaacatgaagtatttggctttctgttccatgttagtttgctaagaataatggcctccagctccatccatgttactgcaaaggacatratctcaatcttttttatggctgcagagtattccatggtgtatatgtaccacattttctttatgcagtctgccaattgatggacatgtgagttgattcctt

SEQ ID NO: 40969 - DNA, 201 bp, Homo sapiens
tattccatggtgtatatgtaccacattttctttatgcagtctgccaattgatggacatgtgagttgattccttgtctttgctatggtgaatagtgctgcartgaacatacacatacatgtgtctttatgatagaatgacttatattcctttggatatatacccagcactaggattgctgggtcaaatggtatttctgaatt

SEQ ID NO: 40970 - DNA, 201 bp, Homo sapiens
aatatgtttccatttttttgtgtcctcttcaatttatttcatcagtgttttacagttttctttgcaaagaccttttacttcttcattaaatttattcttaygtgtgatatatatttttagctattgtaaatgttactgctttcttgttttttattttcagattgatcactgttagtttgcagacacactattaatttttgt

SEQ ID NO: 40971 - DNA, 201 bp, Homo sapiens
tctaggtaacatagtgacctaagagaatgtacacttactctgtctcacatataggtgctattgaatatttttggtggtgatgttgaagatatttgaattaygttggtggtaagtggaggccagagagttacttaatatgtggactggcatggtgtaagtctggaaggaactgtggtgaacagtttctttgcttatggtgca

SEQ ID NO: 40972 - DNA, 201 bp, Homo sapiens
acttaaagcaaacactggaactcatttcctaagacactttgaggtcactcattcccacccaattaaaaaaaaagtagaagaagaaaagaaaaacacctgtratgagttttcagaggcttatatggtgttactgtattttttcagaatgtattgttgtgtaacaagaaatatttcatgggtaatccaaagtataggagttct

SEQ ID NO: 40973 - DNA, 201 bp, Homo sapiens
aattagctggatgtggtggcatgcgcctgtaatacccaggaggctgaggcaggagaattgctggaacccgggaggtagaggctgcagtgagccaagaacgygccactgcactccagcctgggtgacagagcaggactctgtctcaaataataataataataataataataataaataagatcaatcaatcaacaaggaata

SEQ ID NO: 40974 - DNA, 201 bp, Homo sapiens
aacgcgccactgcactccagcctgggtgacagagcaggactctgtctcaaataataataataataataataataataaataagatcaatcaatcaacaagraatatttaacagcaataactataaagtctacattcaaactaaatgcatcttttatgggtctctcttggcacttggtgagataggtaaagtgaaattgttt

SEQ ID NO: 40975 - DNA, 201 bp, Homo sapiens
  misc_feature (1)...(201): n = A,T,C or G, or insertion/deletion polymorphism (see Tables 1-2)
gtgcaatgaactgaagaatatgactaatgcaatcctcagctcctgagttccagcaacataaacaacaacaacaaagggccctatatgtactagataaaaangagtaaatatttatttttgtgactttaggatggtaaaggatgttccaaatgtgataccaaagaccaaaaacaaaagaaaaggggcgcgaactttactgct

SEQ ID NO: 40976 - DNA, 201 bp, Homo sapiens
atgaaatagaaaaggactgtgtgcaaaaaacaaaaatgccttgctacagatggtgacatttgaattgacagttttatagcataaaggaaaaaaccgtgtamaattctaggagaagagcttttcaggcagaagaaacaaatgcaaaagcatccagatgggatgactgcaacctgtttgaatgaagagatgcagacttgagta

SEQ ID NO: 40977 - DNA, 201 bp, Homo sapiens
tttcatccagtttcatggatagagaaattagcaaagttatatgatttacctaagaatttaatttccatgaaaaaaagttatagttaaggaaagccaaaaaraaaattgtggaaagggaaagctactaatgaagacacatggactgaaacatcacatctgtcactagccagctggagagttcttttaagtcatttccccttt

SEQ ID NO: 40978 - DNA, 201 bp, Homo sapiens
cttaagtgctgaatacaaaaagccagacacaagaattcatgtgctattattccacacctttataagattaaaacatgggcaaatctacagttttagaaatsaagttagtgattacccttaggagatagtgactagcagaagatagaaggaggcttccgagtgtctgtaatctttttaaggtttcttgatatgagtgtaggt

SEQ ID NO: 40979 - DNA, 201 bp, Homo sapiens
tgcgggcttgcaagaatctcattaactgtagggccatctgccacgttgctactcatttggctcatttaatcacaggtgggtaggaaggtctcaatagtttyggttcccattcaattctgatttttgcttgggaaacagaaggaaggtctcaatagttttggttcctgttcaattctgatttttgcttgggaaacagaaaag

SEQ ID NO: 40980 - DNA, 201 bp, Homo sapiens
gccagtgcacttggcccacaatacaatattgttaactctaggcactatgttgtgcagcagatctctagaacttattcatcttgcataactgaaattttatrcctattgaatagcaactccccattctcttaattatctaggatcatattttcaggaacgtcatcgcatgtgtgtgtgtgtgtgtgtgtgtgtatatatata

SEQ ID NO: 40981 - DNA, 201 bp, Homo sapiens
atgttgtggaaatatagagggtctctagggtcaggaagccttatgaatgttgtgagaggcagcttttctcctcaaatgtgaggcagctcacacaaaagaartacaaatagttaataaacaaacaaaaaattcaatctcaccagcaatcaagtttgaagtatatcagctttgacctatcaaattgtaaaagagatcttaaaa

SEQ ID NO: 40982 - DNA, 201 bp, Homo sapiens
ctaaaggagtaaatttacacacaaaagagaaggtccaagggctaacctgggacaccccaacattaagaggttggtaagatgaaatggaaaagagaacttcwcaagagagtcccagtgaggttggaagaaaatcaccagtgagtggcatgcttgaatgtaatgaagatggtaggttaagaaggagaatgtgatcaactgtgt

SEQ ID NO: 40983 - DNA, 201 bp, Homo sapiens
tgtgatcaactgtgtcaaatagtgctgacagttcaagtaagaggaggatggagaactgactttagactgagcaatgtggagtttattgatggccttaaggrgagcagttttggtagaattgtggagcaaaattttggagtgagtaagagagagaatgagatgaactggagatcagagactatacaaaacaatagaaatcac

SEQ ID NO: 40984 - DNA, 201 bp, Homo sapiens
attgttctcagaaaggatcccttgtgattaactagtagtccttagcaaaaaaacttaagaaccattcccattttagggtcactctcaagatttctacagakcctttccttctcctatgctttatcaacactgtcactattcctaaccctaccatccccccttttctaagggcagtcacaaagtggaattaaaactaaagtt

SEQ ID NO: 40985 - DNA, 201 bp, Homo sapiens
ttctaggagaagagcttttcaggcagaagaaacaaatgcaaaagcatccagatgggatgactgcaacctgtttgaatgaagagatgcagacttgagtaggsaatagggaagatagggcaaggaccaggtcatgtagggctatgctttggaaggagatttcattctaagggtactgcagtaaaacaggaagaatttaatcag

SEQ ID NO: 40986 - DNA, 201 bp, Homo sapiens
tggtcagtattgtttcagatacccaaatggaagtgtcaggtggaagagatatttctactttgaagttcagagaagaactttaggcaggaaaacttggagtygttaacattttgatatttaaaaccattggatgggatagggataatataacatagagggaggattcagccatcagaaaaggaaagcaatgaggcctagttc

SEQ ID NO: 40987 - DNA, 201 bp, Homo sapiens
ttgaaataagcgaattaggcaaaaagagaaaaaagaataaaaatgaaaaaagtttacatgacatatgggatatcactatgcaaacaaatagtctattcctrttttagaaattccagaaggaaaagcagtgagaaaataaataggccacttatttaatgaaacaatagctgaaaagtttccaactcttgggagataatcatc

SEQ ID NO: 40988 - DNA, 201 bp, Homo sapiens
tgaagttcagagaagaactttaggcaggaaaacttggagttgttaacattttgatatttaaaaccattggatgggatagggataatataacatagagggargattcagccatcagaaaaggaaagcaatgaggcctagttcaaaattcagctatcagggaaggagtaatctacagaaaacaactgagaatgaatagccaaa

SEQ ID NO: 40989 - DNA, 201 bp, Homo sapiens
gacagatcttttgaaataagcgaattaggcaaaaagagaaaaaagaataaaaatgaaaaaagtttacatgacatatgggatatcactatgcaaacaaataktctattcctgttttagaaattccagaaggaaaagcagtgagaaaataaataggccacttatttaatgaaacaatagctgaaaagtttccaactcttggga

SEQ ID NO: 40990 - DNA, 201 bp, Homo sapiens
gtatgatgagaacttgagactgcttttttggattttggtcacaaacagaagtaataaaaacactttgattcaatgtgactttggcaattacggctctgtawgctaattaaatttctaaataaggtggcttaagggacacttaaagtagtgatattcaaagtgtggtccccagaccaggagtatcaaaatcacctggaaact

SEQ ID NO: 40991 - DNA, 201 bp, Homo sapiens
tagtttaattagaccccatttgtcaattttggcttttgttgccattgcttttggtgttttagacatgaagtccttgcccatgcctatgtcctgaatggtaytgcctaggttttcttctaggatttttatggttttaggtctaacatgttaagtctttaatccatcttgaattaatttttgtataaggtgtaaggaagggat

SEQ ID NO: 40992 - DNA, 201 bp, Homo sapiens
tctagaaataaggcaaactataactatttttaacattatcctcacatgttacatgactatgttaaaatataaatgccatagcaattttaataaatgaaatyaccctcactgaatcaaatgtaaagctggctttctgattcatggtcctcatttttctcattgttgtatattttcctaattcactttttagactgttttaac

SEQ ID NO: 40993 - DNA, 201 bp, Homo sapiens
gtagcttcttttgctgtgcagaagctctttagtttaattagaccccatttgtcaattttggcttttgttgccattgcttttggtgttttagacatgaagtmcttgcccatgcctatgtcctgaatggtattgcctaggttttcttctaggatttttatggttttaggtctaacatgttaagtctttaatccatcttgaatt

SEQ ID NO: 40994 - DNA, 201 bp, Homo sapiens
cctgcttcacaggtagaccagaaggggtgcggcctgaaagctgtggtttcactggtctccactgggacggcttatggcctggggcagtttttagttctacstacagactacctggaacccagcctgctgcttttagcgaacattatgagtgggatacatgccttgccaagtgcatgggagctgagtggggcttactgctgc

SEQ ID NO: 40995 - DNA, 201 bp, Homo sapiens
agatgagtaggttgcgaaaatattctcctattttgtaggttgcctgttcactctgatggtagcttcttttgctgtgcagaagctctttagtttaattagaycccatttgtcaattttggcttttgttgccattgcttttggtgttttagacatgaagtccttgcccatgcctatgtcctgaatggtattgcctaggttttc

SEQ ID NO: 40996 - DNA, 201 bp, Homo sapiens
gtcagatgagtaggttgcgaaaatattctcctattttgtaggttgcctgttcactctgatggtagcttcttttgctgtgcagaagctctttagtttaattrgaccccatttgtcaattttggcttttgttgccattgcttttggtgttttagacatgaagtccttgcccatgcctatgtcctgaatggtattgcctaggtt

SEQ ID NO: 40997 - DNA, 201 bp, Homo sapiens
agatccctgtggaatcactacactgacttccacaatggttgaactagtttacagtcccaccaacagtgtaaaagtgttcctatttctccacatcctctccrgcacctgttgtttcctgactttttaatgattgccattctaactggtgtgagatggtatctcattgtggttttgatttgcatttctctgatggccagtgat

SEQ ID NO: 40998 - DNA, 201 bp, Homo sapiens
ggtttccagtttcatccatgtccctacaaaggacatgaactcatcattttttatggctacatagtattccatggtgtatatgtgccacattttcttaatcmagtctatcgctgttggacatttgggttggttccaagtctttgctattgtgaatagtgccgcaataaacatatgtgtgcatgtgtctttatagcagcatga

SEQ ID NO: 40999 - DNA, 201 bp, Homo sapiens
aatgtagatgaatgtccccccagcacctttactttgtaatttatgtccctcatctctcattttgctcggcattttttcctcatttttttaagcattctcaytttattgggcatatattttctaggatttttacatttgctttttttatataattactccaatgggtgtcattatttcttcattactttctaatgactaaaa

SEQ ID NO: 41000 - DNA, 201 bp, Homo sapiens
aaacaccaaaaaatggataatgcagttttcagtgatttttcccgtaatctgtggattcagcactcaatgtagatgaatgtccccccagcacctttactttstaatttatgtccctcatctctcattttgctcggcattttttcctcatttttttaagcattctcattttattgggcatatattttctaggatttttacatt

SEQ ID NO: 41001 - DNA, 201 bp, Homo sapiens
caagaaacaccaaaaaatggataatgcagttttcagtgatttttcccgtaatctgtggattcagcactcaatgtagatgaatgtccccccagcacctttamtttgtaatttatgtccctcatctctcattttgctcggcattttttcctcatttttttaagcattctcattttattgggcatatattttctaggattttta

SEQ ID NO: 41002 - DNA, 201 bp, Homo sapiens
gagtctgagggtgtaaaatagcagcagactgaagatagtaattataacttttttcaacatctaccctgtggataccagcgcttggcaggacctgtgcaatrgggatgtgtataattaagagagaagggtctgtagaaaggctgtggggaggagataattcatttacactctctctccctatgtctgaatagaagcgtaact

SEQ ID NO: 41003 - DNA, 201 bp, Homo sapiens
tggatcttttcagggaaacaatactcagagtaagattagaaaataccaaaggcacctaggaaaagtttctgacttttcagaggttagaggaagtcttcctwctattttgttgtttaccatgtattatatgataagaaatttggaaagactttgataatgctatatatgttaatgtgctccaatgttttccaaagcatgttt

SEQ ID NO: 41004 - DNA, 201 bp, Homo sapiens
cctgccttaagcatgtttaggatacaaaaaaaatgtaagattttttcctccctgtaaaatttccctgaaaggaagataattatagatataagtaaatatamttcaagttagaaaattttaatggctatagaagtaaaataataataatatacaattagagttgaatggggaagaaaaatgcttttggttgtatcagaaaat

SEQ ID NO: 41005 - DNA, 201 bp, Homo sapiens
taaaaatgtacacatatattcaccaaaaaacatctactaggatattcatagcaccatatatattatagtcccaaactaaaaattatgcaaatgcccatcamccatagactggataaatacattttagtataatgacatgctatacagcaatgagaatgaataattccatatacaacttacgtagaaaaaaatttaatgttt

SEQ ID NO: 41006 - DNA, 201 bp, Homo sapiens
aattatgcaaatgcccatcacccatagactggataaatacattttagtataatgacatgctatacagcaatgagaatgaataattccatatacaacttacrtagaaaaaaatttaatgtttagtgaaagttgatacaaaaaagtatatgcagtatgattctatttgcatgaaccaaaacagttgcacgaacttcttattca

SEQ ID NO: 41007 - DNA, 201 bp, Homo sapiens
atccagcaccgtgcctgtggtatttgacgtgttcgttcccttactcttctcccatcttgtttctttgttggttggcatctacatacattacagatttccartcagcaccaagaaacaccaaaaaatggataatgcagttttcagtgatttttcccgtaatctgtggattcagcactcaatgtagatgaatgtccccccagc

SEQ ID NO: 41008 - DNA, 201 bp, Homo sapiens
  misc_feature (1)...(201): n = A,T,C or G, or insertion/deletion polymorphism (see Tables 1-2)
gtcccttgatcttgacttcctcttcttcctcattggttctgagctgccaaagtattagcatccttcaagtctgagttttactattaggacaggctgcctcntcactcctctttctgatgacatatgtatgggtatgtctttgtctttatttctaaccactctattaaggcataattcacatatcataacattccctattta

SEQ ID NO: 41009 - DNA, 201 bp, Homo sapiens
taatttttgagtagtttcttataaaaatggataatcccaattttaactcacataattatgtatctaggagtccaaaaaatcagtcttgtcttaaagtcttsaaatacttaaaactacttgaaatacttaaaactaaaaatacttaatacttaacatacttaaaaacctttaaaaacttaaaactaatgatgaaaatattat

SEQ ID NO: 41010 - DNA, 201 bp, Homo sapiens
tttcaaagttgtcggctaaacaaagtgccatgaaagttctctaggtgttcgcttttggaaaactataaattgttactttaagaaaatttgggtattatgamaagtacttttaagaaaaatcattgtggccgggcactgtggctcacacctgtaatcgcagcactttgggaggtcatggcgagtggattacctgaggtcagg

SEQ ID NO: 41011 - DNA, 201 bp, Homo sapiens
ttacatttttcattagactattaatacagatttcattgatgccaaaatattggccagacttgtacccctagaataaatcccatttggttgtggtacagacwtacatacacacatgctaatatatgatgtttatatttttttatcctcttcctcctctcctccgccttttccccctttcttcccctcctccccctcctcccc

SEQ ID NO: 41012 - DNA, 201 bp, Homo sapiens
gtttttcttagatgttcttcaccaggttgaggatgttccttaccattcctactttgctgagaatttctataatgaatgaacactgaattttacatatttttcctgaaaaaaagaaataattattacatttttcattagactattaatacagatttcattgatgccaaaatattggccagacttgtacccctagaataaatc

SEQ ID NO: 41013 - DNA, 201 bp, Homo sapiens
ttttatcattaagtatgatattagtcacaggtttttcttagatgttcttcaccaggttgaggatgttccttaccattcctactttgctgagaatttctatmatgaatgaacactgaattttacatatttttcctgaaaaaaagaaataattattacatttttcattagactattaatacagatttcattgatgccaaaata

SEQ ID NO: 41014 - DNA, 201 bp, Homo sapiens
ttttatttcttatattttaaaattgttattgtagtagttagaatttctagcacaagattgaatgggagaagttagagtgaacatccttgccttgttcccartcttaagagaaaagccaatattcttttatcattaagtatgatattagtcacaggtttttcttagatgttcttcaccaggttgaggatgttccttaccatt

SEQ ID NO: 41015 - DNA, 201 bp, Homo sapiens
tatttcttcattttaagtttttatttcttatattttaaaattgttattgtagtagttagaatttctagcacaagattgaatgggagaagttagagtgaacrtccttgccttgttcccaatcttaagagaaaagccaatattcttttatcattaagtatgatattagtcacaggtttttcttagatgttcttcaccaggttg

SEQ ID NO: 41016 - DNA, 201 bp, Homo sapiens
tgttttttgagttaaattttggataaagtgaggtttaggtcaggttgttgttgttgttgttttgtttgtgttttttgtttgttttttgagatggagtcttgctctgttgcctaggctggagtgcagtggcgtgatctaggctcaccacaacttctgcctcccaggttcaaatgatccttctgcctcagcctcctgagtagc

SEQ ID NO: 41017 - DNA, 201 bp, Homo sapiens
caatttgatgcctaggctggagtggggtggtacaatcaaagctcattccagacacgacgtcttgggctcaagagatcctcccacctcagcctcccaagtakctgggactaccagtgcatgccaccacacccagctaatttttaaaaaatttgtagagatgggttttcactatgttacccaggctggtcttgaacttctggg

SEQ ID NO: 41018 - DNA, 201 bp, Homo sapiens
ataaacattgaagacattatgctaagtgaaataagccagacacaaaaggacaaatattgtctgattctactaataagacacacctagaatagttaaatccrtagaggcagaaaatagaatagtggtcaccaggatctggggaggggagaatggaaagttgttgcttaatgggtacagagttttagtttaggatgatgaaaa

SEQ ID NO: 41019 - DNA, 201 bp, Homo sapiens
gacttcagtcattcagctgcaggctctaagaaagtctgttgtaactgtgcattttaattaaccgactcagctgaggaaatattgtctctctactgtggtgwagctgtctgccttgtaaagtacctccctggataaacagaggacttttatttcttaaactgcctttcccccatcgtctttaagagtatgttgggctttctt

SEQ ID NO: 41020 - DNA, 201 bp, Homo sapiens
tagaaaaaaatttaatgtttagtgaaagttgatacaaaaaagtatatgcagtatgattctatttgcatgaaccaaaacagttgcacgaacttcttattcayatgcttaatgccactttctactattaattctctcccagttaattaacataacataaataaaaatagtattgataatttaaacatttgagaattcttactg

SEQ ID NO: 41021 - DNA, 201 bp, Homo sapiens
agaatttttccctccttttacattaaattattagatggtgtcattttaattattgctttcatgagagataaaactattagtattttccttttaactcagtytgaaggcatatatccaagttgtatggattgacttaaaagttggatagaaagaaaaattgaaagaaattttaagtggagatgagaaagagaaaaagaaatg

SEQ ID NO: 41022 - DNA, 201 bp, Homo sapiens
ataaagtagtacataaaagaacaaaggtcatcatagaacattacttggttcaggtccaactttgaatatttaagtagtcacatttgtgtaaatgattactrtgatgtaaacaaattagaaaatgatgtgaggaaaagcatgaaagagcttaatcttcatcatattaaaaattcattggatacacttttaatataattaaat

SEQ ID NO: 41023 - DNA, 201 bp, Homo sapiens
ttgagcttatggaaatttagattctatttccggaaagtccaccaggagtctgttattcaaaataaaaataggtagtgtaatatgactttcaaagcgcattrtggtactgagatttttagcagttggaactaatgaagggaaggagaaagtattatgtgccaacctttgtattaaatgattttatctacatcatctcattga

SEQ ID NO: 41024 - DNA, 201 bp, Homo sapiens
gctccatagaaagacaatttactgcctgtctacttaggtagttcactcaccaaatcaagtaaaaaattgtttaaattctttgaaaagatgtaatgtcaacrtccttggaaaatacaaactcatttcaatgcaatatatcttgcataagtattgcttacaagactgtggcactgggactatttaactacatgctgtggtagc

SEQ ID NO: 41025 - DNA, 201 bp, Homo sapiens
agtggcatctattgtaagatttaatcaatatcaaagtaccttgagaaatccactttaactatttctttttctttattgcttataaaagtatgattttaatratctggcatccttaaaattttattttatggtgacttgcctagatttttcctctcagcatatgaaaaacccccaaacaataaaaaaaaattagtaaaaata

SEQ ID NO: 41026 - DNA, 201 bp, Homo sapiens
ggacagagctaaggattctactaactacattagggtcttcgaaaaaactggaaagagaaattctggtaagctctcaaccacatgcctgtagcaagctgctytcccattcgcgaaccttatctgaaaactccctaactaatgtgaggtgtggtggagaaatctggcttctcaatgctgtttcatttatttatttatgaaaca

SEQ ID NO: 41027 - DNA, 201 bp, Homo sapiens
aataaagtactggtgaggatgtcgagaaactgaaacccttgggtattgccagtgggaatgaaaaatagtacagccactgtaaaaagcatcatagattactrtctgatcagaaatcttacttctaggtatatgattgatcattgaataattcaggggttaggattgctgacccgtgtgcagtcgaaaatctgcatttaactt

SEQ ID NO: 41028 - DNA, 201 bp, Homo sapiens
tttctgagatttactcagtcttgccttctttgatgagataacttcctttatgttcatcatctgaactttatctttaaaataaatcttctggttctgtggaycataactaataatgttcgattcttttcatctccaaagtagaacataataacatctgccatgtagaggcattttatttaaaaataatggtattcttgaaaa

SEQ ID NO: 41029 - DNA, 201 bp, Homo sapiens
tgagatttactcagtcttgccttctttgatgagataacttcctttatgttcatcatctgaactttatctttaaaataaatcttctggttctgtggaccatractaataatgttcgattcttttcatctccaaagtagaacataataacatctgccatgtagaggcattttatttaaaaataatggtattcttgaaaaagtt

SEQ ID NO: 41030 - DNA, 201 bp, Homo sapiens
tagccactcttggactgagtcagcctccaggaactgtgtatggcccctactttggcacgaccccttaagtcggcatcacaaccaggtctgatctggttcargataataaattgtttgaagagggaagattatccatgaggctagttgagaaatccaaaacaaaataatgtgattctaagccacactgaatacttgaggctg

SEQ ID NO: 41031 - DNA, 201 bp, Homo sapiens
taaaacctgacttataaacttttaaggatttttacttaggaaccattttcatgatttatgagtaagtacattgtacaatatttataaagtgttacagatakttctgcaatcagagtatctatgacaaaattaattttcccttgattctgtataggttctgtggccatgagcatatattaagggttatcaagggtcatgaac

SEQ ID NO: 41032 - DNA, 201 bp, Homo sapiens
agaccatcctggccaaatggtgaaaccccgtttctattaaaagtacaaaaattagctggtcatggtggcacgtgcctatagtcccagctacttgggaggckgaggaaggaggatctcttcaactcgggaggaggttgtaatgagccaagatggcgccactgcactccagcctggagacagagccagactctgtctcaaaaa

SEQ ID NO: 41033 - DNA, 201 bp, Homo sapiens
ttttattggctaagactggaaatatcccaccacttccttcatgttagaatgcagtcatattgccatttctaactgtaaaggagagtgggaagcttatactkcctgtgggcccaggaagaagatggaacagatgtggtgggaagctagctagtttctgtcataatacttttcaatatttattttattttctctgtcacaaga

SEQ ID NO: 41034 - DNA, 201 bp, Homo sapiens
ttcatccagtttcatggatagagaaattagcaaagttatatgatttacctaagaatttaatttccatgaaaaaaagttatagttaaggaaagccaaaaaaraaattgtggaaagggaaagctactaatgaagacacatggactgaaacatcacatctgtcactagccagctggagagttcttttaagtcatttcccctttc

SEQ ID NO: 41035 - DNA, 201 bp, Homo sapiens
gactggaaatatcccaccacttccttcatgttagaatgcagtcatattgccatttctaactgtaaaggagagtgggaagcttatacttcctgtgggcccargaagaagatggaacagatgtggtgggaagctagctagtttctgtcataatacttttcaatatttattttattttctctgtcacaagattagaataatcta

SEQ ID NO: 41036 - DNA, 201 bp, Homo sapiens
ccgattgcaactctgttgtggaattggctggtgtttggtgttccccatcatcgtggactcccacagtaaactccacctcttactaccaggaactcttatcygggcatgttgccctcttgggccagcctgtttttaaatggctccacactgaagattctactgcagatattagggttggcttctggaattcatcccctttca

SEQ ID NO: 41037 - DNA, 201 bp, Homo sapiens
cattcatatatatatatatatatatatatatatatatatttgaataaaatgaatgaaatcctgtcattcttggaaacatgggtgagtctggaggggattakgttatgcaaaataagtctagcacagaaagattaatatcacatattctcactcatgtgggagctaaaaacttgaccttatagaagtaaaccgtgaaaactg

SEQ ID NO: 41038 - DNA, 201 bp, Homo sapiens
aatttttttgtatttttagtagagatggggtttcaccgtgttagccaggatggtctcgatttcctgaccttgtgatccacccgcctcagcctcctcaagtkctgggattacaggcatgagccttggcaccgacctgtttttttttttttgagacggagtcttgctctgttgcccaggctggagtgcagtggcgtgatctcg

SEQ ID NO: 41039 - DNA, 201 bp, Homo sapiens
aagaaactcaagtaatatcttttcacttaatagaatttgaataattattttttcaaggcaaaatctttcaaaaagtaaaggaattgtagccaccctgtaartggcttgtgatagagttaagcacagactaggaacaaggacacacttggcaggtttgaaggggcaaatggggccctgggcaggccatttgggttattttca

SEQ ID NO: 41040 - DNA, 201 bp, Homo sapiens
atgagaattctactacctttgccattctctttttgttctctgctttttaaaaatatcagaccttacgagaattcatatacagttgagctgttttacaatawtatggaatgggatggacccataggctcactggacttgcagcaacagaagcctctgtcactttcaaagtgtatgtgaagggcacattacttctgccgtggt

SEQ ID NO: 41041 - DNA, 201 bp, Homo sapiens
tacattttcaccagtgtttggtgttatcagtgttttaaattttagtcattctaatagatgggccatgtgttgttttgaattgaaattccttgatgataaayaatgttgaccatgtttttgtgtccttatttgtcatctgtatgtctttggtgaggtgtctgctcgcatcttttgctcattttttaattgagctgttttctt

SEQ ID NO: 41042 - DNA, 201 bp, Homo sapiens
taaattcctgtggaaatcgttacattcatccgttcactcacacattcatctacttatttaacaaatatttattgagttctgtgcactgtccttgatgctgmaactatttttaaaaatcatggtacctgacctcaagcatcataaagcttatcccatcatcatactcctttcatttttggcacctaagaagtgactttaatc

SEQ ID NO: 41043 - DNA, 201 bp, Homo sapiens
ttacttgtttcttcagtcaaaactgatttgatatttacttgctgtgaggataccaataaactaagtgctgaaaaggagagcatgattcaaatctttcagtkgtttaactgtggttgaggatatattaaatagtgggattcttttataaaacaaggcaggaatatgttaaggaacaaaatgaataggggcaaaaaggaatag

SEQ ID NO: 41044 - DNA, 201 bp, Homo sapiens
tgtatgtgtgtgtacacgtgctattgaatccactcaaaagctatagatgatatctactattgttaagttccatttatattggaggcaactgagatatggaragaacaaatacctggcccatgatcacaattttggcaactgctaaaaccggaaaaatgtttgtagtcttatgttactttatcttcaaaaaagttagacttg

SEQ ID NO: 41045 - DNA, 201 bp, Homo sapiens
gtgctattgaatccactcaaaagctatagatgatatctactattgttaagttccatttatattggaggcaactgagatatggaaagaacaaatacctggcycatgatcacaattttggcaactgctaaaaccggaaaaatgtttgtagtcttatgttactttatcttcaaaaaagttagacttgtgtcttgaagagtgagt

SEQ ID NO: 41046 - DNA, 201 bp, Homo sapiens
aactgctaaaaccggaaaaatgtttgtagtcttatgttactttatcttcaaaaaagttagacttgtgtcttgaagagtgagttggggttaaagtaattggrttaatcagaaatctttacaaatctatttcagcaacatttacttgaaaaagaagaaataataagttggagcaaagtaacatctctagcttgtgaggaaatg

SEQ ID NO: 41047 - DNA, 201 bp, Homo sapiens
aagtaacatctctagcttgtgaggaaatgaggcagcattttaaatattgctacaacagggtctaaagtttagcacaattttcttctattgctagttcttcyttgagatgttatatcaatggagcaagatttttcttttaagtgtaaatattctagggaacattttcttacctattgtaaaatgcaatttcttgttatattc

SEQ ID NO: 41048 - DNA, 201 bp, Homo sapiens
aggtgaattggtcagtttgaaacttttccatatgatatttattgtcatgttactgttaataactttctcttgctttccaaaataataaaggaataaaagaygttatttcatttttctttgatgaacaaaggttgcactatggtggagaatgtgagggcataattcttctaaggtttatccatgttgtagcatgtatcagta

SEQ ID NO: 41049 - DNA, 201 bp, Homo sapiens
aattgttttattattgagtttttatagctctttatatattccagatatatgacacatcatatatataatttgcaaaaattttctattattctgtatattgkctttttactttatagtactctttgataagcaaaattttttagttttcatgaaatgtgatttatctatcttttcttttgctgtttgtgcttttgttgtcat

SEQ ID NO: 41050 - DNA, 201 bp, Homo sapiens
tgcccattttttaatgagtaattgttttattattgagtttttatagctctttatatattccagatatatgacacatcatatatataatttgcaaaaatttyctattattctgtatattgtctttttactttatagtactctttgataagcaaaattttttagttttcatgaaatgtgatttatctatcttttcttttgctg

SEQ ID NO: 41051 - DNA, 201 bp, Homo sapiens
aagttaacccttgtttatatcaattagcctatagtaaattgattttgttacattgttttgcttaaagtcacagttcccaagaaccaatcaaaaatgttaartgaggatttactataatctagagatgatttaaagcgtatgataggatgtgatgtatgtaaatattatgccattttatgttaagaacttgaagatcataga

SEQ ID NO: 41052 - DNA, 201 bp, Homo sapiens
gtgtttacgttaatactgcccctccctctcttcctcaaatcttgaattccttactgttgtgacctgaccatacgatggcaaattctagaaggggctctatmtgtaatttatattgagattattttctgttgacaaacgtgacctggcctctttaagtgctttaaaccagcagttttccaacccccgtcccttgatcttgac

SEQ ID NO: 41053 - DNA, 201 bp, Homo sapiens
atcagaaacataagacaaactttggtaagtaccttaatggaggaaaagatctccaacagttgacaggatcagggaagtctgaactaaggacataggatgtsagttgggtggtgaagatcaggtattattttaacaaggagaaatggagggtgttctacctggaaaaaaccttgggagatgttgtaaaagtgagaaagcata

SEQ ID NO: 41054 - DNA, 201 bp, Homo sapiens
aagtagctgggacttcgggcacacaccaccatgcccggttaatttttgtgtttcttggtagagacagagtttcaccgtgttggccaggctggtctcaaacmcctgacctcaagtgattcacctgccttggcctcccaaagtgctgggattacaggtgtgagccaccacctcctcaggtcttgattctctttctaaacatct

SEQ ID NO: 41055 - DNA, 201 bp, Homo sapiens
gcctcccaaagtgctgggattacaggcgtgagccaccgcgcccggcctctccagactaattctatgctctactcatggtttaggattttcacctcattgtrctctaaagtcttggatttcctattctagatcagatggcttgtattaagtgtggacctgtcacctattgatcctatttaaaaaattaccaagagcctttaa

SEQ ID NO: 41056 - DNA, 201 bp, Homo sapiens
aatctatattcatgatggattacacaacagccatttacagtggcaacttatcattagggatatggaggttgttggggaaatttaagacacccctgatatcmttatggcttttaagaacctttgaggtacatctttcatcctctgcccactgttagctctgaggtctgaaattcccaagccttactcccacaaaaataccag

SEQ ID NO: 41057 - DNA, 201 bp, Homo sapiens
tgagtttatttgagaatttcagcaaggagtctcctgaaacaagtgacaccaagccatttatttcaagtaagggatggttacacatgattcaggaatacacrgcaatagtagcctaacggtatgtcacaatgcctatgtaattcacctcacttcatgtcatcctgtgggcatcgtataaactcaaatcattacaagaagaag

SEQ ID NO: 41058 - DNA, 201 bp, Homo sapiens
atattcatgatggattacacaacagccatttacagtggcaacttatcattagggatatggaggttgttggggaaatttaagacacccctgatatccttatkgcttttaagaacctttgaggtacatctttcatcctctgcccactgttagctctgaggtctgaaattcccaagccttactcccacaaaaataccaggaaat

SEQ ID NO: 41059 - DNA, 201 bp, Homo sapiens
aacattgttctgcataacattttgaaatcttgtgctctcttgctcagtcctgctgagatgtgaatgatcttttcctctagcacatctatgctgtatactayttgcccgttagtcacttagtagccctctcggttatcaggttgactatcacagtattgcagcatttgtgtgtaagtaatccttattttgcttaacatggcc

SEQ ID NO: 41060 - DNA, 201 bp, Homo sapiens
ttacaccactaggttagaaaaagaactgttctccgagggaaatcagtgttattaccaaagggaggaatggattttggatggaaggccagaatatcccctayacttgattttcttattttaatttttagccttttctctatttctcaagtagaagtttaagtcattatttcttgcctctaatgtgtgaagctttctattaaa

SEQ ID NO: 41061 - DNA, 201 bp, Homo sapiens
tattttaatttttagccttttctctatttctcaagtagaagtttaagtcattatttcttgcctctaatgtgtgaagctttctattaaacttcctacgctawcccacacatgttcaggtcattcttttttagactttcacctcagtacatttatcttcgggaaagactgtctattcaaacacatgaaaattaaccaaaatcc

SEQ ID NO: 41062 - DNA, 201 bp, Homo sapiens
gtgagaacattctttttgcaaatatttattgactatttggctttctaattcggtgacttgcttatatcgttttccaattttccgatttttgttaggttgtmttttgtaattaatttgcttaggtttgttaaaaatatctctgttgcccatgtcttttgaaatattttttaaataatttttcagtcacagaagatttgaaga

SEQ ID NO: 41063 - DNA, 201 bp, Homo sapiens
tggacctttagattgagttccgtttatagtgctgaatgcaatggcaagtgagattgtatggttttggcaggaggagttgaggcagaatggacatagggatrtctgttttttacatagaaagttttaagattatagctggaagggaccttagactagttgtactcaaagtttgacctatggtccagttctggtcagtccatt

SEQ ID NO: 41064 - DNA, 201 bp, Homo sapiens
atttttggactgtctattccattccattggtctttgtgtacgtttttatgccagtaccacactgttttgattactatagctttgtagtatattttgaaatyggagaatgtgatacctctgattgtgttattttggctcaagattgctttggctattcagcatcttttgtgcttgcatatgaattttaggattttttttcta

SEQ ID NO: 41065 - DNA, 201 bp, Homo sapiens
agcgatgtggtttttatagtctatattgttcttttaataatgaaaataaatttaatgccctaatatttttggacatcaagacagatcaaaagaaggcattyggtaaggcagtgaaattattaagtaaacaattcagactgaagcataatcttggtatacaatcaagataataagacattgcttcactagcatcaagagcaa

SEQ ID NO: 41066 - DNA, 201 bp, Homo sapiens
tcagggacgtatattttacagtgtaagtgctctcacatgcatattatcttattatcatctttccaaactctccttgtgataagtattattcactctgtaamgtgatccaagcttctgcgtaaatgattagctcaggtcttgttaacttactggggagtaggtgagccaagattgtattcagctcttttaatgctaaatgct

SEQ ID NO: 41067 - DNA, 201 bp, Homo sapiens
aaagtggcgcaaaaatagtcatgaagtaggcagcaggcagcaacctcagggacgtatattttacagtgtaagtgctctcacatgcatattatcttattatsatctttccaaactctccttgtgataagtattattcactctgtaaagtgatccaagcttctgcgtaaatgattagctcaggtcttgttaacttactgggga

SEQ ID NO: 41068 - DNA, 201 bp, Homo sapiens
taacttcactttcttttgtcaaagaaatggatttagcagtgaaagtcgctgggcgtggtggctcacgcctgtaatcctagcactttgggaggccaaggtgkgtggatcacctgaggtcaggagttcgaggccagcctgaccaacatggagaaaccccatctctactaaaaataaaaaaattagccgggtgtggtggcacat

SEQ ID NO: 41069 - DNA, 201 bp, Homo sapiens
ccctttgttgcccagtgaagtggtgtgatcatagctccctgcagccttgaactcctgggctcatgcaatcctcctgccttagtggccaagtagctggcacwacaggcatgagccgccgctaacggctgattttttatttatttatttaatttaatttaatttaatttaatttaatttaatttaatttaatttatttttgta

SEQ ID NO: 41070 - DNA, 201 bp, Homo sapiens
aggtttaattgactcacagttccacattgctggagaggcctcaggaaacttacaatcatggcagaacacaaaggggaggcaggcaacttcttcacagggcrgcaggacagagttgagtgctgcgaaagtggggaagagccccttataaaaccattagatctcctgagaacgaactcactatcacaagaacagcatggggga

SEQ ID NO: 41071 - DNA, 201 bp, Homo sapiens
atatgcgttgctactattatttctctggaacatttttactgacttctaatgtattatcatgatggtcagaaaatgtgggttgtataatcttgattcttcawattgagatttgctttgctttctggcttagtgggtggtcaatagtgtaaatgtctcatgaatgctttaatcagaatatattttctattgaatatatctaat

SEQ ID NO: 41072 - DNA, 201 bp, Homo sapiens
cttgcagttaattgaggtcagcctggattagaagttctatgtgttgagaatccctgtttcagttactctggtagagataactgagtgatcaaaagctgttygctcacatctgtgctcatatgctgaaacttgaaacctggcatatttgatttatggtagcaacgtggccctgagataagaattgtataaacataaggtaaa

SEQ ID NO: 41073 - DNA, 201 bp, Homo sapiens
tttctttgccttaacaacccagctatatgcagatggatctcaaatacacatctcccatctgtaatgatttttctcctgaatttccaacctgtgtataaacyactatgtaatatatatacccaaaaatcagcatatctaaaggagaacttctgtcctcatctaattccgctgccacgcctgtacttttttctccattacctc

SEQ ID NO: 41074 - DNA, 201 bp, Homo sapiens
ggcttttgtaaaagttcttctggtgatgctaatgagctgtcagggtttaaaacctctggttgagagctgttaggccaatggaggatacataaaagcagggycaatgggatggaaacatggaagttaacagacagggaggaatcatatcaaagataatattctttcaaactttgtagtgttaggtgctccaaatttttatag

SEQ ID NO: 41075 - DNA, 201 bp, Homo sapiens
ttttctcaatcttgcctggcaatttagagtataccttaataacataatgtattttcatctctctttcacctttaaaagtatgtggttttagcagattaccracaaaagatgtctgtatttccatacagacatgtctttattgacagtcttctactccctaccccttccacttgccccaaaaaaggtcagcactattataat

SEQ ID NO: 41076 - DNA, 201 bp, Homo sapiens
tgcctggcaatttagagtataccttaataacataatgtattttcatctctctttcacctttaaaagtatgtggttttagcagattaccaacaaaagatgtmtgtatttccatacagacatgtctttattgacagtcttctactccctaccccttccacttgccccaaaaaaggtcagcactattataataaaattgacact

SEQ ID NO: 41077 - DNA, 201 bp, Homo sapiens
ttcaaaactatcttaaatactcactgtaactcataatatttaactggagaagcaattataattgatttctttttctatggttcaactaatgtaccatagcmtttgaggcttttccctcatgaatttgtggctcccaaaacagtgatttcaggtacacttactgcattatagcaaaatattctattcaatttactaaacgta

SEQ ID NO: 41078 - DNA, 201 bp, Homo sapiens
cagaaggcagtgggcattgaacaaataaccacagggattgccatggtagaaatagtcatcttatgtaggattatgagtttaagagttcaagataatttgamacaataaagtagagtgatgatcagcatattcttcttaattatatgaattgccacttgaaagcatgaattagaaaaaaggtaacattttaaagtagtatct

SEQ ID NO: 41079 - DNA, 201 bp, Homo sapiens
acagtgagaccctgtctctacaaatgtttttttttttttaaattagcctggcatgtggtatatgcctgcagtcctaggtagttgggaggctgaggtgggargatcccttgaacccaggagtttgaggcttcagtgagccactccactccatcatgggagacagattgagacactgtctttaaaataaataaataaataaat

SEQ ID NO: 41080 - DNA, 201 bp, Homo sapiens
tctcattctatccaccatattctttattcagatttatgtatttccaggcctttgtttcactgtactgtaatccagataatttctgcagataacttttccarttcactaatcttttcttcagttgtgtatgatatgatgattcatccatttgttaactttttttaaacatatatatttcttcaattttagatatttggtaga

SEQ ID NO: 41081 - DNA, 201 bp, Homo sapiens
attacttgaggccaggaatttgaggccagtttgggcaacacagtgagaccctgtctctacaaatgtttttttttttttaaattagcctggcatgtggtatrtgcctgcagtcctaggtagttgggaggctgaggtgggaagatcccttgaacccaggagtttgaggcttcagtgagccactccactccatcatgggagaca

SEQ ID NO: 41082 - DNA, 201 bp, Homo sapiens
accatattctttattcagatttatgtatttccaggcctttgtttcactgtactgtaatccagataatttctgcagataacttttccaattcactaatcttytcttcagttgtgtatgatatgatgattcatccatttgttaactttttttaaacatatatatttcttcaattttagatatttggtagattcttgctgtctg

SEQ ID NO: 41083 - DNA, 201 bp, Homo sapiens
agcaggtattactccatcccttaacactgtaagcagggaatcactggagctgctagcatttatacattgtatgaaggataccacagttctaaagactgctratagagattctaaagactttggtgaggcatggtagctcacatctgtaatcccagtactttgggaggccaaggcaggaggattacttgaggccaggaattt

SEQ ID NO: 41084 - DNA, 201 bp, Homo sapiens
agatttatgtatttccaggcctttgtttcactgtactgtaatccagataatttctgcagataacttttccaattcactaatcttttcttcagttgtgtatratatgatgattcatccatttgttaactttttttaaacatatatatttcttcaattttagatatttggtagattcttgctgtctgcttttttttttaagat

SEQ ID NO: 41085 - DNA, 201 bp, Homo sapiens
tgaataacttttaggctataatacaagacagtcatgcaaataagcatatgtgctcatgaatgtttgtgattaatttgtttaaattctctttacataacagrctaggatttgtggtgctacatgccacacaagttgtgcaggtctccaataaaccaaaataaaataaaaaaagcaggtattactccatcccttaacactgta

SEQ ID NO: 41086 - DNA, 201 bp, Homo sapiens
taatttcattgatgtgtttccttctagtctttttttttctagatggctttaaaaataattgcaataatagtatagataaaatttggaaccttgctttttcrtttaaccatataccaaaacattttccacagaatattacctattctacagtggtgttattttaaatttgtgtaacatttgttcaagtgaatgaatataatt

SEQ ID NO: 41087 - DNA, 201 bp, Homo sapiens
tgataatacacataaaatgcttagaacacatcctggcacatagaaaagttgcataaatattagccatgatttttatggttttgcatatcttattaaattcycaattgtctcaggctatgttgatgaaagacacagtatttctacacctttaagacatgaataacttttaggctataatacaagacagtcatgcaaataagc

SEQ ID NO: 41088 - DNA, 201 bp, Homo sapiens
ccggagtccatcctttcaaccttatgtttttctatcatctgtaacatcacctattatattacataagaaagggtgaacaaataagcaaactcaacatcacmcacacatcaattatgtgtgacagactgaacatggattagcagaatcttcttttaatttctgagacatgtaagaggcagaatattttaggatgtatagctg

SEQ ID NO: 41089 - DNA, 201 bp, Homo sapiens
catagatcacactgttaacaccagctgtgtcactattagtggggttatttttatttaccatagctagcatagtttgggagctcaccacgtcccaagcattrtacatgtattattttcttttacatatgttatttcattttctccttacagctatttaatgaggcaggtgtcaatatctccatttatagaaggggagactga

SEQ ID NO: 41090 - DNA, 201 bp, Homo sapiens
tctttccatttagagaacttctgatggttctgctttattgactcttcttaatctactaattctctttaggaatttatatgattcaatatcctaaactagartggtttatttatctagtattggacaaagaggaaaaagtttcaagtgctgatagttaccaaacttccaaatccctgtgagcccattagagttaccagaaaa

SEQ ID NO: 41091 - DNA, 201 bp, Homo sapiens
ctttattttcaggaataatttttttatgtaacctgatattaacaaggaaataggtagtatttataacttctttccatttagagaacttctgatggttctgytttattgactcttcttaatctactaattctctttaggaatttatatgattcaatatcctaaactagaatggtttatttatctagtattggacaaagagga

SEQ ID NO: 41092 - DNA, 201 bp, Homo sapiens
cagccaacagattaactcttcttgaattgggtacctgcctatgacctaaatagtgttgaagtgggagaaaataataccaaacctgccctcctgtggctgtyctctcagtgtgggctgcgagcagaatagtttctcttagggacagtttgtaagtatagcatttatggtaattaacatgtttagtataccaagaagcaaaga

SEQ ID NO: 41093 - DNA, 201 bp, Homo sapiens
atgaggaaacacattatcatcagtgtaaataaaacctgaaaatattcctccttgaccagaattcccagtcaataactaaatctatattcatgatggattayacaacagccatttacagtggcaacttatcattagggatatggaggttgttggggaaatttaagacacccctgatatccttatggcttttaagaacctttg

SEQ ID NO: 41094 - DNA, 201 bp, Homo sapiens
catttccttcaatacctttctcttggtagaaaggtgaggaaatggtttccagaaatatttactgaattgaatgaaatcatttacacagaagagaagatttmacaagtccatgatgggaatattatagttatgtttggtaggataactacatttgaagagcattaacaaagagatatatttgaaagtttgtcttttagttgt

SEQ ID NO: 41095 - DNA, 201 bp, Homo sapiens
tttagaacctttgatggggcagtttgggacaatgccacagactggaagaatgggatctgttagcataagaaatacaaatatttatgataatgctgtctttmttgatcaccatgtgctctctgctgtggtgttttgcactgtgagacttggggaaatattatttggattagaataatttctatttgtgaagcccatttcgtt

SEQ ID NO: 41096 - DNA, 201 bp, Homo sapiens
aaatcaatatgtatttccagcaaagcaaaggggagtaataagactttttggctatagttgcagatgggaaattatagtgaagtctttatatgaaaaacagkcactctttaaacatatatctcagagtagtaaataccaagtcttgcttcttcatgtcacaatcaaattattaaaaacagaagtttatactcactgtcttta

SEQ ID NO: 41097 - DNA, 201 bp, Homo sapiens
ccagagttctttctcatgcagaactttcacttggtcatcattaactcatcaaaagggagaaaaagcttttcaactatgaacttttaatgcaatgtattatsgtagtttaatggcaagatttagtaaaatggctaagcaatcttttaatttggacgtagatttggaaatggaataaatagagatctccagccagttaataat

SEQ ID NO: 41098 - DNA, 201 bp, Homo sapiens
aaattagctggctgtagtggggcatgcctgtagtcccagctatttgggtggctgaggcaggagaatcacttgaacccctgaggcagaggttgcagtgagcygagatggtgccactgcactccagcctgggagagagagtgagactccatctcaaaaaaaaaaaaattgtaggatagactacaatgtgtataacttcactcc

SEQ ID NO: 41099 - DNA, 201 bp, Homo sapiens
atttaaacagcagcaattttcctagaggtgaatcacataatgatttttccaatctcttttatgtgagatatcactgcaaaaagtatgattagatttaatcyagttgtcttgcacaaaaataatatgtagaaaataccaaccaaggtgactctctatgtgcttaatagcctaaagatttaggttaaggatataacagagagc

SEQ ID NO: 41100 - DNA, 201 bp, Homo sapiens
gttactatcaggaatagaaaaaaaattgagatatatttgccaatatcaggattctaacagtatcataagggggatgcacataaataaaatgattatattgraaaacactcaaaatgctgttggaaaaaggaaaagtgagactttacttttgagcagggttgttggaagaactccctgtagaaaccagtgaggagtagatag

SEQ ID NO: 41101 - DNA, 201 bp, Homo sapiens
tctctagaatgacaccttcctggaaaacagtaggcctctaatcaaactatgttgtgttttgaattaaattgctcatttatagtctagtcaactctatttgrtaagtcctatgtaagttactatcaggaatagaaaaaaaattgagatatatttgccaatatcaggattctaacagtatcataagggggatgcacataaata

SEQ ID NO: 41102 - DNA, 201 bp, Homo sapiens
ggaggcataggttgcagtgagccgagatggcactactgcactctagcctgggcaacagaacaaaacatttggaaagaaagaaagagaaagaaaagaaagaaggaaggaaggaaggagtccataacaagaaaagtaagagacaagaaatgaaaagagaggtatttatactagcagagttcttgagttgtaatcatattgcag

SEQ ID NO: 41103 - DNA, 201 bp, Homo sapiens
tgcaataaaagtaacatattattctacaattcttccttttagagaacatggccctttcatagaattttaaagttagaaaggaatatagaaacaatttaggrcaaatattcattttatgggtttggaaattaaggcccagaaacgtaatgggatctgccaaaaccttatccagtcttctatttctctatttatttaacaaat

SEQ ID NO: 41104 - DNA, 201 bp, Homo sapiens
caatggctgtttatgcaagaaattgtgcaataaaagtaacatattattctacaattcttccttttagagaacatggccctttcatagaattttaaagttaraaaggaatatagaaacaatttagggcaaatattcattttatgggtttggaaattaaggcccagaaacgtaatgggatctgccaaaaccttatccagtctt

SEQ ID NO: 41105 - DNA, 201 bp, Homo sapiens
catctcttagtgtttgaggcttcataatttatagggtgagcatcatggccttcctatttcaaacgtctccttttattttcagcttcgtattacacacacatgttttgacatattttcaatggctgtttatgcaagaaattgtgcaataaaagtaacatattattctacaattcttccttttagagaacatggccctttcat

SEQ ID NO: 41106 - DNA, 201 bp, Homo sapiens
aattccattctactgaagtccacttcatgggggcaggatgtgtttttagtattagcatctttggggtgaattatgatgttgttgaaggcatttaattcaaygagtactcatttttattgtgtcactttttaccaatactgctaaagtaacagaacattctattcctctaatttgcctgagcaatatatcgtagtcattagc

SEQ ID NO: 41107 - DNA, 201 bp, Homo sapiens
cagcttcacagctattagcacttggttactgcattataccttatgtcagtggttctcaaacattggtgcacattagaatcacctggatgagtttattacamtacagatggttaggcctcactcccaggatttctaatttaataggtctcgggtgaggtccaaaatttgcatttctgacaggttcccaggtgatgttggtgc

SEQ ID NO: 41108 - DNA, 201 bp, Homo sapiens
cctgtttagaggggggattgagagatgaagccggctgggcttctgggttgggtggggacttggagaattttctgtctagctaaaggttgtaaacgcatcartcagcactctgtgtctagctaaaggtttgtaaacgcaccagtcagcactctgtaaaaacgcacaaatcagtgctctgtgtctggctaaagatgtgtaaat

SEQ ID NO: 41109 - DNA, 201 bp, Homo sapiens
tggtaacagcttcacagctattagcacttggttactgcattataccttatgtcagtggttctcaaacattggtgcacattagaatcacctggatgagtttrttacaatacagatggttaggcctcactcccaggatttctaatttaataggtctcgggtgaggtccaaaatttgcatttctgacaggttcccaggtgatgt

SEQ ID NO: 41110 - DNA, 201 bp, Homo sapiens
ataactataactacctgcttattttttgtttccctttgaaggcagaggacaattttcctttttcctttgagtcaatagcaactagcataacgtcagacacrtagcagataccaagtaatgattgggtgagattggttagctgatccttccaacacctcaaaagatacaccttttattttatttagtagaaaaaaaaccaaa

SEQ ID NO: 41111 - DNA, 201 bp, Homo sapiens
tcatagacaaaaatattagaagcaataacaacaagtggaataaatgtgactgaaaaccaagttagaaatatggagaaaagctttgaaaaaaatcccataawatttagttcaaatgcacaaaaacacaacatttattatgggaagatgaaagatgtggaaaagaaaaaaaagggatccaatataaatataatttgtattctt

SEQ ID NO: 41112 - DNA, 201 bp, Homo sapiens
ttttgaaacttcctctgtaaaacttctttccaactcttgttcctgaggtttatggtcctggttttattaattaaggttcctggatgtcatctttagctacrtgttaccatttaaggatgtcaggcagtgtgtacctgagagttttctttgattaataaagagctcttcttcaatcacctatcttgcaacttgcataacttt

SEQ ID NO: 41113 - DNA, 201 bp, Homo sapiens
aagcaaaggttgaaatgttaaactttttgagatgagtcataattgtaatggtgctatttatcttcaaagtttttcacaaaatgaagtaacatcctctcagyagtcacaattatatgagcacctttcaaagatgttggaattaaggttaagaggttaaaaagtcacttcagaccaagagtagaagtaaactttttgagaatt

SEQ ID NO: 41114 - DNA, 201 bp, Homo sapiens
atactctcaggagtataattctgctccttttggccggcaatggtatgattaataagggtagaatttcatttttttgttctatttgggatttctgaaatagycttggattaatttagaactacttattataattgtggtatattgatcaatagtaagttgaccctgtttgctgctgttttcatcacagttcctgttctgcaa

SEQ ID NO: 41115 - DNA, 201 bp, Homo sapiens
gcctgggagagagagtgagactccatctcaaaaaaaaaaaaattgtaggatagactacaatgtgtataacttcactcctcttgtataaagatgtgtgggcygagtgcagtggctcacgcctgtaatcccaacactttgggaggctgaggtggacagatcatgaggtcaaaagatcaagaccatctcaggtcatgaggtcaa

SEQ ID NO: 41116 - DNA, 201 bp, Homo sapiens
tgtaagtatagcatttatggtaattaacatgtttagtataccaagaagcaaagatgaataatacatagtccctcctataatggagctcattacccaggaakagacatgtgtacgagcaatcatgcaatagaataactactatttatttatatggacaaaatattttttaaacacaaaggagaaaattcaatttgctgggta

SEQ ID NO: 41117 - DNA, 201 bp, Homo sapiens
aaaaaaaaaaaaattgtaggatagactacaatgtgtataacttcactcctcttgtataaagatgtgtgggccgagtgcagtggctcacgcctgtaatcccwacactttgggaggctgaggtggacagatcatgaggtcaaaagatcaagaccatctcaggtcatgaggtcaaaagatcgagaccatctcctgatcgaggca

SEQ ID NO: 41118 - DNA, 201 bp, Homo sapiens
ttatattcataacttcatatctccactgagggttttacaccagtactttaaaagtatactttgctgtgaaggcataatttcagtacaaccacatgtgtacrtagctgtccaattgcaagaacaatgaaacaccagggaccagagccactgcagtatacacgaaggtacattgtaagttaataggttaataaaactctaaaa

SEQ ID NO: 41119 - DNA, 201 bp, Homo sapiens
tagaccgaacgctcaagaaagggagagcaggaggcctagaatatgtaaattgtttgatatttgacaaatcagttactgtgtgtggtgtgatatgcaaattrggaataatgctttcctcttatctgcattgcagattcttcagggcatgttctacatgcattctgcatgcactatgtgcaacacagcagaaaagtttagtgc

SEQ ID NO: 41120 - DNA, 201 bp, Homo sapiens
atgtgttttatgaaaaaattatgcatagaattcaacatttttgcacaaaaataaacttgtgctaacttgtgataacgtgcgtggacaggatctagtttgaygggttaaaaatcagagacatcagtttgaaaagagccctatattagtctgttctaatgctgctaataaagacagaactgagactgggtaatccataaagga

SEQ ID NO: 41121 - DNA, 201 bp, Homo sapiens
tgatatgcaaattgggaataatgctttcctcttatctgcattgcagattcttcagggcatgttctacatgcattctgcatgcactatgtgcaacacagcakaaaagtttagtgcaagaaatccgggcaatggaaatcagaggaaggaaatgtatattagctttatatctttatgtgaaatttgtgcatgcctagccacagt

SEQ ID NO: 41122 - DNA, 201 bp, Homo sapiens
tttatatctttatgtgaaatttgtgcatgcctagccacagtcaatgaattggtgagatcagcatctactaacttacaaatggatactgcattaaataatamatttaaagataagttatgaataatacatccctcagttctgaacacatttagggatttctaaatgtgaaacacagcatatgctaagactaatgcttagaat

SEQ ID NO: 41123 - DNA, 201 bp, Homo sapiens
taaaggtagaagaactggatttggtagataagtggtcagacaagaagcacacatgtttctgcctcttttctccttgtgacaggctggtttaaatataatgmagtaacactcttactttccctccgactcctttccttaatgtttttctttcacacttagcactatcctttcattgttctctcttgtttttgatctttcctt

SEQ ID NO: 41124 - DNA, 201 bp, Homo sapiens
tcatctcttagtgtttgaggcttcataatttatagggtgagcatcatggccttcctatttcaaacgtctccttttattttcagcttcgtattacacacacatgttttgacatattttcaatggctgtttatgcaagaaattgtgcaataaaagtaacatattattctacaattcttccttttagagaacatggccctttca

SEQ ID NO: 41125 - DNA, 201 bp, Homo sapiens
taaactcatctctggataagcagaagcaaggaatcagatacaggcagtgctcctggaccctgaatatatgttccaaacatattgcaaacattagactattycttttctaccctctgtaccctctttctaaattggtaattatttcttctttacctactaatgtacctcttcttctttaagtcatcaatgtaaaaggaaggc

SEQ ID NO: 41126 - DNA, 201 bp, Homo sapiens
cctctgtaccctctttctaaattggtaattatttcttctttacctactaatgtacctcttcttctttaagtcatcaatgtaaaaggaaggcagtgcccaarttttctttggacccttaattcctatctactcacccaaaaagtcctgttgaaagcttcgattatgggccatgcattcagggcaagatatcctgccaggctc

SEQ ID NO: 41127 - DNA, 201 bp, Homo sapiens
aggtgtcttcctgatacgccattcagtacagtggtattctagaaggagagatttcatttttctttcttatacttgtctgtttgtgtgtctttcatgcctgwaaaatgtagactagaatctgtgcctgtgctatgtgctaagcataaactatttttcaagcaatttctttagagaagaactaagtttaagggtatcatattt

SEQ ID NO: 41128 - DNA, 201 bp, Homo sapiens
gcaaaatatctattatgttactttatccttataacatccctaagagttcttttaaaaaaaggtgcaagtcattaaaaacaaaagttatcttagcttttgtrttcatttcacaaacttaatataacatgagctgtgtcaatcagaataagacaaatcctgtctctgagacagagggatagctatcacttcttataatgagca

SEQ ID NO: 41129 - DNA, 201 bp, Homo sapiens
tggttaacaattcttcatttattcattttacccacatccattaattgagtttcaggtgttgtagtagatacaaatgacagatttaagaagtgtcagtgtaraagatgaggcagagtataaataaaagataacaaaagtctcacagatatagtggaaatatatgaagagattaatgaaagaacaaatgagatgatttgtaac

SEQ ID NO: 41130 - DNA, 201 bp, Homo sapiens
acattcaagcactagttggttcacattctaacactagctcatcacatctcagaaaatctattctgacaagtttgattttcttcagtactatttgctctggmagaacatgatcaggaaccatttttggctgaattccctagttctcagtgagacaactgacataccttggcatctctatggaccaaataacactaatcttat

SEQ ID NO: 41131 - DNA, 201 bp, Homo sapiens
tgtattaataatatagcttgaatattacttattagaagtatggttaacaattcttcatttattcattttacccacatccattaattgagtttcaggtgttrtagtagatacaaatgacagatttaagaagtgtcagtgtaaaagatgaggcagagtataaataaaagataacaaaagtctcacagatatagtggaaatata

SEQ ID NO: 41132 - DNA, 201 bp, Homo sapiens
ggtgaatatcggttaaaattctgtattctggcgtgagtatctttggtctgagaacacaggcaacaagctggagtgtagtgttctcagtacttaattagttrtttactagactagataccaacagagaactctaatgccacacactgttagagttcagaggaaccctaaagatcatttagtgtaatggcctccttttatgca

SEQ ID NO: 41133 - DNA, 201 bp, Homo sapiens
ttaaaagcgggaaaataatttatttggtctatgtgtgtaatgctatgtcattgcttattagactctggtagtggttctgaatattgtagacaaagtcgttgccatatgagctcacaggagctcacagtgtgatcgacagcataaaatattgcatttctccacgttcgtacagacgcttttatattagcatcacagctgctt

SEQ ID NO: 41134 - DNA, 201 bp, Homo sapiens
gaaaatatttatgttaatcagcaaagaatacatccattgtattcttattttatggtgttaaaaataaacatgtctgcaagacacagattacagttcactgkgaaagtgaaaacaataaccagaatcgtggaagtctatctgttctaagtttcatagactttccatagccatatgtaaaggctatggaaatactttgacagt

SEQ ID NO: 41135 - DNA, 201 bp, Homo sapiens
gtgctaatttaggaaagaaatgatagaaaatatttatgttaatcagcaaagaatacatccattgtattcttattttatggtgttaaaaataaacatgtctkcaagacacagattacagttcactgtgaaagtgaaaacaataaccagaatcgtggaagtctatctgttctaagtttcatagactttccatagccatatgta

SEQ ID NO: 41136 - DNA, 201 bp, Homo sapiens
cagagccaagtagtggtttttgattatttcttttgaaaatcattatcttggtctggcacagaaatgaggaatgccctatatgtatttagttaaagctaaarttttttaatgaaataaagaagaatggaaattttcaaatattagatggagattttcaaatattagaatctggcaatggaagaaaaaagggagagactatct

SEQ ID NO: 41137 - DNA, 201 bp, Homo sapiens
caaaaaaacaaggtgaccccagaccagctgtctttagcataaggcccatatctggaccatgaaaaatgctcaaatgttggaattcattcacatctttttckgcttattcatcagcaagtagccgacctcctttcactagttagatttcttgggagagagttcacaagtgtccactgaatctcagctgccagggactttgct

SEQ ID NO: 41138 - DNA, 201 bp, Homo sapiens
tagctttattctgcctaagacacttcacgtaagttcctctggagcttgtttgggtaaatagaaacatctatttagttgctcctttaatatctacttttggwggcaattttttttaaaggaaggatacatttgcaggctaacagttcttggtacagaacaatgttgcactgacattttcagaatactctcaggagtataatt

SEQ ID NO: 41139 - DNA, 201 bp, Homo sapiens
cttgttttatttatggaagtaggagggaattacttaggggtagtaatttaaggctatttcagttggcatttaattgggtttagatgtcggaagatgcatasagctagatacttaaatagagggtttacagtggtaaaatagactaggagaacaatcttatgaactttgcaatatgctttcctacttaaatatcttccaagg

SEQ ID NO: 41140 - DNA, 201 bp, Homo sapiens
ttaccctcatgctgttcttgtgccagtccgtgacttcttacaagattgatggttttataaggggcttttcccctgctttgctttcacttctctctcctgtsaccatgtgaagaaggatgtgtttgctttgccttctgccatgattgtaagtttcctgaggccttcccagccatgtgaaactgtgagtcaatttaatttctt

SEQ ID NO: 41141 - DNA, 201 bp, Homo sapiens
cagcctttttggtgttctctttcttctatacacttaaatatatgtctgtgagtgtgctttactaaacattcaatttttaaaatcaactttattgaggtatratttgaatacaataaaatgcacccattttaatggttgattgagttttgagaaatgtagccattcaggtaaccacaaccataattgaaatataagatttct

SEQ ID NO: 41142 - DNA, 201 bp, Homo sapiens
cctataaactacagagtatttcctcatgaatgattagttttttcaatgtattgtttttaatcacagaggtcttgctactttattttattttagtttagttyagcaagatggagtcttgctctgtcgctgaggctggagtgcagtggtgaaatcttggcttattgcaacctctgcctactgggttcaagcgattctcctgtc

SEQ ID NO: 41143 - DNA, 201 bp, Homo sapiens
tgtcacagaatcaatggctatcgtcctcagacttctaaggctggtctttgctatgtgcatgtccagtctcctcttctcccccttattatttccagcgagaytgactatttatgattcccttgatgcactgaactattttgtttttgttggcttattttcctccctctgtgtagaattttctcaatatggtgatcactcagc

SEQ ID NO: 41144 - DNA, 201 bp, Homo sapiens
ataaactacagagtatttcctcatgaatgattagttttttcaatgtattgtttttaatcacagaggtcttgctactttattttattttagtttagtttagyaagatggagtcttgctctgtcgctgaggctggagtgcagtggtgaaatcttggcttattgcaacctctgcctactgggttcaagcgattctcctgtctca

SEQ ID NO: 41145 - DNA, 201 bp, Homo sapiens
agagaggttgggctgaagatacatacttgaggtagacagaataaagatggcaattatgacatggaattggatgatagtacagatggagaaaagaaaaggtctgaggactgggcactgtgtgtgtactccagcagttagatgtcagaagaatgaggaggaatagcaagggaatctgagaaggaacttcattaagctggtaag

SEQ ID NO: 41146 - DNA, 201 bp, Homo sapiens
aacctactcatatgctccctttgagtacccagcatgaaatttagttctgtgagcattttgtctacaagtgggcatctttcatgccaaaataaatatattgrccaatatttcttgctaccagaaaagattaaatattttaaaatgtaggcttgcacccaagctgctggttatctctattgtagtattgctgacatgagaggg

SEQ ID NO: 41147 - DNA, 201 bp, Homo sapiens
ctactatgcccccataacagaacctactcatatgctccctttgagtacccagcatgaaatttagttctgtgagcattttgtctacaagtgggcatctttcwtgccaaaataaatatattgaccaatatttcttgctaccagaaaagattaaatattttaaaatgtaggcttgcacccaagctgctggttatctctattgta

SEQ ID NO: 41148 - DNA, 201 bp, Homo sapiens
aacactaactaaaaatggataaagacctaaataaatatacaaacctataacatttctaaaaggtaggagaaaaatctaggtaaacagctttggcaaagacrttttaggtacaacaccaaagccacgatccatgaaagaaagcattgataagctggactttattaaaatgtaagctttctgctctgtgaaagacactttcaa

SEQ ID NO: 41149 - DNA, 201 bp, Homo sapiens
taattaaaaacagcagaaatgtttccttccaatctcaattctcttcttttaattcactgactaagggtctgcttttgtaatctcccccaaattctgtaatrtgcccagacttactatagaaagtaattaagacctgtatgatttgcactaaggctataatcaacgtgtagcccagtgtcttgcacacatttattcatttca

SEQ ID NO: 41150 - DNA, 201 bp, Homo sapiens
taaactacagagtatttcctcatgaatgattagttttttcaatgtattgtttttaatcacagaggtcttgctactttattttattttagtttagtttagcragatggagtcttgctctgtcgctgaggctggagtgcagtggtgaaatcttggcttattgcaacctctgcctactgggttcaagcgattctcctgtctcag

SEQ ID NO: 41151 - DNA, 201 bp, Homo sapiens
acttataccttgatttcaactgggctgattttccacagcttagacctattgtaggtaggaaaccagcagttgaaagagaacttaattgctttttattattkttctccccttttctggggtagaagcaagaggaggaaggagagctgaagggaacataaaagttatttctagctctcaggtttctgaaggctgacttttccc

SEQ ID NO: 41152 - DNA, 201 bp, Homo sapiens
gaatataactgtcaaaacttataccttgatttcaactgggctgattttccacagcttagacctattgtaggtaggaaaccagcagttgaaagagaacttarttgctttttattattgttctccccttttctggggtagaagcaagaggaggaaggagagctgaagggaacataaaagttatttctagctctcaggtttctg

SEQ ID NO: 41153 - DNA, 201 bp, Homo sapiens
atggccaaacttttctagttaccttcagtcttttgtgccagtccctctcttctaatcaataactagaatataactgtcaaaacttataccttgatttcaaytgggctgattttccacagcttagacctattgtaggtaggaaaccagcagttgaaagagaacttaattgctttttattattgttctccccttttctggggt

SEQ ID NO: 41154 - DNA, 201 bp, Homo sapiens
acatttagtacatagtgatcagatctgatcgagacatcaacacatctgtttctacacgccatcttacagaagaggaaactgagacccacagaaactgtgtratttgcttaagttcacacatctaggaagtggaaaagttaggagtaggaatcgcctctcctctgactcactaagtagaggttttaattttttctccacatc

SEQ ID NO: 41155 - DNA, 201 bp, Homo sapiens
aggttgcagtgagccgagatcgcaccactgcactccagcctcagcgagaagagtgagacttaaaaaacaacaacaaaacaaacaaataaacaaaaaaaagrtttagtaagcagataaatagagcaaaaatatgttttatttataaaatggcaggagaaaaatatttgttcatgtacttgtaacacttgtaacaatgcactt

SEQ ID NO: 41156 - DNA, 201 bp, Homo sapiens
ttacagatgtgcaccaccacgcctggtaatttttgtattttttagtagagacagggtttcaccatgttgaccaggctggtcttgaactcctgacctcaggygatccacccgcctgggcaccccaaagtgctggcattacaatcatgagccaccacacccagccagaaataatatttttatctgttagctttctttaacttg

SEQ ID NO: 41157 - DNA, 201 bp, Homo sapiens
actaactgattcagtacttaattatgaaggcttctgagtgtctggcatatgccacatgctgggggtgaggagagcagtgaataaaagcagatttattcctyttccctgctagtattttcatatctattgggggagagatgcattaatcaattaattacaaaaaatgagtttatcattacaagctgtgttaagcatttgtaa

SEQ ID NO: 41158 - DNA, 201 bp, Homo sapiens
agaaatgagctttgataagacagtatctttcacaaactactgctaactctgacgagaaaaccttgattgtaaggaggcctatctaaaaatcctcagtattyttataaaaacaagtaattaattcactaactgattcagtacttaattatgaaggcttctgagtgtctggcatatgccacatgctgggggtgaggagagcag

SEQ ID NO: 41159 - DNA, 201 bp, Homo sapiens
aacatctctgtaaacttctagagaagatgattacctaaatagagtggcttttaatcaaacttctgtccagacctaggtgatgaggcaatctttagaagttygttttagaatactataattactcctgataatatcatctctgattttgcctaatattacagctactactccagcatagattttgatattttaaaaacagaa

SEQ ID NO: 41160 - DNA, 201 bp, Homo sapiens
aaaagccataattgaaaacacttcaacatctctgtaaacttctagagaagatgattacctaaatagagtggcttttaatcaaacttctgtccagacctagrtgatgaggcaatctttagaagtttgttttagaatactataattactcctgataatatcatctctgattttgcctaatattacagctactactccagcata

SEQ ID NO: 41161 - DNA, 201 bp, Homo sapiens
atcttcagagataaaggcactaagaatggacagagggaagacgcagaagctgggctgaagggtgagaaagctggaaacgctacatggggctacagtatacycacactcattcctggcccccagtggctctgagggaacaggtgagttgcactggcaaggagcaaactgcttttgccacaggcctctggaaccctggcaggg

SEQ ID NO: 41162 - DNA, 201 bp, Homo sapiens
gaaaaagtacatgtgtttatgtatgtttatattgaaaaagtttcaaaaccaaataagtcctataatatcctattaatcataaaaaaagaaaaagaattggygggggacaagatgaccaactagacgcaggcaggtggaacggctctcatgaagggactcagatgactgacacactcctaacacatcttcagagataaaggc

SEQ ID NO: 41163 - DNA, 201 bp, Homo sapiens
agttagtctacctgcacactttggctctatcctgctgcctggaatgtggatgtcatggttggaactctagctggcatcttggactatgaggataaggccayacctaaggtggcggagtgagaagttggaagacgcctgggttcctaggtattttataaagcagaaccactacatcagctcaggagcactttacctccagac

SEQ ID NO: 41164 - DNA, 201 bp, Homo sapiens
ctttgagatgcaagtaagattaatgacatataagtgaaatttttattgggtaacttttgcaaacttccataaaagttagtctacctgcacactttggctcyatcctgctgcctggaatgtggatgtcatggttggaactctagctggcatcttggactatgaggataaggccatacctaaggtggcggagtgagaagttgg

SEQ ID NO: 41165 - DNA, 201 bp, Homo sapiens
caagttggcagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaag

SEQ ID NO: 41166 - DNA, 201 bp, Homo sapiens
taaatatagaaatatttaagagctgcttcatgctgcctcctacagcatggctgggcagaatagacacagaacattcagaaatttgagttttgggaaacatrcaggagagagatgtgacagtgagatgttgcctccaatatgaattgtccttgtcttctaaaaacagaatcctgctaaattaatgaccaacagtaatagcag

SEQ ID NO: 41167 - DNA, 201 bp, Homo sapiens
agactgtaactaaaggaaatcctagtggtcctttgggtcaaataaggaaaatatattgcatatgtacagctatttcctcaatgtccttatggaagacttarcaaatcacccatgacactctacttttgtccagaatcagcctcataatccttcttaacacagtgcttcagccagccattatcagttgattgtaattgatgt

SEQ ID NO: 41168 - DNA, 201 bp, Homo sapiens
gccttggccttctttcctttcagcagcttgggtggctggaggaagcaacaagaccaaacattttgtataaaggatcttatgatattttattgtaaaatatsctttatagactgtaactaaaggaaatcctagtggtcctttgggtcaaataaggaaaatatattgcatatgtacagctatttcctcaatgtccttatggaa

SEQ ID NO: 41169 - DNA, 201 bp, Homo sapiens
actacaactttaagcaaaatgatatgtaataaaaccaactttaccttaggctaatttacataaacaagcagtaagctcctacagcatgtttgtcatagaamtatcaaacttctaagtaaagactcaaaacacttttaatattaaacattgaaataaatgtgagccaaacatacattcaagaaagattaataaaaacaagta

SEQ ID NO: 41170 - DNA, 201 bp, Homo sapiens
aaacaaggttatatacacacatttacacacagtaagttctcaacgttgtcgataggttcttggagactacaactttaagcaaaatgatatgtaataaaacyaactttaccttaggctaatttacataaacaagcagtaagctcctacagcatgtttgtcatagaaatatcaaacttctaagtaaagactcaaaacactttt

SEQ ID NO: 41171 - DNA, 201 bp, Homo sapiens
ttaccaaaatgtgacacagagacaggaagtgagcacatggtgttggaaaaatagcagttgacaccgatttgccacaaaccttcaatttgtaaaaaaaaaamaaaacactatttgtgaggtgccataaagtgaggcacaataaaacaaggttatatacacacatttacacacagtaagttctcaacgttgtcgataggttct

SEQ ID NO: 41172 - DNA, 201 bp, Homo sapiens
cgtctgtaatcccagctactcaggaggctgaggcaggagaattgcttgaacccaggaggcagaggttgcagtgagctgagatcatgtcactacactccagyctgggcaacagagctagactctatctcaaaaaaaaaaaaaaaaaaaaaaaagaataatactaaataagattaattttatttaatccagtaaacatttaat

SEQ ID NO: 41173 - DNA, 201 bp, Homo sapiens
attacaaacctaattctcatagccctatcattacctagctatttaattttggtaagtttctgacttagtttcaacatttataaaacaaagtgatttctgtwcatatttattaagatttttttgtctcccatactttactggccaataaaaagccataattgaaaacacttcaacatctctgtaaacttctagagaagatga

SEQ ID NO: 41174 - DNA, 201 bp, Homo sapiens
acatttcaaatacatagtgtatagtaaagtgtaatgaatgtgaactccaccacttatgaaaacattgtaatttatctgactataaaggtaaataataatawtcaatttcagagtggctactaaactagataaaatacctatacagaggaatagcatagttcctggtgtataatagatactggacaagtaggtaaatattat

SEQ ID NO: 41175 - DNA, 201 bp, Homo sapiens
ccttttcaggatctatttctggccaggtaatttaatcttaaatgcttagtattaaaacgtactagtctgtaattaagtggaagcctcagcagaaggtgagkgggaaagtttgaattcagtgactcaaaattccaaatttgcttgtgtattgctatatttgtgactaatagctaatgagaaaaccaagctgatataattcca

SEQ ID NO: 41176 - DNA, 201 bp, Homo sapiens
tgcagtatttcttttactgtgttggtatggaactgaacccgaatatctttgaggtattcctgtacttgatttttatctatgacattttcccaacttgttaygtaaaggatggtggttgtttaaggccccacatttgaagcatcttactcgagttttgtggggcttatttacattttgaattttcttttcatgttgcctctg

SEQ ID NO: 41177 - DNA, 201 bp, Homo sapiens
gtgggtaccattcacccattcccctctgcattttctgcgttcaatacgcaatgagggggagctgtagtccctcaactggcaagggaaatcacattctatcrtgtgtgctctctcaccaactatttggccttgggaaaattgcttaacatcccttgattccttcttctgtaaaatgggagtgataattcctaagtgacagga

SEQ ID NO: 41178 - DNA, 201 bp, Homo sapiens
ggtcatctgggcaaagttaattgaaaactttctggaatggattcactattttagatgccattaagaacattcatgattcatgagaggaggtcaaaatatcmacattatattaggcatttggaagaagttgattccaaacctcatggatgagttcaagggcttcaagacttcaatggtgaaagtaactgaggatgtggtgga

SEQ ID NO: 41179 - DNA, 201 bp, Homo sapiens
tactgtggtgaatatgttaatatactgataaatagatacatttaactagaggctgatggggtgtgcaatggcaaatatttggtaccgattggtgggttggygatacaacatgaaatgtgggtaccattcacccattcccctctgcattttctgcgttcaatacgcaatgagggggagctgtagtccctcaactggcaaggg

SEQ ID NO: 41180 - DNA, 201 bp, Homo sapiens
gccagcttcataacatgaaaatgccaggtgaagcagcaagtgctaatgtagaaggtgcagcaagttatccagaagataatagctaagatcgttgatgaagyagttacacttaacaacatattttcaatgtagacaaaatagtctcatggaagaagacgccttctaggactttcatagctaaagaggagtagtcaatgcctg

SEQ ID NO: 41181 - DNA, 201 bp, Homo sapiens
atgcatatgccatgctactgtggtgaatatgttaatatactgataaatagatacatttaactagaggctgatggggtgtgcaatggcaaatatttggtacygattggtgggttggtgatacaacatgaaatgtgggtaccattcacccattcccctctgcattttctgcgttcaatacgcaatgagggggagctgtagtcc

SEQ ID NO: 41182 - DNA, 201 bp, Homo sapiens
ctaagcttttgatcttcattgaatttcatctaaatcttcatttaattcatggagacttgagcaattttttaaagttccaacctgtaagtggatagctctgmtgagctaattgtaagacatatcatgaagaaagtagatagagtgtataatgaaaatagtctccttgtggtaagatattgtcaaaggccaatctggatgcat

SEQ ID NO: 41183 - DNA, 201 bp, Homo sapiens
tttatgcatatgccatgctactgtggtgaatatgttaatatactgataaatagatacatttaactagaggctgatggggtgtgcaatggcaaatatttggyaccgattggtgggttggtgatacaacatgaaatgtgggtaccattcacccattcccctctgcattttctgcgttcaatacgcaatgagggggagctgtag

SEQ ID NO: 41184 - DNA, 201 bp, Homo sapiens
tataaatattagtaataatattgttatcaattttcaacttaaaatatgtttccatgggtattttagtaaacacttagaggagactgaataatatgtgttasctaaatgagatttggcacttctaagcttttgatcttcattgaatttcatctaaatcttcatttaattcatggagacttgagcaattttttaaagttccaa

SEQ ID NO: 41185 - DNA, 201 bp, Homo sapiens
aatattgctttcagtttcattttctctacactctccttttgggattcttattaaacttgtgttaaatgttttgaccgtgtcccacatttctctaatgcttktctctaccttcttccctctcctcaccacaatgcttcagtttaaatatttttcattgacttttcttcagatttactaattttttattcttctatgtccagt

SEQ ID NO: 41186 - DNA, 201 bp, Homo sapiens
ttgtgttatcatttattagtgttgtatatataacaaagaggaaaatataagcagagtacatgggttaaattattactagaatgatttatattcaatctaaytcttctaaatgtctttttgatttgtacatgtgtttttgtatccaaattgtgctgtataccatcaaaaacactgatgattcaaccttacttaaagaccttt

SEQ ID NO: 41187 - DNA, 201 bp, Homo sapiens
caacctctcctgtgctccacactggatgctggtcatcatgagagtgctattccattgggcttagctttcctgggatttccatcagtttaggatgaaacaamccctggaccaggccctcctccttaattcccacattgcacaaaggaaagtggtgcaaaagcttttttgtctgtgtttaaatatcatcaacaatcccaactg

SEQ ID NO: 41188 - DNA, 201 bp, Homo sapiens
aggatgaatatttttattttgccctcaattctatgtaatgccaagctgcagctcatggccacaaatcatacatgtacatctataataatgataaaaaaaaagccaagttttcttggccacttcatctgtgttgggtgcgatgctaattactttatcaaaatcaggatatttaattctctcaggagtacaaataaacattct

SEQ ID NO: 41189 - DNA, 201 bp, Homo sapiens
cagttgtgagattaggttgttaatttaagatttttctaaattttgatgtggccatttagtgctatgaatttccctcttaacacttccttagctgtgtctcrgagattctggtatattgtatgtatgggggtctaacctcccactttgctggacctgcagctacttttgctggaaagcccaagtatctaaggctccagggtc

SEQ ID NO: 41190 - DNA, 201 bp, Homo sapiens
ctagctggaattttgtatcctctaataaatctctccctatcactcccttcccctgacctttcccagccccagtatcctctgttcttttacttctatgagaycaactttttttttttaacttccacatttgagtaagaaagtgtggtgtttaactttttgttcttggcttatttcacgcaacataatgtcctaatcctccaa

SEQ ID NO: 41191 - DNA, 201 bp, Homo sapiens
cctgacctttcccagccccagtatcctctgttcttttacttctatgagatcaactttttttttttaacttccacatttgagtaagaaagtgtggtgtttamctttttgttcttggcttatttcacgcaacataatgtcctaatcctccaattctatccactgtgaaagacaggatttcattctttttatggctaaatagta

SEQ ID NO: 41192 - DNA, 201 bp, Homo sapiens
agggcttgtcaatgtgccagagactttaaactctgccaatgactggttttgcatctttaggcaaagtgcttaaactttctgaacttcagtattcatatatktgaaatggtgacctcatgttatatttgttgagaattaaataaaacaatgaaaagattcttactgccctttgcacatagttttcaatcagcaaatattcca

SEQ ID NO: 41193 - DNA, 201 bp, Homo sapiens
ttgtcaatgtgccagagactttaaactctgccaatgactggttttgcatctttaggcaaagtgcttaaactttctgaacttcagtattcatatatgtgaawtggtgacctcatgttatatttgttgagaattaaataaaacaatgaaaagattcttactgccctttgcacatagttttcaatcagcaaatattccaaataa

SEQ ID NO: 41194 - DNA, 201 bp, Homo sapiens
caaatgaaggcagaagtaggaatagtgtctgtttctggttccctagcatggattccagcacagagttttacatatttgttgaatgaataacataaatgaaygaataaacacagcaggtaaagaaatgtgtaatttttgtttgtttttaagagacagaaccttgtcagtctagtacttcacttggtcaaatacctcttttgg

SEQ ID NO: 41195 - DNA, 201 bp, Homo sapiens
aaattatatagattggtatataccaggatgaattcagtttaaagagaaaacatgaaattcagtagaaatattctttaaattctaaacagagaaattgaaaygaagttatattcatactgcatgtgggtatagttttttcttacgtatatttatgtatacatgtttaaatataatacctttacttaaccacctactgtacac

SEQ ID NO: 41196 - DNA, 201 bp, Homo sapiens
tatagttgtcattgaacaaataatacgacaaagataatatcttccaaaaattattgaatattaaggaataaattcagaatattgaagaagagaaataaagratcctgtgatgtggcttatattacaacattacctaaagtagtccattcctcttagtgaataaatgaaggaattaatgaattatatgaccaatatttatag

SEQ ID NO: 41197 - DNA, 201 bp, Homo sapiens
atttattggtcagaatatttttgtccagtaaagatgaagattgatttgactgagtcagaaatacttgcatgaaatttatcgtataaaattatgagatagtmacatagtcaaagaaaattatccttttaaactctggcatttatgattatttcaaaatccctaatagatgccagttattgatgagttctcttctctgacatt

SEQ ID NO: 41198 - DNA, 201 bp, Homo sapiens
tatgagatagtaacatagtcaaagaaaattatccttttaaactctggcatttatgattatttcaaaatccctaatagatgccagttattgatgagttctcytctctgacatttatctttctgtggttgttcaatgtaaagattccagaacagtacatgtacttcaacagcacttcattttgtaagtttgtcgcttttatct

SEQ ID NO: 41199 - DNA, 201 bp, Homo sapiens
cctcaggacaatggtgagggtgttccaaacaaaagcacttctgactttgttgttgaatttaggtatgagaatctatggtcaaagggccctacaaagaaaaycataaacaaatgtgcagcaaaggaaaaaatttgaactgcacatttacaataatggcttctgatacacttagtacctcttgagtgggagttaggcatcagt

SEQ ID NO: 41200 - DNA, 201 bp, Homo sapiens
ctgactttgttgttgaatttaggtatgagaatctatggtcaaagggccctacaaagaaaatcataaacaaatgtgcagcaaaggaaaaaatttgaactgcwcatttacaataatggcttctgatacacttagtacctcttgagtgggagttaggcatcagtgtgtggagtaacaataggaataatcaatgaacagaggaga

SEQ ID NO: 41201 - DNA, 201 bp, Homo sapiens
atttattaatttaatttaatgtattgagacaaagtctcactctattacccaggctgcagtgcagtggcatgatcttggctcactgcaacctccgcctcccrggttcaagtgattctcatgtctcagcctcctgagtagctgggattacaggtgtgcaccaccacactgggctaatttttgtattttaatacagatgaggtt

SEQ ID NO: 41202 - DNA, 201 bp, Homo sapiens
gcttatgctagcaagtaggatgaatggggaagcttttccatttttatttgtttcagcaaataaaaatacttgtaagacaatgtataaatctacgtaggatkaaagttatgaaggacttaatgggggtaacttcaaaatctctttattcatgtctttatatagttcctatatagttgtagtttcctgattgttatctacttt

SEQ ID NO: 41203 - DNA, 201 bp, Homo sapiens
agaagaaagtctttcccagatgattttcatcagtttctcttacttgtcataggtcaaaacttggttcctctctcaatcttgagccaattaccggcaaaagraaattagatttccaagatgagtttagagggtgctgataagtgattaacaactgactagaagccagagggagtggtagtcctaatttgtagcatttgttta

SEQ ID NO: 41204 - DNA, 201 bp, Homo sapiens
agattttgcataagattagtatgacttctttaaattttggatagaattaactagtggagccagttaagtctggaatttttttttgtatgtgaaagattatwttttgtttaggaatgtttttcatctgttttcataaataagacttacgatatcttttgttgttgtgttggtgccatttttgtcaagttttcttgaataggc

SEQ ID NO: 41205 - DNA, 201 bp, Homo sapiens
ttagagggtgctgataagtgattaacaactgactagaagccagagggagtggtagtcctaatttgtagcatttgtttatttctgtggcataaatacccccrcctttgcaggttttaagctaccaatgtgatgtcactgaactctgagttggtacgaaatgcatagaatcggctcttgtgagctggaataaacaggttctaa

SEQ ID NO: 41206 - DNA, 201 bp, Homo sapiens
ggctggcgcagctaagaaatattggctgaatattttccatttgtccctccacatcccctttctctcctcctatggtcctaggagaacatcgatggggcagsctcctttgttctctggcttctggttgggcaaggctaatgagaggcactaggaggtgattagaggccaggagcaaaatgatgtctagcttttattctctag

SEQ ID NO: 41207 - DNA, 201 bp, Homo sapiens
gtataccatgaagaagaactttttgtattgtgtctgtttggtgactgctgggactctgtatctggatgtttaaatctcttgctagatttgggaaattttcmtctattaattcattaaataggtttttaaactctttctctctttgccttcttggataccaataatttatatattttatcacttttttttctgtcccatata

SEQ ID NO: 41208 - DNA, 201 bp, Homo sapiens
aaaaatagtgccattatattctccaactagtattttaggaaaggaaggatcatcttttcactagtcttctcagagattgttcaaagaaaaaaggcaaaatraagtgtatattgtagacataaaaggcaaataagggacatgtggggtgcaggagagagggtttgaggtatcgttcttatcattaggaaagcagaacagaga

SEQ ID NO: 41209 - DNA, 201 bp, Homo sapiens
tacatttccttgaattgtccaggcagcctatctatatataatgaagtaaaaataaatttaatatgacaatacgattcaatatacaatcacaaataacatartaaaatatacttaactaaaattttttgtccttattgtctgtcttgtgaaaaattataatatatgctgtttctccattttatatgctaggtggagatgtaa

SEQ ID NO: 41210 - DNA, 201 bp, Homo sapiens
gtatcaatatagaaactgtttactcttcaagctcccaagttccagtcaagggccagccttgcaaacatgcctttataagaaaaggagcctcactcctgctmtgttaactcttttctaaacaggagctaaatagagccaatttctaactccataaaatctctaaaaattgagctttaatgacaactacaatgcaacgggatt

SEQ ID NO: 41211 - DNA, 201 bp, Homo sapiens
ctcttatttatctctctaaacctcaatttcctcattgttatatggcactgatagaaatatcaactacctcttaggatttttgccattattaaatgagtatwcacacacacacacacacacacacacacacacacacaaacaccaatatctggcacacagtaaatactatgtgcttagacattattatttatatcatgctct

SEQ ID NO: 41212 - DNA, 201 bp, Homo sapiens
aacatagatgtctctctcaatttcctgaaatgtttatctataaactcgaagaagctatgattgtacaaaatacttgccgaatatatatatgtatgtttatrtacacataccacattgtgtatatatgtatacacacacacacacacacacacacacacacacacacacacatatatgccacattctctataaatatagatg

SEQ ID NO: 41213 - DNA, 201 bp, Homo sapiens
tcttgctcaaagcccactgtaactactacctggctactgcctatgttccctcaaggacctagggctctacagtcagccagtggcaaaggcagccatgtttrtgtccttcccttccgggtggaaagttctgcgcaggcccagatggagatgctgtctggaagccagggattgaagtaaaaaacgttagaaatctacctgatg

SEQ ID NO: 41214 - DNA, 201 bp, Homo sapiens
gccattaagtaaaataaggattattggaacacaagcactgagacactgtgataatggatctgataatcaaaatggctgctaagtaactattggattggtarcatatacagtgtggaaatgctgggcaaaggaatgactcatgtcctgagtgggacagaccagaatggcacgagatatcatcacacaatttaaaacttatga

SEQ ID NO: 41215 - DNA, 201 bp, Homo sapiens
agctgagccacttggagctggaagtgggatgacacagggccccactgtggccacatcactggaactgccctaggctagacctgaaatcagcacagcactgrgtcttgctcaaagcccactgtaactactacctggctactgcctatgttccctcaaggacctagggctctacagtcagccagtggcaaaggcagccatgtt

SEQ ID NO: 41216 - DNA, 201 bp, Homo sapiens
ataaaaatatagaatacctaggaatacttttagtaaaaatgatgtaaaccgatattttaaaaattatttaatagataaaataaaaattaagtaactggaartaaatgctatgttcctagataagaagacttaatatcataatgatgtcatttcttgccagatagatgtatgtatttaataattccagtcaaattgcctgct

SEQ ID NO: 41217 - DNA, 201 bp, Homo sapiens
ctcagtttctagctgaagtgttggagttattttaggggatgtgggagcaacatgggaaaccacaaacccaataagaaatctgtgggcaaagagatagagayattgagaacctaaaataagtcaatggatgggagatctgaaattgagagatgtttctgaagtggaatcagcagaatgtggggacagattggatgtggggtt

SEQ ID NO: 41218 - DNA, 201 bp, Homo sapiens
gaatacatttccttgaattgtccaggcagcctatctatatataatgaagtaaaaataaatttaatatgacaatacgattcaatatacaatcacaaataacrtagtaaaatatacttaactaaaattttttgtccttattgtctgtcttgtgaaaaattataatatatgctgtttctccattttatatgctaggtggagatg

SEQ ID NO: 41219 - DNA, 201 bp, Homo sapiens
ttctccctctctttcctgaaatatttaaattataagccttatgtagaaaatcagaagctgctctaaccaaatagctgtcttataagacaggagacaacctrtacttctaggaacaagaggaatacatttccttgaattgtccaggcagcctatctatatataatgaagtaaaaataaatttaatatgacaatacgattcaa

SEQ ID NO: 41220 - DNA, 201 bp, Homo sapiens
tgaatattaaggaataaattcagaatattgaagaagagaaataaaggatcctgtgatgtggcttatattacaacattacctaaagtagtccattcctcttrgtgaataaatgaaggaattaatgaattatatgaccaatatttatagcacaaaactaatttctttccttacacacagatgtttataatgaatgttatataa

SEQ ID NO: 41221 - DNA, 201 bp, Homo sapiens
atagcacaaaactaatttctttccttacacacagatgtttataatgaatgttatataagagaagctctcctttattgacaataatagtaagcaattgatakttcatatgttctatgcaacattgttttctaaaatcttattgactatgtagaagataataatatttgcatacaaagaatgttttctctgtccttcctcatt

SEQ ID NO: 41222 - DNA, 201 bp, Homo sapiens
gttttaggaccaaactggggtctgctcaccctgtgcagtaaaacgaggtgatatggtttggctcgtctccccccaaattacgtcttgaattgtaatccccrtgtgttgagggagggacatggtggaaggtgattggatcatgggggcagttccctccatgctgctctcatgatagtgagtcagttctcatgagatctgatg

SEQ ID NO: 41223 - DNA, 201 bp, Homo sapiens
aaagtaccatgggatggaggtgaggcaacaacttttgagcaggagactggcagttggcgttttaaaatttacagtggtaaactagttattaaatctacaaraattatatatctgtgctcagaagatactgagaattacagaagattcattctcaaagagtgaggagaaagaaagaacttttttcccataatttcatgtccc

SEQ ID NO: 41224 - DNA, 201 bp, Homo sapiens
tataaaaactaaggcagcgtagtttagtgattaacagcatagattttggcacctagattccaactcctggctacaatttaccagctatgtaaccttaagcrcgttacttaccttccctatgcctcagttttctcatctgcaaaacgggcataaaaacaaaaactcacttcatgttttgagaattaagtcattttaatatct

SEQ ID NO: 41225 - DNA, 201 bp, Homo sapiens
accccaaagatcccgtaacaaaaggtcacatatctctctttctccaggattggtctctggtgtcttatttactgtgtttggtgaagttttcttggctggtstcaatgcttgtaaatgttcatctgtagctgggcatttaagagttaggtatttgttttagtcttcacagtctgccttgtgtgtacccatctttcttgggaa

SEQ ID NO: 41226 - DNA, 201 bp, Homo sapiens
ttttaagtaacaaaatattttactcagtttctagctgaagtgttggagttattttaggggatgtgggagcaacatgggaaaccacaaacccaataagaaayctgtgggcaaagagatagagatattgagaacctaaaataagtcaatggatgggagatctgaaattgagagatgtttctgaagtggaatcagcagaatgtg

SEQ ID NO: 41227 - DNA, 201 bp, Homo sapiens
cacctttgggccatagagggcctgaaagctggggcctgggctgccagtcccacagactagagtgggaacttgtggtgccttttctgggcccaccaatggtygcccatgagccaaatcagtgcacacttcctcccatttgaggcccataaaagccaaagtctcagccagaggtgagcagacaatgggatgaccagctgcaga

SEQ ID NO: 41228 - DNA, 201 bp, Homo sapiens
gtggagggcatgctaacatacttgctgttactacagcattcattggttacacagatcttacttatgagaaaacattgaagattttaagtaacaaaatattwtactcagtttctagctgaagtgttggagttattttaggggatgtgggagcaacatgggaaaccacaaacccaataagaaatctgtgggcaaagagataga

SEQ ID NO: 41229 - DNA, 201 bp, Homo sapiens
gcattgaagaccaccatgaatgtggagggcatgctaacatacttgctgttactacagcattcattggttacacagatcttacttatgagaaaacattgaagattttaagtaacaaaatattttactcagtttctagctgaagtgttggagttattttaggggatgtgggagcaacatgggaaaccacaaacccaataagaa

SEQ ID NO: 41230 - DNA, 201 bp, Homo sapiens
gttgactttgacctttagtttttaacttgcaaatcagcacctacattgataatttcaatttgcgtttatctaaagttccactatatacactgaaacccaaytgagtctccacatggtacaatatactctgcttaatacctaggatgtagagatgaaatgaagacagggaggaagatgactaatataacagtctaagagtaa

SEQ ID NO: 41231 - DNA, 201 bp, Homo sapiens
ctctgtaagtgtttcctcatttgcaaaatggggatgataaatctcccactgaggattaaatgctccaatgcaagttaagctcttggaaccctggcacaaaktaaatacttaatagttattatcttattatttgaacaatgttgatatttctaatttctgagctatcatgttaaatagagtaattagcacttcttatattct

SEQ ID NO: 41232 - DNA, 201 bp, Homo sapiens
catggactagtgcttgcacagtatactgtgaacttactgttgactttgacctttagtttttaacttgcaaatcagcacctacattgataatttcaatttgygtttatctaaagttccactatatacactgaaacccaattgagtctccacatggtacaatatactctgcttaatacctaggatgtagagatgaaatgaaga

SEQ ID NO: 41233 - DNA, 201 bp, Homo sapiens
tttccaaagagaagccctagtcatgggtgacagtgagacatgatggtggatccccacacaattacctgccagatccaggtcttatataccacagtactgtkgatcttgatttgtagacctgtaaactaaagatataagttgtctcttcccgcataaccaacatacaaaggtcggattgaagttgacagatttccaagggaa

SEQ ID NO: 41234 - DNA, 201 bp, Homo sapiens
accatcatagaaatatttgggcaatgtaaataatatatatatcattgtcttttttactctcatcaacactgccttcttttcaaagttgcccttaatatatrttaaaacttgacatatgtctcaaagaagtgactctgtgagattaaattgatggttttcatatttcatagactgatcttaataatggttaagagtatggtc

SEQ ID NO: 41235 - DNA, 201 bp, Homo sapiens
ttctgccatatggattaaaattccttaaattcctcttgcgtagattcagaattggctcttcattccatgatctgtgattctatttcttttcctctcttccrctggcctctaagtgttgaagacaattgttctcttttgtttctcttctctaacctaaacatctaagttcctgcagctgtgttgctagtcctcccaggatct

SEQ ID NO: 41236 - DNA, 201 bp, Homo sapiens
ggagatcttcgtgataaggaataggtctgtattttagctgtggtgatggtagttacaagaatctatacacaagataaaatggcatgaagctatacacatgyattgcaccaatgacaacttcctggtatttatattgtaatgtagttatgtaccacagaaccattggaagaaactgggtgaagggtgtaggttcctctctgt

SEQ ID NO: 41237 - DNA, 201 bp, Homo sapiens
tcaaattattcaccaagtccttccacctcttgacactcagtaattttgtcattccactagacccgcttcactttatctataataatttttattcgttcttsgttctttgtttggatgccactttcttctgcaagaattttctaaacccagtttacgaattaggtattcccatatattcacataacaccacatacctgtaca

SEQ ID NO: 41238 - DNA, 201 bp, Homo sapiens
ttatacagcctaagccagttcataaatatttaaccattgtattatgttgcctttcactctctcttgcttaatgaattaggatttagcattattgtcatagmagaataccatgtaattgtatttgtgtcaacaaaataccagatttctatgagcactatttagcaatcaaaagtaagacatctttctaagatatgtttatat

SEQ ID NO: 41239 - DNA, 201 bp, Homo sapiens
gggagatcttcgtgataaggaataggtctgtattttagctgtggtgatggtagttacaagaatctatacacaagataaaatggcatgaagctatacacatktattgcaccaatgacaacttcctggtatttatattgtaatgtagttatgtaccacagaaccattggaagaaactgggtgaagggtgtaggttcctctctg

SEQ ID NO: 41240 - DNA, 201 bp, Homo sapiens
aaatgtggccatcatcctccgatggttccttttcaaattattcaccaagtccttccacctcttgacactcagtaattttgtcattccactagacccgcttyactttatctataataatttttattcgttcttggttctttgtttggatgccactttcttctgcaagaattttctaaacccagtttacgaattaggtattcc

SEQ ID NO: 41241 - DNA, 201 bp, Homo sapiens
cagtgagatgtatccagtgaaaaattgtggagataaaaaaattgtgataaatttgcagttatacatctagaatttctggactggcttttcatgcaaaccaktgttagtgatgaagaaagcaagccagagaaataaaaggactttcctgagatagcaagttggaaatataagctccttaataataataatacttaatatttt

SEQ ID NO: 41242 - DNA, 201 bp, Homo sapiens
gcctcccaaagtgctgggattacaggcgtgagccaacgcgcccggctgtatgactccatttatataggattcttgaaataaaactatagaatagagaacargtaagtggttatcagggtttagaaatggttggaggagagtgtagttgtgactgtagaagggtaatatgagggagatcttcgtgataaggaataggtctgt

SEQ ID NO: 41243 - DNA, 201 bp, Homo sapiens
ttcctttttaataattcatgacacttattaacttcccacccatccaaaaagcaaaagaaacacacagacacacaacgtgcacacacacagaaacacacatrcatacaccacaaagacatatcttgaacacctaaaaaatgcaaaactattgtgaaagaaaccttcatagcaccagtactgtggtgcacacagtttaaccag

SEQ ID NO: 41244 - DNA, 201 bp, Homo sapiens
ttcatttcacatgagagcttcttgtgtgagttttttgcctctacatttcacatttctctgtctctgtctcctttcaaacacacacacacacacacacacactcacacacacacacgcccttcccccaaatagtctttctctaaggcaaatctgattctgccccttccgactttatacttagaatcttttaaaaggtgattt

SEQ ID NO: 41245 - DNA, 201 bp, Homo sapiens
ttagtagagatggcgtttcaccatcttggccaggctggtcttgaactcctgacctcgtgatccaccctccttggcctcccaaagtgctgggattacaggcrtgagccaacgcgcccggctgtatgactccatttatataggattcttgaaataaaactatagaatagagaacaagtaagtggttatcagggtttagaaatg

SEQ ID NO: 41246 - DNA, 201 bp, Homo sapiens
cttcatttcacatgagagcttcttgtgtgagttttttgcctctacatttcacatttctctgtctctgtctcctttcaaacacacacacacacacacacacactcacacacacacacgcccttcccccaaatagtctttctctaaggcaaatctgattctgccccttccgactttatacttagaatcttttaaaaggtgatt

SEQ ID NO: 41247 - DNA, 201 bp, Homo sapiens
tgcttaaaaccacattttttgggaaaaactccagttatttctgtgtcagataaatcttacccatgtttctgtgtttgtggatatctttattcttcttcttmttattattttttgagaccgagtctcactctgttgcccaggctggagtgcagtggcgtgatctcggctcactgcaacctctgcctcccgggttcaagtgat

SEQ ID NO: 41248 - DNA, 201 bp, Homo sapiens
gagaaaatttcctgtttcaaaaggatacacttcaatatgttagagatatgttctacaaattataatcacagttcacttatgcctttctgaaacaataattstgagcatctaaactgtgcttaaaaccacattttttgggaaaaactccagttatttctgtgtcagataaatcttacccatgtttctgtgtttgtggatatc

SEQ ID NO: 41249 - DNA, 201 bp, Homo sapiens
ttttttagagacagggcctcactgtgttgcacaagctagtcctgaactcctgggctcaagtgatcctcccatctcagcctcccaaaatgctgagattacargcttgagccactgcacccagccttttgttgctttttgttcaactcagaccattaaagacttggatgatgcccaaccacattgtgaagggtaagctacgta

SEQ ID NO: 41250 - DNA, 201 bp, Homo sapiens
tttaaagatttccattgaatgctattaccacagaaccttcctagagatttatgtaatgcctttgtacattcaaaaggaaattccagctcagtaactgagctgcaaatggcacccattgaagctactcaaccacattgctgaaggccaccaaattgcttcttgcaggcttctactattcagaaattattaaatactttcaaa

SEQ ID NO: 41251 - DNA, 201 bp, Homo sapiens
ttcctagcgcaaagaaatgataaatttttgaggtcataaatataattattctgatttcatcattatgctttgtatatatgtattgaaatattattttgtaygacataaatatgtagaattattatgtgtcaattaaaaatgaaaaccaaagaaaaaaatgagattggacttagaaaataaagaaaatcacagttacaaact

SEQ ID NO: 41252 - DNA, 201 bp, Homo sapiens
atatgactgacttcataggattaataaggcaccacactggtatgagaacaatgattccaaaaagtacaagaagcatattataaattattcttggttgtatkatataatgtaattgtaatgattagtttgttctgttactgcattccacaatccaatcaaaggtctaaatcgacacatgttgctgaagaaaaggcaatatag

SEQ ID NO: 41253 - DNA, 201 bp, Homo sapiens
agctaagtcaataataataacatattaaggcaagtcttttgtatctgttttatcaccatatgactgacttcataggattaataaggcaccacactggtatsagaacaatgattccaaaaagtacaagaagcatattataaattattcttggttgtatgatataatgtaattgtaatgattagtttgttctgttactgcatt

SEQ ID NO: 41254 - DNA, 201 bp, Homo sapiens
catctgtgtaactgtctctctaactggtttcagatagctgaaaatggaaacaagttttctttataactaaaatagaaaataaatatatcccaccataaacgtgaatgtgattgatcatctatcacttcctattttttttccttcaaagatgtagtctatgtaattctgaggaatcatttattgaaaaagaaaaaggcttca

SEQ ID NO: 41255 - DNA, 201 bp, Homo sapiens
gggataaaccccactttatcatagcacatgatcccttcaattagcttttgaaatcagtttactagtattttgttgaggatttttatatgtatatttatcargaatattggcctatatatgtttttttcttgcagtgcccttttctgactttgttatgtgggtaatgctagccttgtaaaacgagtttggtccttagctttt

SEQ ID NO: 41256 - DNA, 201 bp, Homo sapiens
ttttcagacactcctttattctttctctttttctcttttttatatcctaaaatatacaagtttcaaatatataaaataaaaaatgaaattttgtaaaccartgcattcacttatcctctttggctatttttaaaactttaaactgaaattacttcctcaaagaaaatttggaacagttttaattgtttgaacattttgaaa

SEQ ID NO: 41257 - DNA, 201 bp, Homo sapiens
cttcttgaagaagaaaaataaactgaaatattttaaaatgatacttcatgcttttcctttccaagtataagaacacaaaattttggacacagattcttttwtaagttccaggagctttggttgcattagcaacatggtttttgtttatttgtttattttattttgcttaacttggtctccaagggtgctaatatacttata

SEQ ID NO: 41258 - DNA, 201 bp, Homo sapiens
ctctctgatatctccagattttgttcctttctgttggaatcactataaggtcaagttcctttttaataattcatgacacttattaacttcccacccatccmaaaagcaaaagaaacacacagacacacaacgtgcacacacacagaaacacacatacatacaccacaaagacatatcttgaacacctaaaaaatgcaaaac

SEQ ID NO: 41259 - DNA, 201 bp, Homo sapiens
taggctttaacttgcacatagtcagttttcatggcatatatgtttaacaagagtctattcattaatttgagcagaatatccagccccaaagtggatatttkgggcatctattcattcttggtagcagtttaagatttgaagaacttttgagtaatacaggacttagagcttagagtaaagttgtacttctactttgtggta

SEQ ID NO: 41260 - DNA, 201 bp, Homo sapiens
cggtggattttccttaggggtttttatggactttaaagtgggagcttaagggtattttgaaccgtattagccatgtaggtcatgaggaatgattacatttrtagatattttggtgccttgatgtcagcaagggttgcacaatgagtttcaatatgcatacattccagagatctatagaaattctagttacttacaaagttt

SEQ ID NO: 41261 - DNA, 201 bp, Homo sapiens
taagtcatccttgagaattttccccatctaatttgtcttcagtcttattgaatatattttctagcagctctacaatctatactacacatctttgtctccartgtcactgccgtaatttaggcttccttcatttcacatgagagcttcttgtgtgagttttttgcctctacatttcacatttctctgtctctgtctcctttc

SEQ ID NO: 41262 - DNA, 201 bp, Homo sapiens
gttgagggaagcagagagaaaaaagaagggagaaatcccagtaaagtcccaggatgagtcaaaaagatgcccggcagggtgtcagagccccagcatcagaragtggttgactctcaggttggcaagaagaatttattgacaacagtataggtttgaaaaggaaggttttattagatagaaagcatgctgcagaagagtaca

SEQ ID NO: 41263 - DNA, 201 bp, Homo sapiens
gttacaaacaaaaatatagctatactgtgtattatatttacttatgtagttaacttttactggtgctctttatttcttcatctgaattcaagttactgtcwtatgtccttttatttcagcctggaaattgccccttggtatttgctgtagggctagcaaccaattgtctcactttttcttttcctgagaatgtcatttctg

SEQ ID NO: 41264 - DNA, 201 bp, Homo sapiens
ttggtttctaagagtaaagtaccagactgttgagggaagcagagagaaaaaagaagggagaaatcccagtaaagtcccaggatgagtcaaaaagatgcccrgcagggtgtcagagccccagcatcagaaagtggttgactctcaggttggcaagaagaatttattgacaacagtataggtttgaaaaggaaggttttatta

SEQ ID NO: 41265 - DNA, 201 bp, Homo sapiens
actttgctcctctatagattcattttcccccagtcctttgtgcatgcccgtcaacacgaattggtagttatcactttatgtacttgttttaaaacacaaaraaaattagttacaaacaaaaatatagctatactgtgtattatatttacttatgtagttaacttttactggtgctctttatttcttcatctgaattcaagt

SEQ ID NO: 41266 - DNA, 201 bp, Homo sapiens
tcccactgaagagtggcctcagccaaagatcattggtttctaagagtaaagtaccagactgttgagggaagcagagagaaaaaagaagggagaaatcccartaaagtcccaggatgagtcaaaaagatgcccggcagggtgtcagagccccagcatcagaaagtggttgactctcaggttggcaagaagaatttattgaca

SEQ ID NO: 41267 - DNA, 201 bp, Homo sapiens
tacatattttgtgctcctccattcctccattttactttgcttttttgtattaaatatgtattttctagtgtactgttataattttcttttactatattttsagagttatgtttatagtggttgccttggaaattacaattaacacattaaattatggaaatttaattcaaattaatagcaacttaattatagtagagcaca

SEQ ID NO: 41268 - DNA, 201 bp, Homo sapiens
gggtccacaaccagcagattgtgtctgtgcagagttgattttgctgctgctcatttccaaggcacggtttacagtgttaaagtgaaggtggacttgccacycttggaagggggcaatagtaaatttgcttttttgtcttggcctttggataataccaaggagtgcactcagccagaaaccctcaattgccaaagagtactt

SEQ ID NO: 41269 - DNA, 201 bp, Homo sapiens
catttacatttcatgtgaatactgataaggcagaatatacgtctaccaatttgatatttgttttctatgtcttacatattttgtgctcctccattcctccrttttactttgcttttttgtattaaatatgtattttctagtgtactgttataattttcttttactatattttcagagttatgtttatagtggttgccttgg

SEQ ID NO: 41270 - DNA, 201 bp, Homo sapiens
gttctttggaagattatgcaatttttatgtaattttacgtatcagataaagcccaaaagacctgaacatatggggtctctgaatataaaagtttaaagagyttgtgggtcaaaatgggaccactttataagaatgcaacccaagggcaaataggatagaactgaagaatgagttgaacccatgttgggtttagatacggca

SEQ ID NO: 41271 - DNA, 201 bp, Homo sapiens
tctgtttgcatggtatttctttttctatccttttactttcattctattggtatctttgaatgtatatgtctcttttataaacagcatgttgtattattttwaaaaatccattagtcgatttttgccttttaattggagtgtttaacccatttacatttcatgtgaatactgataaggcagaatatacgtctaccaatttga

SEQ ID NO: 41272 - DNA, 201 bp, Homo sapiens
tgtcgccatgtaattagttggcgacggcattttttctcctccaatttacgctttttttttttgagacaatgtctcactcttgttgcccaggctggaatgcwatggcacaatttcagctcactacaacctctgcctcccgggttcaagcaattctcctgcctcagcctcctgagtagctgggattacaggcatgtgccacca

SEQ ID NO: 41273 - DNA, 201 bp, Homo sapiens
tacatccatcacctgagcagtatacactgtaccctaagataaaatcttctgttattgatatgagatctcatttgttttctaacataagcatttacagttayggctgtccctttaagaactgctttaggtgcatcccataaattctggtatgttgtatttttgctttaatatatctcaaaatattttctaatgtctcttgat

SEQ ID NO: 41274 - DNA, 201 bp, Homo sapiens
actattccttataatatttaaacattttctgttaagtcaatagtaatgtccatgctttcattcctgattttggtaatttgagaattctctcttttttgttrttggccagtctaactagaaatttgtcaattttgttatcttttcaaaggactaatttttggttttgttgacttttatctgtaggttttttatcctctttta

SEQ ID NO: 41275 - DNA, 201 bp, Homo sapiens
gtcactcgctcttccgatgaccctcttatttctagtgaggacaggcttccagggttggcttgtaacctggaggttaggaaccttttctactctagtgtccwggatttctgcagcaataacaggtccccattctgttagtagcatagggatgagccctgggtttattagttaatgaaaaagaatgtgccagtgctgtcgcca

SEQ ID NO: 41276 - DNA, 201 bp, Homo sapiens
cagaattgagcagtaaatttatctgatcctgagattttctttgtcagtaattatttattaattcagtctcttcacttgttatagctttattcatttgcctrttgctccctgagtgtagctagtttctaggaattgtctgtttcgtataggttacctaatttgttggcatgtagttgttcatactattccttataatattta

SEQ ID NO: 41277 - DNA, 201 bp, Homo sapiens
ctcttttcttttttggaattcttttgtgaagaattagtattaattttttgaatatttggcagaattgagcagtaaatttatctgatcctgagattttcttkgtcagtaattatttattaattcagtctcttcacttgttatagctttattcatttgcctgttgctccctgagtgtagctagtttctaggaattgtctgttt

SEQ ID NO: 41278 - DNA, 201 bp, Homo sapiens
gtagctgtgacagcccagaaggaagaggtgccccacctcatgagggagagagggtcactcgctcttccgatgaccctcttatttctagtgaggacaggctyccagggttggcttgtaacctggaggttaggaaccttttctactctagtgtcctggatttctgcagcaataacaggtccccattctgttagtagcataggg

SEQ ID NO: 41279 - DNA, 201 bp, Homo sapiens
tgaatttcagaggcttgattataatccaggaatagagttagaagagcttgtccttggcattgccctcgtccccattctgcaggactcccttgttaggtagrttgataaggctgtagctgtgacagcccagaaggaagaggtgccccacctcatgagggagagagggtcactcgctcttccgatgaccctcttatttctagt

SEQ ID NO: 41280 - DNA, 201 bp, Homo sapiens
tgtaatgctggcctcaagaaataagttggaagttttttgtcctcttttcttttttggaattcttttgtgaagaattagtattaattttttgaatatttggmagaattgagcagtaaatttatctgatcctgagattttctttgtcagtaattatttattaattcagtctcttcacttgttatagctttattcatttgcctg

SEQ ID NO: 41281 - DNA, 201 bp, Homo sapiens
aggatactaggtctaaagcttttgaaaaatatgctgtggggtgcttagagggccatagatcttaggctcactctcaaaactatcccccttcatttgtgtamgtaaaaaaagaaaggcttagtcagatcaggtagggctaaggctgggactgagattacagcctgtttttaaagtgtttagagcatgcttcacattattagt

SEQ ID NO: 41282 - DNA, 201 bp, Homo sapiens
aatattttgttgatggtttttgtacttatattttaaaggatgtttatctgtagttttcttttttcatggtgtctttagttttagtgtcaatgtaatgctgrcctcaagaaataagttggaagttttttgtcctcttttcttttttggaattcttttgtgaagaattagtattaattttttgaatatttggcagaattgagc

SEQ ID NO: 41283 - DNA, 201 bp, Homo sapiens
atgtattttggggtatcagttcctaagccccaacaatagccaaggaaaaaagcaaagcctgaaaagttgcttttcattaaggtttctaattgcagctcaaytctttcgtttacactctgattttgcaggtgggcccaatatagagacttggagtcaacatgggttagaaatagactctatcatagaacttgtctattttcc

SEQ ID NO: 41284 - DNA, 201 bp, Homo sapiens
gctttttgtgtgtttctggaaacagtttgctaatattttgttgatggtttttgtacttatattttaaaggatgtttatctgtagttttcttttttcatggkgtctttagttttagtgtcaatgtaatgctggcctcaagaaataagttggaagttttttgtcctcttttcttttttggaattcttttgtgaagaattagta

SEQ ID NO: 41285 - DNA, 201 bp, Homo sapiens
gattaactttaagatatttctccatggaatttgaatgagcctgagagacagacattatcttgtgaaagggtctattcaagtgtggttacatttttggcctwcttttctgtaatagataatgagataatagtaaggagaagaataaacagttgttctcctggtggatcagtactttaggcagataaagggacttcaggcaac

SEQ ID NO: 41286 - DNA, 201 bp, Homo sapiens
tttttttttttggttaataataaaagagcgttggattattttctgtgcctattatgatgatcatgtggttttggttcattattctattcatatagtttatkggatcgattgagtttcatatgttgaaacggtcttgccttcctggaatgaaatcccacttggtcatagtataagctttttgtgtgtttctggaaacagttt

SEQ ID NO: 41287 - DNA, 201 bp, Homo sapiens
tgttcaccattaagtatgttctcagttgtgaggtttttgtagataccatttatcagattgagaaagtagtcttctattcctagactgctttttttttttttggttaataataaaagagcgttggattattttctgtgcctattatgatgatcatgtggttttggttcattattctattcatatagtttatgggatcgattg

SEQ ID NO: 41288 - DNA, 201 bp, Homo sapiens
gtgtacacagtgagaatcacggagtgattacctatcccccaaatagggtttagaagcttatatatcatcttttgtgggtacagaaagaatgggaacttagktcttggcaaaacaggttataggagggaggaaaagaggaattctgttgacaggcaataaatgacaactagggagaatgaatggattggagggcagagatga

SEQ ID NO: 41289 - DNA, 201 bp, Homo sapiens
ttttactttttatgccattgtacgtggaattttaatttcatattcagactgttcaagtgtatagatatagagatgattttcacatattgatcttacatccygcaaccttgcagaatttattatcataaatagtttgtctgtattccttaggatttcctatatgcaaaattatttcattttaaagtaaagataacttcagtt

SEQ ID NO: 41290 - DNA, 201 bp, Homo sapiens
attgtgcaccacgtactgcctatattaatcaggaaggtgaaatgatctctatgtcagatctagagtttctgaatatggaagtgtgagagattaatttcaayatatatgagctatccttaaaattttgaaaatataattaaatccaattataaagatacgattaagaaaaaaatgatggtttataggacattgcatacactt

SEQ ID NO: 41291 - DNA, 201 bp, Homo sapiens
attcttccaatccattccccagaatgtctttccatttatttaaaacttcttcaggttatttcagtgatgttttgtaggcagtatgcaagtcttgaacttcytttgttaaatttgtttctattttactttttatgccattgtacgtggaattttaatttcatattcagactgttcaagtgtatagatatagagatgattttc

SEQ ID NO: 41292 - DNA, 201 bp, Homo sapiens
atattaattaaatacaattgtaatacaatgtgtttaatacaacatattttattaattaaaggcaatttgaaaaatattacttaaagaattgcatttgaaaycattggctaagaataggaatataacataaggactggaaaaagagacaagtgacaagtagcttggagggaaggtcaaattagtttctctgtaaaagaagat

SEQ ID NO: 41293 - DNA, 201 bp, Homo sapiens
aaaaaaacccacaaaacacagctggaattttgaaagggactgcattaaatttgtgaccaatttggatattgttgacatcatgagaatattaattcttccawtccattccccagaatgtctttccatttatttaaaacttcttcaggttatttcagtgatgttttgtaggcagtatgcaagtcttgaacttcctttgttaaa

SEQ ID NO: 41294 - DNA, 201 bp, Homo sapiens
agaggtttaatggttgggccatcgaaggagaagatgggaaggaacctcaaatccatctccccaggtagtttggggctgggtttttaagggttttggagtgkgtcaaagtgtggagattgttaattggtggaagagtacagggggaagtcataggatggggagaggaagaaaccatctcatgttgattctgttcctctgtgg

SEQ ID NO: 41295 - DNA, 201 bp, Homo sapiens
attatgatcaacttgccaatttctgaaaaaaacccacaaaacacagctggaattttgaaagggactgcattaaatttgtgaccaatttggatattgttgayatcatgagaatattaattcttccaatccattccccagaatgtctttccatttatttaaaacttcttcaggttatttcagtgatgttttgtaggcagtatg

SEQ ID NO: 41296 - DNA, 201 bp, Homo sapiens
cctatacttagaaaacctcatcgtctctgcccagaggctcctagacctgataaacaactttagcaaactttcaggatacaaaatcaacatacaaaaatcascagcatttctatacagcaataacatccaagcaaagagccaaatcaagaatacaatccattcacaatagccacaaaaagtacaaaatacctaggaatacag

SEQ ID NO: 41297 - DNA, 201 bp, Homo sapiens
agagatccaacatcattcttttgcatgtggatatccagttgtcccagacccatttgttgaaaataatatttttcacatttgaattatcttggtactcttcyaaatatcaattgaccaaagatgtatgggtttatttttggactctccagtctattctattgatctatttgatccattatgccaatactactccaacctttt

SEQ ID NO: 41298 - DNA, 201 bp, Homo sapiens
tttgttttgatagaagttttaaatatatcttcccttttctgtgctttagagaacaatcgagactaaaccggaagaaagggataaaaactttaggagtgatrgaactcagttcaatgaaaacattgattaaataccttaatcaaagtaaacattaatataaaaagccttttaggaacatagaggattaaatatgggaattat

SEQ ID NO: 41299 - DNA, 201 bp, Homo sapiens
tgacctcaggtcatctgcctgcctcagcctcccaaaatgctgggattataggcgtgagccaccgcacctggctgcaaaagtcattttaaatttcttaaagwttaggctccaatatgagcaaaaaaatactaagattatggaataaaagtcttgaaaagtgttcgttttgctaattcacccctgaaatttaaactaaaacat

SEQ ID NO: 41300 - DNA, 201 bp, Homo sapiens
tttagtcatctcttccaacagaaattaaatgtttcaagtctactaatagtactcactttgactatctaggtctttacttggaacctgtccatcaggtggtrtggtcagagctaagtcaataataataacatattaaggcaagtcttttgtatctgttttatcaccatatgactgacttcataggattaataaggcaccaca

SEQ ID NO: 41301 - DNA, 201 bp, Homo sapiens
cccaataataggattgctgggtcaaattatagttctatttttagttctctgaggaatctccaatcgagtttccatattggctgtactaatttacatcctcwtcaacagtattcaagtgttcccttttctctacatcctcaccaccatctatcagttttcgactttttaataaagtcatgtgagacacataataaagttatg

SEQ ID NO: 41302 - DNA, 201 bp, Homo sapiens
aaattagaaattgaataccaccaactacaccaggccattgtgaagaaaaataatatacatgaatatgccttatcaactataaaacggtatataaattaatrtattattaatagtatcttcatgtttatatttcatgaaacaaatgattatatgcagtagctatttctttttaaattcctgacctatggctttagatgtgat

SEQ ID NO: 41303 - DNA, 201 bp, Homo sapiens
tcagctttgtccaagatcagatggttgtaggtgtgtgggcagtcttatttctggactctctattctattaagttggtctaaatatctgttttgtaccattrccatgctgttttggtttctgtagccccatagtatagtttgaagttgggtagtctatgcctccagctttgctctttttgcttaggatttcctgggctattc

SEQ ID NO: 41304 - DNA, 201 bp, Homo sapiens
agcatttttctgggtaacccatctcctcactcccagcctctgttaaccactatttttactctgcttctatgagtttgacttttctggattccacacacaartttgatcatgcagtatttgtctttctgtgcttggctaattttatgtaacataatgttctccagactcatcaatgttgtggcaaatcaaaagctttccttt

SEQ ID NO: 41305 - DNA, 201 bp, Homo sapiens
ttgtgtatataatttgggggttattttcaaaaattatgtggtttgcagtggattatttattagcacttaaaattttccacatgaaaaataagcctttgatwaccaaacaaagggatatgatctcaatatcatcttcttcctaaagtatttattccagagtgaatatcaggatgcccatttgtagggagacaaaatctatct

SEQ ID NO: 41306 - DNA, 201 bp, Homo sapiens
taatagtgttctacacaaatattcgtttcttagttttgataaccatacctggttatgtaggatgttaacattagtgatgttaacatttgagaaagctgggyaatagatatacagaaactctctgtatcattatgacaactcttttgtaagtctaaagttatttcaaaataacaagttaaaattttaaaaattctcaaaatg

SEQ ID NO: 41307 - DNA, 201 bp, Homo sapiens
ttgagggaaaaattgcctatctcaaaatccttggagggctttgaggccttcagaagtgaagtgagttacctatatccacgtagctaattaatgtcaaagcyaggattagaattcaggtctcctgactccaaattcagtgtacttttgatgttatcacaatcaagtaaccataataggttttttttgcccaatatgtgcaaa

SEQ ID NO: 41308 - DNA, 201 bp, Homo sapiens
cactttctgtactttataggtttgcctattctgggcatttctgtaaatagaaaacatagcttttgtgaccagcttctttcatttagcgtaatgttttcaargtttatccatgatgtgtagcagaaatcattatttcattccatttttatgatggaataatattatattgtatgaatatgctgtaatttttaattcactcat

SEQ ID NO: 41309 - DNA, 201 bp, Homo sapiens
ggtgacaacatggtgtcattcctgtctctagaaataatgctaaacatttaggaatcatttgctcttatgactcaaaacaaccctgttgaaaatggatagtrctcttttgtatgtaataaagatcagtgggttaggttgctgctggttttctattattgcaaattgattcccctgtgaattttcagctgtggtgaattcttg

SEQ ID NO: 41310 - DNA, 201 bp, Homo sapiens
cgttgcaaagacttaataaatacgatgataaaagcgcatactagcagactgagtgttcacagaaaagaagaagcaattaaccctgtataagttcatgaggwatcttcaaagaggtgacaacatggtgtcattcctgtctctagaaataatgctaaacatttaggaatcatttgctcttatgactcaaaacaaccctgttga

SEQ ID NO: 41311 - DNA, 201 bp, Homo sapiens
tatattgacataaatataaacgtaatatttatgcataaattttacatataatatatgtaattttatataacataattatatactttatataatgtaaacartaatatattaataatgatgttgttaattacatagtatggaaaatttaaacagtgtgcttcaaaaaatattcaggacaaaatttaaattacagaaacaaat

SEQ ID NO: 41312 - DNA, 201 bp, Homo sapiens
gctaggccaaagcatgatgctataattatttatattgctaaaatatataatataaacatattacatactttatatattatatattgacataaatataaacktaatatttatgcataaattttacatataatatatgtaattttatataacataattatatactttatataatgtaaacaataatatattaataatgatgtt

SEQ ID NO: 41313 - DNA, 201 bp, Homo sapiens
cgccagaactttatttcacatggcattgcagaattctaggacacataagtggtataacagagttttagaaagctgataatatgtataggagaatgggtgtrcttcattaattgtacttgtaaatattgaaaattaatgggtttccaaagaaaatattcctctgaaagtatccagaaaatcaggaatagtggttagtcacaa

SEQ ID NO: 41314 - DNA, 201 bp, Homo sapiens
ttatgtaggatagtacctgtcgtagaggagtaacaaataaattcttttgtgagcacttatttgatagaaccctaaggctatacactgaaggacatatcctrttgcacagattggctctgggctatgcagaaaggtcaccacaggaataggctatctgtcaatttagatttccctgtgttagaaggaatcaaagtggtaggt

SEQ ID NO: 41315 - DNA, 201 bp, Homo sapiens
ctgctctgcccagccaaagtagcagtttcattcctggcaggtcttactagcagagggatagttcaagaatccttatccacaagtatttgtttgttctcttyccctttctctccataagaagtaaaagcagtaactttctttaataggatctgtgccctttcgttaaaaatagtgaagactgataatagtctactattgaaa

SEQ ID NO: 41316 - DNA, 201 bp, Homo sapiens
tttttttaaattaaatatttgatattagggaattttctataggaaccacattacagatggttaggtttccaagccatcccacaagaacatgacaacttatstaaaagaattgtagttttactaagaggagcctgagctctagagtgggtggtgaagagtggggaggcagtgggggagggggtggtggttatgtgttactgt

SEQ ID NO: 41317 - DNA, 201 bp, Homo sapiens
tcagatgtttcagagcagcaggaagaagataatcttacacctaaaaaaatgtaaaggttccttacttactgaatcaatcagcagcacctgctctgcccagycaaagtagcagtttcattcctggcaggtcttactagcagagggatagttcaagaatccttatccacaagtatttgtttgttctctttccctttctctcca

SEQ ID NO: 41318 - DNA, 201 bp, Homo sapiens
gtttgcaataatctttgaaataaaaaagacttaaacattttagttgaaaagtgagtataaagttagactaattaggtaagtatgatgactgtgtcatggartttaataagcttaaaggagaatcagccatcaccttacaaactaattgtgttacaaaagttaatctttttttttttaaattaaatatttgatattagggaa

SEQ ID NO: 41319 - DNA, 201 bp, Homo sapiens
gttttactttctaaagaaaccagcttgagttaatgtctaccattggcattctctcagagtcactgctcagttctcaccaccagctaggaatgtggacaagytgttaatatatggattttccagactcctaaacacagttctgcattagttggaggctctgagagactggtctgggactgtgctactaccagaattgttgca

SEQ ID NO: 41320 - DNA, 201 bp, Homo sapiens
acacttagcattgagtattcacacattcatttaatcaccctgttgttcataaaatgtaccccacccctaaaataagtctaaagacccacaatgcaaagacyattttatcctcttcagagaataatatctggaattatgctgggctgaggtgggggtagatattcagtggtgtgaaataggagatgggatcaaactgccttt

SEQ ID NO: 41321 - DNA, 201 bp, Homo sapiens
cactagcccatcacaactctacattcatcctccttgtagaagaagaatggctgcttccacagttagtaaataggaaataattgtttaagaaatttttttttaattcacataaaacatctgtttgagttaggaaattaataacaaaaggattttgcattcagaattttgtcttggtgatgacatggaatttatgaacaaata

SEQ ID NO: 41322 - DNA, 201 bp, Homo sapiens
ctttcctgcgccttgtaaagaaggtgccttgcttctcctttgcctactgacatgattgtaagtttcctgagggctccccagccatgcggaactgtgagtcwattaaacctcttcctcttataaattacccagtctcgggcaattctttatagtagtgtgaaaatagactaatacaatcaatgacaacaaaaaaagactatt

SEQ ID NO: 41323 - DNA, 201 bp, Homo sapiens
tcatgatattgtagtaaattctcatattgtttatagtatttttttcagttgattctcttgggttttccagatatattttatcttctgggagatataacatyatgtttgatgtaaattaaatgatccacaattgagaaaatagtgttgatacaatgagagagaagaggaagagagtaatgcatttcagacagtgaggagagt

SEQ ID NO: 41324 - DNA, 201 bp, Homo sapiens
ctacatagttaaaagtatctacatggggccagactacctggattgaattctatttctgccatacaagctgtgagaactgcttgctcatctgtaaaattagkataacataggtatctatctcatggggtttgttagaaggactaaataagtccctattcttaaagcatttagaagagtacctgaaacaaccagtaaaggtag

SEQ ID NO: 41325 - DNA, 201 bp, Homo sapiens
aaggagtttcactgtcaggatctgatgctgaggccaataaggtctatgtactgccttcacggagcagatgtttagagagagcctgctgtgtgtcagatacygtcctgagagatttcagcagtgaatgaaactctcaaaaatttctaccctcatgaaatttatactttattgatagttttggcagccttgcctcttgtatgt

SEQ ID NO: 41326 - DNA, 201 bp, Homo sapiens
ttctttaaatacataatcaattatcccaaaagcgtttattaaatgatatgttttattattcattcattcattcattcttctttgattaggagttttttaartcatgaataagttctttctattttaggctagctatcctgttttattaatctacttttatatccgtagcactttgttttattattatagctttaggatgct

SEQ ID NO: 41327 - DNA, 201 bp, Homo sapiens
ctcatggaatgagtttggaagtactccctcctttatttttcagagtagtttgagcagaattggtattagtttttttttcctgattatttgttcttcataarctatattgtagtaattagttcttctttaaatgtttgataggattcagcagtgaagccataggtcctgagcctttgtttgctggatgacactttattatgg

SEQ ID NO: 41328 - DNA, 201 bp, Homo sapiens
ctatatcacagattagtgcactggaatgacaaagtacagtcttagccgacacaggccactgtgccattttcttatatactctcaaaccctctcatgaattraaacacctaaagttgagcaaagacatgctgaatagaaccccatacatagtttctttaacatgacatttcttaaccattaagaaatggactctggcccact

SEQ ID NO: 41329 - DNA, 201 bp, Homo sapiens
gaattgcttgaacccggaaggaggaggttgcagtgagctgagattgcaccaccacactccagcctgggcgacagagcacgactccatctcaaaaaaaaaawatatatatatatgtatatatacatttttatttatataatatatattgtcatttatataaatatatatatcttaaaatatatatgtatttttaaaaaatat

SEQ ID NO: 41330 - DNA, 201 bp, Homo sapiens
agaattgcttgaacccggaaggaggaggttgcagtgagctgagattgcaccaccacactccagcctgggcgacagagcacgactccatctcaaaaaaaaaatatatatatatatgtatatatacatttttatttatataatatatattgtcatttatataaatatatatatcttaaaatatatatgtatttttaaaaaata

SEQ ID NO: 41331 - DNA, 201 bp, Homo sapiens
gagaattgcttgaacccggaaggaggaggttgcagtgagctgagattgcaccaccacactccagcctgggcgacagagcacgactccatctcaaaaaaaawatatatatatatatgtatatatacatttttatttatataatatatattgtcatttatataaatatatatatcttaaaatatatatgtatttttaaaaaat

SEQ ID NO: 41332 - DNA, 201 bp, Homo sapiens
gggtagatcacttgaggtcaggagttcgagaccagcctggccaacataaagcaaaactccatctctactaaaaataccaaaattagccgggtgtggtggcrcacagctataatcccagctacttgggaggctgaggcaggagaattgcttgaacccggaaggaggaggttgcagtgagctgagattgcaccaccacactcc

SEQ ID NO: 41333 - DNA, 201 bp, Homo sapiens
atctaaataagataaaatatctacataatagaacagacatgatcaagacaatgtttaaaataaaatatatttagcaattttgtataaatgtatgaatactmgtcctacaattttaaaaaataaattgttgtaaatgggattagctactttccttcttttcacacttttaatctagcagtaaatttaacttgaatttcaact

SEQ ID NO: 41334 - DNA, 201 bp, Homo sapiens
gatttgggagagcattttggctttggggtaagggatgacaaagcgaagccagaaatgagggctccacaatcctgggacagtgagatgacttctttgacccraacagaggcagtgttctgatgacctgtagaaaaaaaagtttggctagcttgtggaagatcttaaatgaggctgagtgtaggtttaagataaaaaggaaca

SEQ ID NO: 41335 - DNA, 201 bp, Homo sapiens
attacatagacatgtttagcaggtttattgctctaccattgacacagggtaaattgcacatactaaatgggtacaattttcgtaagattgacatatgtctrtcaaaaagaactgacaacaccatcaagaaacatactgaacacccctaaattttcctagtgcccttttgtaaccccttccttttgaaggagcaaatgaaag

SEQ ID NO: 41336 - DNA, 201 bp, Homo sapiens
gaggttgaggctgcagtgaactgtgatcctaccactgcactctagcctgggcgacagggcaagaccatgtcgtaaacaaataaaaaaacacaaacaaaccraacattcaattacatagacatgtttagcaggtttattgctctaccattgacacagggtaaattgcacatactaaatgggtacaattttcgtaagattgac

SEQ ID NO: 41337 - DNA, 201 bp, Homo sapiens
agccctctgtggctgctctgtctgacctgtatgggggctgaccctgtaactctggtttcactagaatcagaaatcaatcttgtgaattatcttgggcagaytatgactctccaagtggtaggtccctaataatttgtctggaatagtgcagtaaaaaatagttgggttttaataaaatgatgaagctgtttccataagcaa

SEQ ID NO: 41338 - DNA, 201 bp, Homo sapiens
ttaaggccctgtctactgcttatagatatatacagggtctcagacctctctttgtaagaataacaatttatcatcaaaactatagagtcattttttctgcmaaaatgagtgtagtttcttcccaacttatagaaatattatgtctttgatatgaactttaattgagcagtgaattacttagtggtttgcagtgcttctggg

SEQ ID NO: 41339 - DNA, 201 bp, Homo sapiens
tacacttattagcttggttatttttctaaaaatctggattagtttaggatctaattctcttccattttgatttgttgggtcattttattgtagaatatgtrtataaaattatgcatggcttggttttcttaaataaacttttaattttagaatagttttagatttacagaaaaattacagatagtacagaggagttcttgt

SEQ ID NO: 41340 - DNA, 201 bp, Homo sapiens
gtgtccaatcttttggcttccctgggccacagtggaagaagaagtgttgggccacacataaaatacactaatactaatgatagactatgtgaaaaaaaaaacccacaggaaaaacctcataatgttttaagaaagtttacaaatttgtgttgaactacaccacattcaaagctgtcctgggccacagggctgcaggtcgga

SEQ ID NO: 41341 - DNA, 201 bp, Homo sapiens
accgtgttagccaggatggtctcgatctcctgacctcatcatccaccctccttggtctcccaaagtgctgggattacagccgtgagccaccatgcctggcmtaggatgtagttttgcaatgtggaacaaagtgcctacctaagttgggctattatccttccacaaaaactgggagatagggctcctatctcccttgatgtc

SEQ ID NO: 41342 - DNA, 201 bp, Homo sapiens
agagaatatttgtctactttataattttaacaagaccttgtgtgccaatgagaatgattaggtgccccttctgtcatgtggtcgaggttttgtgactaaaatatgacatatactctatgaaaataaataaatggtttaatgaactataattttatagttgaaggagagaaaaaaggccaccatttggaaaataagaattgt

SEQ ID NO: 41343 - DNA, 201 bp, Homo sapiens
gcaattctcaatgataactctggtgtattatggatagatgagagagaaaatatagggtttcagaaatcttatggtggagtttcatacaaaccagttgcctyctcttaccttggtggcagtctggaatgaggagagtatattagattataaatattaaatatgctttaaatgtcactcgtgttttggtgaaaaatagtgaag

SEQ ID NO: 41344 - DNA, 201 bp, Homo sapiens
aactctagcctgggcagcacagcaagaaaaaacaaacaaacaaacaaaattctgcactctaatttacttagtggatatacattttggtaatttactatatrgtgtttatttattaaaaaatactgtagcctttttaagctaaatttcaatgtttaccttagttatttcattagaatacatttctaaaagtagaatttctat

SEQ ID NO: 41345 - DNA, 201 bp, Homo sapiens
gcagggattgattgcagtgagccgagattgcgccattgaactctagcctgggcagcacagcaagaaaaaacaaacaaacaaacaaaattctgcactctaayttacttagtggatatacattttggtaatttactatatggtgtttatttattaaaaaatactgtagcctttttaagctaaatttcaatgtttaccttagtt

SEQ ID NO: 41346 - DNA, 201 bp, Homo sapiens
gctcatttttatacctgttcctatacttttgttacacagtcaatacaacataatacttaggtgtgtgtgtatggtttatatgtgagtggtgtgggcggatrctcttgagtattatattgttgtattgtaggatcaaattttatttttttaatcctcttcaacttgctttctccacattttgttttcaagatacagatgctt

SEQ ID NO: 41347 - DNA, 201 bp, Homo sapiens
caaaagttcatatgactgaaattttttgttttgaacctttgaaaactaggaaatatatatcaaacacaagagtaaatataacatatatgtacttaaaataytactactaataataaatcaagtaaatatctatgtacttaaccttacctcgtggtcctgtctccccactcttacttaatcactgttctgaaatttgtattg

SEQ ID NO: 41348 - DNA, 201 bp, Homo sapiens
ttgcctcctgtttgtgaactcatgtctctaacaagtttcagaaagttcctagctattttctattcaaatatgtcatttattctattatctcgattatctcrtcctgagcatgtgacagtatacatgatgggtagtctcattctatccaccatattctttattcagatttatgtatttccaggcctttgtttcactgtactg

SEQ ID NO: 41349 - DNA, 201 bp, Homo sapiens
tatttgcaaaatacatttatttgggtcaggataggaaaagccgctatgtgactttggatactgttcactcaacattcttgctgagactttagatttatagmccagaataatcagctgcatggaattgataagtgaggcaaagtgcaagggataagagagagagaatttgcctttattaagtacttaactatgtgtccacca

SEQ ID NO: 41350 - DNA, 201 bp, Homo sapiens
aaaagtagttatatgattatcaacttattaaatattctattcaagtcagattctggtagattacatcacatcatcaacaagcggacactcgtagagtaaawcctacagactataatggtgtaggaggcaagattgattgtaaactagcttcttttccttattaaaatgtatgtctctttttgtatatgaatttaaaagtaa

SEQ ID NO: 41351 - DNA, 201 bp, Homo sapiens
tttgcttggaatgtgggattatgtgataatctttgtgtagtaataattaataagtgacatatttgcaaaatacatttatttgggtcaggataggaaaagcygctatgtgactttggatactgttcactcaacattcttgctgagactttagatttatagaccagaataatcagctgcatggaattgataagtgaggcaaag

SEQ ID NO: 41352 - DNA, 201 bp, Homo sapiens
tcttctgaatgccatcaaggaagagagagactccatcaggacaagaaatataatcttatgtaacgaattgtgaagtaacgaacatgtaatcaaatatatcycatcaacttttccgttttctgtttgttacaaacaagtcacaaactcaggaagaaagggtcatggtggccaccttaaaggactacctgacacatcagagaa

SEQ ID NO: 41353 - DNA, 201 bp, Homo sapiens
ggtatgtgacagttttttattatttgcttggaatgtgggattatgtgataatctttgtgtagtaataattaataagtgacatatttgcaaaatacatttakttgggtcaggataggaaaagccgctatgtgactttggatactgttcactcaacattcttgctgagactttagatttatagaccagaataatcagctgcat

SEQ ID NO: 41354 - DNA, 201 bp, Homo sapiens
ttcttgcttcctgttctgctctgtactagttatataacttcaaatctctgtgtcttcatatataaactgggaatattaacagtatctaattcagagggctyttgtgaggattaagtgaattaacacataaaaaatgcttgccgttgtgcctgacacgcaggttcagtaactgttagctaatttttttgttgttagtaattt

SEQ ID NO: 41355 - DNA, 201 bp, Homo sapiens
tttccccaacaaagttgcttgtcttctgaatgccatcaaggaagagagagactccatcaggacaagaaatataatcttatgtaacgaattgtgaagtaacraacatgtaatcaaatatatcccatcaacttttccgttttctgtttgttacaaacaagtcacaaactcaggaagaaagggtcatggtggccaccttaaagg

SEQ ID NO: 41356 - DNA, 201 bp, Homo sapiens
ttttacatacaggaagaaggtcacatgtttaacagaaactattcttgcttcctgttctgctctgtactagttatataacttcaaatctctgtgtcttcatmtataaactgggaatattaacagtatctaattcagagggctcttgtgaggattaagtgaattaacacataaaaaatgcttgccgttgtgcctgacacgcag

SEQ ID NO: 41357 - DNA, 201 bp, Homo sapiens
aataaatggaaataataacaaacagtatctcagaccacagtgcaatcaaattagaactcaggattaagaaactcactcaaaaccgcacaactacatggaarctgaacaacctgctcctgaatgactattgggtaaataaattaaggcagaaataaataagttctttgaaaccaataagaacaaagacacaacataccagaa

SEQ ID NO: 41358 - DNA, 201 bp, Homo sapiens
atgtgttgccctgaaataagaggaaaataagcattttcccaattgacccttcagcaatttctccaggctttttttttttttcaggagcccctttccaattycccatcatttttcaataagatgtgggaatttcttccccaattttttttttctggagctacgttttgatttattttgtgttcattgactatggagtcagga

SEQ ID NO: 41359 - DNA, 201 bp, Homo sapiens
tgtcatctctctgaataattagaagtgttaaagatgactggagccacttacatattctaatatcaatttacaatatcacataaaagcatctttagaatcakgactaaaaactgacttgttcatgtttgtggaacaagtctaattttttaagtttcaatatacctttatttaaaatagttaatgtcacacatgcaaatgata

SEQ ID NO: 41360 - DNA, 201 bp, Homo sapiens
ataatgtcaaaaaatgaattatcaggaaataaactaaaaatgaaacttaagtctttagatcaataaaatgcaatacttttgatttttatgaaattcataaygagtgtcacagtttgcaaatgagaatcaaccatttttatttattctcatcctaaatcaaattaaaatttggagtttgtcaatttaaaaaaacagctagtg

SEQ ID NO: 41361 - DNA, 201 bp, Homo sapiens
caccggagtggtcatgattactgtatcctcagaaagattaatttttagatgtgtgccctgaagcagaatgtgttgtagaagcatgattcactgaattctgycataaatgggaaatgagattgttgggtctgtgcacaaaattacagacttttgtttttgtttttgttttattttcaaagaaaataatgatctttccaaaga

SEQ ID NO: 41362 - DNA, 201 bp, Homo sapiens
ctgcttaatggagctgagcagcagcctgcatttcttggcacatttgacaagcaagttcagtctcagttagtaaaccttatttaagaaactaatgttctccrtttgtgtatttgcaaaggatatgttttagataatgtcaaaaaatgaattatcaggaaataaactaaaaatgaaacttaagtctttagatcaataaaatgc

SEQ ID NO: 41363 - DNA, 201 bp, Homo sapiens
atatctcactgaaattatttagaatcaataattgaatttttactaggattttatgaattccatctcctttggagctgtcatatattcttgctttttcatgwttcctgtgtccttacattgatatccgtgcatctcatgtagcagttgcttcttctaactttttcaatttgctttcacagggaaggactttttttgaggaag

SEQ ID NO: 41364 - DNA, 201 bp, Homo sapiens
gaaatactactttaaaaaaatgttgattttgtatcctgtagtgtaactgaatttgtttaacaactctaagggttttttggtggagtcttttgacttttctmaatatgagtatcatgtcatctgcaaagagggacaatttgactttctctttttgaatctggatgccttttctttctcttgcctgattactctggctaggac

SEQ ID NO: 41365 - DNA, 201 bp, Homo sapiens
gttcttctgtttttgtttttgttttgcttttcttttttttgctatttcattattggtgtatagaaatactactttaaaaaaatgttgattttgtatcctgyagtgtaactgaatttgtttaacaactctaagggttttttggtggagtcttttgacttttctaaatatgagtatcatgtcatctgcaaagagggacaattt

SEQ ID NO: 41366 - DNA, 201 bp, Homo sapiens
agacaagagggtagtagttaaaatttgcgaaggattttcagtgttgtcttctgatattaacatgatgagccagggacagtcatttggctcttttttattcrttgttaaaagtaaggtcaataagaaatgattcaccagggctgtggttgtgaagaagaccgagacccgcgatgggaagctggtgtccgagtcctctgacgt

SEQ ID NO: 41367 - DNA, 201 bp, Homo sapiens
ggggcttctggccgatttcagtgaggagcattctctcttacagactgagagtatttaagtgtttagggcaagagggcttatcacaggcttggaatgttttygtgtcggggagaagtttattgtggggttgtaatgtctctgatcagaggggaagttaccttggggctaaacatctctctgggcagagaggaggttacctca

SEQ ID NO: 41368 - DNA, 201 bp, Homo sapiens
ctgattctttgaaaatttagtaaaataaacaaagcccttgcaggactgaataatttttttttaatacagggaatatttaactgtgaaggagaactcatacwgtaaataaagtagtgcataaatagaatttgagaatactgtgaaaaaccttaggaatgcagcttcaataaactggaaaatttagatgaaatgaacaatttt

SEQ ID NO: 41369 - DNA, 201 bp, Homo sapiens
gaggctgagtgggaggattgcttgggcctgggaggtggaggttgcagtggtgagctgtgatcacgccactggcactccagcttgggcaacagagtgaccckgcctccaaaaaaaaaaaaaagtggaataacatgacttttcaccttaactctttggcaattatatatcttggcatattgaggaaacaatgaaagaagcaaa

SEQ ID NO: 41370 - DNA, 201 bp, Homo sapiens
gtacttggccaatttcaagcttctatgatgtgtatataggctagcatcttattctttctttagcttttctcatgtgattgagagattagttaaaagcccakggaggatgctttcaaaatacaaaacaatctgctgttttgcccataatgaactaaatagcaaatgcttataatacttttacacacgtcagtgtgaaattga

SEQ ID NO: 41371 - DNA, 201 bp, Homo sapiens
tttttttccagctatatataagctgattctaaagaaagaattacaaaaatacatttatatggaaaggcaaaggaaccagaatagccaaaaaaaaaaaaaaacaaaacaaaacaagcaaacaaatttggagcatccactgtacctgattttgagacttgcactataaaactatagtaattaagagtgatatttgcaaaagag

SEQ ID NO: 41372 - DNA, 201 bp, Homo sapiens
acaaagggaaccattttgggaagtcctgacatagacatttctatacatttttgaaaggggatattttacaaataattatcaaatgaagaaagttggttggkcagttatccagttgggcagagattggattatcagtaactggtgtgataaattcattttcttaaagaaacaaaggccttttatagcattaactgcaatgcc

SEQ ID NO: 41373 - DNA, 201 bp, Homo sapiens
tctattatcctttattcagcaggagtttattttatttttcatctttcttatgatttttaagatatgtactgaatgcacaagagggctaaaatacaaccttrtcttggtctagagacttgccacccagctggtagttttattgtaagaacagttacctggggaggtgatttactggtaagaataaaggtagtatatcctatt

SEQ ID NO: 41374 - DNA, 201 bp, Homo sapiens
gataggatgagtagcttcctaggtgggaaagtggaagcagcattccccagagaaggaatatggaatgtagggcacagttagaagaaaagaagcaggagatwacatggtgtgaattgggaacacatcatgaaaggattggaatcaaaacttaatattataaaaatctaaggagccggacatagtggccctagcctgtcgtcc

SEQ ID NO: 41375 - DNA, 201 bp, Homo sapiens
gactccctctcttgctaaaggaaaaaaaaaaaatgcatgaggatgtcaagtattttaaaatgactctaatgtgttgtgcatggataatcgagaaaaatatkggtgctatttttttttttactgaaatgtgaattaaaggaaaaagataattctgaggatgatagagagttcaaaatcagatattttggatttcagaaaaaa

SEQ ID NO: 41376 - DNA, 201 bp, Homo sapiens
atttttttccagctatatataagctgattctaaagaaagaattacaaaaatacatttatatggaaaggcaaaggaaccagaatagccaaaaaaaaaaaaaaacaaaacaaaacaagcaaacaaatttggagcatccactgtacctgattttgagacttgcactataaaactatagtaattaagagtgatatttgcaaaaga

SEQ ID NO: 41377 - DNA, 201 bp, Homo sapiens
agtcagtgcaataaggcaaaagaaagataaaaggcatatatattggcaaagaaaaaataaaatttttctatgtgcagatgacatgattgcgaattccaaasatctattatatttatacgtgctagcaatgaacaattggaaaccaaaattataaaagaataccagttaccaaaacttcaaaaattgatatacgtaagtata

SEQ ID NO: 41378 - DNA, 201 bp, Homo sapiens
ttaaaggttctagtcagtgcaataaggcaaaagaaagataaaaggcatatatattggcaaagaaaaaataaaatttttctatgtgcagatgacatgattgygaattccaaagatctattatatttatacgtgctagcaatgaacaattggaaaccaaaattataaaagaataccagttaccaaaacttcaaaaattgatat

SEQ ID NO: 41379 - DNA, 201 bp, Homo sapiens
attgaccctttatcatgctgaattgatcctttataatgatttttttgtctctttgtacagtttttgtcttgaaatctattatgtctgatgtaagtatagcyactccttttttggggggctgttcattcagatagagtatcttttatcattcctttgttttcagtctatgtgtatttttgtaagtgaagtgtgtttcttgta

SEQ ID NO: 41380 - DNA, 201 bp, Homo sapiens
gggactttcctaatttgataaaaggtatcaacaaaaagcccacagctaacatcattcttaacagtaaaagaatgaatgctttcttcctaacaacaggaacwtgacaaggctagttatttcactggtcctttttaacattacattaaaggttctagtcagtgcaataaggcaaaagaaagataaaaggcatatatattggca

SEQ ID NO: 41381 - DNA, 201 bp, Homo sapiens
tgttaaagtctctagttgttattatattgaggtctacctgtctctttagctctaatgatatatatctgggtgctctatcattgggtgcatatatatttacratttttatatcctcttgctgaattgaccctttatcatgctgaattgatcctttataatgatttttttgtctctttgtacagtttttgtcttgaaatctat

SEQ ID NO: 41382 - DNA, 201 bp, Homo sapiens
cttatagcatcattattaatagccctaaagtgagtataatagtactgatacatactatataataaagtatgatacatactacattattccaagtataatartacttggaaacattatactgagtgaaagaagccagtcaaacactacatattttatgattccattaatataaaatgttatttcatagcagactccaatagg

SEQ ID NO: 41383 - DNA, 201 bp, Homo sapiens
tgtgttactatctgacacagcaattcagttcctatctgtatacctaagagagataaaaacatacacccacacaaaaacttacacatgcgtacttatagcakcattattaatagccctaaagtgagtataatagtactgatacatactatataataaagtatgatacatactacattattccaagtataataatacttggaa

SEQ ID NO: 41384 - DNA, 201 bp, Homo sapiens
atgaaggagaaataaacactttccagacaagcagatgctaagagaattcatcaccaccagaccagacctacaagaaattcccaagggaatcctgaacttargctgagcatggtggctccaatctatgatcccagcactttgggaagcctaagcagtagcatcacttgagtccaggatttcaagaccagcctgggcaacata

SEQ ID NO: 41385 - DNA, 201 bp, Homo sapiens
gggttgcagtgagccgagatcatgccactccactccagcctggcgacagggcaagactctgtctctgtctctctttctctctctctctctctctctctctmtatatatatatatatatatatacacacacacatacttactattcaatttaatttcctatattacaacaaattggaggatgtattccacattctttctaac

SEQ ID NO: 41386 - DNA, 201 bp, Homo sapiens
tgttgtttattaccaagacttttccgtctttgcaaagtttgccttaaagtattgtcataaatgatgaaatataagccatacttatctaaatcacaaagaargtttttagaacatagcacctttgattttaatcagactttgtagctcattagtacattttcaaaatttgatgatcttctaagtgttttctcagcattaaga

SEQ ID NO: 41387 - DNA, 201 bp, Homo sapiens
tcccaaacaggtggaaacccttattttcaatgtacagatattgaataatgtaaagctacatgatagagggatgagaaattgactgagtttaaaaaaaaaaaagttcagtgtttttatatatagatataatgctttaaaagttttcaaatgctgaacaaatttagtaagatgagggccaggtgcgatggctcatgcctgtaa

SEQ ID NO: 41388 - DNA, 201 bp, Homo sapiens
ccagatagaagcataatattgtaatcttcatgtgaaattctttattccaccccatttatccctgttactaagctcctcctcctgtcaggaattcttaataragaatatagaatatattagctttttaaataaataataaaccttctggactgtattgtgaaggcttacaaattatactcttagtgtcaacttcagttcttt

SEQ ID NO: 41389 - DNA, 201 bp, Homo sapiens
aggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagttgtttccctgtcccacctggaaagcacatactggtccaaaaaattcagca

SEQ ID NO: 41390 - DNA, 201 bp, Homo sapiens
aaggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagttgtttccctgtcccacctggaaagcacatactggtccaaaaaattcagc

SEQ ID NO: 41391 - DNA, 201 bp, Homo sapiens
tatcatttttagatcattattgtaatgagtctgaattcttttctgacctatttaattccataataatgtatcctcacctactttcaaatgcacataataartttatcaaggattaagaagggatgaaatatttttgggctactaccagacagaagctcaaggcctaggagaacttggctgtgtaggtctgttaactgcatt

SEQ ID NO: 41392 - DNA, 201 bp, Homo sapiens
tgcaaaagagttcagaactggttctgaatttggctgtgtaaaatagacaagatactttgaagtcgccggggtgttgaccaaaaggccgcctttgtttgatmaatctacactccaaagttcagaacagcttatcctacctggcatttccattgattagaatggatgtgtttaaggtatccctctctttgatcaataattcta

SEQ ID NO: 41393 - DNA, 201 bp, Homo sapiens
tgaaggccaccaaattgcttcttgcaggcttctactattcagaaattattaaatactttcaaaaaagtttaattttaaaaatctgagcttaaatgcacccmaaacacgtttctgtagggcattctttgtatgtagcgtaggactttcattttgttactccccttctgtgcattcattcctagcccatgataaaaataaaaa

SEQ ID NO: 41394 - DNA, 201 bp, Homo sapiens
acaatatttttatattatgcttagtcttggaatttacttggaattaggttagctgataaatcctgaaataggcatagttgaaacttaaagtataacttatwtggggttgtatttttcaggtgaagctctgaaagtatcagctgagagatttacagatgacccctgttttctcccaaaaagggaggctgtggttcaagctgc

SEQ ID NO: 41395 - DNA, 201 bp, Homo sapiens
ttagtagagacggggtttcaccatgttagccaggatggtcttgatctcctgaccttgtgatccgcccgccttggcctcccaaagtgctgggattacaggcrtgagccaccgcgcctggctgaatgttactctgtttttaagcggttttggaaaagtttatttcttactcttgatataagagctgtgcacagtgctgctata

SEQ ID NO: 41396 - DNA, 201 bp, Homo sapiens
aaagaaaaggaaggaaggaagaaagaaagaaagaaaggaaggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagttgtttccctgt

SEQ ID NO: 41397 - DNA, 201 bp, Homo sapiens
gtagctttcttcaattaagaaaaattcttttgtcttactggattctgattttccctttcttatttcttcttatgttcactgtgtagtttccagagtgcttytccattcctttgttacccttctctctcccaaggcctttctaagaccacctcttagagccccacatactcattcctccttctagtaggctctgatctacca

SEQ ID NO: 41398 - DNA, 201 bp, Homo sapiens
aaagaaagaaaaggaaggaaggaagaaagaaagaaagaaaggaaggaaggaaggaggaaagaaagaaagaaaaggaaggaaggaaggaaggaaagaagaargaaagaaagaaagaaagaaagaaagaaagaaagaaagaaagagaaagaaagaaagaaagaaggaaagaatacattagaggtaagcctcagagttgtttcc

SEQ ID NO: 41399 - DNA, 201 bp, Homo sapiens
taacaaacaatccattttaagctggtaaaagttaagttgatggcaagcttctctcacttttttcttccagtacaagtttcttgaaattgtcttgctcagaytttagtccttcagatatacatatttttttacctcatgcagtctattcttttcaagagaattaatgacattttaattactaaatgttcagtgctggtttcc

SEQ ID NO: 41400 - DNA, 201 bp, Homo sapiens
aaagaaagaaagaaaaggaaggaaggaagaaagaaagaaagaaaggaaggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagttgt

SEQ ID NO: 41401 - DNA, 201 bp, Homo sapiens
tttcatttcctgtctttcccttcctctcctccccaaacagtctgttaccccatgctgtcccttgttgcccaagaacctccaatttcgaaactcaacgaggktctgtatgtatgatttcttaacatctacctccctcacaaacatacttagatgcatgaatccctattaaattgttagacagtgtgagcgggatgctctcct

SEQ ID NO: 41402 - DNA, 201 bp, Homo sapiens
gaaagaaagaaagaaaaggaaggaaggaagaaagaaagaaagaaaggaaggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagttg

SEQ ID NO: 41403 - DNA, 201 bp, Homo sapiens
aagaaagaaagaaagaaaaggaaggaaggaagaaagaaagaaagaaaggaaggaaggaaggaggaaagaaagaaagaaaaggaaggaaggaaggaaggaaagaagaaagaaagaaagaaagaaagaaagaaagaaagaaagaaagaaagagaaagaaagaaagaaagaaggaaagaatacattagaggtaagcctcagagt

SEQ ID NO: 41404 - DNA, 201 bp, Homo sapiens
aggaaggaaggaaggaagaaagaaagaaagaaagaaaaggaaggaaggaagaaagaaagaaagaaaggaaggaaggaaggaggaaagaaagaaagaaaagraaggaaggaaggaaggaaagaagaaagaaagaaagaaagaaagaaagaaagaaagaaagaaagaaagagaaagaaagaaagaaagaaggaaagaatacat

SEQ ID NO: 41405 - DNA, 201 bp, Homo sapiens
aagaaagaaagaaagaaagaaaggaaggaaggaaggaaggaaggaagaaagaaagaaagaaagaaaaggaaggaaggaagaaagaaagaaagaaaggaagraaggaaggaggaaagaaagaaagaaaaggaaggaaggaaggaaggaaagaagaaagaaagaaagaaagaaagaaagaaagaaagaaagaaagaaagagaa

SEQ ID NO: 41406 - DNA, 201 bp, Homo sapiens
aggaaagaaagaaagaaagaaagaaaggaaggaaggaaggaaggaaggaagaaagaaagaaagaaagaaaaggaaggaaggaagaaagaaagaaagaaagraaggaaggaaggaggaaagaaagaaagaaaaggaaggaaggaaggaaggaaagaagaaagaaagaaagaaagaaagaaagaaagaaagaaagaaagaaag

SEQ ID NO: 41407 - DNA, 201 bp, Homo sapiens
ggttgcagtgagccaagattgtgccactccactccagccagggagacagaacaagaccctatctctaaaaaagaaagaaagaaagaaagagagaaagatgmagagagagggaaagaaggagagagagagagaaagaaaaatagaaagaaagaaagagaaagataaagaaagagagaaagaaaagaaaagaaagaaggaaag

SEQ ID NO: 41408 - DNA, 201 bp, Homo sapiens
tactgtaatccagataatttctgcagataacttttccaattcactaatcttttcttcagttgtgtatgatatgatgattcatccatttgttaacttttttwaaacatatatatttcttcaattttagatatttggtagattcttgctgtctgcttttttttttaagataggttctcactctgtcacccaggcaagagtaca

SEQ ID NO: 41409 - DNA, 201 bp, Homo sapiens
acaataactgagtaccctatgacacagtcattccaagtatacacccaatagaaagcatatatgtgcaccaaaagacaagtactagccaaaagttggaaaaagaacaaatacggaaatgaccataatagctctaagtagtaaatattcatcaacagttgaattaataaataaactgccttgcatttacacagtggaatacta

SEQ ID NO: 41410 - DNA, 201 bp, Homo sapiens
aaattccaaccatttttcacaattgagccaaccatagcctttgaactcttggtaacttttatgctcatgtcttctctccctctcactatatatatatatayacacacacacacacacacatttatagaagaggtatttgcctacatataaaaatgcatacatatataaattagttgttctaaacaaggtaaatttgtgcct

SEQ ID NO: 41411 - DNA, 201 bp, Homo sapiens
agaaatatggatgtcccacctaaccttagagttatcacaagttaagaggttggaggcatatcacaaattaggctatcttatctgcctcatggatcaaaaamcagtgagttaaaagactatcaagtaatattttagtgatctcacagaagaaccacactggcatcttgaggtacacaagtagaaatagagcaaagccccttt

SEQ ID NO: 41412 - DNA, 201 bp, Homo sapiens
atctaagatagaacagataagaggggaaatgtaattctatgtatagagtgattagtattcatatctctgtgtagaagtgcagagatatgaaatataggtgmaagtccaggaagtacaaatactttaatatggctggagtgtaggctgctgtaaatcaaacttctctcaaaagtttgtgagttcctttatgagtgaatctat

SEQ ID NO: 41413 - DNA, 201 bp, Homo sapiens
agagacagcaaaaacacaggcaattgccttcataaagcattaaaaatcttttaggtatttgttactatttctcccccattaaacttttctcccccgaagcytctaagaaggaagaatactgaatgatctgtactttctttttcttttttttttttcttacctacagttttgaagaggatgataagaaacggtcaatgtgga

SEQ ID NO: 41414 - DNA, 201 bp, Homo sapiens
ggctcatacctgtaattccagcactttgggggaatgaggaaggaggattacttgaatccaggagtttgagaccagcctgggcaatatagtgagatctcatytctacagaaaattagaaaatcaaccaagtgtggtggtgcacccctatagtcacagctacttgggaggtttaggtaggaagatcccttgagcccaggaggt

SEQ ID NO: 41415 - DNA, 201 bp, Homo sapiens
acgactaccctaatctcaaaaagaatggttaggttgggcatggtggctcatacctgtaattccagcactttgggggaatgaggaaggaggattacttgaayccaggagtttgagaccagcctgggcaatatagtgagatctcatctctacagaaaattagaaaatcaaccaagtgtggtggtgcacccctatagtcacagc

SEQ ID NO: 41416 - DNA, 201 bp, Homo sapiens
gatgataaaggttaatgatggaaacgactaccctaatctcaaaaagaatggttaggttgggcatggtggctcatacctgtaattccagcactttgggggamtgaggaaggaggattacttgaatccaggagtttgagaccagcctgggcaatatagtgagatctcatctctacagaaaattagaaaatcaaccaagtgtgg

SEQ ID NO: 41417 - DNA, 201 bp, Homo sapiens
ggatgataaaggttaatgatggaaacgactaccctaatctcaaaaagaatggttaggttgggcatggtggctcatacctgtaattccagcactttgggggratgaggaaggaggattacttgaatccaggagtttgagaccagcctgggcaatatagtgagatctcatctctacagaaaattagaaaatcaaccaagtgtg

SEQ ID NO: 41418 - DNA, 201 bp, Homo sapiens
gcccacaggttttgctgtatgatttccccaacaaagttgcttgtcttctgaatgccatcaaggaagagagagactccatcaggacaagaaatataatcttrtgtaacgaattgtgaagtaacgaacatgtaatcaaatatatcccatcaacttttccgttttctgtttgttacaaacaagtcacaaactcaggaagaaagg

SEQ ID NO: 41419 - DNA, 201 bp, Homo sapiens
ctttgggaggccgaggcaggcagatcacgaggtcaaaagatcaagaccatccaggccaacatggtgaagccccgtctttactaaaaatacaaaacttagcygagcatggtggtgcatgtgtgtagtcccagctactcaggaggctgacgcaggataattgcttgaactcaggaggcgtgggttgcagtgagccgagatcat

SEQ ID NO: 41420 - DNA, 201 bp, Homo sapiens
gcctgatattcggacatgatgtgaatacatcagccttggatttgcatgctctaccaatttctgattacatgagaagttgcactgtagatcattgtcatttsttctacactcatactaattgggggaaaggattctattatttgggtgaaaatattgagtgtattagagcaaggacagtgagtttctactgatggcactgtt

SEQ ID NO: 41421 - DNA, 201 bp, Homo sapiens
tttaaattacaatagaaaactcttaaaagaaaacataggataaatttttgtgattttggtttggcattgttagatacaacaccaagtaatgacataaaaaattataatttgatttccttggaagttaaaaaaaatcctctgtgaaaggcactgttaaaagagtgaaaagtcataatagagtgggaaagaatatttgcatat

SEQ ID NO: 41422 - DNA, 201 bp, Homo sapiens
ttatgccttacattatatacaaaaaatgagtcaaattagataacagctttaaattacaatagaaaactcttaaaagaaaacataggataaatttttgtgaytttggtttggcattgttagatacaacaccaagtaatgacataaaaaattataatttgatttccttggaagttaaaaaaaatcctctgtgaaaggcactgt

SEQ ID NO: 41423 - DNA, 201 bp, Homo sapiens
aacttcagaaaaattctccattccaattagcctgtaagagacaaattgttaattccagtttaataatcttattttcctgaggtgtttttgtttttttttttattttttgagacagtctcactccgtcacacaggctgaagtgcagtggcatgatctcagctaactgcaacctctgtctcctaggttcaagtgattcttata

SEQ ID NO: 41424 - DNA, 201 bp, Homo sapiens
tgctaaggagagcagaaataattatgcgttatttccctggtatcattaggttaaattcagacaatcctgtagctttggtttcagatggtttacgaagcacrtttaagtatcaaaatcaggaaagtgaaacaaagcattaagattctagtatcaacggaatcaaatactccaggatacaatatctacctaattctgagggca

SEQ ID NO: 41425 - DNA, 201 bp, Homo sapiens
cccctgatcattgctttccttcaaaatctttgcaggatatttgaatcagcagcctccctctttttaatgttcttagttcttatcaaagacaacatcagaakaactaatacatggtttttgtttgttttttgagtttttttggatataggacagggcagtccatctgaacctgttttgattaaggtagcattcttctctcac

SEQ ID NO: 41426 - DNA, 201 bp, Homo sapiens
gcaggggtgaaagtatattggtcggagttctccggggaaacagaaccaatagattgtgtgtgtgtgtgtgtgtgtgtgtgtgtgtgtgtgtgtgtgtgtgtataggtgggtgcgtgtatgtgtgtgtgtgggtgtaggtgggtggagagagaaaaatttattttaagggattgacttgtacaatttcggagactggcaagc

SEQ ID NO: 41427 - DNA, 201 bp, Homo sapiens
caggagttcgagaccagcctgccaatatggtgaaaccccgtctctattaaaaatacaaaaattagctgggcatggtggtgggcacctatagtcccagctaytcaggtggctgaagtgggagaatcccttgaacttgggaggtggaggttgcagtgagccaagatcgtgccactgcactccagcctgggcgacagagcgaga

SEQ ID NO: 41428 - DNA, 201 bp, Homo sapiens
tgcaggggtgaaagtatattggtcggagttctccggggaaacagaaccaatagattgtgtgtgtgtgtgtgtgtgtgtgtgtgtgtgtgtgtgtgtgtgtgtataggtgggtgcgtgtatgtgtgtgtgtgggtgtaggtgggtggagagagaaaaatttattttaagggattgacttgtacaatttcggagactggcaag

SEQ ID NO: 41429 - DNA, 201 bp, Homo sapiens
ttgcaggggtgaaagtatattggtcggagttctccggggaaacagaaccaatagattgtgtgtgtgtgtgtgtgtgtgtgtgtgtgtgtgtgtgtgtgtgtgtataggtgggtgcgtgtatgtgtgtgtgtgggtgtaggtgggtggagagagaaaaatttattttaagggattgacttgtacaatttcggagactggcaa

SEQ ID NO: 41430 - DNA, 201 bp, Homo sapiens
cttgcaggggtgaaagtatattggtcggagttctccggggaaacagaaccaatagattgtgtgtgtgtgtgtgtgtgtgtgtgtgtgtgtgtgtgtgtgtgtgtataggtgggtgcgtgtatgtgtgtgtgtgggtgtaggtgggtggagagagaaaaatttattttaagggattgacttgtacaatttcggagactggca

SEQ ID NO: 41431 - DNA, 201 bp, Homo sapiens
ttaaattgtggtagatttatacttaaagtcataaaatatgcatataaaactattgaaaaaataccagaaaattcgactgtgattatctctggactgtggcrttataagtgcttcttattatttatttttcagctttattaaggtataattggcaaatattttttatatttacagtatataacatgatgtttgatatacgta

SEQ ID NO: 41432 - DNA, 201 bp, Homo sapiens
tacccattctccttgagtaatacaatgaatgcctcaggtttccaccaaaatccatgtttataactgctttagaatgcttcattcaaatgcttccatcttgsatgattccaactatccacttttccatgtctagagccaggtggccaagagcttcaagagacaaagcacaacaggcagattgacattgctataaattaatgc

SEQ ID NO: 41433 - DNA, 201 bp, Homo sapiens
acttctacctacttatctgtctcttttgctggcttgtccaactctaatatattcttcctttttctttattagtctacccattctccttgagtaatacaatkaatgcctcaggtttccaccaaaatccatgtttataactgctttagaatgcttcattcaaatgcttccatcttggatgattccaactatccacttttccat

SEQ ID NO: 41434 - DNA, 201 bp, Homo sapiens
cgagattgcgccactgcactccagactgggtgacagagcgagactttgtctcaaaaaaataaataaataaataaattattttgccaacatctgaaaattakgtaatatcattggagtcattgtaaagtctctgatcacagaggctaagtttctgttttataatgacatatatccagtgcctatttgtcgaaagaataaatg

SEQ ID NO: 41435 - DNA, 201 bp, Homo sapiens
catttagaagatagaacatggcttttaaaaagtcttatcatctacgtaagggtcaggagatgggagaagttaaaaatcaggaccctgaaattccccaggaragtaactatcagggagcaacgtaaaaaaaattattttcccatattccttttccatatacaagagttctatgcatataggagccccatgtagaaattttta

SEQ ID NO: 41436 - DNA, 201 bp, Homo sapiens
agagtggatgacatttaggatgagagttaagaggagaaggagccagacactgtacaagctgggagaagagaactctaggcagaggatcaacagcagcaaaygccttgggaacacagtgttttatctcccagctttagagtctgaaaacaaagttaatgcaattgcagcctacttgaataaaaggaagatgatattggcaaa

SEQ ID NO: 41437 - DNA, 201 bp, Homo sapiens
agctatgatgaaacaggggcccctgctgagatgtttcctatgactggtgaaggctaagcagcctgcatacactggtaatcctatgtatgtatgtatgagtrtatttatttttgcttcaattgtctgttagacctaaagtttctgggccagggaggatgagatagtttgtatgtctcaaattcaggaattaaaatagagcaa

SEQ ID NO: 41438 - DNA, 201 bp, Homo sapiens
ataggagagaattgaacaatgagaacacatggacacaggaaggggaacatcacacactggggcctgttgtgggtgaggggaggggggagggatagcatttrgagatatacctaatgttaaatgacgagttgctgggttcagcacaccaacatagcacatgtatacatatgtaactaacctgcacgttgtgcacatgtaccc

SEQ ID NO: 41439 - DNA, 201 bp, Homo sapiens
gttgaatgggtaacacagtgagatttagtaatagtagtattgaatttaaagtgagtaaaatcagagatggaattgaggccagctcactgctgttgaagggrcagaggaaagagcactagttgttaagatctcagtgcagttcccatgctcttttgacttaaaaattaagaagcttatttttttctgcagggcatccagaat

SEQ ID NO: 41440 - DNA, 201 bp, Homo sapiens
tttcattcatgaattagtatgaaattcaaaggttatgacatgcctctgcaataatacttaagtatacttagaaaatatttaaattaggccaggcatggtgsctcacgcctgtaatcccagcactttgggaggctaaggtgagtggatcacgaggtcaggagatcgagaccattgtggctaacagtgaaaccccatctctac

SEQ ID NO: 41441 - DNA, 201 bp, Homo sapiens
aaaaaaaagcaatcgtatacaggtaaactgaattgttagtgcatactttgtacaaaggaaatattatcttaagaatattattattataatatattggtttracgcatcagctcagaaatctcctacttaaaagcagtgcggccaatgataaactgaaattcccctaagctttggtttcttcatctatccaatgtctgtaaa

SEQ ID NO: 41442 - DNA, 201 bp, Homo sapiens
aggaggcagaggttgcagtgagctgagatcctgccactgcactccagcaggggtgacagagcgagactccgtctcaaaaaaaaaaaaaaaaaaaaaaaaaaggcttttctttcaaaatggaatatgagctacaggagaaaaagacactcatattatttttctttgaatctctcccagggcctaccattgtgtcgtatgtta

SEQ ID NO: 41443 - DNA, 201 bp, Homo sapiens
actgccatcactctctttttaaatatctctaccccttgtttctcacatcaaattctatgcatatttcaagaaaaagcttatattcatgtcctctagaaatytttggcaataatgaattctttctgttctcgtgcactgtagctcttaagggacgtgccaactcaattacatcatcccagacaagtatatgctcttgatgaa

SEQ ID NO: 41444 - DNA, 201 bp, Homo sapiens
ccacaatagaagtttaaatcatttatgagcatgaacagcaaagaagatggtgacctgggcaacatagcaagaccctgtctctaccaaaaaaaaaaaaaaaattagctgggccttgtggcgtgcgcctgtagtcccagctactcaggaggctgaggtgggagaattgcttgagcccaggagttgaagattacagtgagctat

SEQ ID NO: 41445 - DNA, 201 bp, Homo sapiens
ggcggaggttgcagtgagccgaggtggcgccactgcactccagcctgggtgacacagcaagactcagtctcaaaaaaaaaaaaaaaaaaaaaaggccggcrcagtggctcacgcctgtaatcccagcactttgggaggctgaggcgggtggatcacgaggtcaggaaatcgagaccatcctggctaacacggtgaaacccc

SEQ ID NO: 41446 - DNA, 201 bp, Homo sapiens
aatagcagttggtaacccctctcaattccctttcatttaatatggtttacatatacatatcttgcattttgtagcttgattaaaacatgctttttttttttggcattgcagctctgtcctacaatcttaaatatttataaaaactaaaggttttagttctagcagtccttaccctctgcagtccggcagtgtttgaaaatt

SEQ ID NO: 41447 - DNA, 201 bp, Homo sapiens
tgtcccaatcagagtgagtgtgggtgtgtgtttagtacttgctgtgtgtgatggaatggtgtcctgttcagggctggttcccttcttgtgcactgagtttyggggataggctccagccacctgtgacccagaactggaattaaaaaattaatgagttaattaatatatattactgtaaaataaaagttcataaagtagaca

SEQ ID NO: 41448 - DNA, 201 bp, Homo sapiens
gtgatgacaaaaactgcaactacttttgcaccatcctaataattttgactgtgcactataacttttatcactttctgccttctatgatagttatttttatrtattttcttctctattatgttgaaagtcttggagggcaagaacgctttattatgtgctgaattatgtctccacccaaatttatatattgacatcgtaacc

SEQ ID NO: 41449 - DNA, 201 bp, Homo sapiens
tttattccaccccatttatccctgttactaagctcctcctcctgtcaggaattcttaatagagaatatagaatatattagctttttaaataaataataaascttctggactgtattgtgaaggcttacaaattatactcttagtgtcaacttcagttcttttgtactacgttggggaaaaacctaaactggaagtggacgg

SEQ ID NO: 41450 - DNA, 201 bp, Homo sapiens
tgactgtgactaattagagaacttaattaagctgtcaagaaggaataaagataatcagtctcagtcagttcccactcttttgcacccaggagcatgagcarattcactcaggccaccacataatccttgctctctcacttgatattgatgtaacctcatatgcaccttcctgaggtgatgcaggttatacaagtaaatgac

SEQ ID NO: 41451 - DNA, 201 bp, Homo sapiens
cctagaacctataatgtgatttgtttatggttcttctttgccttattgatatgtgtattgagacccaggttttaaaatttaaaaatgttttgttatgaaakagtcttaatctaaatgtctttaaatggtttggggcctataagggtgactgagtacttctatttgctcttccaaagaaacacaacttggaaattagtatat

SEQ ID NO: 41452 - DNA, 201 bp, Homo sapiens
aggatggtctcgatctcctgacctcgtgagccgcccgcctcggcctcccaaaatgctgggattacaggcgtgagccaccgcgcctggcctgaaattgattkttgacagatgttgcagaaggtaaaagttaagatacaattttccccatgtggatatcctatagacctagtaacaattatcaaatcaatcatcttttctctt

SEQ ID NO: 41453 - DNA, 201 bp, Homo sapiens
tccaaagaacaggacacagcatagcagatggcttcaattgcaggaatcaaatgagaaagtgagaaagagcctgtgaaggagattaaagtcacagtcttttrgaaggtaatctcggaaatacctctcacttttgcttcattctgttcataagaaacaagttaatagttcaagcctatactcaagagaagggagttttgcata

SEQ ID NO: 41454 - DNA, 201 bp, Homo sapiens
gcacttttgttcaacctgtcccaataatagactatatagttaaccaaaataactgaagaattatcttaagagctagggtgcatgactatcagatattaaaagtaaaaaaaatctgataatttcaattattagatgtgatatacttaaaagagtatgctcatacaatacttctgggaatgtaaattgttacaatctcagtga

SEQ ID NO: 41455 - DNA, 201 bp, Homo sapiens
agaatttattatgctcaacatcactaatataattttattagttatttaagaaacaaacccaagaaactcttccacagaatctaaatgaaaggaaatgattwaaaaaaaatgctaacaaggatgtggagtaaggggaattcttatgtactgttagtgggaatgttaattagtacagctatttattatggaaaatactattga

SEQ ID NO: 41456 - DNA, 201 bp, Homo sapiens
aaaaacaagagctgctcctgcaccaccacactcttaattggacaaagattggatcagattgtaagaatttattatgctcaacatcactaatataattttawtagttatttaagaaacaaacccaagaaactcttccacagaatctaaatgaaaggaaatgatttaaaaaaaatgctaacaaggatgtggagtaaggggaat

SEQ ID NO: 41457 - DNA, 201 bp, Homo sapiens
gtgaacgccgtttctaaataggatcccaatgcctggtgggagaggcagcctcactctaccgtgcaggctggacaaaggtcccagccctgaagtcttagackctgagagtcaacgaaattgttaaaaaaaaaaaaaacagaaaacaaaacaaaacaaaaaaaaaaaacaagagctgctcctgcaccaccacactcttaattg

SEQ ID NO: 41458 - DNA, 201 bp, Homo sapiens
agagctgcaagtgttatcaggagttttcagcaaactatttaaaatagtcaaaaactgagcagttaaaaagtaccttctgaagtgaacgccgtttctaaatrggatcccaatgcctggtgggagaggcagcctcactctaccgtgcaggctggacaaaggtcccagccctgaagtcttagactctgagagtcaacgaaattg

SEQ ID NO: 41459 - DNA, 201 bp, Homo sapiens
caactttaaaaacaagagctgcaagtgttatcaggagttttcagcaaactatttaaaatagtcaaaaactgagcagttaaaaagtaccttctgaagtgaaygccgtttctaaataggatcccaatgcctggtgggagaggcagcctcactctaccgtgcaggctggacaaaggtcccagccctgaagtcttagactctgag

SEQ ID NO: 41460 - DNA, 201 bp, Homo sapiens
aaaggaaaatagccacagttaaagtagtataaaattatatataacaaagtcccagaagtttatacattataaaagtggcaagtaccaaaattgtggctcawatagggaagctgttgcaccaggagtgtggcaacagaagtctttaagaccatactcaaactgaaagcaactttaaaaacaagagctgcaagtgttatcagg

SEQ ID NO: 41461 - DNA, 201 bp, Homo sapiens
atatgaaagctttaaaaaaggaaaatagccacagttaaagtagtataaaattatatataacaaagtcccagaagtttatacattataaaagtggcaagtaycaaaattgtggctcatatagggaagctgttgcaccaggagtgtggcaacagaagtctttaagaccatactcaaactgaaagcaactttaaaaacaagagc

SEQ ID NO: 41462 - DNA, 201 bp, Homo sapiens
agcaagaacacgccaaacccaaagttaatagaggaaaataaataataaagatcagcacagaatgaaacaaattagaggcaaaaaagcaaacaaaagattcrtgaaaaaagttagtttttgaaaagtaaaccaaatcaacaaactattatatagattaagaaaaagacctaaataaataatatcagaaatgaacaatgagat

SEQ ID NO: 41463 - DNA, 201 bp, Homo sapiens
attgtatcatgtgggacaagctggattaaaggattggtagcaaataatgaaacatgtcagcagcttaaaatgaaaagtgaaaaggtttatttctcactacrtcatatattcgttgttcattggaggtcagcaaggggtgtcagcatgtattagtcacgcagagacccatactgatgaagactatatcttgaaacttgcttc

SEQ ID NO: 41464 - DNA, 201 bp, Homo sapiens
agtttggagtggagagatgctggattgggctctgatagacaatttgctttatcaaaaaggcctcgacatgtagaaaaaaacctacacaattgatcaggcaraaataagggatttggatgtttttatactttttcttgatgttgccttttgtttctctgtttctagcaaatacaaatggaaataaataatgatcagactatt

SEQ ID NO: 41465 - DNA, 201 bp, Homo sapiens
gttggaggtggggcctggtgggaggtgtttgggtaataggggcagattcctcatgatgagctgtcctcaggatagtgcattatcagaagatctggtcattkaaaagtgtgtggcacctcccacttccctcttgctcctgttctccccacgtcgtgcacctgttcccacttcatctcctactgtgagtaaatattccctgag

SEQ ID NO: 41466 - DNA, 201 bp, Homo sapiens
tataaattacccagtctgaagtatttttttgtagcaattcaagaatgacctaactcgtaccatttacccatttttaatgggattgctttttgcttgctcarttgtttaagttccttatagatcctggatagtaaaactatgttagattcatagtttgcaaatattttcttccattgtgtgggttgtctatgtactctgttg

SEQ ID NO: 41467 - DNA, 201 bp, Homo sapiens
tctcatattaaattgtaactctcacaattcccatgtgtcatcggaggaacctagtgggaggtgatggaattaagagggtgggtcttttctgtgctgttctygtgatagtgaatgagtctcatgagatctgatggttttaaaaagaggagtttccctgcacaagctgtctctctttgcctgcctccatccatgtaagatgtg

SEQ ID NO: 41468 - DNA, 201 bp, Homo sapiens
aaattatattttaaaaatgtaagaataaaatcatttgtagtcttatcacccagagataactatttcaagtgttttctgtgaagatatttgaaaaaaattatatatatatatatatttggacatttattagtattccaaaatgggatcagattatacaaattattctccaatctgtttttactcccatttaagtctgccacc

SEQ ID NO: 41469 - DNA, 201 bp, Homo sapiens
aatgaaaacagaaacaagacataccaaaaaacctatggaacacagaaaaaatagtacaagagggaagtttaaaggaataagcacctatataaaaaaaaaaaagatttcaaataacctagtgatacacctcaaaaaatagaaaagcaagaacacgccaaacccaaagttaatagaggaaaataaataataaagatcagcaca

SEQ ID NO: 41470 - DNA, 201 bp, Homo sapiens
gaatgacaaatgagttaatgaagaaattaagaaggaaattttaaatacttcttgaaagaaatgaaaacagaaacaagacataccaaaaaacctatggaacrcagaaaaaatagtacaagagggaagtttaaaggaataagcacctatataaaaaaaaaaaagatttcaaataacctagtgatacacctcaaaaaatagaaa

SEQ ID NO: 41471 - DNA, 201 bp, Homo sapiens
tcttgtgatagtgaggttaattctcacgagatctgatggttttataaaggcttcttccttcactgggctctcattctccttcctgccatgatgtgaaaaargatgtgtttgcttccccttccaccatgattgtaagtttcctgaggcctccctagccatgtggaactgtgagtcaattaaacctcttttctttataaatga

SEQ ID NO: 41472 - DNA, 201 bp, Homo sapiens
ttgtgaagaatgattgatatggcttggctatgtccccaccaaaatctcatcttgaattatagttcccataattcccacatgttgttgtgggagggaccccrtagagataattgaattacaggggtggtttcccccatcctgttcttgtgatagtgaggttaattctcacgagatctgatggttttataaaggcttcttcct

SEQ ID NO: 41473 - DNA, 201 bp, Homo sapiens
atctagctggccctctagatcttttttgtaccagcctagatgctgtaggtccaaaataaaaccaatgaatagatgggttacctttttttttttttttttttttcagataactaatcatagtttgaatagctgtgatgagaattggcacaatcttgcatcttctgtaggggacagattttcttagaaaagttacagatgtgt

SEQ ID NO: 41474 - DNA, 201 bp, Homo sapiens
aatctagctggccctctagatcttttttgtaccagcctagatgctgtaggtccaaaataaaaccaatgaatagatgggttacctttttttttttttttttttttcagataactaatcatagtttgaatagctgtgatgagaattggcacaatcttgcatcttctgtaggggacagattttcttagaaaagttacagatgtg

SEQ ID NO: 41475 - DNA, 201 bp, Homo sapiens
gaatctagctggccctctagatcttttttgtaccagcctagatgctgtaggtccaaaataaaaccaatgaatagatgggttacctttttttttttttttttttttcagataactaatcatagtttgaatagctgtgatgagaattggcacaatcttgcatcttctgtaggggacagattttcttagaaaagttacagatgt

SEQ ID NO: 41476 - DNA, 201 bp, Homo sapiens
agaatctagctggccctctagatcttttttgtaccagcctagatgctgtaggtccaaaataaaaccaatgaatagatgggttacctttttttttttttttttttttcagataactaatcatagtttgaatagctgtgatgagaattggcacaatcttgcatcttctgtaggggacagattttcttagaaaagttacagatg

SEQ ID NO: 41477 - DNA, 201 bp, Homo sapiens
taccaccttacccgagccagaataaccattattaaaaagtcaaaaaaaaaaaatccccaaaagatgctcgggtggacgtggtgaaagaggaacacttatakgctgctggtggaaatacacattagtacaacctctatggaaaagagtatggagatttctcaaagctaaaagtagatctaccatttgatccaggaatctcac

SEQ ID NO: 41478 - DNA, 201 bp, Homo sapiens
cacctaccatcaaagttcatgttctgagaataataatgtcttattataatttttgaataaatatgtcctgcttattaattaaaattgttctgtgcacaaarcatgttattactgttttcttccagctaatgagtcatagtactgagatgattacttttgagattaatcatttttaaatattgcaaagtatatctgttgcat

SEQ ID NO: 41479 - DNA, 201 bp, Homo sapiens
atgtcattttatagagttagtcaaaaagcaataaaatatatagtggctgccctactagtaactaatgtacacaaactataacaactaaaataattcagtcrtggtgtagttataaaagccacagtacagaaggatacactgaagctgacctagtacacttagaaaatctttcatttgtattaccatgtagtattcatgtat

SEQ ID NO: 41480 - DNA, 201 bp, Homo sapiens
ttgaaatgtaaatggataactggataaacaaaaatttgatcccatttatatataaagaatacttgcagacataaaaaattaatattgtagtggaagaatgracaaagaatatggttatattattaaccactttctccttataaaagttatggcagacaaatatttgaaaaatattaaaaataaaatagttagaataagatg

SEQ ID NO: 41481 - DNA, 201 bp, Homo sapiens
gacataagccttatagtaatttgggaatatgcgtaaaatgaaaatctttataaacttttcatacgtgcatcatctgtatccatatctgtactatacttcasggaacctatccaaaggaaataatataaagtgataaactttttatttttttttgagatggagtctcgctctgtcatccaggctggagtgcagtggcacgat

SEQ ID NO: 41482 - DNA, 201 bp, Homo sapiens
gtgaagggccattcctacagtcacataaactgtgttacattgttaacattgagaaggtggcatcttctaacaacccagcattccttttatacatcttctgrtattttctagaatcagagtaaaggatttaaaactttctagaggaaagcaagtatttcttcttgtactaatcactttctttcccagaaaaacatctttcaa

SEQ ID NO: 41483 - DNA, 201 bp, Homo sapiens
tatttcttcttgtactaatcactttctttcccagaaaaacatctttcaaatttcttcctagaaggtaaggaactaggagcagagtggtagaggatggggtractgggaccttgacacttagcattgagtattcacacattcatttaatcaccctgttgttcataaaatgtaccccacccctaaaataagtctaaagaccca

SEQ ID NO: 41484 - DNA, 201 bp, Homo sapiens
gcttgcatttacaaagcatttctgcccccgctgtcttttctaagatacaaccctgagagatggaatagaaaatgaagcgagggagggaggaaactcacctkgcctcacttctgctagggtttcagaattaaatctttctgaaagcatagttggagtatgtgaaatctgtatgttctatggctcatatctttttgttcatta

SEQ ID NO: 41485 - DNA, 201 bp, Homo sapiens
tcattaaataagaaatctctttgcacatgactcgttttgctttctgaggtgaaacatttatattctaatataatgtgttaatgacaatagcaatttaaatrttgtagcacacacagcaaagggaattagaaatattggtaagttttatgttttccccatttagaaacagtctatgtcttatgatttaaactgtaaaggcag

SEQ ID NO: 41486 - DNA, 201 bp, Homo sapiens
cagtactttaatgaatatattctatgcatagaatttttttcagaaatgaaattttaaatttcaacttctgtctctctccaaaaaaaattgtaataccttawcctcaacctcgtcatgtctcattttagattttgtcattctctccaaacttatttagatacttaattctttatttattttcttattcagaaagaatgcttt

SEQ ID NO: 41487 - DNA, 201 bp, Homo sapiens
agttttggaggagacaaatattcaaatcatagcagtcttgtcctaaattaaaaataataataattaaaacagaaaaactggcagctccaaggttttgaaartattctcctgtattttgttttaggagtggaatggtcttagatttatatttggttatattagatttttagtattcccatgtatttggagttttctaacgtt

SEQ ID NO: 41488 - DNA, 201 bp, Homo sapiens
tgcagatgagggctttctgcagagttctgaagtggcacagggaatcacatggcaggggggctgagcatactcatcatcttaaggccccacctcttactgcygccacattggggattaaatttcaacttgagttttggaggagacaaatattcaaatcatagcagtcttgtcctaaattaaaaataataataattaaaacag

SEQ ID NO: 41489 - DNA, 201 bp, Homo sapiens
aatggtgtcttttaataagtgaaaagctgattttggtgaaatccagtttagttttatttttaacggttaatgctgtttttttctctctttgtattaatctrttttctgttgtttcaggtaacaggatacctcaaactgggtaatttataaagaaaagaaatttattttttacagttatggaggctaagtccaaggtcaaag

SEQ ID NO: 41490 - DNA, 201 bp, Homo sapiens
gaaacacacatacatacaccacaaagacatatcttgaacacctaaaaaatgcaaaactattgtgaaagaaaccttcatagcaccagtactgtggtgcacamagtttaaccagtttgaggtgcctgcctgctactgagatacagcagtgaactcttctaccatttcaatgagatatccttctgagttctcacaggctgttta

SEQ ID NO: 41491 - DNA, 201 bp, Homo sapiens
gcaatatatttacttgtttaaaaagatgattgtgctctggtcattcagtatctcttccctaactaaatttaagcactcctttcatgttggtcaaaaccacrtacagagttttctgtgtccctgatttttttctaccttctgagaatagaatgtaagtaaaagaagaatgtaacaggggttttttttttagacaaataaaaa

SEQ ID NO: 41492 - DNA, 201 bp, Homo sapiens
gatttctttttgtttactaatttgaaaaaaaaatctgttaaaggcatccatttctcaccagttaataatgtaaaaaagactggattggcatgtttaaattmccagaatcatcagttaaggattgattaaatgcctgatatcatcacttagaaaagtgtcttgaacttgatggagcttatggtaacaaagtttatatttaaa

SEQ ID NO: 41493 - DNA, 201 bp, Homo sapiens
caaaacctttactgaaaatgtgttttatgaaaaaattatgcatagaattcaacatttttgcacaaaaataaacttgtgctaacttgtgataacgtgcgtggacaggatctagtttgatgggttaaaaatcagagacatcagtttgaaaagagccctatattagtctgttctaatgctgctaataaagacagaactgagact

SEQ ID NO: 41494 - DNA, 201 bp, Homo sapiens
tgtttatttttgtctttctttctttcttttcttttcttttttttatttgaaatggagttttgctcttattgcccaggctggagtacaatggtgcgatctcrgctcaccacaacctccgcttccctggttcaagcaattctcctgcctcagcctcccaagtagctgggattacaggcatgcaccaccacgcccagctaattt

SEQ ID NO: 41495 - DNA, 201 bp, Homo sapiens
tttgcctgtttatttttgtctttctttctttcttttcttttcttttttttatttgaaatggagttttgctcttattgcccaggctggagtacaatggtgcratctcggctcaccacaacctccgcttccctggttcaagcaattctcctgcctcagcctcccaagtagctgggattacaggcatgcaccaccacgcccagc

SEQ ID NO: 41496 - DNA, 201 bp, Homo sapiens
tctaggtcaagttgacaacttctccttaataacttggtaaccttacctgaaaatggagatgacaacacctacctacctcattgtggtgtaaaaattaggtkaaaaaaattaggtgaatatgtagaaagtgtttggaacagtggtgcatgatgcaaagtatggactttgttagtattttattattatcgttattagcatttc

SEQ ID NO: 41497 - DNA, 201 bp, Homo sapiens
cagcaatttgttcttgcacataatcttctttgattgcataagaaatgtggaaccactcttttgtgttgattgcagcactcaggttagtattttcgaaaaaycagccagcaaatgcttagttcttgaatccctcagtgaaatggcattttaacactattgttaacctttctccaagaaacttacagaagtgtctgaattcat

SEQ ID NO: 41498 - DNA, 201 bp, Homo sapiens
gtttcaccatactggtcaggctggtctcaaactcctgacctcaggtgatccacccgccttggcctcccaaagtgctgggattacaggtgtgagccaccacrccattatttcagatgtgggatatttcaagatgattcagaaactttctgctgctttcagaaatgtatgcatagcttgtcattataaaaagggacttttcaa

SEQ ID NO: 41499 - DNA, 201 bp, Homo sapiens
ctcttaccttcatctgcagtctgtttgcaaaacagcaatttgttcttgcacataatcttctttgattgcataagaaatgtggaaccactcttttgtgttgrttgcagcactcaggttagtattttcgaaaaaccagccagcaaatgcttagttcttgaatccctcagtgaaatggcattttaacactattgttaacctttc

SEQ ID NO: 41500 - DNA, 201 bp, Homo sapiens
tcttggaggaaagtcagggccaagcccaggcaccatgaatgacagcaggaggtggacagattgctgggtggaagggggtacatccctggtgaggccccacytttgggccatagagggcctgaaagctggggcctgggctgccagtcccacagactagagtgggaacttgtggtgccttttctgggcccaccaatggttgcc

SEQ ID NO: 41501 - DNA, 201 bp, Homo sapiens
acctttgggccatagagggcctgaaagctggggcctgggctgccagtcccacagactagagtgggaacttgtggtgccttttctgggcccaccaatggttkcccatgagccaaatcagtgcacacttcctcccatttgaggcccataaaagccaaagtctcagccagaggtgagcagacaatgggatgaccagctgcagag

SEQ ID NO: 41502 - DNA, 201 bp, Homo sapiens
ggaccctaagcccagttacactagggttattgcagcctcataaatgtgccgcctttgttgtcttggataagatccagaagaattctccgaattaccaggcrgattgtttttctcttttcttactttctctcaaatgttgtttctctctgagctgagccacttggagctggaagtgggatgacacagggccccactgtggcc

SEQ ID NO: 41503 - DNA, 201 bp, Homo sapiens
taataattaaaacagaaaaactggcagctccaaggttttgaaagtattctcctgtattttgttttaggagtggaatggtcttagatttatatttggttatrttagatttttagtattcccatgtatttggagttttctaacgttattttaatattttaatttgattttacataggttttttgcttaggttaatatttaaga

SEQ ID NO: 41504 - DNA, 201 bp, Homo sapiens
tgaacttggggattcagattgctgttgaatagtagtgaatttaaatgctcaattcaaatgccaaattttcttctggtaaatgtacaattaggaatcaaatrtgaattcccctagcaatttgctcctgtttttatatatggccttccttggatttcagaggaagactgaatctattgaacaatttattgtgtatttggccct

SEQ ID NO: 41505 - DNA, 201 bp, Homo sapiens
aaaccaacataattttttttaattcaggacatgaatgaaaacttttctaaagagatggatattttaaaggaaagccaatcagaacttctatgaaagactacacatttcggcaactacaaaatgcagtgaaaagcttttaaaatagattagaccaagcagaagaaagaatttcagaactcaaaaacaaggctttcaaattaa

SEQ ID NO: 41506 - DNA, 201 bp, Homo sapiens
agagcagctagggttcaggagaatattcattatacatccaaatttgggaattattctcagaggcataattattaaagctttgagagccaaagagcttctcrgggtaggctatgtgaaaagagaagaaaatgaatctacaggttagatattagtctttattttgaaatataatatattgtaataccaaatactaatttggcc

SEQ ID NO: 41507 - DNA, 201 bp, Homo sapiens
acaatatcacaatcagaaaatcaacagtgatacatttcattgaccttactcaattttgccagttttacatttacccaattgtgtatgagcatttattttgtttttttttaacccttttaagaagacaattaatatttaaggttttgtttgtttgtggttgttctggttcagtatgaatgagtttgaagggctcatttttct

SEQ ID NO: 41508 - DNA, 201 bp, Homo sapiens
aatggaaaccaaaagcaagcaggagtagctattcttaaaacaaataaaatagactttagagcaacaatattaaaaaaggacaaagaaggtcattatgtaawtaaaataggataaattcaacaagaagatataacatgtctaaatttatatgcaccgaactctagagctcacagattcataaggcaattcctaccaggtcta

SEQ ID NO: 41509 - DNA, 201 bp, Homo sapiens
aagtaaactgtgaaatgctgctagtgttgtaattatagcctcattttatttctgaatgatgataaagtgcttttgtttttgttgatgttgttgttgttgasagtgcctaatctattaggctttttcaacacggtttctgaaagaggctatcgaaagacaattgtagtactagtccattgcaaaagtgaacagtctacccac

SEQ ID NO: 41510 - DNA, 201 bp, Homo sapiens
agtcagagtagtttttagggtcaaatgctaaactactgaaacaaataaagtaagattcaatagctcagacaagatagaagtgtatttttctcacataacarttgcaaatgagtattctgggttagcagtgccttccttccacatagtcactcaaggtcttattctggtagtgcctctgccttattcaccatgtgatataaa

SEQ ID NO: 41511 - DNA, 201 bp, Homo sapiens
tttagtagagatggggtttcgccgtgttagccaggatggtcttgatctcctgacctcgtgatccgcccgtctcagcctcccaaagtgctgggattataggygtgagccaccgcgctgagccttgagttgatttttgtatgtggtataaggaagaggtccggcttcaatcttctgaacctggctagcctgttatcacagcac

SEQ ID NO: 41512 - DNA, 201 bp, Homo sapiens
atgatgctggccttatagaaggagttagggaagagtccctcctcctccattttatagaatagtttcagtaggaatggtaccagctcttctttgtacatctrgtagaattcggctgtgtttccatcaggtcctgggctttttttggttggtaggctatttattaccgagttaattttgtagctccttgttgacctgttcagg

SEQ ID NO: 41513 - DNA, 201 bp, Homo sapiens
gcttctctaattttttcagttgtgagattaggttgttaatttaagatttttctaaattttgatgtggccatttagtgctatgaatttccctcttaacactkccttagctgtgtctcagagattctggtatattgtatgtatgggggtctaacctcccactttgctggacctgcagctacttttgctggaaagcccaagtat

SEQ ID NO: 41514 - DNA, 201 bp, Homo sapiens
tatattgtatgtatgggggtctaacctcccactttgctggacctgcagctacttttgctggaaagcccaagtatctaaggctccagggtctccacatatgrctgagcagctgctcttccaagactccaagtgtctctgtctgtcagactgaaggccctggtacaatgggttcacaaggagatctcctgacctgaaggttac

SEQ ID NO: 41515 - DNA, 201 bp, Homo sapiens
gtgggggaggttctccttgctctgtgttgttcccaggtgggcagttgtcctgtcttgcccttctttgttctctgtgggtcaagttgtttccttgattagtygtaatcatccagtgagtaactggatgtttcagttgagggcattgtattactcacccctttcattcttctccctgacagccatgcacaccagctgcatcta

SEQ ID NO: 41516 - DNA, 201 bp, Homo sapiens
gtttccagattagagcttagtagcctagaagaaaaaaaggaatactcatattttcagtagttcttcaatataaccaaaaaggaaatttagctttgaatttmtaccacaatattcttatctgctctagggtggaaatacatagtagcaacagggttaaagcaatgaacactttctttttttattccacttttaagcaggagt

SEQ ID NO: 41517 - DNA, 201 bp, Homo sapiens
gaagaaaaaaaggaatactcatattttcagtagttcttcaatataaccaaaaaggaaatttagctttgaatttctaccacaatattcttatctgctctagrgtggaaatacatagtagcaacagggttaaagcaatgaacactttctttttttattccacttttaagcaggagttagagcaccttctattattaaaaagaa

SEQ ID NO: 41518 - DNA, 201 bp, Homo sapiens
gggtgatgattgggggatgaagcagatggaaagggtgtaggtaaagtgggagcaggatgaggagagtgtgagaggcaaatggaaggatcatctaagacatyagaatcgggtagagaagaagttctttggaagattatgcaatttttatgtaattttacgtatcagataaagcccaaaagacctgaacatatggggtctctg

SEQ ID NO: 41519 - DNA, 201 bp, Homo sapiens
aatggattggagggcagagatgattaactttaagatatttctccatggaatttgaatgagcctgagagacagacattatcttgtgaaagggtctattcaartgtggttacatttttggccttcttttctgtaatagataatgagataatagtaaggagaagaataaacagttgttctcctggtggatcagtactttaggca

SEQ ID NO: 41520 - DNA, 201 bp, Homo sapiens
aaagcagaagactagcatacattatattttagaattaaaataaaatgtaattaaatttaattaattaattatattttagcattaaaataaaatgtaattawttgtaaaatcaattgactaattaaatgtacttaatcaattaattataaaataaaattgtaattaattgattaattgattattgaaaactaccatgtttcc

SEQ ID NO: 41521 - DNA, 201 bp, Homo sapiens
aattatattttaaaaatgtaagaataaaatcatttgtagtcttatcacccagagataactatttcaagtgttttctgtgaagatatttgaaaaaaattatatatatatatatatttggacatttattagtattccaaaatgggatcagattatacaaattattctccaatctgtttttactcccatttaagtctgccaccc

SEQ ID NO: 41522 - DNA, 201 bp, Homo sapiens
attatattttaaaaatgtaagaataaaatcatttgtagtcttatcacccagagataactatttcaagtgttttctgtgaagatatttgaaaaaaattatayatatatatatatttggacatttattagtattccaaaatgggatcagattatacaaattattctccaatctgtttttactcccatttaagtctgccaccca

SEQ ID NO: 41523 - DNA, 201 bp, Homo sapiens
aaggataaggtagatgttatccaggagaagtaggaggtgaagatgaaaaaacacattcctaaaaagataacagtttatgcagacatcctcctggggaaaakagctcagtgcccgtgaattctggaaagaactgagtggcttcagttcagagattgagggggcatatagtgttagatgagactgggaggcaggtaggcaagg

SEQ ID NO: 41524 - DNA, 201 bp, Homo sapiens
cagctaaacaaatcctaaatgaacaaaagcatgttggaaagataaacctggaaaaatattttttctttgtatctcctgtgtattttttctctgaaaacccrataaattatcataaagttgaagagggtgggaaaacaatttcagaaacaaaatataaaattgctactgatttgatgattttacattttccttaaaaattat

SEQ ID NO: 41525 - DNA, 201 bp, Homo sapiens
atctattccaaaagattgagaagaagagaatcctccctaatacattctacaagcccagtatcaccctggtaccaaagcaaaggaaagacttaacaaaaaakagaaaactacagaccagatctctgatgaatatagatgcaaaaatgctcaacaaaatagtagcaaaccaaatccaacagcgcatcaaaaaaataatccact

SEQ ID NO: 41526 - DNA, 201 bp, Homo sapiens
actgaaatctttaaaatattgaatcaaaattgtattagttttaatttacttaaattttaaatttattagttttaaattacttaaattttaaaattattttwaaaatttgcacagaaaggtcctgggatttttatgtacattgcattgactctgttgattaacttaagagaactgaaatctttacaatattgaactaaactg

SEQ ID NO: 41527 - DNA, 201 bp, Homo sapiens
ataatccactatattcacatggatttcactttagggatgcagagatggtttaacaaattcaagggaataaatgtgattcatcagataaacagaattttttwaaataaatatatgatcatttctatagatgcagaaaaagcattcaataaaatccagcatgactttatgataaaaaccctcaacaaactagacatagaagaa

SEQ ID NO: 41528 - DNA, 201 bp, Homo sapiens
ttgggtcctcttcacctccaaagacccaagctgccacagcatggccccatttttagagaagagccaccacctgagtttattcttccctggggcccaatagcccctgcacctccatatccctggggcttgctgaccttccacctcatctaccaggaaagctgcagcatcatgacaaaagatgaacatagtggtgcagctgta

SEQ ID NO: 41529 - DNA, 201 bp, Homo sapiens
caagggaataaatgtgattcatcagataaacagaatttttttaaataaatatatgatcatttctatagatgcagaaaaagcattcaataaaatccagcatractttatgataaaaaccctcaacaaactagacatagaagaaacatacctctaaataattaaagctgtatattccaaacccatagccaacatcatactgaa

SEQ ID NO: 41530 - DNA, 201 bp, Homo sapiens
acctgaaatcttgaaattgaaaaattcaataagtgaaataaaaaatacaatagaaaaacttcaatagtagaactgaattaagcagaaaaaaaatttctgarggtgaatagagaaattacccaatgagacaaaaaagaggagaaaagaaaagaaaaacagaatgaaaaagaatgaagaaactctataggatataagagacat

SEQ ID NO: 41531 - DNA, 201 bp, Homo sapiens
atggacaaatcaattactctttctcaattccaattttgtcattattaaaatgaggaaagaagatccatgataggtttgctgtgatgattatataataatgyatataaaatgtatggtacagagtgacgacacaataaatggtgattgttattttcaaattacttcaaattctctaaaacagaatgtaaacagacaggagaa

SEQ ID NO: 41532 - DNA, 201 bp, Homo sapiens
taatcaaaattgaacagttgttagtgagacaaacaaagaaaaaagagagatgacccacataaatcaaaaatcataatgcaggcattacaacagataccacrgaaatataaaggatcacaagagaatattgtgaacaactatatgccaataaattggaaaacctagaggaaatgaataaatttttggatacatccaccttcg

SEQ ID NO: 41533 - DNA, 201 bp, Homo sapiens
agaaaaaccatagcgcagagctggtgtggaatttaaaattctttacagaatcccacaaaacttagaatatggggcaaacccacataatgccatagctggaygatgaaaaagtttatagtcaacagctgatgacagaaaaaggataaaaacattttggccaaaaaaacagcatagaatagtcatcatagatagctaattcat

SEQ ID NO: 41534 - DNA, 201 bp, Homo sapiens
agacaaacaaagaaaaaagagagatgacccacataaatcaaaaatcataatgcaggcattacaacagataccacggaaatataaaggatcacaagagaatrttgtgaacaactatatgccaataaattggaaaacctagaggaaatgaataaatttttggatacatccaccttcgaagactgaaccaggaagaatttgaaa

SEQ ID NO: 41535 - DNA, 201 bp, Homo sapiens
ggctcctccaatctatgacattccctcagtcttttcttgtctttcatgaccttgccacttttaaagaatactagtcagttatattgcagaataactgccarttggggttggattgatgttttctcattattggattgaagttatgcatttttggcaggcatgctacagtgatataaccttctcagcctatatatcagggag

SEQ ID NO: 41536 - DNA, 201 bp, Homo sapiens
tctcaaatcagagtgaaataaacatttaattacctggagtgcatgggatagggtattcttctttaagctagtatttatatttgtatgtatgcattcatacatgtaagttaggaactgcttaaccatcaggaaaaggttttccttccactttacccttttctttcacttgctactttgtcccccattgtgaaaaagctttct

SEQ ID NO: 41537 - DNA, 201 bp, Homo sapiens
gaaataaacatttaattacctggagtgcatgggatagggtattcttctttaagctagtatttatatttgtatgtatgcattcatacatgtaagttaggaaytgcttaaccatcaggaaaaggttttccttccactttacccttttctttcacttgctactttgtcccccattgtgaaaaagctttctaaaagcctgagtcc

SEQ ID NO: 41538 - DNA, 201 bp, Homo sapiens
aaatgatgaattttagaaaacagactttgatgtagctaatggagggagactgggaattttataactccagtatctgtaaactaaataatggagtttcaacrggaaaaatattctggagtctgatagcaaaagttctctaagtgaatagaggcacttgaggtcctatactggtagggaaagtcacagcaagagattcagggt

SEQ ID NO: 41539 - DNA, 201 bp, Homo sapiens
aaaaacacctaaatatctgaagggattgatcatattcctgaagttggagattcaatattaagatgtcagttattcccagattgacttacagattgatttaycactgtcttaaattctcagcagactcttttatgaaaaccgatcatttgaggtggttacattggaggatacgtttgccaaaactcatcaaactgcatttaa

SEQ ID NO: 41540 - DNA, 201 bp, Homo sapiens
agggtagcaggtgcttgctgtaggaagattcagtgggactggtgaatataatttttaagtatgaatagaattcaatttttaagcctctggacttaactgtyagtaagtctgtaagatggatatagaagtgctgagaatatatgagtggagcatcagtagtattaatatctgataggcctgaatgtcactggctatactgag

SEQ ID NO: 41541 - DNA, 201 bp, Homo sapiens
ctgcagcattaacttctcgggctcaggcaatcctcccacctcagcctcctgaatagctgggaccacacctggctaatttatttttattttttgtagagatrgtgtctccctatgttccccaggctggtctcaaattcctaggctcaaaggattttcctgtttcagcttcccaaattgctgggattataggcatgagccact

SEQ ID NO: 41542 - DNA, 201 bp, Homo sapiens
gagtaaggatgttaaatcagaaataaaaaatctcccaataacaacagcacaaagcctaggaccagatgacttcactgctaaattctaccaaatttttaaaraactaaaatcagttctcacaattttgcaaaaaagtaaaaaggagtacaaactttcttactcattttataagggaagcattaccctgataccaaaaccaga

SEQ ID NO: 41543 - DNA, 201 bp, Homo sapiens
cagaccaatattttgaatgaacatagacgcaaatatcctcaacaaaaaactaacaaatgaaatccaacagcatatcagaaggattatacattgcaattacrtgggattatttttctaggaatgcaaggatagtttaacatatgcaagtcaataaatgtgatacatcacagcaacaattgaatgatcacctcaatagtggca

SEQ ID NO: 41544 - DNA, 201 bp, Homo sapiens
tactgaatggagaaaactgaaagcttttccttgaaaaactgggataggacaatgatgcccactttcaccactcttatttaacatagcactggaagtcctarccagaataattaggcaagagaaaggaataaagtgcagctgggtgcagtggcatatttgtgtagtcccagctactcaggaggctagaatgagaggatcact

SEQ ID NO: 41545 - DNA, 201 bp, Homo sapiens
ttttatcaatgtggtcttcaattatatatttgtgaccaggatggaaaagtggaggttggatgttagtacaattggggaacattgtaggaggttgacacaamgggttttggtaagtaggtaaattttatcctgaaggagattctgaacttgcttatgtccttttcaaatattttttgaagaaaggaaaataatctgacattt

SEQ ID NO: 41546 - DNA, 201 bp, Homo sapiens
tgtatggaaccacgaaagacctcaaataactaaatcagttctgagaaaaatgaataaagctagaggcataatactgcttgtctccaaaatatactacaaakctatagtaatcaaagcagtgtgatactgatataaaaacagacacatagacaaatggaacagaatagagaacccagaaataaatccacgtatgtatagcca

SEQ ID NO: 41547 - DNA, 201 bp, Homo sapiens
aggtggaagaatgaaactagatctctatctctcactatatacagaaatcaactcaaaatgggtgaaaacttaaatgtaagacccaagtctataacactacyagaagaaaactagagatattggcctgggcaaagtttttgtggttaagagttcaaaaacataggctataaaagcaaaaatagaccaatggattatataaag

SEQ ID NO: 41548 - DNA, 201 bp, Homo sapiens
atgttcaatatcactaatcatcaggggaatgcaaattaaatccagagaggtataatttttccccaattagaatggctgttattaaaaaaaaatcagaaatrttggtgaggatgtggagaaaagggagctcttatacactgttgatgagaatgtaaattaggacatctattttgaaaaatagtataatgtttcctccaaaaa

SEQ ID NO: 41549 - DNA, 201 bp, Homo sapiens
attctctatagtcaagatatggaatcagcctaattgcttatcaccagattaatggataaagataatatagtatatatacacgatggaatactattcattcwtatatatatatatatatatatatatatatatatttgaataaaatgaatgaaatcctgtcattcttggaaacatgggtgagtctggaggggattatgttat

SEQ ID NO: 41550 - DNA, 201 bp, Homo sapiens
agcaatctacagattcaatgcaatttctatcaaattaccaacactattttttacagaattagaaaaatcaatcctaaaattcacatggaaccaaaaaatascccaaatagtcaaagcaacctaaacaaaaagaacaaatctggaggcatcacattacctaacttgaaattttactacaaggctaacgtaaccaaatcagca

SEQ ID NO: 41551 - DNA, 201 bp, Homo sapiens
aggccaaataattctcttttaacaactgctaagtaaattcaactttgtatatgtggatagttttaataaaagtaaaccaaggagttagtaaaaacggttgytctcaaactgtaatcaggaatgcctggcaagctggacgtggtggctcacccctgtaatcctaacacattgggaggctgaggtgggtggatcacctgaggc

SEQ ID NO: 41552 - DNA, 201 bp, Homo sapiens
ttctctatagtcaagatatggaatcagcctaattgcttatcaccagattaatggataaagataatatagtatatatacacgatggaatactattcattcatatatatatatatatatatatatatatatatatttgaataaaatgaatgaaatcctgtcattcttggaaacatgggtgagtctggaggggattatgttatg

SEQ ID NO: 41553 - DNA, 201 bp, Homo sapiens
tttgcacagcatatttggagaacattgagtgatttgatacactgaagtcaaagtataagtgcagaacggatagcgcagatcatggaagacggtagtacctrgaaagcaatgtaaattaatgactttccaccacacacagactttctatgttactttagtggtaaatgtgttgcacaaaaagggaaaataaagttatttgaa

SEQ ID NO: 41554 - DNA, 201 bp, Homo sapiens
gtaaaaacggttgttctcaaactgtaatcaggaatgcctggcaagctggacgtggtggctcacccctgtaatcctaacacattgggaggctgaggtgggtrgatcacctgaggccaggagtttgagtccagcctggccaatacggcaaaaccccatctctactaaaaatacaaaaaattagcagggcgtggtggtacatgc

SEQ ID NO: 41555 - DNA, 201 bp, Homo sapiens
gaaggaaaaaatgttaagggcagccagagagaaaagtcgggttacccacaaagggaagcccatcagacttacagctgacctctcggcagaaactctacaarccagaagagagtgggggccaatattcaacattattaaagaaaagaattttcaacccagaatttcacatccagccaaactaagcttcataagtgaaggaga

SEQ ID NO: 41556 - DNA, 201 bp, Homo sapiens
aagctggacgtggtggctcacccctgtaatcctaacacattgggaggctgaggtgggtggatcacctgaggccaggagtttgagtccagcctggccaatayggcaaaaccccatctctactaaaaatacaaaaaattagcagggcgtggtggtacatgcctgtaatcccagctactcgggaagctgaagcaacaagaatca

SEQ ID NO: 41557 - DNA, 201 bp, Homo sapiens
tatcttataaaggaccttctgagatttctatgtttggttcgtattttaagaaagccacatccttccttttggagtagacatttcttagtacttaaggaagyctattagttaatgtatagatgaattccttcatttcatcttctcaattacattagacaagttaactgggccagtgagaattggatcagtgtctgactcatc

SEQ ID NO: 41558 - DNA, 201 bp, Homo sapiens
tccaccacacacagactttctatgttactttagtggtaaatgtgttgcacaaaaagggaaaataaagttatttgaaatgattttaacaaacaattgtcagygacataacaattgtcaaatcaattgttaaaatggtgttaatcaattgttatgtgattttcatttaacaagtattcattgatcacctgctatgacaagcac

SEQ ID NO: 41559 - DNA, 201 bp, Homo sapiens
tctactaaaaatacaaaaaattagcagggcgtggtggtacatgcctgtaatcccagctactcgggaagctgaagcaacaagaatcacttgaacccaggagrcagaggctgcagtgagccgagattgcaccatgagactccagcctgggcaacaagagtgaaactccatctcaaaaagaaaacaaaaacaaaaacaaaaaaa

SEQ ID NO: 41560 - DNA, 201 bp, Homo sapiens
gacataacaattgtcaaatcaattgttaaaatggtgttaatcaattgttatgtgattttcatttaacaagtattcattgatcacctgctatgacaagcacwgtttttggcctttggggtacatcggtgaacaaaatgaatgaaaatcactgtcctcacaaagcttacattctctttattataagtttattttattatatta

SEQ ID NO: 41561 - DNA, 201 bp, Homo sapiens
ccttttaaacatgcatggttttcgccgtctagagacttactgaggttgaatgtcaaagtatagcatttgagaatattttatgccttccagttgattctgcygtgagctgtttgagaaaatactaggttaaactgcatgattaatattattcactattaactggagaagatagtaatgttacaaatccatatgctggtagat

SEQ ID NO: 41562 - DNA, 201 bp, Homo sapiens
gagactgtataatgagaaatgttcagaagctccagaaattcaacagcaaatttttccttgttttcattctcagaattctctagtagaatgaatcagatatkgatgaaaattgaatagagaagtatgccgagaacttcacagtatcagtcagtctctactgcataacatttaaatattttcaggtaatgcttcccatgaagt

SEQ ID NO: 41563 - DNA, 201 bp, Homo sapiens
ttatataatataatataatataattaatataaatagtatgagtactttcaattcacgttcactcacactatctaattcaaatatctagatcacctgtgagraagataaaaatagttataatttatttattgtcatatcatttcaaagcctgttctaaattcttttcttaactcatttaagtaaatcctatgaggtatatac

SEQ ID NO: 41564 - DNA, 201 bp, Homo sapiens
actgaaggaaataattttacaatgcatttttattttaggaggacagatttttttagaatggctaatcaacaacaacaataaaataatacaatatattttawattcaggaggattatccaactgaatttcagataatctttataaatataataacttgctctgaaatgcttgctctacaatactcatataaacagtactatt

SEQ ID NO: 41565 - DNA, 201 bp, Homo sapiens
tgcattattattttttttcacaatttttatccaatgttttatatattttgcttttatcctactttaatattcatttcccagagttagaattatatgtgttktgagggaagaaacttttgtctctgctcactgttgtatctctagaattgaaaaaagataatatttattgcataaataaacaaatgaatgggcacagcctcg

SEQ ID NO: 41566 - DNA, 201 bp, Homo sapiens
cataacttgaattaaaattctaatgttggctactaaatagggaatatagaataatgtactggacagtttctttgtaaaatgcagacgcatgcttcagctayggattttttttaaagcaaatgttgataaaagctataagaataacattaaagctcaatacagtgaaagcatttctgtgatgtactcagctgatgtggttca

SEQ ID NO: 41567 - DNA, 201 bp, Homo sapiens
ggcaaccagaacattttattgggcattgtatcctcatcacttacaagtgtgaggcacataaaaggcacttgatttgtgcttgttgaatgactgaataaatkattgcttggcaaatgattgcttggcaaatgattacacagaataagctccagtgtggttaaagaaagtgatcccggttgccctggcaaccaggcaaaggat

SEQ ID NO: 41568 - DNA, 201 bp, Homo sapiens
agaagcagtataggccgggcgcggtggctcacgcctgtagtctcagcacgttggaaggccgaggcaggcggatctcttgaggtaaggcatttgagaccagsctggccaacatggggaaacctggtctctattaaaaatacaaaaattagctaggtgtggtagcgcaagcctgtaatcccagctattagggaggctgagtga

SEQ ID NO: 41569 - DNA, 201 bp, Homo sapiens
tctgatgcttaatacctggcagtatgtgaggcaaacataaaagaaatctgtagagagtatttttacctgatttgtgatatcttctcattaactatagcagkacctccacaaatcccacccatattctttttttcctcctcttaaattttgtaaaacaaactcatactttggaaatcaacccgttaaatatgattttattgg

SEQ ID NO: 41570 - DNA, 201 bp, Homo sapiens
tcctagccagaacaatcagtcaagagaaagaaaaaaaaatgtatccaagtaggaagagaggaattcaacctatctttctttgcagacgatttaagcctatrcttagaaaacctcatcgtctctgcccagaggctcctagacctgataaacaactttagcaaactttcaggatacaaaatcaacatacaaaaatcaccagca

SEQ ID NO: 41571 - DNA, 201 bp, Homo sapiens
gaagtcaagtatgacggggtaaaatgtgtgttcagaggctgtgtgtgacacagctaagttatttatttatttatttatttttttgagacggagtttcgctmttgttgcccaggctggagtgcagcgatgcaatctcggctcactgcaacctccacctctcgggttcaagcaattctccttcctcaaccacctgagtagctg

SEQ ID NO: 41572 - DNA, 201 bp, Homo sapiens
aacaatgtgctcctgaatgacttttgggtaaacaataaaattaagggagaaatcaagaaatactttggaataaatgaaaacaaagatacaatgtaccagawtctctgggacacagctaaagcagtgttaagaggaaagtttatagcaccaaatgcccacatcaaaaaggcagaaggctctcaaattgacagtctaaatttt

SEQ ID NO: 41573 - DNA, 201 bp, Homo sapiens
tagtttgctaaatattaagggaaaataaactccaagaactttttttttttttttttaagtagaactagcttgttgtatcagttatctctgacttccttctyggcctggaaaattctcattgcacatgctgtttgacataactacattctattttcaaaatgtctgctcgatttcattgactatttgcctaaagtctttact

SEQ ID NO: 41574 - DNA, 201 bp, Homo sapiens
tgttaccactagacctgtctttcaagaggtccttaaaacccatttacacctagtgttccatcattggaacaataagcatatgggaattatttatatcctaytactcaaggtcatcaccaaggtctgattgtaaaaattaaaaaaattgcaacctcaggtataaatgggttaagggagtgctaaacatggaaacaaaagact

SEQ ID NO: 41575 - DNA, 201 bp, Homo sapiens
acaacaaacaaacaatgacaaaccacaaaactgaagaaataagagtggatgggaaactccagtgaaaagaaaaggttgggctccatataaagttgtccaaygcagtgcagcatacactcatcagtagagaaaagcaaaatgtctcaggatcagaagaataaacgaatatagcagtgtgaccttggatagttccctctgaac

SEQ ID NO: 41576 - DNA, 201 bp, Homo sapiens
aggcctatattcagcatgcttaatccttgaagaaaagaaattccaaccaggaagttcatattcagtcaaactaagcttcataagcaaaggagaaataaaamcctttttagaaaagcaaatgctaagggaatttgttaccactagacctgtctttcaagaggtccttaaaacccatttacacctagtgttccatcattggaa

SEQ ID NO: 41577 - DNA, 201 bp, Homo sapiens
gagatgacattgattctgtcatgtgttgccctgaaataagaggaaaataagcattttcccaattgacccttcagcaatttctccaggctttttttttttttcaggagcccctttccaatttcccatcatttttcaataagatgtgggaatttcttccccaattttttttttctggagctacgttttgatttattttgtgtt

SEQ ID NO: 41578 - DNA, 201 bp, Homo sapiens
aacctctctatgttagaggccaaaaggataaggtagatgttatccaggagaagtaggaggtgaagatgaaaaaacacattcctaaaaagataacagtttaygcagacatcctcctggggaaaagagctcagtgcccgtgaattctggaaagaactgagtggcttcagttcagagattgagggggcatatagtgttagatga

SEQ ID NO: 41579 - DNA, 201 bp, Homo sapiens
tttagaagacttatatgcattttaaaaaaaaggtttagaatccagattaaacaaacaattatgccgggcacagtggctcacgcctgtaatcccagcacttygggaggctgaggcgggcagaccacgaggtcaggagatcgagatcatcccggctaacatggtgaaaccctgtctctactaaaaatacaaaaaacaaaatta

SEQ ID NO: 41580 - DNA, 201 bp, Homo sapiens
atgtctttttggtaggatttattttcctttgggcatgtacccaataataggattgctgggtcaaattatagttctatttttagttctctgaggaatctccwatcgagtttccatattggctgtactaatttacatcctcttcaacagtattcaagtgttcccttttctctacatcctcaccaccatctatcagttttcgac

SEQ ID NO: 41581 - DNA, 201 bp, Homo sapiens
tctttttggtaggatttattttcctttgggcatgtacccaataataggattgctgggtcaaattatagttctatttttagttctctgaggaatctccaatygagtttccatattggctgtactaatttacatcctcttcaacagtattcaagtgttcccttttctctacatcctcaccaccatctatcagttttcgacttt

SEQ ID NO: 41582 - DNA, 201 bp, Homo sapiens
cccagcaccatttattgaatagggaatcctttccccattgcttatttttgtcaatttttttgatgttcaaatggttgtagatgctcacctttatttctggmttctctattgtttcaattgtgtctgtttttgtaccagtagcatgctgctttggttactgtagccttgtagtataaagtttagtaatgtgatgttttctgc

SEQ ID NO: 41583 - DNA, 201 bp, Homo sapiens
ttctggcttctctattgtttcaattgtgtctgtttttgtaccagtagcatgctgctttggttactgtagccttgtagtataaagtttagtaatgtgatgtyttctgctttgttctttttgcttaggattgctttggctattcaggctctcttttgattccatacaaattttagaacagtttttttgtaattctgtgaaaaa

SEQ ID NO: 41584 - DNA, 201 bp, Homo sapiens
aaagaagttttaagcaagcaaatgacatgattggttttgccttttaaaaatatgactttagaaccttggttttcaaattttaaaatgcatgataatcactyggagggcttgttgaaacacagatggctgggccccacctccagagcttctgactcagtagttctggggtggaacccaagagtttgcatttctaacaactcc

SEQ ID NO: 41585 - DNA, 201 bp, Homo sapiens
tctaacttcattaaagcaactttattttgttcctctggttctttaggatctttaatgatacgctctcaaaaattcaaaacaggtgactgaagggggagatrtaaaacaaactaatattagacaatggcactcacattttgatttttagcttgagtgtgcgtgtgtgcacatgtgagtgtgtgtgtatgttcatactgtaca

SEQ ID NO: 41586 - DNA, 201 bp, Homo sapiens
agtacctaactgaatttgcaaggtctggataaggaagacacaagtgttgaggataactgtgtatctggcttgcttgtttttgaatgtatgaaagagcccargtctgtaatctagagaaagagagaaagagaatggatttccattttaattgtagtcattggcgtaaaggtgcaatttaattgaatatcatgcaacaactgg

SEQ ID NO: 41587 - DNA, 201 bp, Homo sapiens
tcaggcttgtcatagattagtttcatcatttgactctgtttaattagttccccaggtctgccactcatctctgaaagcctatgttccatttcttaatccakccattgtttacattatcaaacagtttagtcttgacctcatatgttacctaggaaaaagagttcagtgattgtttcttaatttgactggtcatgaaagtgt

SEQ ID NO: 41588 - DNA, 201 bp, Homo sapiens
atacaacaaagtatggacattttcaaaccattatcaatctatgaaactgtatcaacgactttgggtaaattttgattttttaaaagttttgcatggggtcrggcgtggtggctcacgcctgtaatcccagcactttgggaagccgaggtgggcggatcacgaggtcaggagatcgagaccatcctgactaacacggtgaaa

SEQ ID NO: 41589 - DNA, 201 bp, Homo sapiens
gattttttaaaagttttgcatggggtcgggcgtggtggctcacgcctgtaatcccagcactttgggaagccgaggtgggcggatcacgaggtcaggagatsgagaccatcctgactaacacggtgaaaccccgtctctactaaaaatacaaaaagttagctgggcgtggtggcggtcgcctgtagtcccagctacttgaga

SEQ ID NO: 41590 - DNA, 201 bp, Homo sapiens
caagctgaggaaggaatctcagagcttgaaggatggttctttgaaacaactcagtcagataaaaataaaggaaaaagacaaaaaaggagaaaacctctgaraaatatgggattatgtaaagagaccaaatctatgactcattggcatccctgaaagagagggaaagagagaatgccttggaaaacatatttgaggatattg

SEQ ID NO: 41591 - DNA, 201 bp, Homo sapiens
accaagagaccacaccgtcaaaatcagcacattctgaacagtacttcggaaggaaggcattgaaagtggttggaaggagaatgcagatcctgggctgaagkggggaggaagttgggaaccctgcatggggttgccaagcaccaggactcattcctggccctgagaggctcccagggaagggatgagttaaataggcataga

SEQ ID NO: 41592 - DNA, 201 bp, Homo sapiens
taatccagtctatcattgttggacatttgggttggttccaagtctttgctattgtgaatagtgccgcaataatcatacgtgtgcatgtgtctttatagcgrtcatcagtatttgagtaaaaattaagaacatatgttaatgggcattataacttgtctggattttcaaaatgtaactaagaacaatacttgttgttgttgt

SEQ ID NO: 41593 - DNA, 201 bp, Homo sapiens
ctcatacagctgggtgaccctctgagatgaagcttccagaagaaggatcaggcagcaacatttgccgttctgccatatttgctgctctgtagcctccactrttgatactcaggcaaacagggtctggagtggacctccagcaaagtccaacagacctgcacctgagggtcctgactgttagaaggaaaactaacaaacaga

SEQ ID NO: 41594 - DNA, 201 bp, Homo sapiens
gggtagaagtgtagagattcagcagaggtggttcacattgtaagtaatacttatagttactcatgatcttatggcttactcctacactaccaatacaatgrcaaagtattaaatttgacattttctttaaatagttttagaatattcgtatagcagttacccaggaattaggtaagagttgtttataatgtctagattaca

SEQ ID NO: 41595 - DNA, 201 bp, Homo sapiens
tagagacagggtttcactgtgttagtcaggatggtctcgatctcctgacctcatgatctgcccgcctcggcctcccaaaatgctgggattaaaggcatgarccaccgtgcccggccttcagtgtatatttaaaatttttcatcatttgtggttggtaaaaaatagtatacttacctttgtatattgactttgtacactgca

SEQ ID NO: 41596 - DNA, 201 bp, Homo sapiens
gcacatacatgatgagtcaacatcagtagctcaagaatggaggaactctgatttaagatggttagcatcaaatctatctatggataaaaaataacagcttyagaaattagagaatagcatataaatggtataaactatgataatgaaagcatgttaatgaaaatgattaatatgtgacaaggtaatattggaagaggtatc

SEQ ID NO: 41597 - DNA, 201 bp, Homo sapiens
ctgcaaggtgacagtgaggctcagggagggacatctgccattgctgaggcttgaataggtaaacaaagtggctaggaaacttgaactgggtgaagcccacygcagctcaaggaggcctgcctgcctctgtagactccacctctgggggcagggcatagctgaacaaaaggcagcagaaacttctgcagacttaaatgtccc

SEQ ID NO: 41598 - DNA, 201 bp, Homo sapiens
cttacacccattagcatttttgactttagtcttttcacctaacttctctgagccttaatttctccatgtagaaaatgaaagatgatgtctttcctatctcrtttaggattgctgtaatataataatatgtataacagtattgcttaaagaatattacctagtggccattgcagtgcataagaactggtaagatgccttacc

SEQ ID NO: 41599 - DNA, 201 bp, Homo sapiens
aatatactagtaacaataagctttatgtcacatgtatgatacaggggatttaaaaaaaatttttggccgagtgcggtggcccatgcctgtaatcccagcastttgggaggccaaggcaggtggattgcctgaggtcaggagttcaagaccagcctggccaacatggtgaaaccccatctctactaaaaacacaaaaattag

SEQ ID NO: 41600 - DNA, 201 bp, Homo sapiens
gccattgcagtgcataagaactggtaagatgccttacctggaaaatataagggaaaagtgttggtttttttaaaatcatgaaaagataagattgaaaatgrcgtgtctttgctgctaattaatgattgctttatgttcatggagctgtaacatttttcccacctgcagaacatattatagtaagctctagttatattttct

SEQ ID NO: 41601 - DNA, 201 bp, Homo sapiens
aagggaaaaagatcaatgacaaatgggtaccccaaaaagtcaagggtcacacaaatataaattcaaaataagtaattcaaacttcttttttttttttttttgagacagggttttgctctgttgcccaggctaaagtgaagtggtgtaatcatggctcatagcagccttgatctctgggctcaagccatcctcctgtctcag

SEQ ID NO: 41602 - DNA, 201 bp, Homo sapiens
cgcttttaataaaactttaacaaacactcgtgaattccaacaaaaatcttgatcattttacagaagtgtatatccaaaaccaccgtgaagctggaaatacrtcaaagacgtgattacatttgtccaagttaagaggacaaccaatgagggcacaatggacagggttctttaggtatgttgggtataaattgtgataatttt

SEQ ID NO: 41603 - DNA, 201 bp, Homo sapiens
gaagggaaaaagatcaatgacaaatgggtaccccaaaaagtcaagggtcacacaaatataaattcaaaataagtaattcaaacttcttttttttttttttttgagacagggttttgctctgttgcccaggctaaagtgaagtggtgtaatcatggctcatagcagccttgatctctgggctcaagccatcctcctgtctca

SEQ ID NO: 41604 - DNA, 201 bp, Homo sapiens
actcctggggctccatagtgggtttcaagggcaggtgtttatgaagccaggttctggggcctgatgatctgggactgaattccacctctgccacatgcaayctgtaggtccttgggcaaattacttcctcaagttctgcttccattttctcttctgtatgtatggttgatgataatacctacctcctagggttattatgag

SEQ ID NO: 41605 - DNA, 201 bp, Homo sapiens
aaaaaatcataaataatcatttcagtcttttatcagttcagtcccatgtaattaattattgttctgcttgatggtagtttagcaattttatgagtccagtktttttttttattagagttctggaatttttacacagttcattgattcacttatacagtttcagagttgtcagaaacctttatttgtcagtgttattcccat

SEQ ID NO: 41606 - DNA, 201 bp, Homo sapiens
aattagttcatacatataaagtgcttagaaaagtacctggtacatgtaagcactctatatatttgctatcgtcatcattatcatcatcattattaaagttrcacatagcctagggtgaaattctactaaaaattttagggaaaaaatactcatttatattatcaccaacatgtacatgttatggaatagaatgaaagtttc

SEQ ID NO: 41607 - DNA, 201 bp, Homo sapiens
ttctaattgtccatcttggtgccggcagcgaggttggggctccaaatctagccgccgccatctaccccaggggaggaggagaaggagtgttttttttttttaatatatttaatggacaggtaatgaggcaaataaaaattctgtacattcagggtgtacgatgtgatgatttgatgtatgtatgcaatgtgtaatgattac

SEQ ID NO: 41608 - DNA, 201 bp, Homo sapiens
agaatctatactagaatgacagggttcttgcttagatccaagtttcagaaccagagaatgccagagatgaagaggagtgaagaaggaagaagagacagtaygtacaaaccataacatagaaagtctctgatgcaaaaggatatgtttttagccactcactccagatggagaggtgtgacctgggaaaaggaaataagagat

SEQ ID NO: 41609 - DNA, 201 bp, Homo sapiens
attgtatgctcatatcaagatagcacatgtaccccattaatatgtacaattatgtagccataaaaattaaaaataaaaataagcaaaggggaagaatgtcrccaaaggagaataaaaaaatagaatgttacagcaaagaaatcaaagaagaatgaaatagaaatgttagaactaaaaatattaaccaataaaataataatt

SEQ ID NO: 41610 - DNA, 201 bp, Homo sapiens
acatttattgggcactcaatgtgtgcacaacagtactctgtatctcacctatataatcctattcatccccacaaacatctatgttctaagttctgtttatrctccccattttactgatgtggcaattgagggatagaatggttaacaaattcttccaggtcgcatggccagaagtatggcagagtcattatcaaagccccc

SEQ ID NO: 41611 - DNA, 201 bp, Homo sapiens
caagacttgtacacaaaatgtataaaacagtgccaagagaaattaaggaagacctaaataaatgcagattatgatgttaaactgtacagtgttgaaactgyaacagtgttaaagtggtcttctcttctcctcaattgatctgtagatttaatggagtccagatcaaaatcccaacattcatttggctagtaattgaaaaac

SEQ ID NO: 41612 - DNA, 201 bp, Homo sapiens
atggttatcaagatagtgtagtgttaaaggaaactcagaaaaatagatcaatagaaatgactagagtccataaagatctacatggatgtagacaactgatrctcaaccaaagttcaaaggcaattcagtgggcaaaggataatcatttcaacaaatggtgctggaacaactggttattaatataaaaaattcaatcaataa

SEQ ID NO: 41613 - DNA, 201 bp, Homo sapiens
caaattgtttgcctagtcagccctaatgcaagaacctggatacttcagttgaaggtgctgaattcacttgctcctttccttcctctctgagtgcgcagacsgcagctgcttctaattgtccatcttggtgccggcagcgaggttggggctccaaatctagccgccgccatctaccccaggggaggaggagaaggagtgttt

SEQ ID NO: 41614 - DNA, 201 bp, Homo sapiens
gactcctgttgggagggctcacttggtcaggaggaatgggatcagaagcagtctggatgctttctggtggagcagatatgctgcgttggggcggggagtgrgggatccttcttcatctggaccgtttgtattctccaaagctggcaggctagaatggctgagtccactgaaccacagagatggtgtggcaacccctcctcc

SEQ ID NO: 41615 - DNA, 201 bp, Homo sapiens
gtttcagaaccagagaatgccagagatgaagaggagtgaagaaggaagaagagacagtacgtacaaaccataacatagaaagtctctgatgcaaaaggatwtgtttttagccactcactccagatggagaggtgtgacctgggaaaaggaaataagagatttggtgacagaggaatggagtaaaaaagtctagcaagagaa

SEQ ID NO: 41616 - DNA, 201 bp, Homo sapiens
gcctcatagaatgagttagagaggagtcccttcttttcaattttttgaatagttttagtagaaatgataccagtcctttttgtacctctggtagaattcakctataaatccttctggtcatgggccttttttttggttggtaggctatttattgctgcctcaatttcagaactcattattggtctattcaggcattcagtt

SEQ ID NO: 41617 - DNA, 201 bp, Homo sapiens
gaagagacagtacgtacaaaccataacatagaaagtctctgatgcaaaaggatatgtttttagccactcactccagatggagaggtgtgacctgggaaaargaaataagagatttggtgacagaggaatggagtaaaaaagtctagcaagagaaacaagagactgcaaactgctcctgttttttctctcaatctacaacca

SEQ ID NO: 41618 - DNA, 201 bp, Homo sapiens
tgtaaggtaggggtccagtttcaattttctgcatgtggctagccagttctcccagcactatttattaaataggaaatcttttccccattgcttgtttttgycaggtttgtcgaagatcagatggttgtaggtttgtggtcttatttctgagttccctattctgttccattggtctacgtgtctgtttttataccagtacca

SEQ ID NO: 41619 - DNA, 201 bp, Homo sapiens
tgtagctaaaagactgcatatgtttgttagtggcctatgaacataaccatggcattataaatagtatcataattaccgtgaaagcaatactgcatctgatkaatgtattttattcggcagccacaagtcttacgaagagtatattttaggtaatgaaaacttgagccttggtatgtttagaataataatgatactaagttt

SEQ ID NO: 41620 - DNA, 201 bp, Homo sapiens
atggtgtaaggtaggggtccagtttcaattttctgcatgtggctagccagttctcccagcactatttattaaataggaaatcttttccccattgcttgttwttgtcaggtttgtcgaagatcagatggttgtaggtttgtggtcttatttctgagttccctattctgttccattggtctacgtgtctgtttttataccagt

SEQ ID NO: 41621 - DNA, 201 bp, Homo sapiens
agaccttgttttcctgggtatcagcagtggagtctgcagaacagcgaatattggtgaacagcaaatgttgctgcctgatctttcctctgggttactttttrtatatggtgtaaggtaggggtccagtttcaattttctgcatgtggctagccagttctcccagcactatttattaaataggaaatcttttccccattgctt

SEQ ID NO: 41622 - DNA, 201 bp, Homo sapiens
ctagtcatctggaaggccctatatttttacaatagagccttccagagttgttagaaatatggagaaaatgctatcatgatcatttccatgtatactaaagyttcagtagttttaattgtgaaaaacagctatcccataaattgaagtgttagtaagacaaatggatgcattgtattaaagctgacagagcagtgactggga

SEQ ID NO: 41623 - DNA, 201 bp, Homo sapiens
gatttttagaattttcagtttttctgctctgttttttccccatctttgtggttttatctacctttggtctttgatgatggtgacgtacagatggggttttsgtgtggatgtcctttccgtttattagttttccttctaacattcaggaccctcagctgcaggtctgttggagtttgctggaggtccactccagaccttgtt

SEQ ID NO: 41624 - DNA, 201 bp, Homo sapiens
attcagtcacaggtcttttaactgataccttttaatgcataaaatcatgtttaaattcttgaaataactgaagtcttaatgaaatatttgagtgcaaaccrtcaattgaaaatgataaataaaagtagtacaaatatctttaattttgaaatatgagggttttctgtgtttctatagtgttccaattttattaacttttgc

SEQ ID NO: 41625 - DNA, 201 bp, Homo sapiens
ttcctttggagtaggagaggtgctctgatttttagaattttcagtttttctgctctgttttttccccatctttgtggttttatctacctttggtctttgawgatggtgacgtacagatggggttttggtgtggatgtcctttccgtttattagttttccttctaacattcaggaccctcagctgcaggtctgttggagttt

SEQ ID NO: 41626 - DNA, 201 bp, Homo sapiens
ttaatgaaatatttgagtgcaaaccatcaattgaaaatgataaataaaagtagtacaaatatctttaattttgaaatatgagggttttctgtgtttctatrgtgttccaattttattaacttttgccctgtcttccgttttctttataactaaaatagtaataaatacatttctaatttaattgtcttatatgcacagaag

SEQ ID NO: 41627 - DNA, 201 bp, Homo sapiens
tgtcttccttaagattgatgtcaatgttttcaaaatagtcactgatttcttaaaagtactttggtataaaacatcaacgtctcaggtataaaaatgattttatggtcttagcaatactcaagtgatattaaattaaaatattaataatttatataatatcaacttatgcaataactatcttataaagcagaattctattta

SEQ ID NO: 41628 - DNA, 201 bp, Homo sapiens
atttaattgtcttatatgcacagaagttctgagtgatactgaatttttggtgttgattgagatttgctttatgtatatgttcagttttaaagcttattatrtatttaagtgaatgtgtgttctctaattgtagggtccatggttttacatatagccattggaacaaacttcttagttgcgttatttgtatctcctacaatc

SEQ ID NO: 41629 - DNA, 201 bp, Homo sapiens
tggtgcgtttacttccagtacaataaagttgtgggagatttttatcatctttgtactttgtaatattaaagaatatatcttctttatatatatccttacaygtatatatattatatatatatatatgaagaatatatatatattaacaagtggagctagtactatatatgcagggtttaatcccacttttccattttaaat

SEQ ID NO: 41630 - DNA, 201 bp, Homo sapiens
ttcagttttaaagcttattatgtatttaagtgaatgtgtgttctctaattgtagggtccatggttttacatatagccattggaacaaacttcttagttgcrttatttgtatctcctacaatccactaatgccttctgctgcctgatgtatcagttataagaaaagtgcattgaaatctcccattattgttgatctgtgaca

SEQ ID NO: 41631 - DNA, 201 bp, Homo sapiens
gtgacaatgacatagggtcattatagatttatcttatttaactgcataacaaggttgttatgggtcattacagatttatctcactgttaacaaggtcgctrtggggttaaatgagataaatctataatgaccctattatctataaagttcttatgagagggactcttgtataataaatactgtataaatgttacttttctt

SEQ ID NO: 41632 - DNA, 201 bp, Homo sapiens
tataatgaccctattatctataaagttcttatgagagggactcttgtataataaatactgtataaatgttacttttctttttgttcattagtctgccataygtatactaccttgaacccaaaagacttagggtgataattttaaaacactgaataaatacgtgttttcttgaactgggcttagttatgagtcagaggtcca

SEQ ID NO: 41633 - DNA, 201 bp, Homo sapiens
taacatgcattacttcacatagttaacatttttttgtggtaagaacacaaaatactttctaagcaattttcaggaatacagttctattaactccactcacygggttgtacaatagatctcttgaacatgttcatcttatccagctgcaatgttgtatcctttgaccattatttccccaactccaccccatcccacagccca

SEQ ID NO: 41634 - DNA, 201 bp, Homo sapiens
ttgccttaacaacccagctatatgcagatggatctcaaatacacatctcccatctgtaatgatttttctcctgaatttccaacctgtgtataaaccactaygtaatatatatacccaaaaatcagcatatctaaaggagaacttctgtcctcatctaattccgctgccacgcctgtacttttttctccattacctctcgat

SEQ ID NO: 41635 - DNA, 201 bp, Homo sapiens
ttgatgggcatcagccgctgtgggcaacacagggtcccttaccccaaaccagtggaatcagaatccctggggaagggacacaagtggaaggcttttgtaaragttcttctggtgatgctaatgagctgtcagggtttaaaacctctggttgagagctgttaggccaatggaggatacataaaagcagggccaatgggatgg

SEQ ID NO: 41636 - DNA, 201 bp, Homo sapiens
ggaagaagtcaaaatgcaagggtaggaatcttcttttagatttcatatatttttactttaattctaccatatattttttatttctaggatcttttaccctsaaaacagcttctcatttggtgtttgacacaatctctcttcctttcttcttccaagctcagcaaatctaaaaacttcaacacaattaagtaagttatccta

SEQ ID NO: 41637 - DNA, 201 bp, Homo sapiens
caaaatcctggcaagtttttggaaatataaatgcatgtggtctaaatttacaatgaatagcaaaaatagttaaataataaaaagaggtaaataaagtgggraaaagtactctacctgatattaagttttacactatagctgcaataatcaaagtggtgtgacattgccagagcatagacacatagatcaatggaacagaat

SEQ ID NO: 41638 - DNA, 201 bp, Homo sapiens
cattaattgtgagcttcccctgggaagagacattgccttggggaaggtagtttcctacaacctaggacagttcctagtgaacgactatgccatgagtggtyaatagcagttatccccagcagctgaaagatggatgtatccaatatgaagaggagatatggccagagctctgtgatatgcaatagaggggagaaaagacac

SEQ ID NO: 41639 - DNA, 201 bp, Homo sapiens
attaattgtgagcttcccctgggaagagacattgccttggggaaggtagtttcctacaacctaggacagttcctagtgaacgactatgccatgagtggtcratagcagttatccccagcagctgaaagatggatgtatccaatatgaagaggagatatggccagagctctgtgatatgcaatagaggggagaaaagacaca

SEQ ID NO: 41640 - DNA, 201 bp, Homo sapiens
gttataagaaaagtgcattgaaatctcccattattgttgatctgtgacaattgctctttctaatctcaattttactttgtatattctggacaatgttattwctcacatatgagtttggaattactatattttttgctgattccttctttattgttccgtagaaacttctttatttccaatgtgccttttttgcctctctac

SEQ ID NO: 41641 - DNA, 201 bp, Homo sapiens
ttctaatctcaattttactttgtatattctggacaatgttattactcacatatgagtttggaattactatattttttgctgattccttctttattgttccrtagaaacttctttatttccaatgtgccttttttgcctctctacaagtgtctcactttcttctgttcattgtcattcttcatctttttattttcaactttt

SEQ ID NO: 41642 - DNA, 201 bp, Homo sapiens
gcacttatttctgcttatagaaaaagaattgtagcactggagtatatgggaaggtagatgagacataaatctggtgagatatgcaaaggctgtgctaaaaygccgtgttaggaatttggtttgcatcttatttatgtaggggaatggcatcagccatctcattttagaaatataattacaattgttgtagaagaatgagct

SEQ ID NO: 41643 - DNA, 201 bp, Homo sapiens
gggtaactttatctgcttcgtgttttaaaaagatcacttggtgaatgtttggagaatggattaaaagaggtacatctagaagcagggggtcctgctagctsactgctaccatgggccatgtaagagatgatgaggacttgaaccaaggctatggcagtgggtatgaagaaaaggaaaaagatgagatcctgtgtaattccc

SEQ ID NO: 41644 - DNA, 201 bp, Homo sapiens
tctgtcatagaggcctgggtggatggtggttctattcacggagagagaaatacaaaaggaggagagtatggaaatcatgggttatgtttgagattatggartgtgcattatttctgtgacattcaagcaatgacacctcagaggaattggaaacatgggtctgttgctcaactgacacatcttgggctagagatctagatt

SEQ ID NO: 41645 - DNA, 201 bp, Homo sapiens
aaatcatgggttatgtttgagattatggaatgtgcattatttctgtgacattcaagcaatgacacctcagaggaattggaaacatgggtctgttgctcaastgacacatcttgggctagagatctagatttaggagtatttagcatatacttggaatgagaaggcatgaactctgggaaataccaggacagaagtagcagg

SEQ ID NO: 41646 - DNA, 201 bp, Homo sapiens
ttagctgagcccatgttttccacttgttgcatttgggtttcctagttttacatttcatattgtaacatttggcagattttaaataacttgtacaatgtatrgaaattctcaaaggactgatgttttgtaaaacttcttcacaataattattagatatacaaagccctgcagctgtattctataaatagtattgaatgtagt

SEQ ID NO: 41647 - DNA, 201 bp, Homo sapiens
aaaacaaaggctttagttgaaaaccccagctgagctcccatttgtcagctagcactgtggtagtcaaccatgcgaatgaggctattttggacctcatgatygtccagtgcctgggctgataccatgggaaacggaattttgtggctgcccacaaaatcatggaaaataatgattttttagaaaacctccactgttttgttt

SEQ ID NO: 41648 - DNA, 201 bp, Homo sapiens
gcatcatgaatgctgaagtttaaccctggatgccactatttctgacttcaagaatatattggattttttcactttaaaaagtttagaaggaaaaatatcaytgttgaattctacttcttggttatttcaaattatttcaaataggaagccccctgtaaaagtgtccagacttactataaatgcattatagttctcatctat

SEQ ID NO: 41649 - DNA, 201 bp, Homo sapiens
tgagatttctttggtataaaataatcataactgattaaatgaaagtatttgatattattctggcatatatacagaagagactagaaaactagaaaatatcmtacatgtgatatactttatgaagtttaaacagcacagagttctggcaaatgttactaatgatgaataaaatattttgttttctggtgcatgcctctaatc

SEQ ID NO: 41650 - DNA, 201 bp, Homo sapiens
aaggtcagaggttattttctgaaggttcttctgcagcgtgtcttgtaagacttgtaccactagcaaatacatttccatcattagcagatatttgtttcacyaaaatgttcaatacatgccatcatgattactcaaaaactgttaaatgttcataggaataatgatgctttgtttgcctcaccattcaaaacaaattaacta

SEQ ID NO: 41651 - DNA, 201 bp, Homo sapiens
aagggaaagaggtgatgtagaaaacctctctatgttagaggccaaaaggataaggtagatgttatccaggagaagtaggaggtgaagatgaaaaaacacaytcctaaaaagataacagtttatgcagacatcctcctggggaaaagagctcagtgcccgtgaattctggaaagaactgagtggcttcagttcagagattga

SEQ ID NO: 41652 - DNA, 201 bp, Homo sapiens
ccctctgctcccaaaactcttaccagtggttttcaaaccttactaagcttgagaatcatttgctgggtctggcttattgaaacgcatcctagatttgcacragacagccactggcctatccatcacctttgtgttaattagaaaaagaggaactctttgggcagatgcagcccccacatgtaggaaatatgaaggctaaca

SEQ ID NO: 41653 - DNA, 201 bp, Homo sapiens
attttttatttctaggatcttttaccctgaaaacagcttctcatttggtgtttgacacaatctctcttcctttcttcttccaagctcagcaaatctaaaawcttcaacacaattaagtaagttatcctacaaactctatagtataattgacctcaatatcatttttttcctcaataaattatggaatatatgaaatgcctc

SEQ ID NO: 41654 - DNA, 201 bp, Homo sapiens
atataagataacagtaaataaagttcattctgtctggattccaatacctatactgccatttctccttttttcaaatcatactgcttcctatattcatagcrcaacctctacttcatcagcacctgctaacagagcaaggataaatacgaatactttattggacccactaataaaaatggccactgtaactaggatgcagat

SEQ ID NO: 41655 - DNA, 201 bp, Homo sapiens
attagatgaacaccttggcactaccagatccaccctgctcaccacctagatatcctacatcatgctgctagagtgatcttttaaaaacaaaacattgaccrtattacacccttacttaaaaccttttaatgagtcaccagtgtgctcaggatgaatccagaatccttagggaaatatacaagaagcttcatgacctggtgg

SEQ ID NO: 41656 - DNA, 201 bp, Homo sapiens
gagacataaaattccagattatctacatgaatctcaacaggttcaatgttaactttgctataaacatccattatccacatggtgtagagaaaaggacactkatctggtccacactggctcctaacttgctgagtcatcttgagcaacatttgacctctttatttctcagttaccttgaatgctaaatgtgggtattagact

SEQ ID NO: 41657 - DNA, 201 bp, Homo sapiens
attggccccacctcattacttttgccatggaagagaacctgacttggttcatgaagcagattcaactgagcaagagaaggaatctcataacagcttaatgwtgtctactgacaagcttgagtataaactcttaaagaaaatgaagacttctccaacccatctcatagtgagatgagcttctcatctgttttatgcaaggat

SEQ ID NO: 41658 - DNA, 201 bp, Homo sapiens
ctattgattatattattattaggaaatgagaataagtaggaaaaaaattgcacctgtctcctttcttcttagctgtggtctcattttagttcctagtattsagaggtgacctaatcagactgcagaatgttctgaaaggttttaaacatgaactgttggttttggcaatcagaagcactgacataacatagtgtatcaaac

SEQ ID NO: 41659 - DNA, 201 bp, Homo sapiens
ctgaatcaatgtgatactcttataactgtctctctaattctgccttgctcccctgttacaatgtcaatcaggtcatgtcatgtgccactttgtggccaccygtttcattcagagaaaaagttaagtccttacaacatattctgcttccctctcccttagtcctgccctgtgtccgtgtttcaaaacctacgcacgtggctc

SEQ ID NO: 41660 - DNA, 201 bp, Homo sapiens
ttaaacagatgcacaaactaaaaagaaaatatcaaaattgtaagtacaatgcaaataattaaaagaaggaatgtgaggccaggcatggtggctcacgcctrtaatcccagcacttttggaggccaaggccagaggatcatgaggtcaggagatcgagaccatcctggccaacatggtgaaaccctgtctctactaaaaata

SEQ ID NO: 41661 - DNA, 201 bp, Homo sapiens
gcgagcacctgtaatcccagttacttgggaggctgaggcatgagaatcgcttgaacccaggaggtgaagattgcagtgacctgagatcatggtactgcacyccagcatggtgatagagtgagactctgtctcaaaaaacaaacaaacaaacaaataaacaaacagaaagaatgtggtaggaagtgactaggggcaatggga

SEQ ID NO: 41662 - DNA, 201 bp, Homo sapiens
atgggaattccagaggctccttctagagatacatagaattcagtgtgtaaagaagttagaatgtttctttctgcatctttaatctatcttctcttaggtgytttgagactagcttaaaaattaattcttgattgcactttgcaactataaacatggggattggtgattgaataattagtgcttatcttctctctttgaaat

SEQ ID NO: 41663 - DNA, 201 bp, Homo sapiens
tgtaaagaagttagaatgtttctttctgcatctttaatctatcttctcttaggtgttttgagactagcttaaaaattaattcttgattgcactttgcaacyataaacatggggattggtgattgaataattagtgcttatcttctctctttgaaattggctacctttgaggttttacagtttttaacaatatcatgataag

SEQ ID NO: 41664 - DNA, 201 bp, Homo sapiens
catctattgcctttaagattttctgtgggatttaggtctcaggggtaatgtggagagacactgaacccacacagagctaaaacttctaactgaagtatccytaaaagggtccattggactgttttggtaacatatctcctgtctataccagaatgacttctcttacacctcattttggaaaggcaagagatgagagtcatt

SEQ ID NO: 41665 - DNA, 201 bp, Homo sapiens
ggataattatgagagcacaaaagcatagatgagggaactagtaggtcagggagcagatggcctaggttctagtggtaagtagtcctacaggctttccctcrtttttatccttgttgttcagggaacataaataatcaccagtgacaagggaaagcatattttgttgtcattgtcattattatttacaatctttcattgcat

SEQ ID NO: 41666 - DNA, 201 bp, Homo sapiens
gcaagtgagattgtatggttttggcaggaggagttgaggcagaatggacatagggatatctgttttttacatagaaagttttaagattatagctggaaggraccttagactagttgtactcaaagtttgacctatggtccagttctggtcagtccattacaatgacccaagttgataggaagattttaaaatcttttgtat

SEQ ID NO: 41667 - DNA, 201 bp, Homo sapiens
ttcacaatacagatgaacgcagggacattgtaatgtcagcaatagaaaagcaacagagaactgtcatagtgttggtcttttttcctctaagattcgttttrtacatttattaaggtgttatcaaagtcgtccttttcaatgaggctgtgggtggaaggcacgtcttggaatgtgttctctttacacatctgaatgaagtgt

SEQ ID NO: 41668 - DNA, 201 bp, Homo sapiens
attgtatggttttggcaggaggagttgaggcagaatggacatagggatatctgttttttacatagaaagttttaagattatagctggaagggaccttagamtagttgtactcaaagtttgacctatggtccagttctggtcagtccattacaatgacccaagttgataggaagattttaaaatcttttgtattagtctatt

SEQ ID NO: 41669 - DNA, 201 bp, Homo sapiens
cctaagcctcgattatcatcaactataaaattgagataataatagtatctaccatttaccgttgttctaagaattaaatgacatagtgcatgcaaaggacktagcatagagcctatcacctagcaagtgctaaaacattagctattatttttaacattaattatttttcaaccctagaatggtacatttttaacaggtagt

SEQ ID NO: 41670 - DNA, 201 bp, Homo sapiens
gaagctgttggcattgggccaggggttgagtggcagaataatctccttatcaattttgttatgtttgatgttgtacaaaataaatagctcaataaaaactscagtttagatgttaccatggttgggaagaaaatggcagtggctacctattaagaaccacaatcacaaatgcagtccttctgtattttatatccttggtta

SEQ ID NO: 41671 - DNA, 201 bp, Homo sapiens
ccgagggcgccttcagagctggaaggctcaagccctctgcagacagtctgcttaagatgtagcttgcattgtgtccctggggtcttatgcttctccccttyttcctaccaggtcagctgaaggacttcagcttctctcttagggtccctaatgttctcataatatcttactggaaaggcaagactccattcatacctgtat

SEQ ID NO: 41672 - DNA, 201 bp, Homo sapiens
cttttattcttccttgtcttattacttagcttatcttttgccatctgaccttatctattcattgatctcttttattctattttatataacctcacaaggtkaacaatttttttctatttcaattgtctttgtctaatttcagtacctactgttttattcttaagataatattttatacctcttcctgccaaagcctgctat

SEQ ID NO: 41673 - DNA, 201 bp, Homo sapiens
gagtcaccccactactgaggggcaaggctggtatttgaaactaattctgtttgactccaaagcctgtgtttcttttttccagtacaaaatgattattccarttggcctctgttttacattaaatgcttaactagcaaaatctagctcttggctgcccttaaaggggctcattctctttagtgccattcttccaaataactc

SEQ ID NO: 41674 - DNA, 201 bp, Homo sapiens
agttttaaagcaggaggtctaatcagaacaatatttagagatatagatgaaggtgtaaagaaaacagctataaatgtaatcattcatttttaggatgcttractgtagtcaggatattgatttaggaataaactactagaaaaactggatgtggctgggcgcggtggctcacgcctgtaatcccagcactttgggaggcca

SEQ ID NO: 41675 - DNA, 201 bp, Homo sapiens
tacattttttttttttttgagacagagtttcactctatcgccaggctggagtgcagtggcgtgatcttggctcactgcaacctctgcttcccaggttcaarcaatcctcctgcctcagcctcctgagtagctgggactacaggtaccagccaccacacccagctaattttttgtttttagtagagacggggtttcaccatg

SEQ ID NO: 41676 - DNA, 201 bp, Homo sapiens
ggtgaaaccccatctcagtaaaaatacaaaaaattagctgggcatggtggtgggtgcctgtaatcccagctactgggaaggctgaagcaggagaatcactkgaacctgggagatggaggttgcagtgagccgagatcgcaccactgtactccagctggggtgacagtgagactccgtcttgaaacaaaataagtaatttaa

SEQ ID NO: 41677 - DNA, 201 bp, Homo sapiens
ttcataaatatgtagattacaagactatgaaatcaatttgaacaattagaaaaagaactgttcatttgatcttagccaaaaggctgagaagcaataaaaaragaaccatttttaaccctcctcaagtgtattactattatagcatattttgtaaacatgatgtaaaactgcttgtggttgacttagtttttaatactgaca

SEQ ID NO: 41678 - DNA, 201 bp, Homo sapiens
aaacatgatgtaaaactgcttgtggttgacttagtttttaatactgacatttctgaaatgttatttctctctactgtatttatttatcctactttttaatytatgaaacttgtcaacatggtgaaaccccatctctactaaaaatacagacaattagccaggcgtggtggcaggcgcctgtaattccagctactcagaagg

SEQ ID NO: 41679 - DNA, 201 bp, Homo sapiens
gattttaaaaaacatatccaacttatttgtatagcagaaccctgtgtagctacatacataaagaaaaaaatccccaacatgaactagaggcagcatcactraaaatgagccatttttctctgatttctcttttctgaattgtttttctggaccaattaccccttgctgaccatcctgactactatagttttgagattttat

SEQ ID NO: 41680 - DNA, 201 bp, Homo sapiens
gtcatcgcaaaatgcctcactcttggcaaccacagtgttggtatttctgacataaagtttcccaaatgttgtttttgaagaccattcatatatttttcacrtttcatggttaattttaagaccttttaactccttgaactcagttaaattgcaggtggtttgctgagcacttctgtccctcttgattttaaggcttggctt

SEQ ID NO: 41681 - DNA, 201 bp, Homo sapiens
tatcttactgcatagttctgactttacacctaccctttggatcttatgattaatatttatttagtcttaatactaacaactgagggtataaaatattagartgagtaaataagacctagtattggctagcacaatggggtgactatagtcaataatgaattaattgtgcatttaaaaataactaaaagtataattggattg

SEQ ID NO: 41682 - DNA, 201 bp, Homo sapiens
tactgccttaatttcattgtttacccaaaagtaaatttattagtccattttcacattgctatgaagatactgagactagctaatttattaaaaaaaaaaaragagaggtttaattgactaacatttcacatgtctaacacttttagtgagttgttgaagttcctcaacattatcgtgtggctatctaagcctttttgtaga

SEQ ID NO: 41683 - DNA, 201 bp, Homo sapiens
ttatttatttatttttgagacagggtctgactctgtcgcccaggctggagtgcagtggtgccatctcagctcactgcaacctccaccgcccaggtttaagygattctcatgcctcagcctcccaaatagctgggattacagacgtgcaccaccacacccggttaatttttgtgttattagtagagacgggttttgccatgt

SEQ ID NO: 41684 - DNA, 201 bp, Homo sapiens
ttatattttaatatattttaaaatacatatattttacctaatatgttatatatattatattttaaatatattttaaagtacatatattttatctaatatartagccgctcctcttttttgttgtagtttaatctgcaagatagatatttcttcaaccctttactttgagcttattgatgccattatgtgtgagatgggtat

SEQ ID NO: 41685 - DNA, 201 bp, Homo sapiens
gactggttttgcatctttaggcaaagtgcttaaactttctgaacttcagtattcatatatgtgaaatggtgacctcatgttatatttgttgagaattaaawaaaacaatgaaaagattcttactgccctttgcacatagttttcaatcagcaaatattccaaataattctttacatatagttgtcattgaacaaataatac

SEQ ID NO: 41686 - DNA, 201 bp, Homo sapiens
ttatataaagaggacaaatccaattcagtagctgttaaaaaacccattcatcaaaaagcattcctaaatgtttgaaacacactgaatcatagattttattrctattcagtagtacaatgacttcctcccttctaagaacctattaactactcattgttgtagaattgaacctttcgagggggtatattctttcttaacagg

SEQ ID NO: 41687 - DNA, 201 bp, Homo sapiens
tgggtatataacaaaatgaaggcagaaataaagatgttctttgaaaccaatgagaacaaagacacaacataccagaatctctgggacacatttaaagcagygtgtagagggaaatttatagcactaaatgcccacaagagaaagcaggaaagatctaaaattgacaccctaacatcacaattaaaagaactagagaagcaa

SEQ ID NO: 41688 - DNA, 201 bp, Homo sapiens
gactcagtcctgtgatggtcatcaaaggtgtcagttcctccgaagtgaatccaccatcacctgacagatacatttattgtttaaatgtcatgatgaaagtkcccaagagccccactggtctaaagtgaggtttctcccaggctgagcacattccttaggaaataggaatcctggtccctaatttatgaatatttacaattg

SEQ ID NO: 41689 - DNA, 201 bp, Homo sapiens
gagatctacaaaccactgctcaatgaaataaaagaggacacaaacaaatggaagaacattccatgctcatggataggaagaatcaatattgtgaaaatggycatactgcccaagataatttatagattcaatgccatctgcatcaagataccaatgacttccttcacagaattggaaaaaaaatactttaaagctcatatg

SEQ ID NO: 41690 - DNA, 201 bp, Homo sapiens
gaaagtgcccaagagccccactggtctaaagtgaggtttctcccaggctgagcacattccttaggaaataggaatcctggtccctaatttatgaatatttrcaattgttatcatctgatgaacattttatctattttcttgccttctcccaagacagtacttttgtgccagtttaaaaatgtatgtaattttaaagtatga

SEQ ID NO: 41691 - DNA, 201 bp, Homo sapiens
ggagaaaatttttgcaatctacccatctgacaaaggtctaatatccagaatctacaaagaacttaaacaaatttacaagaaaaaatcaaacagccccatcraaaagtgggcgaaggatatgaacagacatttctcaaaagaagacatttatgcagccaacagacacatgaaaaaatattcatcatcactgacgatcagaga

SEQ ID NO: 41692 - DNA, 201 bp, Homo sapiens
tacgaaaattagctgggcatggtggtgcatgcctgtaaacccagccactcgggaggctgagacaggagaattgcttgcttgaaccagggagttggaggttkcagtgaaccgagattgcgccactgcactccagcctggcaacagagcaagactccatcttaaaaaaaaaaaaaaaattgatgtctatgcactgataaaaca

SEQ ID NO: 41693 - DNA, 201 bp, Homo sapiens
aaaaaaaaaacaaaaacaaaaacaaaaaacaaaacaaaaaaaaacttagaggagttgaggaggcagacatttggggcaagagtattataggcagaaggagktgtaagtacggagaccatgaggaagttctcttcctgtaataagccaaagagaggctagtgggtgataaggtcagtgagaaaatgtatattgtatgaaatt

SEQ ID NO: 41694 - DNA, 201 bp, Homo sapiens
tgctttctattaatagctttcaagagtttttctaaataaccttcaggcacaggcattttttttttttttttttttttttttgcaagaaagcaggtggaggraaaaaagacctgtggtttgttaaccaataaatgctaagttgctaaatcttcctgtttcaaataaatcagttgggccaattagaatatttattttcttcct

SEQ ID NO: 41695 - DNA, 201 bp, Homo sapiens
ttttaaacacagtcagaatactgagatttactctgcaggaaaacagagcaacaggtaaaaataataagaggaattaatttcactctgaaatgacagcattrtgccttttgactattgactttttgcagagaacatttcactggagggaactgacaactcttactagctgcctgcaaagcttgcctcctccttgctaaggag

SEQ ID NO: 41696 - DNA, 201 bp, Homo sapiens
agtgtgatgttccctgccctgtgtccatgtgttcttattgttcaattcccacctatgagtgagaacatgtggtgtttggttttctgtccttgtgatagttkgctgagaatgatggtttccagcatcatcgatgtccctgcaaaggacatgcactcatctttcttatggcgtcatagtattccatggtgtatatgtgccacg

SEQ ID NO: 41697 - DNA, 201 bp, Homo sapiens
atgcactcatctttcttatggcgtcatagtattccatggtgtatatgtgccacgttttcttaatccaatctattattgatggacatttgggttggttccargtctttgctattgagaatagtgtcacaataaacacacgtgtgcatgtgtctttatagtagcatgatttataatcctttgggtatatacccagtaatggga

SEQ ID NO: 41698 - DNA, 201 bp, Homo sapiens
gcgttcctatttctccacatcctctccagcatctgttgtttcctgactttttaatgatcaccattctaattggcatgagatggtatctcattgtggttttratttgcatttatctgatgaccagtgatgatgagcatcttttcaagtgtgtgttggctgctgcataaatgtcttcttttgagaagtgtctgttcatatcct

SEQ ID NO: 41699 - DNA, 201 bp, Homo sapiens
acaacaggtgctggagaggatgtggagaaataggaacacttttacactggtggtgggactgtaaactagttcaaccattgtggaagacagtgtggtgattmctcaaggatctagaactagaaataccatttgacccagccatcccattactgggtatatacccaaaggagtataaatcatgctgctataaagacacatgca

SEQ ID NO: 41700 - DNA, 201 bp, Homo sapiens
ttcagttataatggtacttgaagaaaccttagaaataatctctttatgttatagctatctatctcatattcattttataaacaatgaaataggtgagggattttttttttttttttttttgaggcggagcctcgctctgtcgcccggtctggagtgcaatggtgccatctcggctcactgcaagctccgcctcccgggttc

SEQ ID NO: 41701 - DNA, 201 bp, Homo sapiens
ataggctttgaggaagaataatgttctctgcttctgtaccaagattagagtttgtttcagatatagctgatgagtaatggatgaattgtacaaaaaaaaamaaacaaacaaaagacttaggctgtcattaactgtattcagcacaagggaaaagctcttcagaaggatggttggactttaatctacttgttcctaatacaa

SEQ ID NO: 41702 - DNA, 201 bp, Homo sapiens
aaagctaagattctgtgactcaatgatttatagtaggaaaacttcgttcctattgtctaaccttccccaccagctcaagcaattcacaaagtacttataartcataaaccagctgttttggcccttgagttgtaatatgtgacaaaaatatcattttttggaaagtgtaatctctgagaatagtttagaaaggtgaaggga

SEQ ID NO: 41703 - DNA, 201 bp, Homo sapiens
attccaaccatttttcacaattgagccaaccatagcctttgaactcttggtaacttttatgctcatgtcttctctccctctcactatatatatatatacayacacacacacacacacatttatagaagaggtatttgcctacatataaaaatgcatacatatataaattagttgttctaaacaaggtaaatttgtgcctgg

SEQ ID NO: 41704 - DNA, 201 bp, Homo sapiens
aaagtgtaatctctgagaatagtttagaaaggtgaagggaaaaaatttataaaacaaaagaggtgttttatgattaaaaagaagttatgatcatataaaartattgctagtcaggaatttctgacactgtcatctctccacagctgaggatctttcagacttttagaacatcaggcctttaaatcctcaatggacaaatgt

SEQ ID NO: 41705 - DNA, 201 bp, Homo sapiens
tacatttctatagtgcctactgggcttggtacatagtgagtaatcagtaattgatagatattattcagagtcatgatacaatgataccacaaaataatcgktatctttttcttcctattctctattgatgatctatgtatataacatccattttcctgtcttatattgtacctgagtcagaataaaatggatcttttcagg

SEQ ID NO: 41706 - DNA, 201 bp, Homo sapiens
agctaacttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcat

SEQ ID NO: 41707 - DNA, 201 bp, Homo sapiens
ataatgctatatatgttaatgtgctccaatgttttccaaagcatgtttacgtctagtatcttggtacttttcctaattgagatctgagcttattacttccrttttatatatgagaaaactgcacaaaattacattacaagccaatgacagtgtttaggccagaatccacagctccaggtctagtccagtaatttctctact

SEQ ID NO: 41708 - DNA, 201 bp, Homo sapiens
gctaacttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcatt

SEQ ID NO: 41709 - DNA, 201 bp, Homo sapiens
caattacaatgagtattcttttcattttggatcttagcaaagacttttgccactgtgtggctgtgtgacagctgctgtacacccctccagtggtggttgaygtgatttctgcacctgtcttatgcttaaaaatattggggggagaaaatggacccagcatgctggaaaatattgacttgtttcccatattaggcttagctg

SEQ ID NO: 41710 - DNA, 201 bp, Homo sapiens
aaataaatattctgaacaaacagcaggtcaagtaatccagtttcctttttgggaaaaaaataaatcacattcaggattaatggagaggaacaaaagccaatagtgtggttaagaatttggattcaggagcaagaaagacttgggttcaaattccatttcatgccctatctctgtgatcttcaatatattacttaaaatttc

SEQ ID NO: 41711 - DNA, 201 bp, Homo sapiens
ctaacttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcatta

SEQ ID NO: 41712 - DNA, 201 bp, Homo sapiens
aaatattctgaacaaacagcaggtcaagtaatccagtttcctttttgggaaaaaaataaatcacattcaggattaatggagaggaacaaaagccaatagtrtggttaagaatttggattcaggagcaagaaagacttgggttcaaattccatttcatgccctatctctgtgatcttcaatatattacttaaaatttctatg

SEQ ID NO: 41713 - DNA, 201 bp, Homo sapiens
taacttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattat

SEQ ID NO: 41714 - DNA, 201 bp, Homo sapiens
gcaagaaagacttgggttcaaattccatttcatgccctatctctgtgatcttcaatatattacttaaaatttctatgcccagtttccctatccggaatatgagtaaacagtacctatctcatagatttgtcgtaagaattaaatacgttaagggacacattattgcaatgcctcaaacatagtaagccatttaaaagatat

SEQ ID NO: 41715 - DNA, 201 bp, Homo sapiens
ttgctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttgg

SEQ ID NO: 41716 - DNA, 201 bp, Homo sapiens
cctgtaaaatttccctgaaaggaagataattatagatataagtaaatataattcaagttagaaaattttaatggctatagaagtaaaataataataatatmcaattagagttgaatggggaagaaaaatgcttttggttgtatcagaaaatagtttatgtaagagttaaatttggttataaaatataatttgtcaaaaagc

SEQ ID NO: 41717 - DNA, 201 bp, Homo sapiens
aaaggctgtctgaaataccatggtacagttattctatggagtattatgtagcctttaaaaataaatgagggagagtcatctgttgttctacaaacaaagasatgatactacagatgcataaaacacctggataaaatgagaacactatatatcatatcattttgattatacttcagagactgagaaaggaggacaagtggt

SEQ ID NO: 41718 - DNA, 201 bp, Homo sapiens
tgaagaaaactacccaaaaacaagtattatgcattgtggtgaggtctctaattcttaaaatgtctttgaaatatatcagttttaacctgtgatttatggtkgtttaattgctgtcacagtgtcatagcaaaaggttaatgttggagctgaacagatcttgtttaaatcctgtttcaaaactggctctattatttccaactt

SEQ ID NO: 41719 - DNA, 201 bp, Homo sapiens
tcaaagataccagatacgattacattggtacttaacaacattcatctggaaagaattgaaaggaggagggattaattaatctccttgaagggggtttactrttaagttaaattgcatttcctctggttctctgcttttggtgcaaaaatttgaaggatgaggaacaactaataggttttctctctttaggatttctaagct

SEQ ID NO: 41720 - DNA, 201 bp, Homo sapiens
caaaatacaaggccatatagaaacaatttttctttgaccattatggattgttggttatatagcatgatatcattgcccaaagatagtcagtattcaaagtytgttatctgtaacaataagaattactatgtcatcatgtggttggaggcattgagataatatagataaagtaaattgccagattcttgatccacacctgtt

SEQ ID NO: 41721 - DNA, 201 bp, Homo sapiens
aaacttatattttgctgtgtgtataacaattaccttgtaacaccaaaaaaaaaaagtgaagaaattactatttagtgtttgaaaactattatccaatttartaaaaagtagcttatgccatgattaagttctggcatacatctttattgttttttgttggtcttactcattaaggtaaacaaacatattaaccaacatcca

SEQ ID NO: 41722 - DNA, 201 bp, Homo sapiens
cccccgtctctactaaaaatacaaaaaattagccaggcgtggtggtgggcgcctgtagtcccagctacttgggaggttgaggctgcagaatggcatgaacmcaggaggtggagcttgcagtgagctgagatcgcaccactgcactccagcctgcgcgacagagcaagactccatctcaaaaaaaaaaaaaaaattgtgtta

SEQ ID NO: 41723 - DNA, 201 bp, Homo sapiens
ttccaaagccaagtgtgtagattttcaggtccataactcaagtttgcattttctgtgtcagttttctaactctatatatcagggaataggaacatattttrcatatctgacttgatgaaggttaatttttgaggaaacaaagaaaaataagataaatttacatggcccagtttacattaattgtttttacatgaatcattt

SEQ ID NO: 41724 - DNA, 201 bp, Homo sapiens
acagttctagttccttgtagtgaagaattatatttagtcatcaaaacctcggtgttatgtgtttttgttgcaattgaggtgtcattcttttactgttactmgctaagaaatattgcattatgaaaaataatacctcttattcaaatataagatcaagaatattttcttatcatttttcattccagttcagtatctcttctt

SEQ ID NO: 41725 - DNA, 201 bp, Homo sapiens
acaaagaaaaataagataaatttacatggcccagtttacattaattgtttttacatgaatcatttacatggcttctagaattgggacacagtccaatatamaatatcagcttatataacaatccaatctttgggtctgattctatttcacctacaggaatgaacagatttatggcttttcctggaattaaatataactttc

SEQ ID NO: 41726 - DNA, 201 bp, Homo sapiens
tttactgttactagctaagaaatattgcattatgaaaaataatacctcttattcaaatataagatcaagaatattttcttatcatttttcattccagttcrgtatctcttcttacattaagaattctagttctccaatacaacaatatctttaaacattcactctatctacaatcacacaaaatattttcagaatcatttt

SEQ ID NO: 41727 - DNA, 201 bp, Homo sapiens
tggtggccttgtagacatcttttctttatgtgtcttccaggctgagcttctggctatttgaagtttcatactcaaactgctaaagggaaagacttttacartttcagatagtcactaaccaatgtagaatgttatcttatccaattacaattctctggaattaagtttggaaatggtccaataatgaaagaatattgtgta

SEQ ID NO: 41728 - DNA, 201 bp, Homo sapiens
gctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtc

SEQ ID NO: 41729 - DNA, 201 bp, Homo sapiens
ctaaatcaatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtct

SEQ ID NO: 41730 - DNA, 201 bp, Homo sapiens
tataaaacaaaagaggtgttttatgattaaaaagaagttatgatcatataaaagtattgctagtcaggaatttctgacactgtcatctctccacagctgargatctttcagacttttagaacatcaggcctttaaatcctcaatggacaaatgtggccttactggcctatgctggcattgaaacagatgggtcggggaagt

SEQ ID NO: 41731 - DNA, 201 bp, Homo sapiens
aatctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgt

SEQ ID NO: 41732 - DNA, 201 bp, Homo sapiens
tctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgtgt

SEQ ID NO: 41733 - DNA, 201 bp, Homo sapiens
gatgtctggtgagggcccactttctggttcatagataatactttctaactgtgtcctcacatggcagaagagataaacatgctcccttgggacctctttcwtaaagccactaatcccattcatgagggctctgctctcattaaccatccacctcccaaaggtcccatctcctaataccatcaccttggaggttaggattta

SEQ ID NO: 41734 - DNA, 201 bp, Homo sapiens
ctctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgtgtt

SEQ ID NO: 41735 - DNA, 201 bp, Homo sapiens
accaagtgggcataatttgagaatttcgagaagagccctctccctaaaatatacagtgatgcactacaataacaatgttgtggccaatgagggactacatrtatgatggtgatcccacaagttatgatattgtgtttttatcctaccttttctatgtttagatatgcgtagctacacaaataccattgtgttacaaatgcc

SEQ ID NO: 41736 - DNA, 201 bp, Homo sapiens
tctgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgtgttt

SEQ ID NO: 41737 - DNA, 201 bp, Homo sapiens
tgaggagttgctgcttatggatgaacagagaaagttgtctcttgagataaaatcttctcctggtgaagatgttgtgaatattgttgaaataataacaaatratttagaatatttcataaacttataaacttatttgatgaagcagtggcagagtttgagaggattgacttcaattttgaaagaagttctactgtgaataaa

SEQ ID NO: 41738 - DNA, 201 bp, Homo sapiens
tgtaaggtgctatgttttatatacatcatctcctttagctgttacttacctagtgtgtagatatttatagatagatgataaatagatgatagatagatgatgatagatagatagatagatagatagatagatagatagacagatattttcttgtttgttactatacttctttgagcattatttggtctcttttgtgtttta

SEQ ID NO: 41739 - DNA, 201 bp, Homo sapiens
gggaaggaaaagattaataagacatctggagtgagcagaatttgatctattctggaaaagctcagaaattgactggaggacttgggagggaggaagggcawttctcacaaaggaaattgcttgatcaaaagcacagagattgggaagcatgggctactttgagaacctgccagtggtagagcatgggaaagggtagggcaa

SEQ ID NO: 41740 - DNA, 201 bp, Homo sapiens
tattacttcttttagagaatcctagcagtaatatttgaggttatatgtacagttgtgctttgtatagatcctctgtgtaaaactatcatcccagcatctgratcacaatgcatattaaaaacgacataactacactttgggaggctgaggtgggtggatcacgaggtcaggagatcgagaccatcctggctaacatggtga

SEQ ID NO: 41741 - DNA, 201 bp, Homo sapiens
tgagaaacttcaaattcagaaaagccaggaaatgtacctgtgatgacttgattagcaagtgtcaaaggaacttgaatttaggtcttaatttctaaggcccrtattctaccatgcctggctgtgatatttccctcaaatgcaaaagaatcataaattattgttatttagattttattggtagtattaagtatccaaaatcat

SEQ ID NO: 41742 - DNA, 201 bp, Homo sapiens
cccatgctcatcatgagttctgcaaatgagccctgcagactgatatcgtgttctgcagtttatttgacaaatagcttttatggcctttgattttttttcaratcacttataaattctagcaacagacaggttgtttgtcagattcaaattccatacagttgaaaggaaagaggtgaagattcctgcgttcaaagtggactc

SEQ ID NO: 41743 - DNA, 201 bp, Homo sapiens
ttggaaaatacaaactcatttcaatgcaatatatcttgcataagtattgcttacaagactgtggcactgggactatttaactacatgctgtggtagcactrtgtgtactggggttaataaaaatggaaaaaaactcacatgaagtttagagactaaatcccatttcttctctgttttggtaaagcaaagtattctgtgttc

SEQ ID NO: 41744 - DNA, 201 bp, Homo sapiens
gtgaacattctctgttaaaatggagtgagccagaaacaccagttctagaaataagacatacacaagggttaattcttttcaaaatgctgcttttaccccatttttttttctccccattgttgcaaattgtaaacatctttaaaagatttcaggactctttgtgtttggttaaggttccaacaggtggaagatatcttccaa

SEQ ID NO: 41745 - DNA, 201 bp, Homo sapiens
cttgtagacatcttttctttatgtgtcttccaggctgagcttctggctatttgaagtttcatactcaaactgctaaagggaaagacttttacagtttcagwtagtcactaaccaatgtagaatgttatcttatccaattacaattctctggaattaagtttggaaatggtccaataatgaaagaatattgtgtaaaatcag

SEQ ID NO: 41746 - DNA, 201 bp, Homo sapiens
ttatgaaagaagttttatcttaaaacaaatgcgacattaatggaatcagtaaagggtcttatacaataggtattatattaaaccggagttcaagcttcacrttgattgtggtatttaaatttcaatgggttgattatgtatgagaggaaaatgaccagtattatgaatgcactaaaacggacaaggaaggatcttgccagc

SEQ ID NO: 41747 - DNA, 201 bp, Homo sapiens
ctgacctttaaaatgagaagtttaggctgagttatttctggattgctactagctagaagaatctgtgactttgagttgggtcataaaaaaaccttttcttyttccttttttttttttgaaaattgatatatccacaactagtaggaagacaaactgattacaggagaataattgagaactaaaattataacgtgtatatct

SEQ ID NO: 41748 - DNA, 201 bp, Homo sapiens
actctatctacaatcacacaaaatattttcagaatcattttaccagtaccattaccatgtaaagttcaagattcttttgttataatatttccaaccaagartgtacagagtactgtgatcaaaatttccttgacttaaatctttgtttttctctgttaataactattaggatcaattcttatttttatatttaatttatgg

SEQ ID NO: 41749 - DNA, 201 bp, Homo sapiens
acagtgtttcccaagatgatgaaaaaaatgagactgtccatgcttcaaatgcaaattagggccaagttcagtggctcacgcctgtttgggaggccaaggtsggcggattgcctgagctcaggagttcaagaacagcctggccaacatgatgaagcctcatctctactaaaatacaaaaaattagctgggcatgatggtgcg

SEQ ID NO: 41750 - DNA, 201 bp, Homo sapiens
attcattcttggtagcagtttaagatttgaagaacttttgagtaatacaggacttagagcttagagtaaagttgtacttctactttgtggtatttatgccrtcagagaattcaggaatgcgctaaatggcaagtttgagaactttattggttaacattcatatcaccaggatttctgttcttcacatcccatcacaattgc

SEQ ID NO: 41751 - DNA, 201 bp, Homo sapiens
tagaaaaatatggctgcttcctccagtgatctagtgctcagaaatctagctactgagttaggggattagagctctggtcctcactctgccaatgtctcackgtgtcaccttgctagggtcatttaatgtctcttagcttcagtttttctgacctttaaaatgagaagtttaggctgagttatttctggattgctactagct

SEQ ID NO: 41752 - DNA, 201 bp, Homo sapiens
ttatttttatatttaatttatggtttgctgtcttaaaaatgtgtatttattttgtgacattttgacctttatatgaataaaaaatcaccacagatacaaaygcatgcttgcacaagtctgatacccattcttaattctttcatccattcacacctgcatcttgtagttaaccattttggttaatgactaattatctaccct

SEQ ID NO: 41753 - DNA, 201 bp, Homo sapiens
cagtgtttcccaagatgatgaaaaaaatgagactgtccatgcttcaaatgcaaattagggccaagttcagtggctcacgcctgtttgggaggccaaggtgkgcggattgcctgagctcaggagttcaagaacagcctggccaacatgatgaagcctcatctctactaaaatacaaaaaattagctgggcatgatggtgcgt

SEQ ID NO: 41754 - DNA, 201 bp, Homo sapiens
tacactatccagatgaaataacataaaagtgttggagcaagtgtctaggaacacactacttcaatacgtattagcttgttgatggtgagtaagtcaatgarcttctctgaaacttagtttcctaatctacaaaacagaaataataaaccctgacttgtttactttctctgagtttcagatgaaataatgtgcataaaatac

SEQ ID NO: 41755 - DNA, 201 bp, Homo sapiens
tttagtagagacagggtttcaccatgttggccaggatggtctcgaactcgagacctcacgatcctcctgccttagcttcctaaagtgctgggattacaggygtgagccacagtgcccggccgattctttgtatttctatggagtcagtagtaatattcccctttctgtttctgatcgtgtttgcttggatcttctgtcttt

SEQ ID NO: 41756 - DNA, 201 bp, Homo sapiens
gatacacagtggacccttaggacgtaatatcttgcacatgtatgtgtgtagcagggtgtcttttatagatctgtgaaagccaacactcaaaacagcatctrattatctacttaatagctaacctgacaattgtatgtgagtacacataataggtacaaaagctggctattagctcgactgtagaaggcaggaaaagtgggg

SEQ ID NO: 41757 - DNA, 201 bp, Homo sapiens
ggccaggatggtctcgaactcgagacctcacgatcctcctgccttagcttcctaaagtgctgggattacaggcgtgagccacagtgcccggccgattcttygtatttctatggagtcagtagtaatattcccctttctgtttctgatcgtgtttgcttggatcttctgtcttttcttttcattagtctagctagcagttta

SEQ ID NO: 41758 - DNA, 201 bp, Homo sapiens
aaattcatcaactgtattctgtcatgtcattttgttgttgttgtttcatgttatagagaagtagacatccccttattcatggttttgattttcatggtttmacttatctgtggtcaaccactgtctgataatattaaataagaaattccagagttaaacaatttataagttttaaatcgtgcactcttctgagtagtgtga

SEQ ID NO: 41759 - DNA, 201 bp, Homo sapiens
tgtcttttcttttcattagtctagctagcagtttatcttattaatttttccaaaaaaaaaaaacagatcctgattttgttgatgttttgaatggtttttcrtgtctcagtcttcagttcagctctcactttagttatttcttgtcttctgctagctttggggtgggttttctcttgcttttctagttcctttaattgtaat

SEQ ID NO: 41760 - DNA, 201 bp, Homo sapiens
agtgatatcagtaaatatgataacaggactactatatttttagctggcctaagagtcagaatcccctagagggtttgctaaactattgattgctgggcccsaggcctaaagtttcccattccttgggtctgactggggcctgagaatttgcatttctaaacaagttcccaggtgatgatcatgctgctggtccaggcgcca

SEQ ID NO: 41761 - DNA, 201 bp, Homo sapiens
gaccataattgaatgattaattacctcatacctgtcccattgtacttattaagctttcagagatacttcctccacagattgctaattatagcacccacagygggtggtggtgggggtgtgtcaaaagtatcacttccagggttcatagcagatggaaacacaccattcatcatccagtattaactttcttcatctgaaggc

SEQ ID NO: 41762 - DNA, 201 bp, Homo sapiens
tcaccgtgttagccagcaggatggtctctatctcctgacctcgtgatccatccacctcggcctcccaaagtgctgggattacaggtgtgagccaccgcgcmcggccattttcccccttttctacactctaccctggacagaagtcactatgtagcccacagttaaggagtggaagttattttccgctccttgagggcaggc

SEQ ID NO: 41763 - DNA, 201 bp, Homo sapiens
gggaacactttctctccatagtcctaacggctatcaaatgtgcgcttctccccttcatgcttttctgatactttgttgactgtggagaatttattcaggcwccatttccaatttatttaatgtacaaagacttcatagcttttcatttttcagtgttaggcagatttcctaagttcatctaagttactctgctcttcaacc

SEQ ID NO: 41764 - DNA, 201 bp, Homo sapiens
ttggggtgggtctcaggattcccctttaacaagccctccctcctaggtgaatttgatgtatgctaaaatatgataatcactgctctaagaaagagctaggwgattgagggaggagaaactatgtttaattaactgtatcatgaccataattgaatgattaattacctcatacctgtcccattgtacttattaagctttcag

SEQ ID NO: 41765 - DNA, 201 bp, Homo sapiens
ttatatgcaaatttaaatcaaaccttagtggaaagaagtctgtaacagtactcttgctgcttcttctgaaaacagagtataaggtagggaaaccttggaaygcctgctggcactggtcagcaagaagtcttatgctctcagcacatttaatggccctcctcttgtgtatcccatttgaagaaacttttgactaagggagca

SEQ ID NO: 41766 - DNA, 201 bp, Homo sapiens
tttttctctagtacaggtgttgtcaaaatgtggtccttagatcagcagtatcagcatcacctaggagcttgttagaaatgcaaattatctggccccacccsctagcctactaaatcaccctcttggggtgggtctcaggattcccctttaacaagccctccctcctaggtgaatttgatgtatgctaaaatatgataatca

SEQ ID NO: 41767 - DNA, 201 bp, Homo sapiens
ccatgtgaagatgtgcttgcttcccctttaccttccaccatgattgtaaggttcctgaggcctccccagccatgcctcttacacagcctgtggaattgtgwgtcgattaaacatcttttcttcataaattacccagtctcaggtagttcttcatagcagtgtgagagcagactaatacatacagtatgtgtttttatttag

SEQ ID NO: 41768 - DNA, 201 bp, Homo sapiens
ccatggtccaataggactttgatgcagtctagtcctgcactcagagagctctacacaagtgcagctcagagcttttgactcaaagtagctgaatataaggmgccaagcatctccctttgaaaacatctccaggtgttcaggggaaatggctaacattgtgaatggaagggtaatatggggaagacggttacttgcagaatc

SEQ ID NO: 41769 - DNA, 201 bp, Homo sapiens
aatatagatcatggttgaaatatttgctacagaattggcaaatgctacaaatcattgactactttttgttttcttcctggaaagccagttattaaacattyaccagcacaccagtggtccagtacctaaaaaattaatttaattgttttttttttctctagtacaggtgttgtcaaaatgtggtccttagatcagcagtat

SEQ ID NO: 41770 - DNA, 201 bp, Homo sapiens
tattgttgctttaatcaaatttattcctttttattactgaatcatatttcattaaatgggcataccatttgttaaataattcatctgttgattaagatttragttgttctcactactgggatattacaaataaatctgctataaatatttgtatacaagtctgtgtgaatatgtgtttctattcctctttggtaaatacta

SEQ ID NO: 41771 - DNA, 201 bp, Homo sapiens
aaaagaatgtaggctatatgaaataaggaagattcagacctttaaaacaaagtctgtctgggtacagtggcttatatctataatcccagcactttggaagsctgaggcaggtggaatggttgagctcaggagtttgagacaagcctgggcaacatggtgaaacccccgtctctgtaaaaaacagaaaaattatccgggcat

SEQ ID NO: 41772 - DNA, 201 bp, Homo sapiens
tttttttcctttcatcttttcttattggaacttatttaaaatttctgagtgtttcactctaagagcatgcattccatatttaaaaaggaactgggttattygctacatgccacatagtgggtttgtcacatttgatatctgaactcttcctcagatggaatcacttatattttactttaggagccccactgcaggactcgc

SEQ ID NO: 41773 - DNA, 201 bp, Homo sapiens
ggttctgttgtcatctactgattcttgctggtttcttcacttcatcctgttgagaccaggaataagtcctgctggtctcctacctcactataaccttgctrcactccattgggttgacgagtcttttgtggatttcttgggatttctatgtagatgatcatatcacttgtaaatagggacagttatatttcttcattttaa

SEQ ID NO: 41774 - DNA, 201 bp, Homo sapiens
tattggctagcagtatttatacccacttttaattacatgcatgttaaggagtgggttactcagaactctctagaaaacggccagtaacttctgggtgttgytgggcatttgtaaactgtcagggcactggtgggagtgtcttatgctgatgagcagtggggacacctagaggttggttctgttgtcatctactgattcttg

SEQ ID NO: 41775 - DNA, 201 bp, Homo sapiens
atccacagtagcagcatgtggactattggctagcagtatttatacccacttttaattacatgcatgttaaggagtgggttactcagaactctctagaaaayggccagtaacttctgggtgttgctgggcatttgtaaactgtcagggcactggtgggagtgtcttatgctgatgagcagtggggacacctagaggttggtt

SEQ ID NO: 41776 - DNA, 201 bp, Homo sapiens
ggaggctgagccaggagcattgcttgaatttttggggctgcaccactgctctctagtctgggcaacagagcaagcctccatctcacaaaaacaaacaaacaaacgaacaaaccataatctaatttaattctaccaacaacctttgtaacaagcattttaatgatcattacagattaggaaattgaggctcagagagtaagc

SEQ ID NO: 41777 - DNA, 201 bp, Homo sapiens
ctgatctaagttttggtaaaatgctctgagatattcctggaacatgagagtgtgggaggctttgaagagcctaccccctctacctatcttccaaggaggcygccatgagacagttactcatcacttcatgggttttgaagaggcctgaggctctctgcctctctgttatttgggcacaactgcaaagtataaagctgctta

SEQ ID NO: 41778 - DNA, 201 bp, Homo sapiens
ggggtttctgggcttatgataaacatcttccctgcatgtctctagagaggctatttggccaaggcttaactacagctgatctaagttttggtaaaatgctmtgagatattcctggaacatgagagtgtgggaggctttgaagagcctaccccctctacctatcttccaaggaggctgccatgagacagttactcatcactt

SEQ ID NO: 41779 - DNA, 201 bp, Homo sapiens
acatacaattgttttgtgtgatcaacatttttcactccctaaggtctctctaatcccaggagaggggtttctgggcttatgataaacatcttccctgcatrtctctagagaggctatttggccaaggcttaactacagctgatctaagttttggtaaaatgctctgagatattcctggaacatgagagtgtgggaggcttt

SEQ ID NO: 41780 - DNA, 201 bp, Homo sapiens
gaaaccccgtctctactacaaaatacaaaaaaaattagccaggcatggtagcgggcacctgtagtcccagctacttgggaggctgaggcaggagaatggcrtgaacccgggaggcggagcttgcagtgagccgagatcgcgccactgcattccagcctgggcgacagagcgagactccgtctaaaaagaaaagaaaaaaga

SEQ ID NO: 41781 - DNA, 201 bp, Homo sapiens
aaatattccttgtaagtacacaataggtctttctaagtcttttctcacaacaacctgttagaaaatataatagaagcaaagatctcagttacaaaactgarctccttctaaataaaactttagctccttctaaaaatctttgtatggttctcttcctcacttatacaggtctctactcaaagttacctcctcagagagacc

SEQ ID NO: 41782 - DNA, 201 bp, Homo sapiens
gaggcaggagaatggcgtgaacccgggaggcggagcttgcagtgagccgagatcgcgccactgcattccagcctgggcgacagagcgagactccgtctaamaagaaaagaaaaaagagaaaaaaaaaaaggaaaactctttctactagtctatgctgtcttccagttacttgacagctgtgttagtgggcctatttgatcc

SEQ ID NO: 41783 - DNA, 201 bp, Homo sapiens
caaaaagtaaaactatctgattttcaggtaagaaaattgcagaatttattttaaacaatatttagtgactaagattgctgcatgttattgaaaaatgggtrgaaatctattctcaattaataaaataaaaattataaagcagcagacatgcagtagtttacaaagatgaaagtgtgcaagtacattgctcagtaatatagg

SEQ ID NO: 41784 - DNA, 201 bp, Homo sapiens
gttcaagacgagcctgaccaacatggagaaaccctgtctctactaaaaatacaaaattagccaggtgtggtggcacatgcctgtaatcccagctacttggwaggctgaggcaggagaatcgcttgaacccgggaggcagaggttgcagtgagccaaaattgaaccattgcactccagcctgggcaacaagagtgaaactcc

SEQ ID NO: 41785 - DNA, 201 bp, Homo sapiens
gaaaaatgggtggaaatctattctcaattaataaaataaaaattataaagcagcagacatgcagtagtttacaaagatgaaagtgtgcaagtacattgctyagtaatatagggtctgatttgggagaaattgcaaagatgacagctgttgaagaagacaaatcaaggagagaagtgcctgaaataaagagtcaggaatttg

SEQ ID NO: 41786 - DNA, 201 bp, Homo sapiens
gacatgactttgttccttcttgccttgattgccatgtaagacatgattgtgaggcctccctagccctgtgaaactgtgagtcaattaaacctctttccttwataaattacccagtctcaggtatgtctttattagcagcgtgagaacaaactaatacaaggggattctctaaaaatggtagacagtcacctgttggctcag

SEQ ID NO: 41787 - DNA, 201 bp, Homo sapiens
acatgactttgttccttcttgccttgattgccatgtaagacatgattgtgaggcctccctagccctgtgaaactgtgagtcaattaaacctctttcctttwtaaattacccagtctcaggtatgtctttattagcagcgtgagaacaaactaatacaaggggattctctaaaaatggtagacagtcacctgttggctcagt

SEQ ID NO: 41788 - DNA, 201 bp, Homo sapiens
ctacatgatagagggatgagaaattgactgagtttaaaaaaaaaaaagttcagtgtttttatatatagatataatgctttaaaagttttcaaatgctgaayaaatttagtaagatgagggccaggtgcgatggctcatgcctgtaatcccagcactttgggaggccaaggcgggtggatcatgaggtcaggagttcgagac

SEQ ID NO: 41789 - DNA, 201 bp, Homo sapiens
gaaacagtttgctgatcccccaactcccatcctaatttaggtgatcatattggttagctccatgagctctttttaagttgtctttttgccccttcttcatrgcatactgttactctcatggatgtgccattttttctcactgtgaggatattatttgcagtttttttttttttttggtggtatactgcttgctgcggtgcc

SEQ ID NO: 41790 - DNA, 201 bp, Homo sapiens
tgattgtaagtttcctgaggcctccctgccagacatgcagaactgtgagtcaattaaacctctttcctttataaataacccagtctcgggtagtatctttrtagtagtgtgtaaatgaacgaatacaactttaaaaataactacattgagaagaaactctggagtcctaggatcaaatcctgttatttttgcaaaaccaag

SEQ ID NO: 41791 - DNA, 201 bp, Homo sapiens
aagacttcactttaagccattgcctttcctataatgaagatatacaaatgattagatatgagagtaacttttattcatagatttcctctttcccaaacagrtggaaacccttattttcaatgtacagatattgaataatgtaaagctacatgatagagggatgagaaattgactgagtttaaaaaaaaaaaagttcagtgt

SEQ ID NO: 41792 - DNA, 201 bp, Homo sapiens
tttgtgtccgaaggtagtgatttatttatttatttatttattttgagatggagttttggtcttgttgcccaggctggagtgtaatggtgcaatcttggctyaccacaacctccacctctgggttcaagcaattctcctgcatcaacctcctgagtagatgggattacaggcatgtgccaccatgccctgctaatttttgta

SEQ ID NO: 41793 - DNA, 201 bp, Homo sapiens
atttatgtttgggcatagacaatattgagcagcttattgtgacattaatagactatcaggctcagttatttttatttttattatttatttatttttttatrtggggtttcactgtcacccaggctgcggtgcagtgacgccatcttggctcactgcaacctttgcctcctgggctcaagtgatcctccctcctcagcctcc

SEQ ID NO: 41794 - DNA, 201 bp, Homo sapiens
ttccttctgtttttaggccaaacactactccaccattatgtgtatataccatgtttttctttatctagtcatgatcaatgggcaattaggtgcttgttatrtcttgactattacgaatattgctgcaattaacatgggagggcagatatctcttcaagatcttgatttcaattttttaaaaattatgctttaagttctagg

SEQ ID NO: 41795 - DNA, 201 bp, Homo sapiens
aagcttaatgtgggctgctgacaggaaacccattttgcaaaactgcttcttcttgaatggcaattgaatcaactcactgttatcaagctttaagtgagtgrgtccttgcagttgccaaaattgaataggaaatgctttaattttgttctggctgtggtccaacaacaagagagacttctcaagtgtggaattacggagctg

SEQ ID NO: 41796 - DNA, 201 bp, Homo sapiens
ttaaaaagctgtttctaatttcctgagaagttaacaatctataagagatttgtgatctaaaattgtattcagcatgttgaataaaggatatgctgacaatwcaaagttttctgaaatagatattcattatctttcctgataccttgctaaacctatcataaaattctaaagttaataaaaatgactgaaattttataaata

SEQ ID NO: 41797 - DNA, 201 bp, Homo sapiens
gcaattcctgcttgagaccttaagtatgatgagaacttgagactgcttttttggattttggtcacaaacagaagtaataaaaacactttgattcaatgtgwctttggcaattacggctctgtatgctaattaaatttctaaataaggtggcttaagggacacttaaagtagtgatattcaaagtgtggtccccagaccagg

SEQ ID NO: 41798 - DNA, 201 bp, Homo sapiens
tgttttaggtcacaagatattaagggcagcgtttgaccttgaatctggatagtcaatcctagatattatgttctaccatagttccagccttatgttgtaakaagttttgcaagtcacttaccatagattttctgttcctaatttggaaataggatataaactcacagctctgtctcagagcatgtttagtaggtgtgctta

SEQ ID NO: 41799 - DNA, 201 bp, Homo sapiens
aggtgggcaaatgtattatacatatgctgtccaagcctatgatagttatctctaactgatgaaggcattttatttatttatttatttgctgaatttagacktggcttcaccatcttccccaacatagctcttcaggcatccactatttatctttcagaattgtcaagtacattaaaacctatttatcatcaaagcactaat

SEQ ID NO: 41800 - DNA, 201 bp, Homo sapiens
tatgtttcaatcaactgaactcaacagatttaccgaatcttcactagcgttgagatctctcagtgttgaggaggtgtttgatccagcctaatgtttgtcayagccttattatgttttcagtttaagcatcaattcataaaaactgaaaattcaaaggatttacaaaaattatcagttttacttacttctcatcttcatttt

SEQ ID NO: 41801 - DNA, 201 bp, Homo sapiens
attgatttgaattttttttttttttttttttttagacagagtctcattctgtcacccaggctgcagtgcagtggcatgatattggctcactgcaacctccrcctcccaggttcaaatgattcccttgcctcagcctccctagtagctgggattacaggcacacgccaccacacccgtctaattttttgtatttttagtaga

SEQ ID NO: 41802 - DNA, 201 bp, Homo sapiens
tcatcaagtaggtaatcagcagtggtcactgacaaatgtcacagaataaagagaatcagatttgaaaggctcagctctaaaaagcaaaccaaggttcagcyactcatttaaaaccttctgtggccctttggcattatcacagaccattctatttgatactttcacaactttcaactattttaaatatcaaacttctctgtt

SEQ ID NO: 41803 - DNA, 201 bp, Homo sapiens
gttgtctatgtataattttctggggacattaagtactattttggattccagactagatagaacagataaaaatttttattattatgaagtttttgtgtctwtttgctttgataagagatttattggattgtatttcactaggttgcatggttagtaattctgtatacttttatgccttctctgtaaggtactcatattcat

SEQ ID NO: 41804 - DNA, 201 bp, Homo sapiens
agtggagaaagaagaggaaaagcaacaaacagaaataaacttttgccacaatccagctaggtctgtgggctaagctcttacccaaagcatcttagtgtaaytgagcctcacaacaacttttgggattaggtattattatccgaattttattctgagggaaacaaactttaaaagagaacacatattgcccataatcactca

SEQ ID NO: 41805 - DNA, 201 bp, Homo sapiens
ggggtgtgtgtgtgtgtgtgtgtgtgtgtgtgtgtgtgtgtgagagagagagagagagagagagagagagagagagagatggcttcttggaagaagaaatrcaggatctaagtccttaagttaagggtaagccagagtctgcctgacattatccataatgtgaaggaaataacagttgaaaaaatattccatctaattcag

SEQ ID NO: 41806 - DNA, 201 bp, Homo sapiens
aatagatcacagtagggacaccagacagccttcagttgcaaaacaacagggcacaagaaagagaatttgattaactgaatttgttcaaatgttatagggcytggtgatataacaaggagggaaattgcaaagatgctttctcaagaatactgtgacaagaatgcacaaaaaggctaataatgcgatatatgattgtataga

SEQ ID NO: 41807 - DNA, 201 bp, Homo sapiens
gatacaggtttgcaaagggtgtaaatgcagtactgaggaaggacttccaacctataccgaggggtgtgtgtgtgtgtgtgtgtgtgtgtgtgtgtgtgtgwgagagagagagagagagagagagagagagagagagagatggcttcttggaagaagaaatgcaggatctaagtccttaagttaagggtaagccagagtctg

SEQ ID NO: 41808 - DNA, 201 bp, Homo sapiens
gggcacaagaaagagaatttgattaactgaatttgttcaaatgttatagggcctggtgatataacaaggagggaaattgcaaagatgctttctcaagaatrctgtgacaagaatgcacaaaaaggctaataatgcgatatatgattgtatagaaattacatcgtaatgaacttgtgctattaatacctaagaagaaagaat

SEQ ID NO: 41809 - DNA, 201 bp, Homo sapiens
gactaggtttcattttgtttctctgattttacaaagtttcaggtacatcaggtgctgagaatacaaagcaaataaaatataggtgatatgatacaggtttrcaaagggtgtaaatgcagtactgaggaaggacttccaacctataccgaggggtgtgtgtgtgtgtgtgtgtgtgtgtgtgtgtgtgtgtgagagagagag

SEQ ID NO: 41810 - DNA, 201 bp, Homo sapiens
aatgcacaaaaaggctaataatgcgatatatgattgtatagaaattacatcgtaatgaacttgtgctattaatacctaagaagaaagaataaattgtcctragataatagctgcatgtagttgcagcaaagaaggattgcaaagagatcaacacggagataaaaaatagcacattgaaggctttggcgagaggggggatgt

SEQ ID NO: 41811 - DNA, 201 bp, Homo sapiens
tattcataagtcttaattctgtgctttgtggaaacaaacaagcaacaaaataggacagagagagagagagaacaaatatgaaattgaagatgtatcttaakttttaaaaaagagaacagccttgactattattttgatatacagaccttgggaaattctacattgaaagcaaataaattagaatttcgaattcatgtattg

SEQ ID NO: 41812 - DNA, 201 bp, Homo sapiens
cacttgtatccccaaagctattgaaataaaaaaaatatattaagttgagaccttgtgcactaaaacaaatactaggctaattcttgttaagcactttgacmtgtatttgcaaaaatgacaaggaagacatgtccctgcctcacagaatagacaattcaacaattagctgcctaattcagcgatgatatattaaagtataat

SEQ ID NO: 41813 - DNA, 201 bp, Homo sapiens
caatcatccatttgaatgaattggaaggaaagctaattaaattgatgaatacttgttttagttttaatccctttaagaatatataaaaactgcaactattrtaactcctcagacactgtgtagtggagttttaattaatagataaggatgatctctaattagctcatcaaaatactttaaacagtatcaaccctacatata

SEQ ID NO: 41814 - DNA, 201 bp, Homo sapiens
cactttacgttcccacgaacagtgtacaaagcttcccgtttttccatggccttgcccatacttcttatctcttgtctttttggtaacagccatcctaatakgtgtaaggtaatatcttatcgtggctttgatctgcctttccttaattagtgatgttgagcattctgtcatatatctgttagccatttgtcttcttttgag

SEQ ID NO: 41815 - DNA, 201 bp, Homo sapiens
ataaatttgcctttctcatttaagatcttaaccatttgtatttttttgtatattgagataagacttttatttttattcacttcatatgcctaaccaattayataaaaactttttaataataattgtttaaataaaaaagtttttttacccataatgatgtgcagagccagatacataatcaagtataaatgcattgtctgt

SEQ ID NO: 41816 - DNA, 201 bp, Homo sapiens
atttttttgtatattgagataagacttttatttttattcacttcatatgcctaaccaattatataaaaactttttaataataattgtttaaataaaaaagtttttttacccataatgatgtgcagagccagatacataatcaagtataaatgcattgtctgtgtaaaaatttgtcttttgttccaatagactatatgtctg

SEQ ID NO: 41817 - DNA, 201 bp, Homo sapiens
cttgacatttgaaaccaatgaccaatatatcaacattcttataatttatttaatgcagctactttttccaaaataagttcatttaacataagcattgtcartcatccatttgaatgaattggaaggaaagctaattaaattgatgaatacttgttttagttttaatccctttaagaatatataaaaactgcaactattata

SEQ ID NO: 41818 - DNA, 201 bp, Homo sapiens
ctcacatgttttgatattctattgtaatctatggcttgtggaaactgatttgaagaagaaaaaacaactttagtccttaccaaattttacctagaatcctytggatttctattccctaagaatgtaatataagataaatacactgaaaaatatctaattttaaacagatgcagagagtcacattctgtttctactattctt

SEQ ID NO: 41819 - DNA, 201 bp, Homo sapiens
cagattggtttcttcctgattcttcatgcctatttcttattcctgcctttcgttgtttttcctttttgtagtaattcttttcatctgattgtgtctatatmttccattacaatactaatatattatttgaaaggttgatgtgtagattaagaaagtagcagctgggcatgatgtcttacacctgtaatcccagcactttgg

SEQ ID NO: 41820 - DNA, 201 bp, Homo sapiens
tcttaagaatttttcatagaagccactgcttctaatgttgtggaaactaccctgaaactgctctgcatcttgcattagtgttctgctgcgtacagttctcrgacaatccagttcattcggaatgccgctgggtgaaaacctcaccactgtttagtgacaagatagatccctgaccacgaaatctactggtggcaacattat

SEQ ID NO: 41821 - DNA, 201 bp, Homo sapiens
ataattggattttattcacttcctgcattggggctccctagcaactactatgtggaatccctctgataactgctcagtcatgataatacatatacaacctyatatgaggcacgaaccccacatagagcaactcttgaccaataaccctattctgtttctaagatggacaatttggaaatgcattttccacagaacctgaaa

SEQ ID NO: 41822 - DNA, 201 bp, Homo sapiens
tactgtattgtattccttgctttctgtttctctgccaatctacatccacgtccttttgcttacacagggtattgattttccgacctctgtctctgtctagrggagagagttctggaaaatccttttggtctgtttagtctgggagagaagtacctgtacactaagtgactctttgctctggatttgactagcccctctttc

SEQ ID NO: 41823 - DNA, 201 bp, Homo sapiens
attgatctactattgcaacagccagcattatagagtcaatattataaattgctgtactagaaagatggtttgttaaactgaagaccacaaaccttaaaatyagatgtatttaaaccttgcaaatttctacacgtccccatcctacaatcttctatcaatagcaaaattggcttgttgattaccatttagaaactacctggt

SEQ ID NO: 41824 - DNA, 201 bp, Homo sapiens
tttcaatcccttcatgagctactgtattgtattccttgctttctgtttctctgccaatctacatccacgtccttttgcttacacagggtattgattttccracctctgtctctgtctagaggagagagttctggaaaatccttttggtctgtttagtctgggagagaagtacctgtacactaagtgactctttgctctgga

SEQ ID NO: 41825 - DNA, 201 bp, Homo sapiens
tcaccaatgatgaagtatattttagagtgagagaaggtataggcatcaagtatatttttgcaacaattagaacttctgtgatttaagcctaaatctctctyctcttccattgatttatagagtagaacgttggtattcaaaaatgcccgttttccaccttataacatggacaaaaaaaccaaagttctatatctttagtag

SEQ ID NO: 41826 - DNA, 201 bp, Homo sapiens
gcctttacacatatgcaaatgctttccagttgttcatctcaaactttgcctgcttgttaaagaaatatgcagtttgcctttggagtgacaggggtctgggwttgaatcctaagaactactgatcccctgtgatcgtgagcccgtaaacccccctgagcttggttttctcatttataaagtgaagatgtcaggttttggacc

SEQ ID NO: 41827 - DNA, 201 bp, Homo sapiens
gagtgagagaaggtataggcatcaagtatatttttgcaacaattagaacttctgtgatttaagcctaaatctctctcctcttccattgatttatagagtasaacgttggtattcaaaaatgcccgttttccaccttataacatggacaaaaaaaccaaagttctatatctttagtagtttataatgccaccaaggcatgaa

SEQ ID NO: 41828 - DNA, 201 bp, Homo sapiens
catcttccgttagtgaatatagaatattttaggttctgtttctgaatgaaaatgctgataaatactgcactccctttctcaccaaatcaacgttccaaaarcaattcatgaaatgagaaaggaatgaaaaaaattgcctgaagacccggatggttgaaaagaatgagaaataaaagggtcatgtccttctctgttagtaag

SEQ ID NO: 41829 - DNA, 201 bp, Homo sapiens
atgtactagataaaaaagagtaaatatttatttttgtgactttaggatggtaaaggatgttccaaatgtgataccaaagaccaaaaacaaaagaaaagggrcgcgaactttactgctgagaatacaaaataaaaaaggtaaacccaagcaaacaaaacacaaaataaagacaaacatccatttgaggagataataatcaca

SEQ ID NO: 41830 - DNA, 201 bp, Homo sapiens
aggctactctgttagcaaataatgactaatgctaaacagaaacatgaaaaggatacactactttcactcaggtattgactaagaataaccaaggaatagamcataccctgtaattgaactgcctaatgaatattatttggaaaaaccataaactactcaaaaagaacaagagtagtcattcggatttaagaaagtgcctaa

SEQ ID NO: 41831 - DNA, 201 bp, Homo sapiens
agataataatcacaaattatataagaaaatgtttatatattcatagaaatagattttcacaaattaataagaagaaatgactcctcaccccactttccacscctggccaacagaaaactgggcataggccctattacaaggtattcataaagaatacatgtacatttatagtaagtatgttaattgttgtcccatctcatc

SEQ ID NO: 41832 - DNA, 201 bp, Homo sapiens
ttgtgatctttagacttgcatggtttgtggtcctacaaaataaatgtaaatattatcttatacctttacttgttctcattccacccctttctataccacccaacatgttcttcctatttgaaaccaggtttattataaatgaaatatatcaattagaaggaaggacacttaaccattcaaaaagttagggccatagtagag

SEQ ID NO: 41833 - DNA, 201 bp, Homo sapiens
tcgaactcgcgacctcaggtgatccacctgcctcggcctcccaaagtgctgggattacgggcgtgagccaccgcacccagcctatatatcacatttttatktatcagttttagtccattaccatatctttgccaacacttggtatcttttgcctttttgacaatagccattctaacaggtgtgaggtgatatctgctgtgc

SEQ ID NO: 41834 - DNA, 201 bp, Homo sapiens
  misc_feature (1)...(201): n = A,T,C or G, or insertion/deletion polymorphism (see Tables 1-2)
ttgaaagcttaactaattgaagccttacttttaatttccttttgtgctcatttatagacatggcttcatctatatcctgtctcagtactaagataggctcntgtgtcagctgctgcctcttgagcagagggtcttatttctagtgcctgaatggaattttacttggaaaagccttgtctactgctatgggcctttctaatc

SEQ ID NO: 41835 - DNA, 201 bp, Homo sapiens
gagtagctgggattacaggcgcctgtcaccacgccaggctaattttgtatttttagtagagatggggtttctccatgttcgtcaggctggtctcgaactcscgacctcaggtgatccacctgcctcggcctcccaaagtgctgggattacgggcgtgagccaccgcacccagcctatatatcacatttttatttatcagtt

SEQ ID NO: 41836 - DNA, 201 bp, Homo sapiens
aacctatgattttcccttcccattatacatttggaatagctgaataatataattatagaatcaccttatcttgaagtcagatgagactttagcattttttrtagaaacttagcaggttagataaaccttgattttgagttatgactcaaattactataactttgtgaattttgagaacatatttatcagctcaaaggctct

SEQ ID NO: 41837 - DNA, 201 bp, Homo sapiens
caaatacctggcccatgatcacaattttggcaactgctaaaaccggaaaaatgtttgtagtcttatgttactttatcttcaaaaaagttagacttgtgtcwtgaagagtgagttggggttaaagtaattgggttaatcagaaatctttacaaatctatttcagcaacatttacttgaaaaagaagaaataataagttggag

SEQ ID NO: 41838 - DNA, 201 bp, Homo sapiens
actcaagtcagcctccctgaaaatttggaggctcagtttttttttttttcttttttgagacagagtctccttctgtcgcccaggctgcagtacagtggcaygatctcggctcactgcaacctctgcctcccaggttcaagtgattctcctgcctatacttcccaagcagctgggactacaggtgcatgccgccacacctga

SEQ ID NO: 41839 - DNA, 201 bp, Homo sapiens
attattttaaattgttattttatttattattctgtctcagcatttatgcccggcttgcaaggatggaaccagggggtggttatgtggaatctgtagatccrtctttttcaatgattaacctatttcaaggatgaatttaaaataaataaatttatttttatctcttatgtgtgtataggactggattccttccaacccccc

SEQ ID NO: 41840 - DNA, 201 bp, Homo sapiens
gaagtttctttccatgtatatagtcccataattttcccagaaattattttaaattgttattttatttattattctgtctcagcatttatgcccggcttgcraggatggaaccagggggtggttatgtggaatctgtagatccgtctttttcaatgattaacctatttcaaggatgaatttaaaataaataaatttattttt

SEQ ID NO: 41841 - DNA, 201 bp, Homo sapiens
gaggcttagacctcctcactgctgagaaaggaggactttgcaccttcttagcggaagagtgttgcttttacactaaccagtcagggatagtacaagatgcygcccagcgtttacaggaaaaggcttctgaaatcagacaacacctttcaaactcttataccaacctctggagttgggcaacatggcttctcccttttctag

SEQ ID NO: 41842 - DNA, 201 bp, Homo sapiens
taatgtgatgttttgatatatgtatatattgtgaaatgattgtacaatcaaacatatctatcccctcattttgtgtgtgtgtgtgtgtgtgtgtgtgtgtggtgagaacatttacaatctgttctcttagcaaatttcaagtatacaatatgttattattaactatagtcaccacgctatacattagatctccaaaactta

SEQ ID NO: 41843 - DNA, 201 bp, Homo sapiens
  misc_feature (1)...(201): n = A,T,C or G, or insertion/deletion polymorphism (see Tables 1-2)
ctcagtactaagataggctcatgtgtcagctgctgcctcttgagcagagggtcttatttctagtgcctgaatggaattttacttggaaaagccttgtctantgctatgggcctttctaatccagatgttccccctccaaattcacattcagaagacaagaagaattatgttttgtttatttaatgttggtgtgtgttctga

SEQ ID NO: 41844 - DNA, 201 bp, Homo sapiens
tattctaaggctcaatcttggaatctaatagagacaagggattctttgcaagctcttctatcttaattcttcacatattgccttactttgtgaattctcaygagcagctcaaggagggctttgtcactttctgctggaagaatgcttgatgattcttatcttgtcagatgagtccagaaggtctttgttcctgggaccagt

SEQ ID NO: 41845 - DNA, 201 bp, Homo sapiens
ataatgtgatgttttgatatatgtatatattgtgaaatgattgtacaatcaaacatatctatcccctcattttgtgtgtgtgtgtgtgtgtgtgtgtgtgtggtgagaacatttacaatctgttctcttagcaaatttcaagtatacaatatgttattattaactatagtcaccacgctatacattagatctccaaaactt

SEQ ID NO: 41846 - DNA, 201 bp, Homo sapiens
tataatgtgatgttttgatatatgtatatattgtgaaatgattgtacaatcaaacatatctatcccctcattttgtgtgtgtgtgtgtgtgtgtgtgtgtgtggtgagaacatttacaatctgttctcttagcaaatttcaagtatacaatatgttattattaactatagtcaccacgctatacattagatctccaaaact

SEQ ID NO: 41847 - DNA, 201 bp, Homo sapiens
atataatgtgatgttttgatatatgtatatattgtgaaatgattgtacaatcaaacatatctatcccctcattttgtgtgtgtgtgtgtgtgtgtgtgtgtgtggtgagaacatttacaatctgttctcttagcaaatttcaagtatacaatatgttattattaactatagtcaccacgctatacattagatctccaaaac

SEQ ID NO: 41848 - DNA, 201 bp, Homo sapiens
atgttaggtagaaagtgtgtggcggtcctttgaccctcacgtgaaaccaaggaggttgtggcaatgataattaggaagaaatactcaagtgggaggtgaayctggagaagactagcataggctgcttggtccagttgcgttacccctgtggagtttgtcttagcaagaatattttattgagacatcaggatccatttaaac

SEQ ID NO: 41849 - DNA, 201 bp, Homo sapiens
aaatagagtcatataaaaagaaaacacaaaaactcattgctgctttcaaaaatgaaataacatctctatggacttgaaatagaacataaacataaaatgtyaggcaagaccaaagtcatcaactagtggggcacacttctgcaagcagcctagaaactggctcccttgtggatgtagggaattaaaatatttcatgcaaga

SEQ ID NO: 41850 - DNA, 201 bp, Homo sapiens
ttactcctcactaagaagatctctagcaaagagaaaaaaaaatagttttagactttcctttagggaagggactctttttcttcaggaaaatatgctgcacygtgttgggagatgagactctgatggatgaatatatatatgacaatacttaaaaagtgtgcttagaaaatatgcagtattttgctgcaggagaacacacag

SEQ ID NO: 41851 - DNA, 201 bp, Homo sapiens
cttccagacaatgtggcagagtaagttcacaccatgacaagaatgctgtgtttcaaatatagaaaatagagtcatataaaaagaaaacacaaaaactcatygctgctttcaaaaatgaaataacatctctatggacttgaaatagaacataaacataaaatgtcaggcaagaccaaagtcatcaactagtggggcacactt

SEQ ID NO: 41852 - DNA, 201 bp, Homo sapiens
aaagtgtgcttagaaaatatgcagtattttgctgcaggagaacacacaggaaagatgagaaaaggacagatggggcccatctaagaagacaggatgccaaygactgaaaatggtagccaccatgaagtaaattattctgtatttgctgacatacatatgacaattcaggtgcatattttacattgtttttaattttttatt

SEQ ID NO: 41853 - DNA, 201 bp, Homo sapiens
tatattcaaaatatagttggtcaccatgttttctgtataattttatttctggcttcctgtcaatttggaatgatagatatagccctgaaaagacttccagrcaatgtggcagagtaagttcacaccatgacaagaatgctgtgtttcaaatatagaaaatagagtcatataaaaagaaaacacaaaaactcattgctgctt

SEQ ID NO: 41854 - DNA, 201 bp, Homo sapiens
gtgcaatagcgagatcttggctcactgccacctcagcctcccgggttcaagcgattctcctgcctcagcctccagagtagctgggattacaggcacccacyaccatgcccagctaattttttgtatttttagtagagatggggtttcaccatgctggtcaggctgatctcgaattcctgacctcaagtgatccgcccaccg

SEQ ID NO: 41855 - DNA, 201 bp, Homo sapiens
taaataagaaaattttaaatatatttgttattagacccagcattactataaggatttcacatatcctaatatattcttcacagccaacttctgagatgagyattattttaatgatgaggaattgaagcacttgggtaaagcaattcaaaggaactcaaaagatcaaacaacaaaactaccattcaaatgcaaacggtttgg

SEQ ID NO: 41856 - DNA, 201 bp, Homo sapiens
atagcgagatcttggctcactgccacctcagcctcccgggttcaagcgattctcctgcctcagcctccagagtagctgggattacaggcacccaccaccawgcccagctaattttttgtatttttagtagagatggggtttcaccatgctggtcaggctgatctcgaattcctgacctcaagtgatccgcccaccgcagcc

SEQ ID NO: 41857 - DNA, 201 bp, Homo sapiens
gacataatggctttattattctctaattgttttacatttatacccttaccaactcaaaataaaatttatacatgcaggacatatgtactgagcactttttrtatctcctacagaatctggtaccattttgcactaaggtaaataaataagaaaattttaaatatatttgttattagacccagcattactataaggatttca

SEQ ID NO: 41858 - DNA, 201 bp, Homo sapiens
agccactgcacccagccaaagtgcagtgctttaagactattcaattttgttccttctcaaatgttcacctataaattttaatctccatcaatgaaccttgycaaagaataattactgtggtgtttgcctaacccatgattttctactttgctcacttcttctatatttattagttggagttttaaggaagagctgtccctt

SEQ ID NO: 41859 - DNA, 201 bp, Homo sapiens
tcactaaaaccatgtacagagcctgactagatcattcctgtttcaaattaaaagatgcttataggcaaacttgaacttgcctgggcataaaattaggtttktggctcattaaattatgtgtaactatctcaaaaaatcttgcctatatatgatttccattttgttattaccccaaagaagaaccacagttccctattgaaa

SEQ ID NO: 41860 - DNA, 201 bp, Homo sapiens
aattgttacaatctcagtgaagaacaaaataacaatatgtggcacctgggttatgttgccaggaatccccctctaggtttattgaagaaacttgtgcacayattcataaggaaaacccggtacaagtatgatcattatagagttttttttttccatcaatggggaaatgagcaaatagcagcaaacacagtagttaagaca

SEQ ID NO: 41861 - DNA, 201 bp, Homo sapiens
gaaaatgttaattatataatttatttattcatgtactcatttattaacaaatatttggtgagcacctactaggtgataggactgttttaaagatagaacarccagtagaacagacaaaactctctgcatccttagagctcacattcttttacaattggaagaattgaataaattacatattttaaatgttttgaatagtgt

SEQ ID NO: 41862 - DNA, 201 bp, Homo sapiens
ctacaatcccaaatagactcttcggcagcagtgactctccaaaactgccgaggcttagacctcctcactgctgagaaaggaggactttgcaccttcttagyggaagagtgttgcttttacactaaccagtcagggatagtacaagatgccgcccagcgtttacaggaaaaggcttctgaaatcagacaacacctttcaaac

SEQ ID NO: 41863 - DNA, 201 bp, Homo sapiens
tgtgctgtgaacaagttctacgtgtttttaaaatgcatctaggagttacattgtcctaaaaagtctaactcatagaagcagggagtagaatagtggttacyaaggactgctggtaaagggagaggactggggagatgttggttaaaggatacaaaatttcagttaaatgggaggaataagttcaagagatctattatacaa

SEQ ID NO: 41864 - DNA, 201 bp, Homo sapiens
gagctgaaggggctttaggctggtgagaacagcatcaatcttgctatccaagtgggtctagataggaaatttgaaaacaggaatcatgtatctgattttaygagttgttgttgcaatagacttagggacttagaaagcatcctggggaattttaacaaaccggtaaaaacctttgcttggagaatggctccagagcctgtg

SEQ ID NO: 41865 - DNA, 201 bp, Homo sapiens
aggatattttatagattagatgaaggattacagggaaattttctccttgccacacagcacgttcctacctaccaatgagcccaagacatgttcctgggcawtgtgagagaacaaagatttcagctagagctgaaggggctttaggctggtgagaacagcatcaatcttgctatccaagtgggtctagataggaaatttgaa

SEQ ID NO: 41866 - DNA, 201 bp, Homo sapiens
ggagattgttaatcatttcctgaaaaaatgattttgataaaattaaactgagtatctattatgtgcaagacagtatgctggggaatgaaagaaaatacaawgaagaaaaatacacagaatttgctttgagagaactcacaatctggtgtatatgaatcagatttcaaaagaattgtatttgtcacgtaaacaaaatctttt

SEQ ID NO: 41867 - DNA, 201 bp, Homo sapiens
aaaaatgcagatctttgtgtgctcctgatgtgctttgactttttattgagtagctcagggagctttgtaaatacaaatctctctgactcctgatatgggamtacttggtttcctgtttcatggtactaagtatttttgacatcatggacactttactaccagaagtcttttgaaattattttttgcctcaagaaggggact

SEQ ID NO: 41868 - DNA, 201 bp, Homo sapiens
tgaacaatgagtaaaaggtagtggaagagattacttgcaaaagaactgtggtggtggagatcaaatgaggattggtggaagcgattgacaatggtttttgrattttctgaaaaagagattgaccacttctaaattagaattagcaatgttattcccttattgtggagtgttctgattataatatcacattgacctttagtg

SEQ ID NO: 41869 - DNA, 201 bp, Homo sapiens
aagcattgtgaatgttttcattgttataatttatttataacaatataaaatataaattaaaaataaaattataacaatttatttataattattataaatamatttataatttaataaataaataattccctttccttgagtgacaagggaaatggttgaggtcatacaagtttgccttgagtttatctcacataaacatcg

SEQ ID NO: 41870 - DNA, 201 bp, Homo sapiens
aatcccatctcttagggaggctgaggcaggtgaatcacgaggtcaggagttcaagaccagcctggccaacatggtgaaaacccgtctctactaaaaatataaaaaattagccaggcatggtggcaggcacctgtagtcccagctactcgggaggctgaggcaggagaattgcttatacctgggaggcagaggttgcagtga

SEQ ID NO: 41871 - DNA, 201 bp, Homo sapiens
gtggcaggcacctgtagtcccagctactcgggaggctgaggcaggagaattgcttatacctgggaggcagaggttgcagtgaaccgagatcatgccattgygctccagcctgggcaacagagcgagactccatctcaaaaaaagaaaaaaaatttcctcattgtattttactatttctggatgtatattatttttattttt

SEQ ID NO: 41872 - DNA, 201 bp, Homo sapiens
ttccctaccacataaaccaaatatactctcagtggatttggaatttatccagaattatgtgtacttcttccattctggttgaagtaaaaatagaaagtgtaaaaaaataaaaatcagtcttggttttgattttgcttaatcattcaacatagatataccttaattattaactacaaaagttaggtatgcatcccctgcatt

SEQ ID NO: 41873 - DNA, 201 bp, Homo sapiens
acgcttagaatgtttcagtaagatattgctcttacagtgcattagataaatgcagtttcattaacaaattctaaaaaaaagacaagtcttaggttaagtckctattacaatgtaataataatgtcaataaatatttccatcttacatttgaacagtaattttgagttccacagtcctttcacatacaatacaggtattcct

SEQ ID NO: 41874 - DNA, 201 bp, Homo sapiens
tcctctttcaaactatagggaaattagcctaatatcaagcatgatttggcctattgccatggcttcaactgtcatcccaatgcaaatgtttaccaaatccttctctctctctctctctctctctctctctgtcctgactgtctaataggtatctggacttgaaacttacctgaaactcaacgtgaatagactcttattaac

SEQ ID NO: 41875 - DNA, 201 bp, Homo sapiens
cctctttcaaactatagggaaattagcctaatatcaagcatgatttggcctattgccatggcttcaactgtcatcccaatgcaaatgtttaccaaatccttctctctctctctctctctctctctctctgtcctgactgtctaataggtatctggacttgaaacttacctgaaactcaacgtgaatagactcttattaacc

SEQ ID NO: 41876 - DNA, 201 bp, Homo sapiens
gattttaaagatcaaaatagatgtgagtggggtgagtgtgattccatcgataaaataataatttagaattcaaattatgaaggcaggatcaactagttgtrgatgagcaacagcaaatggactagtcatgcttaagtaaagttatgacctgggagttagataagccagtgctacaccgagtgcccacagcatgaatatcca

SEQ ID NO: 41877 - DNA, 201 bp, Homo sapiens
ctcatttttcacgagtgaacataagaaacaatgggaatgtgcccttcactgtcagacaagtgggaggatccagcgccctctgtctcatatcactaaaaccrtgtacagagcctgactagatcattcctgtttcaaattaaaagatgcttataggcaaacttgaacttgcctgggcataaaattaggtttgtggctcattaa

SEQ ID NO: 41878 - DNA, 201 bp, Homo sapiens
taagggccactgggagagtttgggatatttccattggtaataatgcaaagtggactttaaattaggtcatgtctctgattctgtatttctcatttttcacragtgaacataagaaacaatgggaatgtgcccttcactgtcagacaagtgggaggatccagcgccctctgtctcatatcactaaaaccatgtacagagcct

SEQ ID NO: 41879 - DNA, 201 bp, Homo sapiens
agctcataaggtgaaatatattttatctgcaagaatttggtgtttgttttcacagcagcatttttaaaacaatatttaagggccactgggagagtttgggwtatttccattggtaataatgcaaagtggactttaaattaggtcatgtctctgattctgtatttctcatttttcacgagtgaacataagaaacaatgggaa

SEQ ID NO: 41880 - DNA, 201 bp, Homo sapiens
taggaccatgcttcttctgacagttctaggaaagaattcttccttgaccctccctagcttctggtggcttccggctctgcctccgactttacatggccttmttctctgtttctgtatgtctctctgtttcctctcctctgcttatgagtaaactagtcactggatttaggacccactccaatccagtatgacctcatctag

SEQ ID NO: 41881 - DNA, 201 bp, Homo sapiens
tcttttcctctgagtttggaggccggaagtctgaaattaaggtatctgtaggaccatgcttcttctgacagttctaggaaagaattcttccttgaccctcyctagcttctggtggcttccggctctgcctccgactttacatggccttattctctgtttctgtatgtctctctgtttcctctcctctgcttatgagtaaac

SEQ ID NO: 41882 - DNA, 201 bp, Homo sapiens
tgatttatattactcagtgcaaaaaaacatgctctcatatcttcaaatttccatacacagcttttactcatggctatgtaagaatgttgaaagtaaaaaaatttaagctttcaaaagatttcaaaatctacattcaataaatcttagcagtcatattagtttcctagggctgtagtaacaaagtactacaagcttggtggc

SEQ ID NO: 41883 - DNA, 201 bp, Homo sapiens
aaatgcattttgcatagtttaggaatgcggatcatgtgtaaatttttacattgactttccccatgtgtctggtttgatttatattactcagtgcaaaaaaacatgctctcatatcttcaaatttccatacacagcttttactcatggctatgtaagaatgttgaaagtaaaaaaatttaagctttcaaaagatttcaaaat

SEQ ID NO: 41884 - DNA, 201 bp, Homo sapiens
catttcttcccctatattgttgtttttcttctttatttcttgattaactctttagttagaatagtagctaaatgcattttgcatagtttaggaatgcggaycatgtgtaaatttttacattgactttccccatgtgtctggtttgatttatattactcagtgcaaaaaaacatgctctcatatcttcaaatttccatacac

SEQ ID NO: 41885 - DNA, 201 bp, Homo sapiens
atggttgtcttattatttaagaatagtagtcaaaatacaatggtattaagaaactgatcaagtaaaaaaatcatataggatacactaccacacacaagcayactcctaaatctgaggccacacaacactatgcattggttaacaaaacacatcctagcatgattaaggcatatagaatagcaaagctttttgccctataaa

SEQ ID NO: 41886 - DNA, 201 bp, Homo sapiens
tttcttatatttcacatactctacccagcttgaaaaaaaatggttgtcttattatttaagaatagtagtcaaaatacaatggtattaagaaactgatcaartaaaaaaatcatataggatacactaccacacacaagcatactcctaaatctgaggccacacaacactatgcattggttaacaaaacacatcctagcatga

SEQ ID NO: 41887 - DNA, 201 bp, Homo sapiens
aacaggtttttttctttttgagagaaaaaaactcaaagcaggttatcagattccgcaaatattccatgtagatctgattgctatactttgactttttttawagtggatatggaaaagacttacgtaaagttaaggaatataatgagttggaagaattcacacatgaagaccatcccttttaaaagataaagcctgagaggg

SEQ ID NO: 41888 - DNA, 201 bp, Homo sapiens
acaagtcagattcctttggtataaatacaatgttggcttaagagaaaataattgaagccacacctatacaatgatgagatttgaacaggggataacaatarggaggcacctgagcatccctgtagattctccattgaaatcaccaaattgatgcagacaaatgggctaaaatagttgattattattaacaggtttttttct

SEQ ID NO: 41889 - DNA, 201 bp, Homo sapiens
caaagtgacatctgtagtctcagcaacttaaagtttgcttgcaatgattagttttcctttcccaaccctctgaaataaggtcttctcaagctttaggatgygttcaacattaagtcttcagttaagacatcttgcctatattggaagagaagggattttataggttaataggctgcatggtataaggtgggaaagggtaat

SEQ ID NO: 41890 - DNA, 201 bp, Homo sapiens
aataaataattcaccacactctatctacttccttctgctaaggtaattagcaatatgtgcaagagagtagctgttcaatcagtgtgggctccagaattagragaaatcaagtatattctccagacaacccaaaatggacaactagagagagcaagaaaaacaaaacaaaaagctctgttgttataagtcactgcaatttaa

SEQ ID NO: 41891 - DNA, 201 bp, Homo sapiens
ctcctcttggttgaggtgatgagtggtcgtgtgacgtgttttgttaatgaaatgtgaaagtgacatttgtgactcctggctagaagatttaagagccaatwaataattcaccacactctatctacttccttctgctaaggtaattagcaatatgtgcaagagagtagctgttcaatcagtgtgggctccagaattaggaga

SEQ ID NO: 41892 - DNA, 201 bp, Homo sapiens
cagacttatgccacccaagatgatctcttagaagtccccttagctaatcctgaccttaacctatataccgatgaaagttcatttgtggagaatgggatacraagggcaggttatgccatagtaacagtacttgaaactaagcctcttcccccagggaccagcacccagttagcagaactagtggcacttacccaagcctta

SEQ ID NO: 41893 - DNA, 201 bp, Homo sapiens
actacgctgactagaaccccttttcaagtcatttgagaaatcatgaaaatttccacaccctgaacttggactaagacagtcatgtgttaataatgcccagracaccatgaaaatcccttaaatggaattatcatcccagatctgaaattatttctacaattgttatttaactaatatccaacatataatcagagagccaag

SEQ ID NO: 41894 - DNA, 201 bp, Homo sapiens
cagtgccatgaggtaggttactgttttacagataagaaaaccaagactcaaaaagttataaaattcgctcacgtttctatctccaaattcaaaacctgaayaatctgactacaaaacccaaaatcttcctgctgtgttttgcttagaagatggaacacaaggagtttttattatgaccagcttaataaaaagtagaaatat

SEQ ID NO: 41895 - DNA, 201 bp, Homo sapiens
ctctttcaaactatagggaaattagcctaatatcaagcatgatttggcctattgccatggcttcaactgtcatcccaatgcaaatgtttaccaaatccttctctctctctctctctctctctctctctgtcctgactgtctaataggtatctggacttgaaacttacctgaaactcaacgtgaatagactcttattaaccc

SEQ ID NO: 41896 - DNA, 201 bp, Homo sapiens
tctttcaaactatagggaaattagcctaatatcaagcatgatttggcctattgccatggcttcaactgtcatcccaatgcaaatgtttaccaaatccttctctctctctctctctctctctctctctgtcctgactgtctaataggtatctggacttgaaacttacctgaaactcaacgtgaatagactcttattaaccca

SEQ ID NO: 41897 - DNA, 201 bp, Homo sapiens
agtgctgctgtctttgtaacagcgattgagtgtgggaactcacactattttcagtagggcttctcctcaccccctccttcttctctctctacccacagtgyttcctgagacactctcattggaacagagttgaaaaccactgttaaaacaacttctcagacaaattaattatgaccggatgataaaactctatttccaaca

SEQ ID NO: 41898 - DNA, 201 bp, Homo sapiens
tcagtagggcttctcctcaccccctccttcttctctctctacccacagtgcttcctgagacactctcattggaacagagttgaaaaccactgttaaaacawcttctcagacaaattaattatgaccggatgataaaactctatttccaacatgctgcaaggaaataggctttagaaaaagtaaatttaaatatgtcctctt

SEQ ID NO: 41899 - DNA, 201 bp, Homo sapiens
cttgaggccagtctaatctcctagaagaggtcataatctcatgaaagtctattagaaaggtgcttgatttttttcttgtcaagaatgctgatgaccgggcwcggtggctaacgcctgtaatttcaacactttgggaggcagaggtgggcagatcacgaggtcaggagttcaagaccagcctggccaatatgttgaaacccc

SEQ ID NO: 41900 - DNA, 201 bp, Homo sapiens
tgtaatttcaacactttgggaggcagaggtgggcagatcacgaggtcaggagttcaagaccagcctggccaatatgttgaaaccccgtctctactaaaaayacaaaaaattagccgggcgtggtggcaggcgcctgtaatcccagctactcgggaggctgacgcaggagaattgtttgaaccctggaggcggaggttgcag

SEQ ID NO: 41901 - DNA, 201 bp, Homo sapiens
gttaaaaattttaaacatattcattcattcatttattgctatttgcatttggtgttaggtttcctctccccaactccctacccttgttgattgaattttattttttttattgtagaatcttaaaaagtttacagaagtcaaaaatgtacaaaaactactctgagacaaatctatcttctcatatcccttctaccttactct

SEQ ID NO: 41902 - DNA, 201 bp, Homo sapiens
tttggagcttttcagttgttaacaaaaccaaaatcacatttaaatgcaagctggacatgtttcattgtacctactctttgcttgattttacatattaattmattcattcattcattcatttaatcacttaattcattcgatcatttatttactgcatgccaacctatgcacttaggatataaacaaagaaaagcttcaagg

SEQ ID NO: 41903 - DNA, 201 bp, Homo sapiens
attccttttcactaattttttttattatagagaaaacatcttactaaaaggaagtttacaatatttttattatttctataaggcagaattactacttttarctaaattttcttctgtttagcaactcaattgctttctttctttaaatatctttgtgtttacaattccaactgttttacacaccaattcctttttgtaatg

SEQ ID NO: 41904 - DNA, 201 bp, Homo sapiens
cagaaggcaaaggggaagctggcatatcacatggcgtgtgtgtgtgtgtgtgtgtgtgtatgtgagagaaagagagagagaggtgggtggggatgccacacacttaaacagccagatctcatgagaactcactatcatgagtagagcaccacgcggatggtgctaaaccattcaggagaaaccatccccctgatccaacca

SEQ ID NO: 41905 - DNA, 201 bp, Homo sapiens
tgctcggcttctgataaggccatgggaagattacaatcatgacagaaggcaaaggggaagctggcatatcacatggcgtgtgtgtgtgtgtgtgtgtgtgtatgtgagagaaagagagagagaggtgggtggggatgccacacacttaaacagccagatctcatgagaactcactatcatgagtagagcaccacgcggatg

SEQ ID NO: 41906 - DNA, 201 bp, Homo sapiens
ctgctcggcttctgataaggccatgggaagattacaatcatgacagaaggcaaaggggaagctggcatatcacatggcgtgtgtgtgtgtgtgtgtgtgtgtatgtgagagaaagagagagagaggtgggtggggatgccacacacttaaacagccagatctcatgagaactcactatcatgagtagagcaccacgcggat

SEQ ID NO: 41907 - DNA, 201 bp, Homo sapiens
ttgttgtctttgattcagatttcaactgcccagttgatcaagcatggggtgatggtcaagcacggagtgagacttgagcagtcagtaaatgtatctattgyactcattaattggtgtattagtacgttcttgcactgctataaaaaataacggagactgggtaatttataaagaaaagaggtttaactggctcatagttct

SEQ ID NO: 41908 - DNA, 201 bp, Homo sapiens
gccacagtatattctgcaagattaatacattttaacattcttcatgcatctccccagtgtttagcttatattatgtcactgcaaaggagatgataccattyaaatattgctatcagttcatgaataacaatatttatccttttgagaatattcaaatttttgttcctgtacctattgccttttgaaagactagttcttggc

SEQ ID NO: 41909 - DNA, 201 bp, Homo sapiens
ttggtaaattgaaatgatcaatttcactattgagtatatgtgttagaaaatatgccacagtatattctgcaagattaatacattttaacattcttcatgcrtctccccagtgtttagcttatattatgtcactgcaaaggagatgataccatttaaatattgctatcagttcatgaataacaatatttatccttttgagaa

SEQ ID NO: 41910 - DNA, 201 bp, Homo sapiens
atttctagctcatgaaccatacaaaaacaggtggcaggccagatttggccatatggtcagccagacatggtcaaacataattggctgacctctgtcttaawctctaactatagctctcaaagctgctttttattttcttaagagaattatgactagtggtgaatttttgaaatgttacaagggatgaggagttaaattaac

SEQ ID NO: 41911 - DNA, 201 bp, Homo sapiens
aactttatttatggacaataaaatttgcgttgcatacagtgctcctgtatcataaaatagtatatttttaagttttattcaactctttaaaaatgtgaaaaccatttctagctcatgaaccatacaaaaacaggtggcaggccagatttggccatatggtcagccagacatggtcaaacataattggctgacctctgtctt

SEQ ID NO: 41912 - DNA, 201 bp, Homo sapiens
ctgcatggcatgaaaccagccatagacaatagataaatgaaagagcatggccatggttcaataaaactttatttatggacaataaaatttgcgttgcatayagtgctcctgtatcataaaatagtatatttttaagttttattcaactctttaaaaatgtgaaaaccatttctagctcatgaaccatacaaaaacaggtgg

SEQ ID NO: 41913 - DNA, 201 bp, Homo sapiens
cttaattaatttgtatttccttctcagaaattatagataagaactttctttttctctaacgggccagataataaatattttagcctttgtgagccatacaytctctgctgcaagtactgcatggcatgaaaccagccatagacaatagataaatgaaagagcatggccatggttcaataaaactttatttatggacaataa

SEQ ID NO: 41914 - DNA, 201 bp, Homo sapiens
aaaattgcttttgcgtttgattttgaattgtttgaatacttcagacgtgattatttcaattatgtaagctaagctgcatttcaatctgggcacagacttaycatcaaaatgttcctgttgagaagaaccagtttctcttctttaaatttcaagcagttttatatttattgtcatgatctaggacactagtgataatcatcc

SEQ ID NO: 41915 - DNA, 201 bp, Homo sapiens
ctggtgaatataatttttaagtatgaatagaattcaatttttaagcctctggacttaactgttagtaagtctgtaagatggatatagaagtgctgagaatrtatgagtggagcatcagtagtattaatatctgataggcctgaatgtcactggctatactgagcagtccataagtcatttgtggaccttgtaaagaaaagg

SEQ ID NO: 41916 - DNA, 201 bp, Homo sapiens
aagtgttcttctttagaaaacagttttctttattaataagcatccttttgtgtttgtgcacaggcagcatgtcagctgaaacaccaatcacattgaatatygatcctcaggatctgcaggtccaaacattcaccgtggagaagctactggagcctctcataatccaggtattaataccatggaaattatgatatatagtaa

SEQ ID NO: 41917 - DNA, 201 bp, Homo sapiens
cagtagtattaatatctgataggcctgaatgtcactggctatactgagcagtccataagtcatttgtggaccttgtaaagaaaagggccaataaatattayggagtctggcagggcagcaggatgctgtggaagagcttgtaagacaaagtctaaaggtgtcaagacaaagaatctagtacactgaggcttgggaaaacct

SEQ ID NO: 41918 - DNA, 201 bp, Homo sapiens
cttacttagcctcaatttcatcctttgtaagatagacatggtattaaacctacttcaaaagattattatgcttacatgagttaatagaaatgaaatgcttaataaacaataggctataataagaagatagctactactactattattaccacatagagttagtacttactagacctactgaagctacttaatatttttgta

SEQ ID NO: 41919 - DNA, 201 bp, Homo sapiens
gcaaagacattcctggctaaacttcggatccggttatatcccaggtccaaaagttccaggttgcggcagtcttggaatattcgcacagggatggttctcarggagttagaccgtaaatgtaaactcagcagcttccgcaagccccgaaactgttcagatcccagagaatgcagctgattataggacagatccaagttccgt

SEQ ID NO: 41920 - DNA, 201 bp, Homo sapiens
aggcccatgcttctggcatctgtccacttactgtgctctctaactgtgatgctctcttccaagactctgcacaggaggcctcttcaggtcagcttcatccwtgccttatccaacaccctacacagatcctatatagagccacatctaaaaatagcatctcccaccgcagctactcttcatcttcttgctcaattttatgct

SEQ ID NO: 41921 - DNA, 201 bp, Homo sapiens
ggctgaggcaggaggatggcttgaccctggggggtcgaggctacagtttctgccactgcactgcagcctgggtgacaaagtgagaccctgccccccccccmaaaaaatgttatagtgttctgcattaaataaagtggttgatttggtttccaaattggacatttgttcaaaatgtaatcattagaccccaaggaattaagg

SEQ ID NO: 41922 - DNA, 201 bp, Homo sapiens
ttcttcatttcacctagttcaggtgacaagattactctttaaagatgatggcaattgtagaacagcccggatgagactttcttagtgtatgtattagtggytgggttatgggaaaaaaagatcctaaggatagagtttgtggaatgtgccggagtgtattttatgcacattatcctctattatcagtcccttggtgttata

SEQ ID NO: 41923 - DNA, 201 bp, Homo sapiens
gcacattatcctctattatcagtcccttggtgttataagctctaaaaagtcacaaaattatctataaatttaatgattaaagtgtgttttatactgtcttrtattgcaatgtttggaacagaaatcagaaatttaattaaagtcataaaatatagaaagatcccataacaaaaattatttgtaaccttaaaaatggctgta

SEQ ID NO: 41924 - DNA, 201 bp, Homo sapiens
gttttatactgtcttatattgcaatgtttggaacagaaatcagaaatttaattaaagtcataaaatatagaaagatcccataacaaaaattatttgtaacyttaaaaatggctgtaaaatacattttaacaattccatagtggtctgtttactaaaaaatataaaattaaaataaaaccagggatttttatatatcttctt

SEQ ID NO: 41925 - DNA, 201 bp, Homo sapiens
tcatgtagtcttttaacttcagatttgcatttgtaaaatggggataacaaagatacctacgtaaggatggttcatcagagtttaaaagggttaatgtatgyaagccatttagtaaaatttctagggcattgtaactgcttagtgagtattagtttttgtagtagttagaataacaaatactacttgctgtaatacaacccc

SEQ ID NO: 41926 - DNA, 201 bp, Homo sapiens
ttagtttttgtagtagttagaataacaaatactacttgctgtaatacaacccccagatctcagtagcttattgcaatgatggtttatttatcaaccttacrttggtctgatgccagcctgttttcctgaataggtctctacaaggtagtgactcaatgattcagtatctttcaatcttgtgattttgccatctgtataagc

SEQ ID NO: 41927 - DNA, 201 bp, Homo sapiens
agcttaattaatttgtatttccttctcagaaattatagataagaactttctttttctctaacgggccagataataaatattttagcctttgtgagccatayattctctgctgcaagtactgcatggcatgaaaccagccatagacaatagataaatgaaagagcatggccatggttcaataaaactttatttatggacaat

SEQ ID NO: 41928 - DNA, 201 bp, Homo sapiens
tcccaattcattagcaatattgtaattaaaagagcacctccagttctagagggtaatgacctttttaattgaacttggggattcagattgctgttgaatartagtgaatttaaatgctcaattcaaatgccaaattttcttctggtaaatgtacaattaggaatcaaatatgaattcccctagcaatttgctcctgttttt

SEQ ID NO: 41929 - DNA, 201 bp, Homo sapiens
agagttatctggaattaatttttcattttgcaaagcttaattaatttgtatttccttctcagaaattatagataagaactttctttttctctaacgggccrgataataaatattttagcctttgtgagccatacattctctgctgcaagtactgcatggcatgaaaccagccatagacaatagataaatgaaagagcatgg

SEQ ID NO: 41930 - DNA, 201 bp, Homo sapiens
ctctgcttttcacgtttatgcaaaacaattgcacattcagtgcattcaggatgcacttagcagatctacaacttgtaatcattaagggaacactaatgcaygtagcatacttagtagaaattatgtacttttctcaatatctagaagaaacaatgctcagatagcctctaatagcaaagcagagagaaaaataaaatgatt

SEQ ID NO: 41931 - DNA, 201 bp, Homo sapiens
atggttaaatagcggctttttatttagaatctctgcttttcacgtttatgcaaaacaattgcacattcagtgcattcaggatgcacttagcagatctacarcttgtaatcattaagggaacactaatgcacgtagcatacttagtagaaattatgtacttttctcaatatctagaagaaacaatgctcagatagcctctaa

SEQ ID NO: 41932 - DNA, 201 bp, Homo sapiens
aaatgagggcatttctctgttcctggtcatttactttagcaactggaaagagagtagaaaagtgcatttacatgcgatggtgtgggatgatagcataatcrcaaatggttaaatagcggctttttatttagaatctctgcttttcacgtttatgcaaaacaattgcacattcagtgcattcaggatgcacttagcagatct

SEQ ID NO: 41933 - DNA, 201 bp, Homo sapiens
gtttgattttatatgcaagccaaggaagtaagtgaccaataaataagaaatgagggcatttctctgttcctggtcatttactttagcaactggaaagagartagaaaagtgcatttacatgcgatggtgtgggatgatagcataatcacaaatggttaaatagcggctttttatttagaatctctgcttttcacgtttatg

SEQ ID NO: 41934 - DNA, 201 bp, Homo sapiens
cagatttagagttgaaaggaatcctgaaagtaatctaattttaattctgaagcttgactttcctcttttgtattcttccaagtggttatttagcctttgcmtaaacaatttctagcataggaaaattattgtctcccataacactcaattccatctttgaacatctttgacatatgactgttagaattagttcttgttaca

SEQ ID NO: 41935 - DNA, 201 bp, Homo sapiens
catatttgccaaaggaatagtatgcagtgaatgaagaaagcataaacaatttgattaagatcacctaacaaatctgtacctgggacaggaaaagaactcarttgcacatgtaatgtgagatattcttcaaaacatgcctatttttggaaatatctcaattttgtgtgaaataatttgatccctaaatgtgtcaacttttta

SEQ ID NO: 41936 - DNA, 201 bp, Homo sapiens
cttccagaccgcactatcttcgtgttctcatgctatgtctctagatttaactataacttgctccactttacacatccaagcctatggacaaaaaaaaaaaatgacattttcttctttacccacacacatctaccacattcttacctgtcatttgcatacctgtcagtttgtgaaatgcccttgtcagtcaatttaatttac

SEQ ID NO: 41937 - DNA, 201 bp, Homo sapiens
aaaatgtgcatatatatattttttatctttacaaggaccttgcaagttatgtaatatttctagacattagaagagacttagaggttaagtaaagtactctrgtatactcagccagtatccagggccataattctaacttatatctgtctgagtccaatgcttccttccagaccgcactatcttcgtgttctcatgctatgt

SEQ ID NO: 41938 - DNA, 201 bp, Homo sapiens
gacattgtgttataaaatgtgcatatatatattttttatctttacaaggaccttgcaagttatgtaatatttctagacattagaagagacttagaggttawgtaaagtactctggtatactcagccagtatccagggccataattctaacttatatctgtctgagtccaatgcttccttccagaccgcactatcttcgtgt

SEQ ID NO: 41939 - DNA, 201 bp, Homo sapiens
tgggagagagagtagataattgaataggaagtttggtggccagacctcaatgcaatgtactttcctctacatctcattggacaaaatccatcaaaaggacytgaataaactgcaaaggagctggtgaatgccctcttcctctgtgcctaagaagaaataggactgatgaacacataaacattccttgtcacactctttgtt

SEQ ID NO: 41940 - DNA, 201 bp, Homo sapiens
gagtagagatgaggtttcaccatgttgaccaggctggtctcgaactcctgacctcaggtcatctgcctgcctcagcctcccaaaatgctgggattataggygtgagccaccgcacctggctgcaaaagtcattttaaatttcttaaagtttaggctccaatatgagcaaaaaaatactaagattatggaataaaagtcttg

SEQ ID NO: 41941 - DNA, 201 bp, Homo sapiens
gtcttggttacaagcaagttaaaagcctcccggattcaaaggagaggagacacgaaccccatctttcaatggaaagagtgtaaaggtcaaaaggagcatgygagatgaggaataatattgtatccatctttagaaaatacaaagtgacccacttctgtcatcgtgctcttattatcatagtcatcatcatcattattatca

SEQ ID NO: 41942 - DNA, 201 bp, Homo sapiens
agcagctgctgcatccttagaaatactttacactttaactgaaaaatctgttgctttcattaatgtgttgagatattcaattaatatttcagactgaggtrtaatattatttcatggcttttatattatgttcaacttcatagtacatatttatttccttttggaaaaaaatgaggatttttgcaactgtttcatattatt

SEQ ID NO: 41943 - DNA, 201 bp, Homo sapiens
tcagtcatctagaggatgaatttcagaggcttgattataatccaggaatagagttagaagagcttgtccttggcattgccctcgtccccattctgcaggaytcccttgttaggtagattgataaggctgtagctgtgacagcccagaaggaagaggtgccccacctcatgagggagagagggtcactcgctcttccgatga

SEQ ID NO: 41944 - DNA, 201 bp, Homo sapiens
tcttcaaagaagaaatttctgccttttggcttgagagataaattttggctgtcagtattttttgagccaagataaaggagggaaattggagtggggtggcrttgactatttataaaccaaatattagcctcatttttgctatgactagtgttgctgagtctggagcctgtgtctgtaatcctaaattgagtcttcctttac

SEQ ID NO: 41945 - DNA, 201 bp, Homo sapiens
agggatgagccctgggtttattagttaatgaaaaagaatgtgccagtgctgtcgccatgtaattagttggcgacggcattttttctcctccaatttacgctttttttttttgagacaatgtctcactcttgttgcccaggctggaatgctatggcacaatttcagctcactacaacctctgcctcccgggttcaagcaatt

SEQ ID NO: 41946 - DNA, 201 bp, Homo sapiens
attaagcattctctaagccatttacttttcaaataatttttttaaaaaaatcaaagaaatattgtgcactaaagaaaaatctaataatatgtaaggatatrttttttaaaaatgtcctctcccactcacaccttccctgtccctgtctaaattccaagatatgactactttagctacttttatgtttagctgttctcttag

SEQ ID NO: 41947 - DNA, 201 bp, Homo sapiens
ggagcaagagtcagctaaaagaaaaaaagaaaaagaaaacaaaacatacgttgtcaagctaaaaggctgtatctgatactttgtttaaccatcatagaaayatttgggcaatgtaaataatatatatatcattgtcttttttactctcatcaacactgccttcttttcaaagttgcccttaatatatattaaaacttgaca

SEQ ID NO: 41948 - DNA, 201 bp, Homo sapiens
tgggcagtcttatttctggactctctattctattaagttggtctaaatatctgttttgtaccattaccatgctgttttggtttctgtagccccatagtatmgtttgaagttgggtagtctatgcctccagctttgctctttttgcttaggatttcctgggctattctttggtttcatatgaatttcaaaatagttttttct

SEQ ID NO: 41949 - DNA, 201 bp, Homo sapiens
gataaaatgactaaaattccatcctaacaaagcaaaatcaccaaacgtctaagaaaaatcagaaagtaaaagaatatgagaggcattgtcaagtatcagatttttttttttaatttcaaaggtataatcttaatcatttggtattgcttcatgaatacaaagactgatcagtgtaagaaaagagatgtccatggaagagac

SEQ ID NO: 41950 - DNA, 201 bp, Homo sapiens
cattcatgtgctcattcattcatgcatgcatttaaaaaatatttcatgatcatgtattatacacaggattatggtcttcacgtaaaaaacaaaatctgaayttggactcaatttctgtccttgaggacttacagaaattagaggaataataaatgtaataaataagaatccaggttgggtgcagtggctcaggcctctatt

SEQ ID NO: 41951 - DNA, 201 bp, Homo sapiens
ataaaatgactaaaattccatcctaacaaagcaaaatcaccaaacgtctaagaaaaatcagaaagtaaaagaatatgagaggcattgtcaagtatcagatttttttttttaatttcaaaggtataatcttaatcatttggtattgcttcatgaatacaaagactgatcagtgtaagaaaagagatgtccatggaagagaca

SEQ ID NO: 41952 - DNA, 201 bp, Homo sapiens
ttcaataagaagaattgtctttacttacatatgaaacaaatctgtcttcccaacaggctactgggctactggttttcaaacatacagtggatgagttcacrgcatgagttaaacatcagttactctatgtttaaagttcttcctggcaacaactcttgaaatatttgaagtcagccctcatgtattccatatgctccctct

SEQ ID NO: 41953 - DNA, 201 bp, Homo sapiens
cctcattagcatttgttattgcttgtcttttagataaaagccattttaactggggtgagatgttatctcattatagttttgatttgcagttctctgatgaytgatgatgttcagcaccttttcatattcctgtttgccattgacatttgtatgtcttcttttgagaaatgtttattcagatcttttgcccactttttgatc

SEQ ID NO: 41954 - DNA, 201 bp, Homo sapiens
gagatattggctttacattttgaattatatcatacttattctttctaatttcctgttttatcctttgaaaggaacccatgaaattctttggccactctgayttttgtgtcctgaaatttccatgtcattgcaatgaaaaagaatcaaagtatggctgcactaaaaggagagtatttctaaaatataaagcactttgcaaaa

SEQ ID NO: 41955 - DNA, 201 bp, Homo sapiens
gcaactttcttgaaaatgagttcactatagttttatggatttgtttctgggttctctattatgttccattggtctatgtgtctgttttaatgccagcaccwtgctattttggttactatagctttgtagtgttaatataatttgaaatcagataatgtgagtcctccagttttctttgttgattttctgcctggaagatct

SEQ ID NO: 41956 - DNA, 201 bp, Homo sapiens
gtatggctgcactaaaaggagagtatttctaaaatataaagcactttgcaaaagcactcaacatacattatgtcgagctcttataactacattataatgtsggtattaacatacatattttactcattacaatttagtaatttgttcaagaccataaagaaagaagtttagaggagatgaatccacccataccgcttttgt

SEQ ID NO: 41957 - DNA, 201 bp, Homo sapiens
acttagtgatatctctagtattaggccaacttccaagggtcttatgcaacacttgtgctaaaagtgagaggggtgaaaatcattgtgttacaatatctgaracaaatatgcctgtgatttgtgaaacaagtgaggtttcctttccatatccaagtttggaccattgcttcatgcatccaaaaccagatagatcaacattac

SEQ ID NO: 41958 - DNA, 201 bp, Homo sapiens
aggtagaggctgcagtgagccaagaacgcgccactgcactccagcctgggtgacagagcaggactctgtctcaaataataataataataataataataataaataagatcaatcaatcaacaaggaatatttaacagcaataactataaagtctacattcaaactaaatgcatcttttatgggtctctcttggcacttggt

SEQ ID NO: 41959 - DNA, 201 bp, Homo sapiens
tctctacaaacaaggcaaagatcacctaaagcatattagtgctagatctcttaatatttctttctccagatttttagatcttaagatagaaaatagcctayagttggcccttagtatctatgggttccatatccatgtatttaaccaactacagatgaaaaatgtggttaggtctatagtagttgtgtgtgtactgaacat

SEQ ID NO: 41960 - DNA, 201 bp, Homo sapiens
tacagcactatctaaaacttttagcctgttattcaatataatattgacacaataatagctattatttattagacatctataatgtgccagacattgtgttwtaaaatgtgcatatatatattttttatctttacaaggaccttgcaagttatgtaatatttctagacattagaagagacttagaggttaagtaaagtactc

SEQ ID NO: 41961 - DNA, 201 bp, Homo sapiens
ccctatacaatgcagagtacaataacaactattttgcatagcacatacattgagttataaattataagtaatctaggtatgatttaaagtaaataggaggrtgtgcataggttttgtgcatatactacatcattttatatcagagacttcagcatccatgaattttggtgtccatgggggtcctggaaccagtccccactt

SEQ ID NO: 41962 - DNA, 201 bp, Homo sapiens
gaggtagaggctgcagtgagccaagaacgcgccactgcactccagcctgggtgacagagcaggactctgtctcaaataataataataataataataataataaataagatcaatcaatcaacaaggaatatttaacagcaataactataaagtctacattcaaactaaatgcatcttttatgggtctctcttggcacttgg

SEQ ID NO: 41963 - DNA, 201 bp, Homo sapiens
tagtgtcaacacatacatatatacacaaattattcaatgaagcttttaaatttcgagatgatatccccttatcacttagcacatttcttctcactgtcaaytggtgtgtgctaagggaatgcaaattaactgtattattaatttaagtaagacataattagtaaggtaaatcttctgccaaaaaccacataacacattcca

SEQ ID NO: 41964 - DNA, 201 bp, Homo sapiens
ggaggtagaggctgcagtgagccaagaacgcgccactgcactccagcctgggtgacagagcaggactctgtctcaaataataataataataataataataataaataagatcaatcaatcaacaaggaatatttaacagcaataactataaagtctacattcaaactaaatgcatcttttatgggtctctcttggcacttg

SEQ ID NO: 41965 - DNA, 201 bp, Homo sapiens
aagggaatgcaaattaactgtattattaatttaagtaagacataattagtaaggtaaatcttctgccaaaaaccacataacacattccagggccaaatatraatgagctatgattagcctgctgttcctctttattagttcagattaatggcgtattccctgtgggcataaagatgcacaaccatgtgttttctaagggtc

SEQ ID NO: 41966 - DNA, 201 bp, Homo sapiens
agtttccaaatagttcctagtttcagaaactgctaaccttgtggtactttccatagtgagtgtgataacttcttacagcactatctaaaacttttagcctrttattcaatataatattgacacaataatagctattatttattagacatctataatgtgccagacattgtgttataaaatgtgcatatatatattttttat

SEQ ID NO: 41967 - DNA, 201 bp, Homo sapiens
cccttcatgcaagtacttcatcgtttcttctcctgcttggtaccattatccagactgtgaatagcattgttgtcagagagcactttcagaaacattcttgrctagaggaaacacagggagtagcaatccattaatgaagcagatttacatcgattaattacattccacttcctctgttcaggcctgtagcacagctccagg

SEQ ID NO: 41968 - DNA, 201 bp, Homo sapiens
agtcagtgatattattcaccattcaataaacattgatttggccttgattgtgttgggtcctgtttggtgctaaatgggtctttggacaaacaggagactakgacagagaaaggccatctagaaaagtgacattcactagtgtagcagagtgaaaataactcaagttatgatcataaaatatattttgctggacttattaca

SEQ ID NO: 41969 - DNA, 201 bp, Homo sapiens
atccagactgtgaatagcattgttgtcagagagcactttcagaaacattcttgactagaggaaacacagggagtagcaatccattaatgaagcagatttayatcgattaattacattccacttcctctgttcaggcctgtagcacagctccaggaggggaaaaaatatgatgaaagaaagagaaaagctctcaaattaaat

SEQ ID NO: 41970 - DNA, 201 bp, Homo sapiens
catggtacctatcttatattgtttttcatcttgtcactttgatctaatggggaatggtaataatatgagtcagtgatattattcaccattcaataaacatkgatttggccttgattgtgttgggtcctgtttggtgctaaatgggtctttggacaaacaggagactatgacagagaaaggccatctagaaaagtgacattc

SEQ ID NO: 41971 - DNA, 201 bp, Homo sapiens
acctgcatgtgtaccactgaactcaaaataaaagttaaaaaaatgaaaacaggtggttgaccactactttgatattattgataatattattgataaggctraagacatgtgttactagtcttgcacttacccttgcatgtgttggttcatgatgttaatttttaggcatagctgattacttactataacccttaagaacat

SEQ ID NO: 41972 - DNA, 201 bp, Homo sapiens
gggtgtactctagggtggagggtgaggatttagaacctacctatctggtactatgcttattatctgggtgacaaaatgatctgtacaccaaacccctgaarcatgcaatttattcacataacaaacctgcatgtgtaccactgaactcaaaataaaagttaaaaaaatgaaaacaggtggttgaccactactttgatatta

SEQ ID NO: 41973 - DNA, 201 bp, Homo sapiens
gacaccagggtgtactctagggtggagggtgaggatttagaacctacctatctggtactatgcttattatctgggtgacaaaatgatctgtacaccaaacycctgaagcatgcaatttattcacataacaaacctgcatgtgtaccactgaactcaaaataaaagttaaaaaaatgaaaacaggtggttgaccactacttt

SEQ ID NO: 41974 - DNA, 201 bp, Homo sapiens
acttgtgttgtgaggatttagagtgagagttgaacagagacctcagtgaaatgaaagagtgtgctcttgctggggaaggaaattccacaggagagggttayatgcaaaagctcaacatagaaactgacccagaaggtcagtgttgctggacacaatgagtgaggggggaaatggtagtaaactaagtcagaggggtctcca

SEQ ID NO: 41975 - DNA, 201 bp, Homo sapiens
tgataaagaatgctatagacataaaacacaatgagaaagaagattctgccaagcctgacatttatttcttcagttagtaaaaatatctattgcatgcctaytgtgtgctaggtcagattccagtcttgagattagaatccctgccatttaggatttacagtgagagaaacagtcaatcaacaggtaaataaaaaataatat

SEQ ID NO: 41976 - DNA, 201 bp, Homo sapiens
actaaatgttcagtgctggtttccacctccctttcacatcgacacggctgactagtgacctttcttgctttctctccttcattctgcatgataataggctytcttggctttcttcctacttctacctacttatctgtctcttttgctggcttgtccaactctaatatattcttcctttttctttattagtctacccattct

SEQ ID NO: 41977 - DNA, 201 bp, Homo sapiens
tacatatttttttacctcatgcagtctattcttttcaagagaattaatgacattttaattactaaatgttcagtgctggtttccacctccctttcacatcracacggctgactagtgacctttcttgctttctctccttcattctgcatgataataggctctcttggctttcttcctacttctacctacttatctgtctct

SEQ ID NO: 41978 - DNA, 201 bp, Homo sapiens
ctttaaaaatatttttataagaaaacttaatacataaatataactttaaaaatatattggcatatgccaagaagtgctactcaataaaaaatctctaaaayaaaatgagaaaaccagccacagtccccaaatttggctttaacctttgttttctcattcatgcatctactagtacagcagattcttatatccctgattttc

SEQ ID NO: 41979 - DNA, 201 bp, Homo sapiens
aatttgtatgttaattaaataaataaataccaaaaacatggagaaagtttgcaaagtgggaggcaagtgtcagatctcttttctaccaatgtcattttatraaacttttttttatctcttaggctatatgaatgattgcataacatattgagatagtgttgaagttggtttgactttaaacagctgaggtaaaattacatg

SEQ ID NO: 41980 - DNA, 201 bp, Homo sapiens
ggttaggctttgtgtccccatccggatcttatcttgaattatcatcctcataattcccacatgtcaagggagagaccaggtgaaggcaattgaatcatggmgtcagtttcccccatgctgttcacgtgatagtgagcgagttatcaggagatctgatggtttcataaggggctcttccgccttcacttggcacttttcttt

SEQ ID NO: 41981 - DNA, 201 bp, Homo sapiens
ggaaggcaaaaaccaagagagtggatcacgaggtcaggagttcaagaccagcctgtccaaaatggtgaaaccccgtctctactaaatatacaaaaattagytgggcacagtagtgggcgcctatagtcccagctacttgggaggctgaggtgggagaattgcttgaatctaggaggtagaggtggcagtgagctgagatca

SEQ ID NO: 41982 - DNA, 201 bp, Homo sapiens
cttattttaagaaaacacgtacatgtcactattaaatttgagacacgctgaaggtaagaacatgagttatcattagagaactatttttccaatatgtatayataccatgtgtatatttttaaagtttatcaaacattttattttgaatgttgagttctagctacccattcatatgagtgatatgaattaattagaaattct

SEQ ID NO: 41983 - DNA, 201 bp, Homo sapiens
aatttgctaaaagattggatattgggaatgagagagacaggagtcagggacaactcaaggttttggcttcagaactgggaagatgggcttactatttataytgatacagaggagactgaattgagcagtctggagatggtgaaagagcagaaattaattttgactgtgactagactaaaagtcagttgaaaaaccaagcaa

SEQ ID NO: 41984 - DNA, 201 bp, Homo sapiens
ggtggatcacttgaggccaggagttcaagaccagcctggccaacatggtgaaacaccatctctactaaaaatacagaaattagctgggcatggcaatgcaygcctgtaatcccagctactaggaagggtaaggtgggaggattgcttgaacccaggaggtggaggtagcagtgagcggagattgtgtccactgcactccag

SEQ ID NO: 41985 - DNA, 201 bp, Homo sapiens
agtaagtcagtgaaagctagccagtgaattatatttttaataagtcatgtgtatggtttagaattcaaacataattctgagaagaagccaagcatgactcytgttttccacagtatttttaatactttttatttcttttttattttcttcctgtgtttttttctctcttctttaaaatttagcaaccacaaatttcttttt

SEQ ID NO: 41986 - DNA, 201 bp, Homo sapiens
agaaaagctctcaaattaaattttcaagtctgatttatgagactcctctgaaaatctagttttttctaatttcaattatttgtttctctgcttccctgacraggctgttctaacactgcctggattttggcttgttgcctgcctcattcctttcttggcttgttctcattacagcacttttgcctggtaggagtgaagacc

SEQ ID NO: 41987 - DNA, 201 bp, Homo sapiens
catgatcctactacttccctctggcctgggcaacagattaagactgtctcttttaaaaaataaatcaacaggctgggtgcggtggctgacgcctataatcycagcactttgggaggctgaggcaggcagatcacctgaggtcaggagtttgagaccagcctggccaacatggtgaaaccccgtttctactaaaaatacaaa

SEQ ID NO: 41988 - DNA, 201 bp, Homo sapiens
aaactgaatccctgaacagatcaataatgacctccaaaattgaatcattaacaaaaagcctaccaaccagaaaaagcccaggaccagatgaattcacagckgaattgtacccactgtatgtataaaaaagcgggtactattcctactaaaactgttccaaaatattgaggagaggagaatcctctctaattcattctatga

SEQ ID NO: 41989 - DNA, 201 bp, Homo sapiens
gccactagctatactaataaagaaaaaagagaggatatccaactaaacacaagcagaactgacaaagggacattaccgctgaccccacagaaatacaaaarctgcaaatacctctatgaacacaagctagaaaacctagaagaaacggataaatttttggaaacatagaaactcctaagattgaaccagggagaaactgaa

SEQ ID NO: 41990 - DNA, 201 bp, Homo sapiens
taacataggccactagctatactaataaagaaaaaagagaggatatccaactaaacacaagcagaactgacaaagggacattaccgctgaccccacagaartacaaaaactgcaaatacctctatgaacacaagctagaaaacctagaagaaacggataaatttttggaaacatagaaactcctaagattgaaccagggag

SEQ ID NO: 41991 - DNA, 201 bp, Homo sapiens
gaggcgtgaaaaaccatacaaaagatcaacaaatccaggagtttattactcgaaagaatagataacataggccactagctatactaataaagaaaaaagaraggatatccaactaaacacaagcagaactgacaaagggacattaccgctgaccccacagaaatacaaaaactgcaaatacctctatgaacacaagctaga

SEQ ID NO: 41992 - DNA, 201 bp, Homo sapiens
tggggttgtttgtttttttcttgtaaatttgtttgagttcattgtagattctcgatattagccttttgtcagatgagtaggttgtgaaaattttctcctaktttgtaggttgccttttcgaaagtgccttcaaattctaagaagctatgggtcctttgggattttcttaatacacactcctcagtctccatattcctcagc

SEQ ID NO: 41993 - DNA, 201 bp, Homo sapiens
tctaactggtatgagatgatatctcattgtggttttgatttgcatttttctgatggccagtgatggtgagcattttttcatgtgttttttggctgcataartgtcttcttttgagaagtgtctgttcatgtccttcgcccactttttgatggggttgtttgtttttttcttgtaaatttgtttgagttcattgtagattct

SEQ ID NO: 41994 - DNA, 201 bp, Homo sapiens
cctgttgtttcctgacattttaatgattgccattctaactggtatgagatgatatctcattgtggttttgatttgcatttttctgatggccagtgatggtragcattttttcatgtgttttttggctgcataagtgtcttcttttgagaagtgtctgttcatgtccttcgcccactttttgatggggttgtttgttttttt

SEQ ID NO: 41995 - DNA, 201 bp, Homo sapiens
tctccacatcctctccagcacctgttgtttcctgacattttaatgattgccattctaactggtatgagatgatatctcattgtggttttgatttgcatttytctgatggccagtgatggtgagcattttttcatgtgttttttggctgcataagtgtcttcttttgagaagtgtctgttcatgtccttcgcccactttttg

SEQ ID NO: 41996 - DNA, 201 bp, Homo sapiens
tttcttggcttgatgtatcatttttcatcgctttttgtacattccattgactgagcgttccagtttatccattcatctactgaagaacatgttggttacayctaagttttggcaattacaaataaaactgctattaagacacatgtgcaggttttgtgtgaacgtaagttttaaatttatctgggtaaataccaaggtatg

SEQ ID NO: 41997 - DNA, 201 bp, Homo sapiens
cagtagctgtggtttaaattttattttgacatgaatctgtaaacttatgtgtgcatagaaaagcatcttctttattagaaatggaatttctttgaggatgrtaatttggggactatttactagaaatggaattgcttgagggtgataatttgggaactattatttcctgatctaactctacccatccataaactcatttct

SEQ ID NO: 41998 - DNA, 201 bp, Homo sapiens
tactctagtaataactctcacagtaagtcaattacttgtcttcaaactcttaatagctgttgtcagcaatgcctattaaacatatacttattattttgatrggaaaattgccccacccctactcccacaatcacccaggaacttgtaaatacacaataaacttttaaaaaattattttcataaagaccaagatatacacat

SEQ ID NO: 41999 - DNA, 201 bp, Homo sapiens
aaatacttaaaatgtgcaaagaaaagaaagagaatataaacaataagccatgtgataaaataatatttgtaaattggttatgtaacataaaactctcttamtaaaatatcttttatataaatattactctagtaataactctcacagtaagtcaattacttgtcttcaaactcttaatagctgttgtcagcaatgcctatt

SEQ ID NO: 42000 - DNA, 201 bp, Homo sapiens
atttacccacactggttgccaatgagacatccattgtcccagcccatgtaaccctttcaggtctaccactgtttccatgacaagtttgtggcacggggctrtggtgagatttgaaacactgttctgggcttactggatgacattttctctgaagtcttttttatccatattggattgtcaaggagtagggcaagttagtac

SEQ ID NO: 42001 - DNA, 201 bp, Homo sapiens
gatcaagacgtcaacaatgctaagactgagaaacacttctcttgaggctaagtctgtctctggaggcttgggctgcatcaagatgtcagggagtctcaccraccctgtcatttacccacactggttgccaatgagacatccattgtcccagcccatgtaaccctttcaggtctaccactgtttccatgacaagtttgtggc

SEQ ID NO: 42002 - DNA, 201 bp, Homo sapiens
gaggtgggccatttatccagcttgaatggtttctgtgaaagcaacagatagggtttacagtgtggttacattgaggcatatatgagtttgaatatttacaraaaatttattggagaggaaagctggatagatgcaatcctagattgtgcctataaaaatttcatgtactctcagtgtaaacaaataatttatataaccaca

SEQ ID NO: 42003 - DNA, 201 bp, Homo sapiens
catgatccatgctcttgaaactgcatgacataatgtcaggaacattgagtttggagtagaatatctgtgttgcaccacttatggtttttaaaggttttttycctcctaatctgtaaaatgggtatgacagcatgaggattaacagtgatgcccaaaaagtgcctatcacagtgcttgaccttactgggaattcagtaagta

SEQ ID NO: 42004 - DNA, 201 bp, Homo sapiens
taaaggtttttttcctcctaatctgtaaaatgggtatgacagcatgaggattaacagtgatgcccaaaaagtgcctatcacagtgcttgaccttactgggrattcagtaagtaagagcaggtattacatttgttgctattgttttgttattaacagtagcgatgaagagccctctcgttgctcccaccttctgtttttatg

SEQ ID NO: 42005 - DNA, 201 bp, Homo sapiens
tttttttcctcctaatctgtaaaatgggtatgacagcatgaggattaacagtgatgcccaaaaagtgcctatcacagtgcttgaccttactgggaattcartaagtaagagcaggtattacatttgttgctattgttttgttattaacagtagcgatgaagagccctctcgttgctcccaccttctgtttttatggtctcc

SEQ ID NO: 42006 - DNA, 201 bp, Homo sapiens
ttatttataaataatacatatgcactactatactaataagtaaaacaaagaaattttataaaaattagaatggaaatgttacattcagttgttttcttatrtgttgtcatggctcatcttgcacaccttctggggtgcacagcttgaaaagctttgctcgagaggtttatcatgtttttgtaaattagactgtcttgccca

SEQ ID NO: 42007 - DNA, 201 bp, Homo sapiens
tgtgaatagtgccgcaataaacatacgtgtgcatgtgtctttatagcagcatgatttatagtcgtttgggtatatacccagtaatgggatggctgggtcamatggtatttccagttctagatccctgaggaatctccacactgacttccacaatggttgaactagtttacagtcccaccaacagtgtaaaagtgttcctat

SEQ ID NO: 42008 - DNA, 201 bp, Homo sapiens
aaaaattagaatggaaatgttacattcagttgttttcttatatgttgtcatggctcatcttgcacaccttctggggtgcacagcttgaaaagctttgctcragaggtttatcatgtttttgtaaattagactgtcttgcccataaccaagtacctcagtcatcttccagaaaatgccttccacacccttgggtctctttcc

SEQ ID NO: 42009 - DNA, 201 bp, Homo sapiens
gtattccatggtgtatatgtgccacattttcttaatccagtctatcgttgttggacatttgggttggttccaagtctttgctattgtgaatagtgccgcartaaacatacgtgtgcatgtgtctttatagcagcatgatttatagtcgtttgggtatatacccagtaatgggatggctgggtcaaatggtatttccagttc

SEQ ID NO: 42010 - DNA, 201 bp, Homo sapiens
aacattgcttagaaaacacaagcacctgagtagacacctgtcaaaacaagagccatgagggagactgctgctagcattttaatacccccattacttctgcygactgtagaatttgccatctgtttgttatatttttgaatgaggttggtccttacaagtgctgtcaatatattaagatttaataaggaagtcccaaaatcc

SEQ ID NO: 42011 - DNA, 201 bp, Homo sapiens
agataattagaatctgatcattgagttcttccctgggctatgaggtgggccatttatccagcttgaatggtttctgtgaaagcaacagatagggtttacartgtggttacattgaggcatatatgagtttgaatatttacagaaaatttattggagaggaaagctggatagatgcaatcctagattgtgcctataaaaatt

SEQ ID NO: 42012 - DNA, 201 bp, Homo sapiens
catcaggttcctcccacaatatctgggaattatgggagctacaatttaagatgagtatgggagaggacacagccaaaccatatcagtcatgttagttttcygtctatcagctattctttttctttttttatttttccttttcactagtgtttgagttaggataattttgctataaatgaaatttcatcatttaaacagttc

SEQ ID NO: 42013 - DNA, 201 bp, Homo sapiens
acagtaagttttttgaaggtaggcactttgtctgattttttttttttttttgagacggagtctcattctgttgcccaagctggagtgcaatggtttgataytggctcactgcaacctctgccttctgggttcaggcgattctcctgcctcagcctcctgagtagctgggattacaggcacccacccctatgcctggctaat

SEQ ID NO: 42014 - DNA, 201 bp, Homo sapiens
gtcgcttttatctccaaattttgatgggaattctttgtccatatgtacttaatattagaaaaacatattgttgagtactttttttttttttttttttttttgagacagagtttcgctcttgttgcccaggctggagtgcagtggtgcgatctcagctcaccgcaacctccgcctcccaggtgcaagagattctcctgcgtc

SEQ ID NO: 42015 - DNA, 201 bp, Homo sapiens
ccctagatgtcagcatcacacaatctacccatgtaacaaaccttcacgtgtaccacctgaatcaaaaataaaagttgaaattattattattattattattwtttttgagacggggtctcgttctgtcacccaggctagagtgcagtggcacaatctcggctcactgtaacctccacctttggggtttaagtgattctcctg

SEQ ID NO: 42016 - DNA, 201 bp, Homo sapiens
gacaggaatatccacaccctagatgtcagcatcacacaatctacccatgtaacaaaccttcacgtgtaccacctgaatcaaaaataaaagttgaaattattattattattattattatttttgagacggggtctcgttctgtcacccaggctagagtgcagtggcacaatctcggctcactgtaacctccacctttggggt

SEQ ID NO: 42017 - DNA, 201 bp, Homo sapiens
agttcattgtcactaaacatcagagaaatgcaaatcaaaaccacaatgagacaccatctcacaccagtcagaatggctattattaaaaagtaaaaaaaaaacaaaaaacaaacaaacaaaaaaaccagatgctgttgaggctgcagagaaaaggaaatgcttatacactgttggtggcaatataaattagttcagccactg

SEQ ID NO: 42018 - DNA, 201 bp, Homo sapiens
atcttcctttcctgtttttttttttttcttttaagcacagttgtttaaattccctacaaggttagaatacatgcacttttaagaaagcattctaccgaagstaattgggtgttttccactatcacataaatctgttggctggtgtttgatattcttggaaagtcggaggataggcatttattagtatcagaggagcccttt

SEQ ID NO: 42019 - DNA, 201 bp, Homo sapiens
tagagcaatctaaattctcaaatcccaaaatttctctttgaccacttctcattgctcagactttcccaggaatttcccattgaacccaccctcattaaccrtatttctagaggcaggttaactatttgatttgaagccatctttattagccatatttctagaggcagattcactatttggaatatgagagatatgtagaat

SEQ ID NO: 42020 - DNA, 201 bp, Homo sapiens
ggtgtgtttcctggaggaactctgcatatagttcttcatacaagaagctgtgtctcagaaccaatctaaaagacactcatgtaaaattgaactccaccatrtttgttgttagttattttcctcattttattttatttacagtatttatcactgtctgaaattatagtccttatctacttgctggtttgtcatcatttattt

SEQ ID NO: 42021 - DNA, 201 bp, Homo sapiens
agttgaatccacatccttctccattgaccatacaaagtttacaatgagaaagaggtaaaatatagaacataaagaaggcagagacagctatctttattttwcaatatatgaaaccagatgccaaataagttttccagagtaacagaataaataaatattagacaggaaagccctttgataccacatgggctctttattggt

SEQ ID NO: 42022 - DNA, 201 bp, Homo sapiens
tacattatttatttaatgtaattctaacagtattaactagacagtatacttaatatttattgacataagtcagaatgacatgatagctaatatttactgarcatttattgtgttcttggcactatattcagtactttacattactgtcatatattcctcacaacaaccctataagataggtacatcacaattgaaggaatt

SEQ ID NO: 42023 - DNA, 201 bp, Homo sapiens
gaccaggacaaattttctacattatttatttaatgtaattctaacagtattaactagacagtatacttaatatttattgacataagtcagaatgacatgayagctaatatttactgagcatttattgtgttcttggcactatattcagtactttacattactgtcatatattcctcacaacaaccctataagataggtaca

SEQ ID NO: 42024 - DNA, 201 bp, Homo sapiens
atattgaagaatatttaccattacaaataaatacaagggcctgatacttttatggtttaattttttttgctataataatgagatagtttattccattgttwttaaagtgaaagactataaaaatggatgatactcagcttaatttaatttataaagaactgtaattttaataatctgaaaaagatgcataagaatgtaaac

SEQ ID NO: 42025 - DNA, 201 bp, Homo sapiens
atggagaactattaagaaattacatgcagatgaaataatatttgcattttgggaagaggacgcaagcagtggagttgtttgataggtgatgcctgagactratgccgggggaactcattaggctgccattgtgtaaaaaataatgcagtaaaataggacaataaggcaattgcaacatttaggattattgagacagagaga

SEQ ID NO: 42026 - DNA, 201 bp, Homo sapiens
ggagaactattaagaaattacatgcagatgaaataatatttgcattttgggaagaggacgcaagcagtggagttgtttgataggtgatgcctgagactgaygccgggggaactcattaggctgccattgtgtaaaaaataatgcagtaaaataggacaataaggcaattgcaacatttaggattattgagacagagagaaa

SEQ ID NO: 42027 - DNA, 201 bp, Homo sapiens
ttatatcccttcatttcacattcacagaaactataaaagtttggtgccaatgtagctgtacaacttgttggcttttgtttttcttcataactttaaaagaycttttggttctgtctgtaatatataatcatgccttaaagctgattacaattttcactgttaaaaggattcacactttggctaccttttcatttattactc

SEQ ID NO: 42028 - DNA, 201 bp, Homo sapiens
tagtattttatataccagtaatgaactaggtgaaaaagaatttaaaaatgcaatcctacttgcagtagctacaaaaaaagacacttagaaataaatttaamcaaggtgaaagatgtctacaatgaaaactacaaagcactgatgaaagaaatagaagaggataaaaagaaattgaaaaacattccatgctcctggactgaa

SEQ ID NO: 42029 - DNA, 201 bp, Homo sapiens
agcaaaaataggcatatatttttcatttttaaaaatttaaatctaaataacacttaacatcacatattatctctttgtaattaaagagaattgtctttagkgttttgtttttttaaatagttaaacaaggaaacatgccactaagcaaataaattcatagtcttagagcagagcaaggtaatctctaaaataattaaggca

SEQ ID NO: 42030 - DNA, 201 bp, Homo sapiens
agaaaaactaaattggagtttttattaaaagtacatgtatttaaactagcaagaaatcttaaactagcagatttcttaaagaaaggttaaaaatgttgttyttatttacttcagagattaaagagtaaatcaagttttataagccaattggataagaaatgcatgttaatttagagcatgacttcagaatgtgtacagatg

SEQ ID NO: 42031 - DNA, 201 bp, Homo sapiens
tattttttgtggggggagcggttttttaacctcactgtgtgtcagacttatgttgggggcttgctaaaacccaggttgctgggccccacctccagaatttytaattcaataggtctgaagtggagtctaaaaatttttatttctaacaaattcctaggtaatgctgatgctgctggcctggacatgacacttcgagaacca

SEQ ID NO: 42032 - DNA, 201 bp, Homo sapiens
ggtgtcttagcttcagggagactgcttcctacgtccacattgtttgattctttctccttgctcttccaccatcccctactcctgtccccaccacatgccarcttatccaggtaatgtgttaattttgattctctaacctttgacagacatgtattgaacgtttatttccagcctcaaaaagcgctgtgataacacagcctc

SEQ ID NO: 42033 - DNA, 201 bp, Homo sapiens
cgtttatttccagcctcaaaaagcgctgtgataacacagcctctgcacacaaggaacttccagtctagaataggagacagactttgaaacctatgattatratactatgccataaattctagaaaccgtggtttgtccaacgtgctatcagaaggtataaagataaggtatatagtacatatatatgtttacattttcttt

SEQ ID NO: 42034 - DNA, 201 bp, Homo sapiens
tatgccataaattctagaaaccgtggtttgtccaacgtgctatcagaaggtataaagataaggtatatagtacatatatatgtttacattttctttatctscctttggggactgggataaaagaagatggaattatttacctgtgtcagtcggggtcctccaaaaggaattggcttacatggcgggggctggcaggtctga

SEQ ID NO: 42035 - DNA, 201 bp, Homo sapiens
agaaggtataaagataaggtatatagtacatatatatgtttacattttctttatctgcctttggggactgggataaaagaagatggaattatttacctgtrtcagtcggggtcctccaaaaggaattggcttacatggcgggggctggcaggtctgaaatctatcgcgtaggttttatataaactcaggcaagagttgatg

SEQ ID NO: 42036 - DNA, 201 bp, Homo sapiens
tttttttttttttctgtttttatcttttgcttttatggcttccaacttactgggtgaagcccacctacattatcaagggtaaactctttaattaaagtcarttgattaagaaatgctcaccacgtctgtaaaataccttcacagaaacatttagataaatatttgaccagatagctaggcaccaaagcctgaccaagtttt

SEQ ID NO: 42037 - DNA, 201 bp, Homo sapiens
atcaagggtaaactctttaattaaagtcagttgattaagaaatgctcaccacgtctgtaaaataccttcacagaaacatttagataaatatttgaccagayagctaggcaccaaagcctgaccaagtttttttgctttgatagaccaaagtcgggtgacgcactgcaaatgtatagaagttccaactccaagatatattga

SEQ ID NO: 42038 - DNA, 201 bp, Homo sapiens
ctaccggaaaattcttctccacaatttttcttacatcctagtagcaaaaagataacaaagctcaaatgccatgaacatttgcagtttgaactgctgtcaayatgagagatgaacatcttattttgcagcaggtgggtggggtgggctaggatttgagcactatagagaaaatatacataaattattttcaaattcttcctt

SEQ ID NO: 42039 - DNA, 201 bp, Homo sapiens
aaatgctgattcagatatgattcgagaatagaatataggtggacaaggcttgtatgaggaagattctgggttactctgagttcagtccagacataacagcragaatgagactctgtggtggacctggaagatgccagaacagtttttattgctgtactgtgacagtgttgccaggatataatctattagtagggaaccagc

SEQ ID NO: 42040 - DNA, 201 bp, Homo sapiens
tttatatcaatagaaaaatatttttacttcaaatgactaaaaggttttcattgacatcaaagcctcttgcagaaacatttgaaattatcagttaaaagcgygttagcaaaatactagtgtgtgatgtgtgtatgtgtgtacaaaatatacacatgttattactaggggctcctgcgtggaacagtgcaggtctagatcatg

SEQ ID NO: 42041 - DNA, 201 bp, Homo sapiens
gattagacatccatattaataaacacctgtcataatagcataacagatgttctaggaacacagctaacacaaaatctaaaaaacttggtcgtattttttgmcaatgtggtgcctaaattaaactttacaacctttatcatacttgttttaataaaattcaatgctgaaataatttatatcaatagaaaaatatttttactt

SEQ ID NO: 42042 - DNA, 201 bp, Homo sapiens
ctaaatatttaacatatatatttagtatcatacttgctaaattgctgcatattttcatatatatgtacatataatttcatatctaacatattacatgttayatggtacatatatatgaaaagatacaggaattagcaatgtgtgttatatgtgttaagtatggtgaatgaactgagaagaatgtgcttctccataaaaggg

SEQ ID NO: 42043 - DNA, 201 bp, Homo sapiens
tttatggctacataatattccatgatgtatatatgaaccatatgttcttcatccaatccattgtttattggcatttaggttaattcaatgtctttgctatygtgaatagtgctgcgatgaacatatgagtgcacatgtctttttggtaggatttattttcctttgggcatgtacccaataataggattgctgggtcaaatt

SEQ ID NO: 42044 - DNA, 201 bp, Homo sapiens
gtaatcccagctactcgggaagctgaagcaacaagaatcacttgaacccaggagacagaggctgcagtgagccgagattgcaccatgagactccagcctgrgcaacaagagtgaaactccatctcaaaaagaaaacaaaaacaaaaacaaaaaaaacctggtggtccttttaaacatgcatggttttcgccgtctagagac

SEQ ID NO: 42045 - DNA, 201 bp, Homo sapiens
ccatcaccatcagaaggaacacacttcaagtaagaaagatatccatgggctcagaattcaccttaataagcaaatatttcatatacatataatgttttccrtaccatgttttatacatgggttacatatagacatgaaactgtactagtgacttctagaatcagtctattgatctctttatatttgttgcacatttgtctt

SEQ ID NO: 42046 - DNA, 201 bp, Homo sapiens
acattttcattaatttctttaattaagatctttattgctcacactgtggacaaaaaccaaacaacaaaaaaaggcctgccaggaaccacactctaaaacayttaaaataccaatctgctaaatactgtcatataaaagagatccctggttagagttactttgggaaccaaaactgaaaaggaatgaagccacagtgattag

SEQ ID NO: 42047 - DNA, 201 bp, Homo sapiens
tcttttcaaaatgctgcttttaccccatttttttttctccccattgttgcaaattgtaaacatctttaaaagatttcaggactctttgtgtttggttaagkttccaacaggtggaagatatcttccaagactgaccatagtcatatttgggaaggaaagatcagaatcaatttaatcaagatactaaatatgaaatggggg

SEQ ID NO: 42048 - DNA, 201 bp, Homo sapiens
aattacaaaactgtaattgtaacaagcgcatgacaaagttttaagatttgtttcaatgttgaattataaatatctcagagtttaattctttcctcaaactrtatttaaaattactacttttaatatatcttaaatatatttgaatatatgtctagaatatatattatcacagagataactttaggaaaaaaattattaaag

SEQ ID NO: 42049 - DNA, 201 bp, Homo sapiens
tgatatttcctaccaattatgactgaatgcaccagaacactttgtcctaagtaaatctataatacattttgaaaaggtttaagtggatttcaaaactgctwgataatagcttttttctaaggagatacgatatgaagacttggaaagtgttgtctgtagttattgtttacatccatagtagttgcctggttagttaacacc

SEQ ID NO: 42050 - DNA, 201 bp, Homo sapiens
gattcctacaattaagatgagcagccagggaataattcaggaaatcttatttaatttctaccttgctagatactatatatgatacacagagtgtaagaggragccctgccctcaaagattttacgatccagttgctaagacaaaaaaaaaattaaaatgtaattattacaaaagactgtaaaagtggccatacctaaaatg

SEQ ID NO: 42051 - DNA, 201 bp, Homo sapiens
gccagggaataattcaggaaatcttatttaatttctaccttgctagatactatatatgatacacagagtgtaagagggagccctgccctcaaagattttaygatccagttgctaagacaaaaaaaaaattaaaatgtaattattacaaaagactgtaaaagtggccatacctaaaatgcactgtggccatcgttgcctaga

SEQ ID NO: 42052 - DNA, 201 bp, Homo sapiens
cccccttttcatatggactgcatggcaggaagaactatgtatgcatttattcctcataattcagtattaatttttagggtaaaggattatctttctaccaktgttatcaggaagacaatagcctaaaaagcaagctgacattctccttcctgtttccatcagtttaaacaacagattatttttaaccattcttatttaact

SEQ ID NO: 42053 - DNA, 201 bp, Homo sapiens
gcatttattcctcataattcagtattaatttttagggtaaaggattatctttctaccagtgttatcaggaagacaatagcctaaaaagcaagctgacattytccttcctgtttccatcagtttaaacaacagattatttttaaccattcttatttaactgattgaggcagtaatggcttctgtgtgtttttttaatccact

SEQ ID NO: 42054 - DNA, 201 bp, Homo sapiens
tgttcattcagaagatgggctaaaagtgggccttgcaagacttgcataggaagagtagtggggccatatggtccaattaaaaaaaaaaaaagataagctaycttttgacaacaatgagtagattaattgaatgaaagctgcatttaagagcgagtataaatatttgttgaatggaaggaaagaagaaaaggaagaatgaat

SEQ ID NO: 42055 - DNA, 201 bp, Homo sapiens
gccttgcaagacttgcataggaagagtagtggggccatatggtccaattaaaaaaaaaaaaagataagctatcttttgacaacaatgagtagattaattgmatgaaagctgcatttaagagcgagtataaatatttgttgaatggaaggaaagaagaaaaggaagaatgaatggatgaaggatggaaggagacagagtgat

SEQ ID NO: 42056 - DNA, 201 bp, Homo sapiens
ggtctatagtagttgtgtgtgtactgaacatgtacaaacttttcctttcttgtcattattccctatacaatgcagagtacaataacaactattttgcatarcacatacattgagttataaattataagtaatctaggtatgatttaaagtaaataggaggatgtgcataggttttgtgcatatactacatcattttatatc

SEQ ID NO: 42057 - DNA, 201 bp, Homo sapiens
tcctacagagaaagttgccatcaccatcagaaggaacacacttcaagtaagaaagatatccatgggctcagaattcaccttaataagcaaatatttcatayacatataatgttttccataccatgttttatacatgggttacatatagacatgaaactgtactagtgacttctagaatcagtctattgatctctttatatt

SEQ ID NO: 42058 - DNA, 201 bp, Homo sapiens
taatgataatttgcatttttttaaagtgtgctataattttgaaagctctcacacattcattacttaatttaattcttatgaaaatcctctgaaattgactyagcaggtcctattttccataattttcaagtaacagtactgaaaaagccattgctcaaatgtatatcctactgaccataggttatttaaatgctcaaattt

SEQ ID NO: 42059 - DNA, 201 bp, Homo sapiens
gattgatgttttctcattattggattgaagttatgcatttttggcaggcatgctacagtgatataaccttctcagcctatatatcagggagtacatcatgycagtatgtcttattactggtgataattaaccttgatcatttggttaaggtggtgtctgctggctttctcccctgtaaagttacactttttccttttataa

SEQ ID NO: 42060 - DNA, 201 bp, Homo sapiens
atcacataagtgtcacctgctctgacagcattcaggacatttgcccatggtgcttttcttccattttttctcttcgtataatcatacactgtaagaggtcrgtggggactggtagtcttttaaagtgcattgacagaaaaggacagtatatatttcaaatctggctcatttgttatagcaaaagacagatactgaattgca

SEQ ID NO: 42061 - DNA, 201 bp, Homo sapiens
taggaaatgttatagagggagggatcctcagagaaacagagacagtaaatttttgctactctgaaatgtaattgcttaagacacttttaatttaaacaacrtacaacatgcacacactgagagagaacttgaccctctctagtaaacatttcttttactttctctaagtctttgacctcgaatgctttaccttgagtacag

SEQ ID NO: 42062 - DNA, 201 bp, Homo sapiens
aagaaaaaatagctcatgctttatatcttctgaagtgccacaaaatgctgttttctcattttattcaaatattattttattaataaaagacataatgatasctaaactttgatgagtgcttactgtgtactgtatcttgagaaaaacatgttttcttgtttatcctctagacagtttgattgattattataccctccattt

SEQ ID NO: 42063 - DNA, 201 bp, Homo sapiens
tgatgaagagtaaatataaaaacactttcttgaacatcatgccagcaccagtgaagagaggtgtgggtgtggaaggtttctagaaggagtttagcatgaarggtgctgtttatgccattgctaacacttggaacgcagtgactaaagacacagtagtacactcctggcacaacctcttgcctgtgactatattaagtgatc

SEQ ID NO: 42064 - DNA, 201 bp, Homo sapiens
catacacaaaaaatataatttcagagtctttccctaggctagcagaagtaaatatcaaagaacttgattatttttaacatcaataatgagattccaattcytcattgaccaatggggaaatagtccagatggttttgaatcaagttgattgtgataatagtgatgattaaaatgacattgttaacactgaagaaaaagttc

SEQ ID NO: 42065 - DNA, 201 bp, Homo sapiens
aaatataatttcagagtctttccctaggctagcagaagtaaatatcaaagaacttgattatttttaacatcaataatgagattccaattcttcattgaccratggggaaatagtccagatggttttgaatcaagttgattgtgataatagtgatgattaaaatgacattgttaacactgaagaaaaagttcctatggataa

SEQ ID NO: 42066 - DNA, 201 bp, Homo sapiens
taaggtaaaaatgtgtgacgggcttattgaaggactacagcactgtacatttataacagcacaagaaatcatgtcagtttataaagccaaagagagacgaygacaacgacgacgacgatggctactactactactactactactactactactactacttttcttttttttttttttttttttgaggtggagtttcactct

SEQ ID NO: 42067 - DNA, 201 bp, Homo sapiens
tcctacgtttccagagaaatgctcttaccttcatctgcagtctgtttgcaaaacagcaatttgttcttgcacataatcttctttgattgcataagaaatgyggaaccactcttttgtgttgattgcagcactcaggttagtattttcgaaaaaccagccagcaaatgcttagttcttgaatccctcagtgaaatggcattt

SEQ ID NO: 42068 - DNA, 201 bp, Homo sapiens
tataagttcaaaatcaagaatgattgtgatgccaaacaaccacagatggctcatatgggtggccgagatgttgacacttgccttctgatgatttaaaatayacaattttttcattaacaaaattattaaaatattatataatgttgccttcagtctatgggtataaggtgcatataaaacataaatgaattttgtatttag

SEQ ID NO: 42069 - DNA, 201 bp, Homo sapiens
atttcagaagataggtttttttattaaaaaaaaaaaaaaaaaacaaaaaaacactgtttggctgggctcggtggctcacgcctgtaatcccagcactttgsgaggccaaggcgggtggatcacctgaggtcaggaattcaacaccagcctgcccaacatggtgaaaccccatatctactaaaaatacaaacaaaattagcc

SEQ ID NO: 42070 - DNA, 201 bp, Homo sapiens
agtgtatgagatagctcacatttctttatcttggcaaagaaaatttcacaaaagatttaaaaaatgtttgagtgaaaccaattttatcttttagcaatgakttttttaaaaaaaggaagagaagaaaattaagttagtttactatgagtggctcctaatgaacctataccaatgtagcaaaaaatcattgttctcttttct

SEQ ID NO: 42071 - DNA, 201 bp, Homo sapiens
ggctgagccaggagcattgcttgaatttttggggctgcaccactgctctctagtctgggcaacagagcaagcctccatctcacaaaaacaaacaaacaaacgaacaaaccataatctaatttaattctaccaacaacctttgtaacaagcattttaatgatcattacagattaggaaattgaggctcagagagtaagcaat

SEQ ID NO: 42072 - DNA, 201 bp, Homo sapiens
tttcaacaaatggtgctggaacaactggttattaatataaaaaattcaatcaataacctcctaccaaaaatttatcaaattgtacactcacttgaaatgtrggatgtttattttatgtcaattttaactcaataaagctgttaaaaatagtaggaaagtatgagagagaaaggaaaaaagggacgaaatgtaaaatgctat

SEQ ID NO: 42073 - DNA, 201 bp, Homo sapiens
aggctgagccaggagcattgcttgaatttttggggctgcaccactgctctctagtctgggcaacagagcaagcctccatctcacaaaaacaaacaaacaaacgaacaaaccataatctaatttaattctaccaacaacctttgtaacaagcattttaatgatcattacagattaggaaattgaggctcagagagtaagcaa

SEQ ID NO: 42074 - DNA, 201 bp, Homo sapiens
gaggctgagccaggagcattgcttgaatttttggggctgcaccactgctctctagtctgggcaacagagcaagcctccatctcacaaaaacaaacaaacaaacgaacaaaccataatctaatttaattctaccaacaacctttgtaacaagcattttaatgatcattacagattaggaaattgaggctcagagagtaagca

SEQ ID NO: 42075 - DNA, 201 bp, Homo sapiens
aaatccaatattctcttttaatagtagcatctgactatttttattatactctatttttaatctaccacctatactggtaataaagaactttgtttcaggtyaatttaaatagattatagagcttttcttaccttaaatgtgtggtaaaattgctacagtatttctaaatggcctttccagcttgaattcattcttattttc

SEQ ID NO: 42076 - DNA, 201 bp, Homo sapiens
tcagggaattttatttctcttttatatatataaacataaatgtatgatttatagatacatatgataaaaatcatatatatacatatatatatatgatttttataaaatcctatcctagttgggaaaatccaatattctcttttaatagtagcatctgactatttttattatactctatttttaatctaccacctatactgg

SEQ ID NO: 42077 - DNA, 201 bp, Homo sapiens
taaagaaaaacctgggaactatggagatctttttttttctgctttgaggagaatattaacccatttttgctgattttagtaacttcacagagaagtttttwaaaaaaattcatatggatgggggtctcactatattgcccaggctggtctcaaatcctggtctcaagtgatcctccagccttggcttcccaaagtattaag

SEQ ID NO: 42078 - DNA, 201 bp, Homo sapiens
tcaggtattatcattgtgtccatacttaagaatgaagaatagataagaaagttactcagtgaaagcaataataacaaaaaatgatttgaaagaatgccctrtagaagagattattgtgtatgcatgtgaatgaaacagagaaaactaaattcaaatcatttactctctctgaaacttactttgcaaatctacaaaatgaaa

SEQ ID NO: 42079 - DNA, 201 bp, Homo sapiens
caaactacaggcctgtctgcctgattcccgcccagagctgtataatgcttgcagtgtctgtccatgtccttcacttgaaaaatatgacacaatgagagggmcaattatgatggtctattgtagtgtgagaaatgtcataatttgaatatttttataaaaatacatataggagaaaaggggggaacacaaccctcactctca

SEQ ID NO: 42080 - DNA, 201 bp, Homo sapiens
ccacatgcctggcaaggcctcacaatcatggtggaaggcaaggaggagcaagtcacatcttacatggatggtgccaggcaaagagagcttgtgcagaaaawctcttgtttttaaaaccatcagatctcatgagactcattcactatcacgagaacagaccaggaaatatccacccccataattcaatcacctcccacgggg

SEQ ID NO: 42081 - DNA, 201 bp, Homo sapiens
ctctagactataaagtccttgaatatttttacatgatttatggtgcagtggccaacgactataaaggatgcaaccggcaaaattatgcaggttggcttagycttaaaagtacacattgggttttgcatttagaaggtgtttttatatctttttaaaagcagtatcagtattatggtgaaggcaaaaattgtatcatgatca

SEQ ID NO: 42082 - DNA, 201 bp, Homo sapiens
taaaaagaacaaagtatttgggctagggcatgcactggagatcacttgtattcatattttagcatggaaagccataaactccatgaggataggaatttttrttccgctgatatatcctaagaataatgcttgacacatagtaggtactcagtacatttttgctgagtgaatgattatacctcaatgacctttttcagatta

SEQ ID NO: 42083 - DNA, 201 bp, Homo sapiens
tctgcatagacaggactattttgtaaaaacagcaacttgttctgattaagttatgatgtatttagcacacacttcagtaagagcattagactatctctttmaaatggaaagctatgtgcttatttgtatgggttttttatttgtttttctggtagagaagttgtcatatctgcgaactgaaagcacttaattttctaagta

SEQ ID NO: 42084 - DNA, 201 bp, Homo sapiens
taatgtatatatttttattatactttaagttctagggtacatgtgcacaacgtgcaggcttgttacatatgtatacatgtgccatgttggtgtgctgcacmcattaactcatcatttacattaggtatatctcctaatgctatccctcccccctcccccaaccccacaacaggccctgatgtgtgatgttccccttcctgt

SEQ ID NO: 42085 - DNA, 201 bp, Homo sapiens
taaaaaagacttaaatgaggtgattttatttttaaaaagcttataataattgagtggtgtatcctcaagactgactagggtgatttcaaatgtaagtttastaccagtttctttctagtgatggtgtggtatctatgtggggagagagtgcgtgggtgcagctatgagcacagctactaagactggaaataaatgtctgtg

SEQ ID NO: 42086 - DNA, 201 bp, Homo sapiens
ggtcatccatttagctcaaaaggagatagaataaaataaagaaaaatgctgaagaacaaatatatatatatatatatatatatatatatatatatatatayacacatctcaagaaggattagctaaattcagaaaaagcataatttagcaattttaatacattcacctatttcaccatatacagtgggagaagaaacttta

SEQ ID NO: 42087 - DNA, 201 bp, Homo sapiens
aacccgggaaccggagcttgcagtgagcggagattgcgccactgtgctccaggctgggcaacagagcaagactccgtctcaaaaaaaaaaaaaaaaaaaaaaaaatggagaaaggcaagtcatattttaagccagaataattttaatagcaaaacctttccattataaaaattacagagaaatattcttcgtgaatatgaa

SEQ ID NO: 42088 - DNA, 201 bp, Homo sapiens
attttatgtgaatcctaaacaacatggaacaaagttggttttgttgtagagaatgaggaggtcagcatgcatttcctgaggcaggaacatttgcctagtgrcttgaaagaatagtaggagttgagcaagcaggtcaaaggggacagactgttcaggccaaggttctaatatgcccacaggacagaggcatggaagatcatg

SEQ ID NO: 42089 - DNA, 201 bp, Homo sapiens
tggtcatggtgaatgatctttttaatgtattattgatttttgtttgctaatattttgttgaaaatttttgcatctatgtgtgtcagatatattggtctgcrgtttcctttttttgttgagtctctctggtgttggtatcagggtaatttttcaatattgccttttgtcttcagaatctacatagtgcagtaggcttttaag

SEQ ID NO: 42090 - DNA, 201 bp, Homo sapiens
gacttcttaaaaattgatgattattataccttctaaggtccaacctatacttctgttccaggggaaatatgataatatacatatgctttctgttgagattrgaccatgactgtatttactgtagggcttaatgatacattcataactgaatgctgcaaattaggttaaagccctagttaatttataatgaaggttttcagt

SEQ ID NO: 42091 - DNA, 201 bp, Homo sapiens
gtattagtctgctttcacactgctgataaagacatacccgagacgggcaatttccaaaagtagaggcttaagggacttacagttccacatgcctggcaagrcctcacaatcatggtggaaggcaaggaggagcaagtcacatcttacatggatggtgccaggcaaagagagcttgtgcagaaaaactcttgtttttaaaac

SEQ ID NO: 42092 - DNA, 201 bp, Homo sapiens
caagtcaacaccacaacgagatattatctcacacttgttaggatggcccttataaaaatatcaagagataagtgttggtgaggatgtggagaaaagggaamcctgatatactcttggtgggaatttagattaatgtagccattgtggaaaacagtatagctgttccttaagaaactaaaaatagaactacaatatgaccga

SEQ ID NO: 42093 - DNA, 201 bp, Homo sapiens
gattaagaattttgtcttttttccactgatgtatcaccaaatcttagaagagtcatgacataaagtaggccctttacatatttgttcaatgaataaatgtrtgactcatggcagaaatgatgttattactttaactggaaaattatttaatgtattgatatatccagagcttctaaatggcaggttagatatagccagctc

SEQ ID NO: 42094 - DNA, 201 bp, Homo sapiens
gaatcagttaggaggtgacagacttcatctggtacccgcagtctggtttttcagtcttcaggctgccctaggcttgaaggtggagtttcgctggacctccygctatctcctgtctctatccctaccacagccatcatggatactgtttatccaaatatagtaagtactaaaataactaaaatacagtggttaaacattaat

SEQ ID NO: 42095 - DNA, 201 bp, Homo sapiens
attcagagagaatcagttaggaggtgacagacttcatctggtacccgcagtctggtttttcagtcttcaggctgccctaggcttgaaggtggagtttcgcyggacctcccgctatctcctgtctctatccctaccacagccatcatggatactgtttatccaaatatagtaagtactaaaataactaaaatacagtggtta

SEQ ID NO: 42096 - DNA, 201 bp, Homo sapiens
tcccctagtgcgcaggtgggcattattcagagagaatcagttaggaggtgacagacttcatctggtacccgcagtctggtttttcagtcttcaggctgccytaggcttgaaggtggagtttcgctggacctcccgctatctcctgtctctatccctaccacagccatcatggatactgtttatccaaatatagtaagtact

SEQ ID NO: 42097 - DNA, 201 bp, Homo sapiens
atgctcttttgacttaaaaattaagaagcttatttttttctgcagggcatccagaattgatctgagttaccgtaactggcttctgctaacatgaccacatrtcacttacataaaaatcagaatgcttgtttatgatacaggtcacaaataccagctagcttagaaacaaataacaggtagctagtgaactgggccttctct

SEQ ID NO: 42098 - DNA, 201 bp, Homo sapiens
gtggtgttgcgtttctttgactctttgtgtttcttgaagctgtttgatggtgtcttcacatttgaagaaggagtcatctccttcagtgtttactgtctgayattaggaaagaaaaaccttgaccagtcagccccgttggagattttgggggtctttcagacctttttgtatgtagaggcacccactctatttctcttttct

SEQ ID NO: 42099 - DNA, 201 bp, Homo sapiens
tacctcatgaaactgtgggtgttgtgtgattattaaaacaattagtagagacaaaacatctagaattatagatgacagataaaacactttacatgtcaggkattatcattgtgtccatacttaagaatgaagaatagataagaaagttactcagtgaaagcaataataacaaaaaatgatttgaaagaatgccctatagaa

SEQ ID NO: 42100 - DNA, 201 bp, Homo sapiens
tgacaatttaatatttacaaaaaagataaaattggcaagaagactgatactgttcctagaacatggaggtaaggaggtgtagccagattatgtttgaacaygagctctaccactaataccatttattggcaagtgagttaacctctctgtttgtcaatattctccttcactaaatgaggataatgattccacttacctcat

SEQ ID NO: 42101 - DNA, 201 bp, Homo sapiens
agggaaatccgctgaccccttgtgcttcccgggtgaggcaacaccctgtcctgcttcagctcaccccttgtgagctgcacccactgtccaaccagtcccartgagatgaaccaggtacttcagttggaaatgcagaaatcatccatcttctgcatcaatcacactgggagctgcagaccggagctgctcctatttggccat

SEQ ID NO: 42102 - DNA, 201 bp, Homo sapiens
tccccttccccagccaggctgccgcctcgcagatcgatctcagactgccgcactagcagtgagcaaggctccatgggcatgggacccactgagccaggcaygggagagaatcaccttttctgctggttgctaaaaccttgggaaaagcgcagtatttgggcagggagtgccctgtttttccaggtagtctgtcatggcttc

SEQ ID NO: 42103 - DNA, 201 bp, Homo sapiens
tcgagcttcctggccactgtatttatctactgaagcctcagcaatggcagattccccttccccagccaggctgccgcctcgcagatcgatctcagactgcygcactagcagtgagcaaggctccatgggcatgggacccactgagccaggcacgggagagaatcaccttttctgctggttgctaaaaccttgggaaaagcg

SEQ ID NO: 42104 - DNA, 201 bp, Homo sapiens
gggtatcaccagcagaggctgcagaacagcaaatattgctgcctgatccttcttctggaagcttcatcccagaggggcagccgcctatatgaggtgtctgwtggcctctactgggaggtgtctcccagttaggctacacagaggtcagggacccacttaaggaggcagtctgtccattctcagagctcaaccaccatgctg

SEQ ID NO: 42105 - DNA, 201 bp, Homo sapiens
agattgtttatatatatgaagatttattaagagaaattggcttacatgggagctggtggtgtaaatcagttggagtttgaggacctgagaaccaggggagkcaatggagtaaatcctactcccagtgtctgagaagatatgagatgcctcagctcaaacagtgaggtaggaaaactgtagtgaatttcccctttcttgctt

SEQ ID NO: 42106 - DNA, 201 bp, Homo sapiens
atcactttcaggtgcaccaatcaaacatagatttggtcttttcacatagtcccatatttcttggaggctttgttcatttcttcttactcttttttgtctawccttgtcttctcactttatttcattaatttgatcttcaatcactgataccctttcttccacttgatcgaatctgctattgaagcttgtgcatgtgtcatg

SEQ ID NO: 42107 - DNA, 201 bp, Homo sapiens
taccagttgtttctttccatgtttcatgcttccttcaggagctcttgtaaggcaggcctgatggtgacaaaatctctcagcatttgcttgtctgtacaggrttttatttctccttcacttatgaagcttagtttggctggatatgaaattctgggttgaaaattcctttctttaagaatgttgaatattggcccctactct

SEQ ID NO: 42108 - DNA, 201 bp, Homo sapiens
cttagagacctacaaagagacttagactcccacacaataataatgggagactttaacaccccactgtcaacattagacagatcaacgagacagaaagttawcaaggatatccaggaattgaactcagctctgcaccaagcagacctaatagacatctacagaactctccaccccaaatcaacagaatatacattcttttca

SEQ ID NO: 42109 - DNA, 201 bp, Homo sapiens
tcaggtctgctctgatcttagttatttcttgccttctgctaggttttgaatgtgtttgctcttgcttctctagttcttttaattgtgatgttagggtgtcrattttagatctttcctgctttctcttgtgggcatttagtgctaaaaatttccctctacacactgctttaaatgtgtcccagagattctggtatgttgtgt

SEQ ID NO: 42110 - DNA, 201 bp, Homo sapiens
tgagacaggagaattgcctgaacttgggatgcagaggttgcaacgagctgagatcgcgccactgcattccagtctggagaaaagagtgagactctgtctcaaaaaaaaaaaaaaaaaaaaaaaacccaaaaacaatagttgctatgactgcaaaggaaatgttagacatgcacaaaagttataatctgaaattggttcaac

SEQ ID NO: 42111 - DNA, 201 bp, Homo sapiens
tgcacattgattttgtatcctgagactttgctgaagttgcttatcagcttaaggatattttgggctgatatgatggggttttctaaaagtacaatcatctsatatgcaaacacagacaatttgagttcctcatttcctaactgaataccctttatttctttctcttgcctgattgccctggccagaacttccaacactatg

SEQ ID NO: 42112 - DNA, 201 bp, Homo sapiens
ggattcacagccgaattctaccagaggtacaaggaggagctggtaccattccttctgaaactattcgaatcaatagaaaaagagggaatcctccctaactsattttatgaggccagcatcatcctgataccaaagcctggcagagacactacaaaaaaagagaattttagaccaatatccctgatgaacatcgatgcaaaa

SEQ ID NO: 42113 - DNA, 201 bp, Homo sapiens
attaaataaggaatcctttcctcatttcttgtttttgtcaggtttgtcaaagatcagatggttgtagatatgtggcattatttctgagcctctgttctgtyccattggtctatatatctgttttggtaccagtatcatgctgttttggttactgtagccttgtagtatagtttgaagtcaagtagcatgatgcctccagct

SEQ ID NO: 42114 - DNA, 201 bp, Homo sapiens
ttcccgttcactcatttattctgtagacacatatacatgatctctacaagatagctgcttactctgataaggcagtctttgaaaggtttatttgaaattaygtccaatagttaacaattattagataatatcccagaaatagtgactaagttggtgttatatttccttgactttttcttttaaatgcatataggttatcgc

SEQ ID NO: 42115 - DNA, 201 bp, Homo sapiens
gttttcagcaagttcttggaaactgtgactttagtggccctcaaataatgttgttttattcaacattgttttcttacaatgttgatgattttaaaaaaatkggtgtcatcatacattgtttcaattaaagtcacagtttccaagaactatggaagaatttaaataaggacttactgtactatagaaattaaacataaagga

SEQ ID NO: 42116 - DNA, 201 bp, Homo sapiens
tgacaaaaaccacatgattatctcaatagatgcagaaaaggcctttgacaaaatctacacccttcatgctaaaaactctcaataaattaggtattgatggracgtatctcaaaataaaaagaggtatctatgacaaacccacagccaatatcatactcaatgggcaaaaactggaagcattccctttgaaaactggcacaa

SEQ ID NO: 42117 - DNA, 201 bp, Homo sapiens
tcaatgggcaaaaactggaagcattccctttgaaaactggcacaagacagggataccctctctcaccactcctattcaacatagtgttgggagctctggcyagggcaatcaggcaggagaaggaaataaagggtattcaattaggaaaagaggaagtcaaattgtccctgtttgcagatgacatgattgtatatctagaaa

SEQ ID NO: 42118 - DNA, 201 bp, Homo sapiens
tataattatatatgctatacatttttggatagataatttttatttggctgaggaggtttctctttgtttcatatttgctaagtctttaattattaatgaaygtagaatttaattgaaaactattgggaagatgtgtttttctttataaatatggtaaattttttatagattatctgatgttaaataatcttgtatttctga

SEQ ID NO: 42119 - DNA, 201 bp, Homo sapiens
ctcaaaatatatatatgtaaaatataaaatacacatgtaaaatatactatatgtaaaatatatataatatatgtaaagtattattttatatatatatatakatagagagagagagacagacagacagacagacagacagacagacagagagaccaagtctcttattccgtcactcaggctagtgtgcagtagcatgatcat

SEQ ID NO: 42120 - DNA, 201 bp, Homo sapiens
aagttatgtgatagagttatgtgtttgtctaggtttatgagatcaaagtagctgatcatttcttttgcatgtatgaacctggagagcaacgtggatagatrgatgatagatagatagatagatagatagatagatagatagatagatagagatttggattgagttcttaaacgcatttgttttatacatcagagtttgtaa

SEQ ID NO: 42121 - DNA, 201 bp, Homo sapiens
tcctccatccctcccttccttactctcttcctctcttttctttctttctttctttctttttctttctttctttctttctttcgttctttctttttctttcyttctttctttccttctttctctctttctttattttcttctttctctcccttctttccttccttcccaacttaatacacagtaagtactgaaatatttttt

SEQ ID NO: 42122 - DNA, 201 bp, Homo sapiens
taaacatatatatatatatacatatttgggggggatctgggggtttggatcaagtaagagacttggtctcaaaatatatatatgtaaaatataaaatacayatgtaaaatatactatatgtaaaatatatataatatatgtaaagtattattttatatatatatatatatagagagagagagacagacagacagacagaca

SEQ ID NO: 42123 - DNA, 201 bp, Homo sapiens
aaataaaaaaaacaagaaactaaacattaccagagaaaacaccttcattcaaagggagacatgaagggaagaaagaaggaagagaagaccacaaaacaacyagaaaacaaacaacaaaatggcaggagtaagtccttttttaacaataataacattgaatgtaaatggactaaactctccaatcgaaagacattgagtggc

SEQ ID NO: 42124 - DNA, 201 bp, Homo sapiens
ttatagaaaagaattagttttatttttaagcagctgctttatgaatacctgcaacgttttagtgcctacctttcttttctttctctttacttttctttccytttctcttttcttttcttttccttttctttcatttttttctctctcccccttctcccttcttcccttccctttccttcctccctcccttccttcctccat

SEQ ID NO: 42125 - DNA, 201 bp, Homo sapiens
acaactgcatgtgaatttgtaattatctcaataaagaacccaactaaaatttatttcagacatttacatagtgtctaatatattgtgtatgtgtgtatatmtatatataaacatatatatatatatacatatttgggggggatctgggggtttggatcaagtaagagacttggtctcaaaatatatatatgtaaaatataa

SEQ ID NO: 42126 - DNA, 201 bp, Homo sapiens
taggcaaatagtggtgtaaagatgtttctcagtcatctttgggtaattttctttgttgttggtggtgggttttttattacataatttttttttttttttttactaaccatttggtcatcattcacacagatctttatggttataatcttaaaaacttaagtttagtgctggtattccaagctactgctttagtccatttat

SEQ ID NO: 42127 - DNA, 201 bp, Homo sapiens
atcttttttgtagatggtgctttgtgaaatgtttcgtggtttataacatttagaatatgtgaaacttttgctgtatgctttcttgtagaagagatttttttatttgaaagtgtagttttaattcatatacagtaaaattgacttttttggtgtatatttctatgagttttggaaaataggtagagttatgtaacccattac

SEQ ID NO: 42128 - DNA, 201 bp, Homo sapiens
aatgagttccgaacgaagtctcacactgtacacaaaaataaactcaaaatggatcagagacaaaggtaaaatattaaaaaattataatataaatacaaaaygtttagaacaaaataggaaaaaatattcgggatctagggctaggcagagtccttgataccacaatcatgaagtgtgaatttaaaaaattgatgaattaga

SEQ ID NO: 42129 - DNA, 201 bp, Homo sapiens
tgttttttttttttttttttcctgcttgctctctatgccttttagatggggcatctatatcatttacattcaagattaatattgatatgtgaggttttgawccagtcatgatattattagcttgtagctttgtattctcaattgcattgtttctttatagggtctgtgggctctgtacttacatatgtttttatggtagca

SEQ ID NO: 42130 - DNA, 201 bp, Homo sapiens
gttgtttatctgttctagaaaccttttggcagagacttcagggttttctaagtatagaatcatatcatctctgaagagagagagtttgattttttttttttctatttgaatgccttttatttctttttcttgcctgaatgttctagctagaacttccagtactgtgttgaaaatgagtagtgagagtgggcatctttttct

SEQ ID NO: 42131 - DNA, 201 bp, Homo sapiens
tcaatcaaatacttgtaacacaattttataaaaattagatcttttatatcagacacgcaactacaaatcatatattatgtatgtggggtgcataacaaccrtaaaagtttctcaaagatcaatgttcaatcatccttcacacacatatcttgaatccagcaatattttccaggcatgtgtgtgtttggctgtatgtgaatg

SEQ ID NO: 42132 - DNA, 201 bp, Homo sapiens
cttctctgagtccatttcctctcctgtaaattagaaattgaataccaccaactacaccaggccattgtgaagaaaaataatatacatgaatatgccttatmaactataaaacggtatataaattaatgtattattaatagtatcttcatgtttatatttcatgaaacaaatgattatatgcagtagctatttctttttaaa

SEQ ID NO: 42133 - DNA, 201 bp, Homo sapiens
gagcttttaaaatattgagtagattaactctttgtaatatgacttgcaattacactttttccagattgttgtcttttgaatttgcttatggtgtattttcrccatggagaagattttaattgttgtcagatttatacatttttttcttttattgactcagtcatagttagctcgcaggcccaaggttgaaaaggaattatc

SEQ ID NO: 42134 - DNA, 201 bp, Homo sapiens
gttcaatcttttgtttgtccttctatcaagttgtaaaacttctttaaatattctaggtataagtcctttgtgggacatttatttttcgaatattttctccyattccgtggtgtactttttcattcattttttttggagctctgtaagcccttttcccaccagcttctgttttagattcaaggggtacatgcgcaggttttt

SEQ ID NO: 42135 - DNA, 201 bp, Homo sapiens
agcccttttcccaccagcttctgttttagattcaaggggtacatgcgcaggttttttacaagggtgtgttgtgtgatgctgagatttgggatacaattaarcctatcacccacatactgagcatagtacccaatgattagtttttcaacactttcctttctccctttttccgcactcttgttgtcaccatttttatgccca

SEQ ID NO: 42136 - DNA, 201 bp, Homo sapiens
ttgtacctctggaagagtttggctgtgaatatgtctggtcctggactgttcttgattggtaggctattaattattgcctcaatttcagaacctgttattgstgtagtcagagattcaacttcttcctggtttagtcttgggagagtgtatgtgtccaggaatttatccattttttctagattttctagtttatttgcgtag

SEQ ID NO: 42137 - DNA, 201 bp, Homo sapiens
taacctccgcctcccgggtttaagcgattctcctgcttcagcctccctagtagatgggattacaggcacgtgcccccacacccagctattttttgtatttktagtagagacggggtttcaccttgttggctaggctggtcttgaactcctgacctcaagtgatccacctgccccaacccctcatagtgctgagattacagg

SEQ ID NO: 42138 - DNA, 201 bp, Homo sapiens
ataagtgctgcagagtttgtataagtattgttgataattggcttgtaaatagcaatattggactttatttttctttcaataattttcaaaagtaagtcaastaaattcgagctgtctaaaagcgaaagaataagcagctttcagtgcaaagaaactgggcaaattttgttaaagtttaacaaaacttttgtaaaattacca

SEQ ID NO: 42139 - DNA, 201 bp, Homo sapiens
ctgatatagggatttttaaaagtatcatttattataaacactgctggcagtatttctttaagattccagatattctaaagtctagtgttgattgtaggttrtagtgatttaagaaaggttatacaaattcccttaccacatgcctcaaaatgcttatgtaaaaagaggaattaaagtatggatgttgataaaaaatgaaat

SEQ ID NO: 42140 - DNA, 201 bp, Homo sapiens
acaggcatgagccatcatgcccagcatctttttattcttttaagtgtcttttgcagagtagaagttttaaatttttatgaagtccaatgtattcattttttgtaaaaaaattgttaattatgtttttggtgttatattttaaaagttcttgccaaacccaagatcacctagagtttctcctctgttatcttacagaagctt

SEQ ID NO: 42141 - DNA, 201 bp, Homo sapiens
agtatcatttattataaacactgctggcagtatttctttaagattccagatattctaaagtctagtgttgattgtaggttatagtgatttaagaaaggttwtacaaattcccttaccacatgcctcaaaatgcttatgtaaaaagaggaattaaagtatggatgttgataaaaaatgaaattatttttgagggaagaagaa

SEQ ID NO: 42142 - DNA, 201 bp, Homo sapiens
agtgagtcagtaggctttaagaaggtcagatgctaactaataatggctaaattatattattttcctaaattgaatgcgattattttctgagcttataaaakttggtctgatatgaaaggagcaggggcagccagtatatcacggtggtttaaagcgaagctggaaaaaatgcccaggctctgtaagaatcatgtgcatgat

SEQ ID NO: 42143 - DNA, 201 bp, Homo sapiens
agatgctaactaataatggctaaattatattattttcctaaattgaatgcgattattttctgagcttataaaatttggtctgatatgaaaggagcaggggyagccagtatatcacggtggtttaaagcgaagctggaaaaaatgcccaggctctgtaagaatcatgtgcatgattaatgctgaggccactgccaacaggaa

SEQ ID NO: 42144 - DNA, 201 bp, Homo sapiens
ggaagtagtctcactctgttgcccagggtggagtgcaatggcaggatctcagctcactgcaacctttgtctcccaggttcaagtgattctcccacttcaayctcccgagtatctgggactactggcatacaccaccacacccggctaattttttgtattttttagtagagatagggtggtatgggaaggtcaagacaactt

SEQ ID NO: 42145 - DNA, 201 bp, Homo sapiens
ttatgtgatagagttatgtgtttgtctaggtttatgagatcaaagtagctgatcatttcttttgcatgtatgaacctggagagcaacgtggatagatagatgatagatagatagatagatagatagatagatagatagatagatagagatttggattgagttcttaaacgcatttgttttatacatcagagtttgtaaaac

SEQ ID NO: 42146 - DNA, 201 bp, Homo sapiens
acaaagtaattaatgaaataaaaatgtaagaaaaagccaatgtatgatattggttcatttgaacaacttttattgaacgcttattgtattcctgacactctttttggtactgaacatttaataaatgaagaagacaaagtgtttttcctcaaggaaatcacagtcagcagggaaatatacaggtaaagagggttgaacagc

SEQ ID NO: 42147 - DNA, 201 bp, Homo sapiens
gtgatagagttatgtgtttgtctaggtttatgagatcaaagtagctgatcatttcttttgcatgtatgaacctggagagcaacgtggatagatagatgatagatagatagatagatagatagatagatagatagatagatagagatttggattgagttcttaaacgcatttgttttatacatcagagtttgtaaaacagta

SEQ ID NO: 42148 - DNA, 201 bp, Homo sapiens
tacaaagtaattaatgaaataaaaatgtaagaaaaagccaatgtatgatattggttcatttgaacaacttttattgaacgcttattgtattcctgacactctttttggtactgaacatttaataaatgaagaagacaaagtgtttttcctcaaggaaatcacagtcagcagggaaatatacaggtaaagagggttgaacag

SEQ ID NO: 42149 - DNA, 201 bp, Homo sapiens
ctttaaagttcatatggaagcaaaaaagagcccgcattgccaagtcaatcctaagccaaaagaacaaagccagaggcatcacgctacctgacttcaaactrtactacaaggctacagtaaccaaaacagcatggtactggtaccaaaacgaagatatagaccaatggaacagaacagagccctcagaaataatgctgcata

SEQ ID NO: 42150 - DNA, 201 bp, Homo sapiens
tcaggtctctgttaactgttaatatattgacatatgagtaaactgaaaataatttacaaagtaattaatgaaataaaaatgtaagaaaaagccaatgtatratattggttcatttgaacaacttttattgaacgcttattgtattcctgacactctttttggtactgaacatttaataaatgaagaagacaaagtgttttt

SEQ ID NO: 42151 - DNA, 201 bp, Homo sapiens
gtatgggcaaggacttcatgtctaagacaccaaaagcaatggcaacaaaagcaaaattgacaaatgggatctaattaaactaaagagcttctgcacagcaraagaaactaccatcagagtgaacaggcaacctacagaatgggagaaaatttttgccatctactcatctgacaaagggctaatatccagaatcttcaaaga

SEQ ID NO: 42152 - DNA, 201 bp, Homo sapiens
ttggctgttgttttaggctacgattatcttcttgtttaacaagttccttattttccttatttatttctaggactaactaggttcctagaatttccatcctrgaaactcagcatttgtctttatgtccatgattgagatccataggcttttaaaaagtggtatccctgctctatctcaataatatttcaggtctctgttaac

SEQ ID NO: 42153 - DNA, 201 bp, Homo sapiens
ctcttctagctattttgaaatacacattagttcagactatagttaccttactgtgcagttaaacactagaacttattcctcctaactataactttgtatcyattgaacatatatatttttatatgtgtgtatgtgtgtacatatccgtgtatatatatgtgtatgtgtatatatatatagagagagagtgtgtgtgatgag

SEQ ID NO: 42154 - DNA, 201 bp, Homo sapiens
taactttgtatccattgaacatatatatttttatatgtgtgtatgtgtgtacatatccgtgtatatatatgtgtatgtgtatatatatatagagagagagwgtgtgtgatgagagagagatgtttgtgtatacatatatataagtatacatattcacattgacaatatactttatttgggttcttatctaaatattagata

SEQ ID NO: 42155 - DNA, 201 bp, Homo sapiens
gaataggaacacttttacactgttggtgggactgtaaactagttcaaccattgtggaagtcagcgtggtgattcctcaggaatctagaactagaaataccwtttgacccagccatcccattgctgggtgtatacccagaggattataaaacatgctgctataaagacacatgcacacgtatgtttactgtggcactattcc

SEQ ID NO: 42156 - DNA, 201 bp, Homo sapiens
aaatttaaattattatagaccatggtttcagtcttgtgactgactttgttgttcacgaggatggacattttgctttcattttaggatcttaaattatttcttttaaaaaaaaatcatctttttttggcattaagatcctgggagtttggccatgttgttaaaaagtagacagattgagtggaaaaagaaaattccacacat

SEQ ID NO: 42157 - DNA, 201 bp, Homo sapiens
tgagcccagattgtgccgctgcactccagcctgggcgacagagcgagactccgtctcaaaaaaaaaaaaaaaaaaaaaatgtgtatggtataagtttctgygataactagaggagctacatacttttgactcacactaaaccaaattgttctaacaagaagctatctgactctagtttatttgtgagaagaaatgtttctg

SEQ ID NO: 42158 - DNA, 201 bp, Homo sapiens
cggttactttcttttaaatttagtgaaagtttatgaatataaatttctcattttgaagtccacataagtctaaatgactttttactttgcttttgtactcatagtgttttgagtcagcacacttacctctaagtgatccctgaatataaattttcttaccatcagtcaaatcctctttgcctttttatacttggactagaa

SEQ ID NO: 42159 - DNA, 201 bp, Homo sapiens
aaaaactaatttgattcatttacttacagaaagccatatcttggaagatgtcaacaagtgtatcatagccttaagagaccaggatgctgataatttagacygtgctgcgggtgctatcagaggccgggcagcaagagttgctcacatcgtcacgggtgaaatggacagttacgagccaggggcttacacggaaggtgtaat

SEQ ID NO: 42160 - DNA, 201 bp, Homo sapiens
ttctaaaaggagacttggggaactgcgacagtgcactagcaattcagcttttgtgtaaattactttatttatcaagagttatgtttcaaatatttaaaagrcctaaaagtttctgtagaccatcttctcattttatgggtgaggaagtgagactcagcaagacttcaagaagcaatttcacaatacgtctagggagaactc

SEQ ID NO: 42161 - DNA, 201 bp, Homo sapiens
tttacactcccatcaacagtgtaaaagcgttcctatttcttcacatcctctccagcatctgttgtttcctgactttttaatgattgccattctaactggcrtgagatggtatctcatcatagttttgatttgcatttctctgatgaccagtgatgatgagcattttttcatgtgtctgttggctgcataaatgtcttcttt

SEQ ID NO: 42162 - DNA, 201 bp, Homo sapiens
ggttactttcttttaaatttagtgaaagtttatgaatataaatttctcattttgaagtccacataagtctaaatgactttttactttgcttttgtactcatagtgttttgagtcagcacacttacctctaagtgatccctgaatataaattttcttaccatcagtcaaatcctctttgcctttttatacttggactagaaa

SEQ ID NO: 42163 - DNA, 201 bp, Homo sapiens
aagtctcagccagaggtgagcagacaatgggatgaccagctgcagagagtagttaccttctctgctgagagtgggagatgtcagtatgaccagaacctgaraggagctgcccactttatggcctcctctttgctgagagcttcagaaacttgcagagaagtcaggactatcagctgtagagaacagcaacccactccaggg

SEQ ID NO: 42164 - DNA, 201 bp, Homo sapiens
ggcgtgaacccgggaggcggagcttgcagtgagccgagatcccgccactgcactccagcctgggcgacagagcgagactctgtctcaaaaaaaaaaaaaarcaaaaaaaacttcctcttaacatgtataggattatatttaatgtaatgcaaacaagtttcttttcatctgttttttctctgaaatagtgattagttgaaa

SEQ ID NO: 42165 - DNA, 201 bp, Homo sapiens
aggcctgtgcgaggcacttatttcttctgaattttgtccatttacatataagcttctcatggagtctgaggtgcagccgcattctttttctttttttttttcttttttgcttgagatcacagaattattattgatagccttcaaaccctctcaaagtgtcagaataagaggtcattaattatacccatttttctctgaagt

SEQ ID NO: 42166 - DNA, 201 bp, Homo sapiens
tagtgaaaggctttctaaaaacatttattatgtacaaagttcatgatatgttttgttctaagtactagagatggttggtttaaaaactttgacttggtccrtgaggtgttcgaattctagcaaggaagcaaacacactatttaaaacaacaataaaataactggatatgggttgatatcagtgttctactccaagtgatat

SEQ ID NO: 42167 - DNA, 201 bp, Homo sapiens
ccttttagtgaaggcaattttcattagtggtgtgatgaatttattgctttttatgttttgtgtatctgttgtatattttgatttgaggttactatgaagcwtgcaaatactatcttataatctattattttaaactaatgacaacttaaagttgatggcataaacaaacaaatgagaaaaaaactaatagaaatgctacac

SEQ ID NO: 42168 - DNA, 201 bp, Homo sapiens
cagcctcccaagtagctgggactacaggcgcccgccactacgcccggctaattttttgtatttttagtagagacggggtttcaccgttttagccgggatgstctcgatctcctgacctcgtgatccgcccgcctcggcctcccaaagtgctgggattacaggcgtgagccaccgcgcccggcctctccagactaattctat

SEQ ID NO: 42169 - DNA, 201 bp, Homo sapiens
gacttggtccgtgaggtgttcgaattctagcaaggaagcaaacacactatttaaaacaacaataaaataactggatatgggttgatatcagtgttctactycaagtgatatgggaaaacaatgagggagcaactgattattttagggaagtcctcacattttttagagaagaggtggaaattaaacaatgaatggcatagg

SEQ ID NO: 42170 - DNA, 201 bp, Homo sapiens
gtatctttttttatttcttatttctgtctgtgtttatctttataggggaagtatgttttttataggcaacagatcattgtgggttttttaaaatctattcwtctactccatgtcttttttattggagagtttaatccatttacatgtaatgttattattgataaataaggacttactcctgctattttttttctgtttttt

SEQ ID NO: 42171 - DNA, 201 bp, Homo sapiens
actccaactagtacagaaaccccatttgttgcctgttaattgaaggccctaatttggctgggtcaagtctcaatgtctagttcaatgcaatcattattgcrttatcacttgatagaagcattacttcctttgaaattaagatctctaaactcacagggcctaaaataatggcaatgagcggcaaaagtttgctagtatatc

SEQ ID NO: 42172 - DNA, 201 bp, Homo sapiens
gaggtgagaggaaaagtgctttcttagaccccccatgtctgtatactactattccctggaatgctcatttcattccctacctgtacccttttcggcttcamaaactcctcagaaatgcactcaccttctatttatccatctaattaccctccctgcttattttgaaatatataatttggactacaaagatatgctggtaaa

SEQ ID NO: 42173 - DNA, 201 bp, Homo sapiens
gttaacactttaacatcctgatttccattcctttgggtatataccttgcagtgggattgctggattgtatgttagttctatttttagtttttgtttgtttstttctttgtttgttttgagatggagtctcgctctgtcccccaagctggagtgcagtggtgctatctcggctcactgcaagctccgccttatttttagtat

SEQ ID NO: 42174 - DNA, 201 bp, Homo sapiens
aagttgaaagttatatgcagctgaaaatctgtgtggggtttgacactcctaactcccatgttattcagtggtcatctgtacattgattttgatgcttatawtaaaacatgatcaaattacatagctggaatgataattttaccaatatgataattttgatgatgataccatattaataatgataatatctattgaatttag

SEQ ID NO: 42175 - DNA, 201 bp, Homo sapiens
ttttcatttctctaataatcagtgatgttaagcttttttaaataagtgtgttggctacatgtatgtcttgtttggaaaagtgtctgttcatgtcctttgcytatttttatatggggttgtttgttttattttttcttgtagatttgcttaagttccttgtagatggtggatattagagcttagtcagatgcagagtttgga

SEQ ID NO: 42176 - DNA, 201 bp, Homo sapiens
actgaaaacttgagaaacacccttaatttctatattcttgtctgattgtgtctctgtctggctatcctgtatctattcatgcatatgtccatgcctatctkgcagattgatagtatttctgcagaagagttgaattctttgctacctttgttgattattatcgactttgactcagggtaatgtgttctcatcttgtgcaca

SEQ ID NO: 42177 - DNA, 201 bp, Homo sapiens
ccacaatggttaaactaacttacactcccaccaacagtgtaaaagtgttcctatttctctgcaaccttgccagcatctgttgtttctggactttttaatasttgccattatgattggcatgagatggtatttcattgtggttttgatttgcatttctctactgatcagtgatgttgagctttttttcacatgtttgttggc

SEQ ID NO: 42178 - DNA, 201 bp, Homo sapiens
ttattaattggcctaatttcaacattgtatctcaaggaataaaaaagccctaggagaaggagagatggaggagatggggacaactggttattggagcagcyagaacacataaaacattgagtaattaagttcactttcttttatgggtgctgttcatggtgccccacaacaattacgatggtaacatagatcacagatcat

SEQ ID NO: 42179 - DNA, 201 bp, Homo sapiens
tctattttttgtacccattaactatcctcacttccccctaagtccccaactacccttcccagcttctggtaactattcttctaccctctatctccacgaaytcaattgatttaatttttagctctcataaataagtgagaacatgtgaagtttatctttctattcctgactcatttctttctatttctgactcatttcact

SEQ ID NO: 42180 - DNA, 201 bp, Homo sapiens
acttttatgtctagctagaggattttaaatgcaccaatcagcactctgtgtctagctaaaggattgtaaacacactgatcagcactctttgtctagctcamggtttgtaaatgtaccaatcagtgctctgtgtctagctaatctagtggggacttccagaacttttgtgtctagctaaaggattgtaaatgcaccaatcag

SEQ ID NO: 42181 - DNA, 201 bp, Homo sapiens
gtattcctaggtattttattctttttgtggcaattgtgaatgagattgccttgctgatttgggtctcggtttggctattgtgggtgtataggaatgctagygatttttgtacattgattttatatactgcaactttgccgaaggtatcagctggaggagattttgggctgacactttggggttttctagatatagaatcat

SEQ ID NO: 42182 - DNA, 201 bp, Homo sapiens
gccaacatattgtgaactagaaaaataagctgaattatttcatacaagatatttcatgaaagccttggcttttcagtttaagcagatactaaaattacctrgggaattattttgcaagtaagtaggttgaaggaaaaacaaaaggcagtggaacgaagtccaggaaactgaataaagaagtcaaagattcattcacttatt

SEQ ID NO: 42183 - DNA, 201 bp, Homo sapiens
tctatcattctgtaggttgtcttgtcactctgttaattgttttctttgctgtgcaaaacctttttagtttgatataatcccatgtgtttatttttgctttygttgcctgtgcttttgaggtgttagccatcaaatctttgccaaaatcaatgtcctgaagccccgtgttttcttctactagttttatagttttggatttta

SEQ ID NO: 42184 - DNA, 201 bp, Homo sapiens
aactgcctggagtttaaatcctggttccaccacttagtagttgtattatgttaggcaagttgcttaaactctctgtaagtgtttcctcatttgcaaaatgrggatgataaatctcccactgaggattaaatgctccaatgcaagttaagctcttggaaccctggcacaaagtaaatacttaatagttattatcttattatt

SEQ ID NO: 42185 - DNA, 201 bp, Homo sapiens
ttttttgaaattttctgcttttctgttctggtttctccccatctttgtggttttatctacctttggtctttgacattggtgacctgcagatggggttttaytggggatgtcctttttgttgatgttgatgctattcctttctgtttgttagttttccttgtaacagtcaggcccctcagctgcaggtctgttggagtttgc

SEQ ID NO: 42186 - DNA, 201 bp, Homo sapiens
ttttgaaattttctgcttttctgttctggtttctccccatctttgtggttttatctacctttggtctttgacattggtgacctgcagatggggttttattrgggatgtcctttttgttgatgttgatgctattcctttctgtttgttagttttccttgtaacagtcaggcccctcagctgcaggtctgttggagtttgctg

SEQ ID NO: 42187 - DNA, 201 bp, Homo sapiens
ttctatgttggaagaccatttaactcagattatttggctttgtgtgtgaacaccagtgcattatcttgagtaatgttggaactgagttcatataaactgtytcttatgttgttttcatcctgtttccttccttttagagactccaagagtagaaacatccatgggtactggaattgggtaattagaatgatttggaaaaac

SEQ ID NO: 42188 - DNA, 201 bp, Homo sapiens
aggtctgaagtggagtctaaaaatttttatttctaacaaattcctaggtaatgctgatgctgctggcctggacatgacacttcgagaaccattaatctaargcaatagctaactgatgatgtagttctaagaatgaaatacatgtgcagccttccaatgtactgtcttacatatataggcagaaaaattctgccttatgtc

SEQ ID NO: 42189 - DNA, 201 bp, Homo sapiens
cataaataataactttgaaggtaaatggattaaattttgctcttaaaagatatagcttggtgactcagacctttaatctcagcactttgggaggctgaggygggcagatcgcgaggtcaggagttcaagaccagtctggccaacatggtgaaaccctgtctctgctaaaaatacgaaaatgaaccaggcatggtggcacat

SEQ ID NO: 42190 - DNA, 201 bp, Homo sapiens
aatgattaccacagtcaaatgaattaacacatccatctctacccatagttaccactgtgtgtgtgtgtgtgtgtgtgtgtgtgtgtgtgtgtgtggctaasacacttaaaatctactttcttatcaaatttcaagtaaagaatacaatatgttaactatagtcaccatgctacacagtagagtcccaaaacttattcatct

SEQ ID NO: 42191 - DNA, 201 bp, Homo sapiens
ttgtgctagagtggggattttcctataaaacctcttttctcttctgttcattcctgcatttccaaattttgaagtctctgaattatgactcacttgtgctyccaaaccagcgtatctgccgtgtattccagttttgtctggcttcagcttattgctggtggatggtgactgctgctggtggtactctgggaaactggaaat

SEQ ID NO: 42192 - DNA, 201 bp, Homo sapiens
acatctggaaaaaaaaatctgaggttctacagtagtgatgttatctgtaggagcaattgagaaggtcacaaatcttgactcctgaccacataactcctgaycagtaagcgattttagaaattacatctatcttgtggcctctcagtcttacaaagacagtttcagtctccaaacaaggaggagttagttttagggaaggaa

SEQ ID NO: 42193 - DNA, 201 bp, Homo sapiens
cactccagcctgggtgacagagcgagactctgtctcaaaaaaaaaaaatatgtaaaagttgtgaaagtgggcttttagcttcaaataaatatatgtctcayatcaaagccacagctaattaaagaactaagaaagaaaaggaatattcaaatatctggagtaatctaacaaacagcagtgttcagagtttttaaattatta

SEQ ID NO: 42194 - DNA, 201 bp, Homo sapiens
cgagttaatggatgcagcacaccaacatggcacaagtatacatatgtaacaaacttttaccttgtgcacatgtaccctaaaacttacagtataataaaaaraagaaatatgtgcttacttctttttcatatttcacaactgaccagtgaattgcctgttctatattttattttttgagcttggaatcatgtcccatttaac

SEQ ID NO: 42195 - DNA, 201 bp, Homo sapiens
aatcgcttgaacccaagagtcagaggtgatagtgagccaagatcatgccactgcactccagcctgggtgacagagcgagactctgtctcaaaaaaaaaaaatatgtaaaagttgtgaaagtgggcttttagcttcaaataaatatatgtctcatatcaaagccacagctaattaaagaactaagaaagaaaaggaatattc

SEQ ID NO: 42196 - DNA, 201 bp, Homo sapiens
attaacaaaatcgctttttatcgttcgtctagaattcaaaaagggagattatattggtctcttttttttcaaaattgtgatattttcttccctgaaaaaartagatccctccaaaaatgcagtgttgttcttgaaataaagaacaaaatttttaaaaatctggtgcatttagatgtatgtttctactcattttttggacct

SEQ ID NO: 42197 - DNA, 201 bp, Homo sapiens
tatatgtacagtagtgaaagctctacaaattaaataaattaaggcttaataaatgtggtttttcagatgagttttttcttttaggaaacagtttgcattckcaatcttgatttgcaagataccatatttcgttaatttaaacacattttcccacattgtccacctcacattttttaccatttctgaaattaggatgcatcg

SEQ ID NO: 42198 - DNA, 201 bp, Homo sapiens
cctttaatcccagctactcagaaggctgaggcaggagaatcgcttgaacccaagagtcagaggtgatagtgagccaagatcatgccactgcactccagccygggtgacagagcgagactctgtctcaaaaaaaaaaaatatgtaaaagttgtgaaagtgggcttttagcttcaaataaatatatgtctcatatcaaagcca

SEQ ID NO: 42199 - DNA, 201 bp, Homo sapiens
ttacagtccaattacttgagcttcatgacttacagggtattatataaagtaaataaagtttctttgaaattaatttttcagtctgaaaacactagaaactwttcaagtatatttgatataactctatttctgtgagaaaaaaaagtattaaatttttctcgtccagctatgtgtgatgcacattcactcattcgcccattg

SEQ ID NO: 42200 - DNA, 201 bp, Homo sapiens
attctaccaaagttttgttccaaggtcaaggctgatcttttttatctttttgatctgattatttaacagccatccttaaatgtatttagttacttataaarctttcctgaatagatttactgcaacattttgtaattagagcattcatgttagaaagtccttttaaaaatatagatgtatttgtctggatgtttattgctt

SEQ ID NO: 42201 - DNA, 201 bp, Homo sapiens
tgtgatgcacattcactcattcgcccattgttcaactgttcgttcattctttcattttattttgacatacgatagtacttttgtagtaggttttttttttyccctgaaacatgttcaagccctagggtttctaatggcagagctgaagactggtgtaccaggcagtgccgcatgttatactccattatagactgtgacagt

SEQ ID NO: 42202 - DNA, 201 bp, Homo sapiens
ggtcaggagtggggggcaatcagtatttagaattgcctcatctcaaggactgaggatcagaggtagactctattccacagaaacagttgtgcatgataaargcgtggggccaaggcacagaagcttaggtttgctagtaccagggcctaacatcagggtgggactagcatactctttatttggtactgggttgcaaagttc

SEQ ID NO: 42203 - DNA, 201 bp, Homo sapiens
tttttccctgaaacatgttcaagccctagggtttctaatggcagagctgaagactggtgtaccaggcagtgccgcatgttatactccattatagactgtgrcagttaattttatgcgttcatttgagtaggccacagggtgcccaggagaaacattgttttggggtgttacactgtaagggtgcttctggctgagatttgc

SEQ ID NO: 42204 - DNA, 201 bp, Homo sapiens
cagtttttctagaagctttgccaagcaggacatcataacgaacacatgcttaaggtccatagattgtgcacatttaatttatgtcattttttatattaaattttttttttttttgagatggagtcttgctctatcacccaggctggagtgcagtggcgcgatctctgctcactgcaacttccgcctcccagattcaagcaa

SEQ ID NO: 42205 - DNA, 201 bp, Homo sapiens
gatatttctttcagttttttcacacttgctgtttcatctgctagaaggctcttgccttcatatgttcctaactacatacccttcacttttacccagtaacttttttttttttttttgggtaaacattgctttctctgaagcatcttctctgatctatataactagactaagccttttatatgcagttttccctacttggtg

SEQ ID NO: 42206 - DNA, 201 bp, Homo sapiens
ccggaggcagaggttgcagtgagccgagatcgtgacattgcactccagcctgggcaacaagagtgaaactccatctcaaaaaaaaaaaattatatttatatgtgtgtgtgtgtgtatatatatatatatatatatatatatatatgtatatatgtgtgtgtgtgtatgtgtatgaatttatccctctttttcctgcttcac

SEQ ID NO: 42207 - DNA, 201 bp, Homo sapiens
cggaggcagaggttgcagtgagccgagatcgtgacattgcactccagcctgggcaacaagagtgaaactccatctcaaaaaaaaaaaattatatttatatgtgtgtgtgtgtgtatatatatatatatatatatatatatatatgtatatatgtgtgtgtgtgtatgtgtatgaatttatccctctttttcctgcttcact

SEQ ID NO: 42208 - DNA, 201 bp, Homo sapiens
ttacttgaagtattcattcaatcaagctaaaaatattctaagtttagtattgttttgtttttctgtctcagtttggacactaatactgtggtttgcccaayatggaatattcagaatctgagagctctatgaatatttgttgtttgggcttaactaaattagaactcttgtggagtaccatatttagagttctcctttaga

SEQ ID NO: 42209 - DNA, 201 bp, Homo sapiens
cagcactccatatctagctaatctggtggggacttggagaacttttatgtctagctagaggattttaaatgcaccaatcagcactctgtgtctagctaaasgattgtaaacacactgatcagcactctttgtctagctcacggtttgtaaatgtaccaatcagtgctctgtgtctagctaatctagtggggacttccagaa

SEQ ID NO: 42210 - DNA, 201 bp, Homo sapiens
ggaggcagaggttgcagtgagccgagatcgtgacattgcactccagcctgggcaacaagagtgaaactccatctcaaaaaaaaaaaattatatttatatgtgtgtgtgtgtgtatatatatatatatatatatatatatatatgtatatatgtgtgtgtgtgtatgtgtatgaatttatccctctttttcctgcttcactg

SEQ ID NO: 42211 - DNA, 201 bp, Homo sapiens
gctatttacaaatacctcgttatttttaatgtaaattctttgcaaagtattattataagtaccgacagcaataattcacattttaaataacaaagaataaygacaaacacaaatcccctgatagtagttacaatttcctccagtttggcaatcctcctataagacatgaggatgtggattgctcttcagtatcactgattc

SEQ ID NO: 42212 - DNA, 201 bp, Homo sapiens
caacccccctccccacgcaaggcccgagcctccccgatgggcgctgcccccttctctgcggcgcccagtcccattgaccccccaagggctgaggagtgcggcacttggtgtgggactggcaggcagctcagcccagggatcctgcacgtgatccactagaggaagccagctgggctcctgagtcaggtggggacttggaga

SEQ ID NO: 42213 - DNA, 201 bp, Homo sapiens
gataaattcagcctcttaagttcctaatttagtaggtttgatatagtcagtctaagtattaacagcattttagcacctacaattcttatattcgatgtttyggggtgtgcaaacaatatgtagaccagacgttctgtctttaagtcatgtccgtgacaaatagagatcacagacgtttacaaaagtgacgattactctaag

SEQ ID NO: 42214 - DNA, 201 bp, Homo sapiens
aaaaaacaatcaacactgtatagattactagagggtgaagtgggctgggtgggttaaaaagctacctatcaggcactatgctcactaccagggtgacgagrtccatgctccaaacctcaacatcatgcaatattcccacataacaaatctgcacatgaaccccctgtatctaaaataaaagttgaaattaaaaataaattt

SEQ ID NO: 42215 - DNA, 201 bp, Homo sapiens
tcttaagttcctaatttagtaggtttgatatagtcagtctaagtattaacagcattttagcacctacaattcttatattcgatgtttcggggtgtgcaaamaatatgtagaccagacgttctgtctttaagtcatgtccgtgacaaatagagatcacagacgtttacaaaagtgacgattactctaagtgggcagagaaca

SEQ ID NO: 42216 - DNA, 201 bp, Homo sapiens
ttaaggtatgttcaaattcagtctttaagagtaaaatgtgaaagcggatgtatggatgtttgagtttgtctatgttgctgaacagtatgaatgtgggtttmcttcagagctgttgccagaaaggagcagtaattacacttgaaattactgttgaaattgggcttaaaacttaatagaaaaagaaacctttatgtctgagca

SEQ ID NO: 42217 - DNA, 201 bp, Homo sapiens
ttgtgactttcataacacttgagacccatttcattccttccctgatgtgagcagaagacaggctctaggtataacttccagatatttaattatatcttctrtgatcacctaggatgcatttccttaaaagttgcagaaaaattatggggtaaaaggcaaaacataactcttccttgaataaataatacaaaccagtatatt

SEQ ID NO: 42218 - DNA, 201 bp, Homo sapiens
ttaagttcctaatttagtaggtttgatatagtcagtctaagtattaacagcattttagcacctacaattcttatattcgatgtttcggggtgtgcaaacamtatgtagaccagacgttctgtctttaagtcatgtccgtgacaaatagagatcacagacgtttacaaaagtgacgattactctaagtgggcagagaacaga

SEQ ID NO: 42219 - DNA, 201 bp, Homo sapiens
agttgatcatatatacatgggttcatttttggactgtctattccattccattggtctttgtgtacgtttttatgccagtaccacactgttttgattactayagctttgtagtatattttgaaattggagaatgtgatacctctgattgtgttattttggctcaagattgctttggctattcagcatcttttgtgcttgcat

SEQ ID NO: 42220 - DNA, 201 bp, Homo sapiens
aagttttctctttatgagagttagatattagattagatattatttttttcataaattatggccccgttttttgctctccctcttaggtaaattctgtccaygcggaatcttgactgtgaacttaaacagttcccacattttgtgactttcataacacttgagacccatttcattccttccctgatgtgagcagaagacagg

SEQ ID NO: 42221 - DNA, 201 bp, Homo sapiens
gtcagtctaagtattaacagcattttagcacctacaattcttatattcgatgtttcggggtgtgcaaacaatatgtagaccagacgttctgtctttaagtmatgtccgtgacaaatagagatcacagacgtttacaaaagtgacgattactctaagtgggcagagaacagagatacttatgagctgtgggtggttaagcaa

SEQ ID NO: 42222 - DNA, 201 bp, Homo sapiens
tgaacagtttttcatatacatgttggccagtgtgcatgacttctttggagaaatgtttattcagatattttgcctatttttttaattgggttatttgggtwtttttctattgaggagtttcacatacatttttggtattaactccttatcagatatatggtttacaatattttcttccattccataggttgtctcttcact

SEQ ID NO: 42223 - DNA, 201 bp, Homo sapiens
ccagacgttctgtctttaagtcatgtccgtgacaaatagagatcacagacgtttacaaaagtgacgattactctaagtgggcagagaacagagatacttakgagctgtgggtggttaagcaaaagatcaagaaagagtcagtgatcaagaaagagtcagtgatcaaccatgaataaaattcagatcatcggccggatgcag

SEQ ID NO: 42224 - DNA, 201 bp, Homo sapiens
ttaaactagattgtgttgcatatcataggcaatctactgaaagatttcaaagaaaaaaatctcattcttttacatagccaagaagatacaatctattacaygcatgttttaagataaacaataactagtcctcaagcaagacaacttcccagcaccacttgccacatatagcttacgctagattcacctggtaattggagt

SEQ ID NO: 42225 - DNA, 201 bp, Homo sapiens
tgatcaagaaagagtcagtgatcaaccatgaataaaattcagatcatcggccggatgcagtggctcacgtgtgtaatcccagcaatttgggaggccaaggmgggcggatcatgaggtcaggagatcgagaccatcctggctaacacggtgaaaccccatctctactaaaaatacaaaaaaaattagctgggtatggtggca

SEQ ID NO: 42226 - DNA, 201 bp, Homo sapiens
cccacgtgtgtacctctgaacttaaagttaaaaaaaaaaaaaagaaagttggaggctaggcacagtggctcatgcctataatcctagcactttgggagtcygaggatggcagattgcttgagcccaggagtttgagaccagcgtgggcaacatggcaagactcagtctctacaaaaaatacaaaaattagccaggcatggt

SEQ ID NO: 42227 - DNA, 201 bp, Homo sapiens
acctctactcagagaaaaacttcaaattttcttatttgagctctttgcatgaaagtgcaagagtatgaagtgtggggacatatggattatcttttaaaagytttaacaatgacaattttggcaggaaacagctttacaattgtcagaagaatattttttcttactcttgggaaggggctacattgcaaaaaacaaaaacaa

SEQ ID NO: 42228 - DNA, 201 bp, Homo sapiens
gcagctcaggctgctgttccaggcaagcaagtgcttcaatgcctggagatatgcctgggtatggattggaaagggccttgctgcaccatgatctttgtgcwggaagggtggggtagctcaggctggaggagtgggtgctccgactgcctggagatctgtctgggagtggggtggagagggacccactgcaccactctctct

SEQ ID NO: 42229 - DNA, 201 bp, Homo sapiens
catgacacttcgagaaccattaatctaaagcaatagctaactgatgatgtagttctaagaatgaaatacatgtgcagccttccaatgtactgtcttacatrtataggcagaaaaattctgccttatgtcaagtcttgtgggcagaaacaatttaacttagtgttttcagatgtatgccaatttatatattaggtcctttca

SEQ ID NO: 42230 - DNA, 201 bp, Homo sapiens
taataatagaggaggaaactgtgtggtcctgatttatggatgaatctttatggcatactgagaccagctgtaattggataggtgctgcactaaaaccccayatggggatgaccctgaaagccagtgggaaagagaaatcttcacaatataaagaatcctacagccttctaccagggtgactttacacgggagaaaaggaaa

SEQ ID NO: 42231 - DNA, 201 bp, Homo sapiens
cccacaagaacatgacaacttatgtaaaagaattgtagttttactaagaggagcctgagctctagagtgggtggtgaagagtggggaggcagtgggggagkgggtggtggttatgtgttactgtagggaggagaagtaggtgccaaatgttttctgtttaatatttgtgagggaatggcaacccttaggcaaattttggaa

SEQ ID NO: 42232 - DNA, 201 bp, Homo sapiens
atattacagttgtcttctttccattttatttcactctagccaagactcaattgtataaaatcagctatgataatattgtatggcaaacttcccttgcctcsttttcctttacttaaatcttcttgtgatgatttagattttttttttcagttaacatctggtttcaatccttcacattattcctgactatattatactaat

SEQ ID NO: 42233 - DNA, 201 bp, Homo sapiens
tgtgggcctttctgctaacacttgcagggctgtgtctactcagagagtggcacagttttcttttttttcttgtcttgtcttttttttttttttttttttttgagatggaatttcactgttgttgcccaggctggagtgcaatggcgtgatctcagctcactgcaacctccgcctcccaggttcaagtgattctcctgcctc

SEQ ID NO: 42234 - DNA, 201 bp, Homo sapiens
agccctccctctgctgggcaaactgtgggcctttctgctaacacttgcagggctgtgtctactcagagagtggcacagttttcttttttttcttgtcttgwcttttttttttttttttttttttgagatggaatttcactgttgttgcccaggctggagtgcaatggcgtgatctcagctcactgcaacctccgcctccca

SEQ ID NO: 42235 - DNA, 201 bp, Homo sapiens
actattttatgaaagctccaattttaaatgtctacttttccgagtatattagcaggcatttcagatttagataaaaatgtggttctcttacacatttttttctttcacaactcaggcagattcaattgagcagaggctcgagtctgctgtttattagtggttttaaaaatagcactaaaacagattctcatgtgccaatac

SEQ ID NO: 42236 - DNA, 201 bp, Homo sapiens
ggggactattgcctatataaaatatattgaaaattcagatacagcatatagtgtatggaggcatttttgctaaaagtaaaaaggagtattttaagtaagtagtatctattcactgcttattcaatctctccctacccctaagcgttatccttaattttttttaatctacaaatagaattgaggctaataaggcctttagat

SEQ ID NO: 42237 - DNA, 201 bp, Homo sapiens
atctaattttgaagctatggtatccaagaaaaatggaaacctcatatttccatcaagggctcatgtgtagccagggtttttaccaagtttacaacatgccrtcacacttaattctgaggacatgtgcctagtttggccaactaaaacatatacagttccttctacttttccataaatgtaagcattttcaggaagagaaac

SEQ ID NO: 42238 - DNA, 201 bp, Homo sapiens
gtgactggtatttaatttttaccccaaacaatgagacaaaatgactattgacttagagagagttctgacaaatgaggtggatacagcctaatcaatcttaractgaatataagtatttaatttgctgatgagctatatttaaatcatattttggttgctataaaatcttcagccctgcaaatctaatcactatctttgatg

SEQ ID NO: 42239 - DNA, 201 bp, Homo sapiens
gggggactattgcctatataaaatatattgaaaattcagatacagcatatagtgtatggaggcatttttgctaaaagtaaaaaggagtattttaagtaagtagtatctattcactgcttattcaatctctccctacccctaagcgttatccttaattttttttaatctacaaatagaattgaggctaataaggcctttaga

SEQ ID NO: 42240 - DNA, 201 bp, Homo sapiens
ggggggactattgcctatataaaatatattgaaaattcagatacagcatatagtgtatggaggcatttttgctaaaagtaaaaaggagtattttaagtaagtagtatctattcactgcttattcaatctctccctacccctaagcgttatccttaattttttttaatctacaaatagaattgaggctaataaggcctttag

SEQ ID NO: 42241 - DNA, 201 bp, Homo sapiens
aggggggactattgcctatataaaatatattgaaaattcagatacagcatatagtgtatggaggcatttttgctaaaagtaaaaaggagtattttaagtaagtagtatctattcactgcttattcaatctctccctacccctaagcgttatccttaattttttttaatctacaaatagaattgaggctaataaggccttta

SEQ ID NO: 42242 - DNA, 201 bp, Homo sapiens
tgtaaaccagggagacagaacttgcagtgagccgagatcatgccactgcactccagcctgggccacagagtgagactctgtctcaaaaaaaaaaaaaaaaatagtatttggctctctgatttcccttctactactttttaagctatctttctgtgcagctcacatttgttccaccaacctatttaataccttggcctctca

SEQ ID NO: 42243 - DNA, 201 bp, Homo sapiens
gtgtaaaccagggagacagaacttgcagtgagccgagatcatgccactgcactccagcctgggccacagagtgagactctgtctcaaaaaaaaaaaaaaaaatagtatttggctctctgatttcccttctactactttttaagctatctttctgtgcagctcacatttgttccaccaacctatttaataccttggcctctc

SEQ ID NO: 42244 - DNA, 201 bp, Homo sapiens
cctattgtgaacagcgcatgtgaaggacctagtttgtgtgctctttatgagactctaacgcctgatgatttgaagtggaatggtttcatcctgaaaccatycccattccccccatccaccatctgtggaaaaattatattccatgaaaccggtttctggtgccaaaatggttggggacaactgttctaagccacacaagtg

SEQ ID NO: 42245 - DNA, 201 bp, Homo sapiens
attcagagacatttcagaacactgtttgaaaatatagtaattctctaacaatgtaaaacagtttttctttgtgagtgtgaaaattaactatgtaaccttctagtgcagggctttttaaacttgaatgtgatacacatcatctgagaatcttttaaaaatgtaggttcttatccagtaaatccggagtggtacctgagattc

SEQ ID NO: 42246 - DNA, 201 bp, Homo sapiens
ttatttttattaggttattctaggtgccttgaacctcatagaaattttagaattagcttgttaatttttacaaaaaagtccactgagattttggttaggastagattagatctatggatcaatttgtgctgaactgacattttaacagtgatgagtcttctgattaaaaacatggtatatatctctacatttattgtggat

SEQ ID NO: 42247 - DNA, 201 bp, Homo sapiens
tattcagagacatttcagaacactgtttgaaaatatagtaattctctaacaatgtaaaacagtttttctttgtgagtgtgaaaattaactatgtaaccttctagtgcagggctttttaaacttgaatgtgatacacatcatctgagaatcttttaaaaatgtaggttcttatccagtaaatccggagtggtacctgagatt

SEQ ID NO: 42248 - DNA, 201 bp, Homo sapiens
tcttggtctctccagtgtagcagggccagagaacaaagctgtgggcttggtcccagcccccacagggttagagcatgcagcacagaagtgatgagctgagycttgaccttctgaaatcatccagaaatgaagccagttgaccaaatccaacttataccacagtcaaaccaccaagggcatcaaagaatataaaagcaaaaa

SEQ ID NO: 42249 - DNA, 201 bp, Homo sapiens
atattcagagacatttcagaacactgtttgaaaatatagtaattctctaacaatgtaaaacagtttttctttgtgagtgtgaaaattaactatgtaaccttctagtgcagggctttttaaacttgaatgtgatacacatcatctgagaatcttttaaaaatgtaggttcttatccagtaaatccggagtggtacctgagat

SEQ ID NO: 42250 - DNA, 201 bp, Homo sapiens
ttgaatatctattacatatattaaagatatgtacatatgtgcatatgtttctatatatttacaatattatatataaatatatgtattatatgtaatgttgmaactatatatgtatagtatgtattatatatataacatgtcaatgattgatttcttttgttttaaatgatcatttggaaaagagttatcttacagctgggc

SEQ ID NO: 42251 - DNA, 201 bp, Homo sapiens
gaggcagaggttgcagtgagccgagatcgtgacattgcactccagcctgggcaacaagagtgaaactccatctcaaaaaaaaaaaattatatttatatgtgtgtgtgtgtgtatatatatatatatatatatatatatatatgtatatatgtgtgtgtgtgtatgtgtatgaatttatccctctttttcctgcttcactgc

SEQ ID NO: 42252 - DNA, 201 bp, Homo sapiens
tacttcattgcagtgctttacacaatatatggtataccgcagatgcctaataaacatttgtttaattaaatctgttttactcaaataaacttgtatatgawttttacaggagtaacgtccaaagtgatcaagggcaaaatttactctgtttatgtttcagagatgcccaacataggctttagagcaaagccagatgtatgt

SEQ ID NO: 42253 - DNA, 201 bp, Homo sapiens
tttttttaaaaaaaaaaattctctatttttcatggattttagaaattttaactatagtataccatgaagaagaactttttgtattgtgtctgtttggtgaytgctgggactctgtatctggatgtttaaatctcttgctagatttgggaaattttcctctattaattcattaaataggtttttaaactctttctctctttg

SEQ ID NO: 42254 - DNA, 201 bp, Homo sapiens
acagctgaactgagactagattctacctctgtgagttaccagttttttgctttttgtttttaaccatagataagctacttaatctttctgaaacttcttcttttttttttttttttttttgagacagactgtcactctgtcccccaggatggagtgcagtgcagtggtgcgatctcagctcggttcaaactctgcctcctg

SEQ ID NO: 42255 - DNA, 201 bp, Homo sapiens
atgccatgtcaatcagagtacagtttgattataattaaatgaaacattagccctatacagtgctcttttctaatcatgtttgttcctatcctttccactayagttatctcaatatggtgaaatgaattataattaaatgaaaaattagccctatacagtgttttcttttaatttgttgtttcctatctttttcattatatt

SEQ ID NO: 42256 - DNA, 201 bp, Homo sapiens
cccattctctcctggcctataaggtttctactgataaattttctcttgttctgatggaggtttcttataggtgactagatgcttttctcttgcttttttttaaaaaaaaaaattctctatttttcatggattttagaaattttaactatagtataccatgaagaagaactttttgtattgtgtctgtttggtgactgctgg

SEQ ID NO: 42257 - DNA, 201 bp, Homo sapiens
cagctgaactgagactagattctacctctgtgagttaccagttttttgctttttgtttttaaccatagataagctacttaatctttctgaaacttcttcttttttttttttttttttttgagacagactgtcactctgtcccccaggatggagtgcagtgcagtggtgcgatctcagctcggttcaaactctgcctcctgg

SEQ ID NO: 42258 - DNA, 201 bp, Homo sapiens
gtatttctgttgtatcagttgtaatgtctcctttttatttctgagtttatttgggtcttctcttttctttgttagtctagctcgtagttttttttttttttaatgttttcaattttgtttatactttcaaaaaactagtgttacatttcattcatgctttttattgtttttctagtttctgattcatttagttctgctctg

SEQ ID NO: 42259 - DNA, 201 bp, Homo sapiens
aaacctaagaataatcagtgttcctgaggaagaagagaattccaaaaattcggaaaacatatttgggggaataattgaggaaaacttcccctgtgttgctrgagacctagacatccaaatacaagaagcacaaagaacacctgagaaattcatcgtaaaaagatcattgcctaggcacattgtcatcaggctatacaaagt

SEQ ID NO: 42260 - DNA, 201 bp, Homo sapiens
tgtatttctgttgtatcagttgtaatgtctcctttttatttctgagtttatttgggtcttctcttttctttgttagtctagctcgtagttttttttttttttaatgttttcaattttgtttatactttcaaaaaactagtgttacatttcattcatgctttttattgtttttctagtttctgattcatttagttctgctct

SEQ ID NO: 42261 - DNA, 201 bp, Homo sapiens
tttgacactaattcacaagacagagaaagaaggaatcctccctaattcattctatgaagccagcatcatgctaataccaaaaccaggaaagaacataaccaaaaaaaaaaaaaaaaacagaaaacaaaaaactaaagaccaatatctttgatgaacatagatgctaaaatccttaacaaaatactagctaaccgaacccaa

SEQ ID NO: 42262 - DNA, 201 bp, Homo sapiens
atcaatattgtgaaaatgaccatactgccaaaacaatctacaaattcaatgcaatttccattaaattaccaccatcattcttcacagaattagaaaaaacmattctaaaattcatatggaaccaaaaaagagcctgcatagccaaagcaagactaagcaaaaagaacaaatctggaggcttcacattacctgacttcaaac

SEQ ID NO: 42263 - DNA, 201 bp, Homo sapiens
aagcaagactaagcaaaaagaacaaatctggaggcttcacattacctgacttcaaactatcctataaggccatagtcaccaaaacagcatggtactagtayaaaaataggcacataggccaatggaacagaatagagaacccagaaataaacccaaatacagccaactgatctttgacaaaacaaacaaaaacataaagtg

SEQ ID NO: 42264 - DNA, 201 bp, Homo sapiens
atgcatgtttatagcaacacaattcacaacttcaaaattgtggaaccaacacaaatgcccatcactcaatgaatggataaagaaagtgtgattatctatctatctatctatctatctatctatctatctatctacatatctatctatctatcatctgtctatctatctatctatctatcatctatctatctatctacctac

SEQ ID NO: 42265 - DNA, 201 bp, Homo sapiens
tgcatgtttatagcaacacaattcacaacttcaaaattgtggaaccaacacaaatgcccatcactcaatgaatggataaagaaagtgtgattatctatctatctatctatctatctatctatctatctatctacatatctatctatctatcatctgtctatctatctatctatctatcatctatctatctatctacctacc

SEQ ID NO: 42266 - DNA, 201 bp, Homo sapiens
accaatcattttcttttatggccaaaggattaagatgatgcaaagatagtaccttccgagctcatgggctttcatatacctcactatgataacaaaattgrataaacataaaggaggccgtataggatatgaaagcaaatcatgtgtatctctgtgagaaaatgaattattcttcagatgattagaaccaaacagcccatt

SEQ ID NO: 42267 - DNA, 201 bp, Homo sapiens
tgttttctgtttacatgatagatcttttcccaactcattacttggtagcctatgggtgtcattatgtgtgtgtgagcgataggtcttgtttttttttttttaattcaacttgccaatttgtgccttttaagtgggggtgtttagactgtttacattcaaggttaatattgatatatgaggttttgatcctatcaaagttgt

SEQ ID NO: 42268 - DNA, 201 bp, Homo sapiens
gcatgtttatagcaacacaattcacaacttcaaaattgtggaaccaacacaaatgcccatcactcaatgaatggataaagaaagtgtgattatctatctatctatctatctatctatctatctatctatctacatatctatctatctatcatctgtctatctatctatctatctatcatctatctatctatctacctacct

SEQ ID NO: 42269 - DNA, 201 bp, Homo sapiens
aatttacatttctgtcattatactttaatttcaattgtaatttctatttttgacacccagaaatctatgatgattttaatgaaaatatcttatgaaaatamtactgtcatattttaccttaaaacttaatattttagatgagaatagaagcacatctcttttatgatatgttgcctgtataaagaaggaaaaatagggact

SEQ ID NO: 42270 - DNA, 201 bp, Homo sapiens
tgcagatgacatgattgtatatgtagaaaccccattgtctcagcccaaaatatccttaagctgataagcaacttcagcaaaatctcaggatacaaaatcartgtacaaaaatcgcaagcattcttatacaccaataacagacaaacagagagccaaatcatgagtgaactcccattcacaattgcttcaaagagaataaaa

SEQ ID NO: 42271 - DNA, 201 bp, Homo sapiens
aaataaagggtattcaattaggaaaagaggaagtcaaattgtccctgtttgcagatgacatgattgtatatgtagaaaccccattgtctcagcccaaaatmtccttaagctgataagcaacttcagcaaaatctcaggatacaaaatcaatgtacaaaaatcgcaagcattcttatacaccaataacagacaaacagagag

SEQ ID NO: 42272 - DNA, 201 bp, Homo sapiens
aacttaaattagaaaacagatgctataaatcattgtttgtgcattaaattcccgtgatctgagtgaaagcacatagaggtttatttgctaaatatttaacrtatatatttagtatcatacttgctaaattgctgcatattttcatatatatgtacatataatttcatatctaacatattacatgttatatggtacatatat

SEQ ID NO: 42273 - DNA, 201 bp, Homo sapiens
cactgacttccacagtggttgaactagtttacagtcccaccaacagtgtaaaagtgttcctatttctccacatcctctccagcacctgttgtgtcctgacyttttaatgattgccattctaactggtgtgagatggtatctcattgtggttttgatttgcatttctctgatggccagtgatggtgagcattttttcgtgtg

SEQ ID NO: 42274 - DNA, 201 bp, Homo sapiens
ttacttaatgggcttttcaagctcaacatgtccaaaatttaaatgaatgaatgaatatatgtatatacacacacctaatgtgtgtatatatatatatatawaaaatcatgtattataaatatacttaagtatatataaatttaatatatttttatttcctcattttctccatttctaccctttctttccactctatttcct

SEQ ID NO: 42275 - DNA, 201 bp, Homo sapiens
aaagcaactttatctagttacttaatgggcttttcaagctcaacatgtccaaaatttaaatgaatgaatgaatatatgtatatacacacacctaatgtgtrtatatatatatatatataaaatcatgtattataaatatacttaagtatatataaatttaatatatttttatttcctcattttctccatttctaccctttc

SEQ ID NO: 42276 - DNA, 201 bp, Homo sapiens
atgagaataaaattacattaagattggtgctttgtgttaaagatacctgtgatgagttttcttttcaagaggaatgaaatgacctagatacaaaaagacaratattacatgatctcacttaaatgtggaacccaaagcaactttatctagttacttaatgggcttttcaagctcaacatgtccaaaatttaaatgaatgaa

SEQ ID NO: 42277 - DNA, 201 bp, Homo sapiens
aaaaatttgccatagttcaggtccatacatataattttatttgatactcatatgtaacttatatagacttatagtttttgacaaaaggcatattttcagtkctggtccactcaatacaatggttgatataatatgctaaactatttaaattaatatactctctttcctttaggattgtatttcatgaaaataatatacatg

SEQ ID NO: 42278 - DNA, 201 bp, Homo sapiens
caaacaatagaaaatgagggactcctccctaactcattttatgaggccaacatcatcctgataccaaaacctggcagagacacaacaaaaaagaaaatttkgggccaatatccctgatgaatatcaatgcaaaaatcctcaataaaagactggcaaaccgaatccagcagcacatcaaaaagcttatccaccatgatcaag

SEQ ID NO: 42279 - DNA, 201 bp, Homo sapiens
aggtcgggttacccgcaaagggaagcccatcagactaacagtggatctctctgcagaaaccctacaagccagaagagagtgggggccaatattcaacattmttaaagaaaagaattttcaacccagaatttcatatccagccaaattaaacttcatcagtgaaggagaaataaaatcctttagagacaaaaaatgctgaga

SEQ ID NO: 42280 - DNA, 201 bp, Homo sapiens
tcactgcaagctccaccttctgggttcacaccattctcctgcctcagcctcccaagtagctgggactacaggcacccaccaccatgcccagctgattttttgtatttttagtagagacggggtttcaccatgttagccaggatggtcttgatctcctgaccttgtgatccgcccgccttggcctcccaaagtgctgggatt

SEQ ID NO: 42281 - DNA, 201 bp, Homo sapiens
accactgtagcttttcaaggatagtcttcaaataagcatgatgttttccttcatgaaattagactagacaagcactgaatgggtctctgatactagtgctrtggtttatatgaatgggatatttagttgctgaggtaaaaacaaccaaccaaccaaccaaacaaacaaacaaacaattaatcagtagcatgttgtatagaa

SEQ ID NO: 42282 - DNA, 201 bp, Homo sapiens
agccatttcccctagatgcactgtttccattactctacctagggatgtagtattagtcctgtgcacagacacttgtaatcagagccccagcattccatttktcattaggggaaacacaaggaaaactgtacaatttggactccgaacatctgataagcagatggcaggttagcctcaatgtagtgcaaatattgtctgttt

SEQ ID NO: 42283 - DNA, 201 bp, Homo sapiens
agaaggcagagattcaggactgcaaaggcttttcatgccatctgttggaactcagtatatgacgatatgctatgacttttaatcaattagcattactgccmgtataatttgatcagttattagatactgctttctgctagttgacaagttgatttcctttacttttctataagacactgaagagagaaccgaaaatgtagc

SEQ ID NO: 42284 - DNA, 201 bp, Homo sapiens
ccagcagagggctctagagaggctcagagccaaagctatcaagaaaatggtccaatgcagtgtgatgatctggggttgtgggagactgatggagaagaaaytctgaggagctattagctggtaaaatatcatcagcacacgcatgctgatttttcctctttttccggccactcattgccatttttgaaacttcctctgtaa

SEQ ID NO: 42285 - DNA, 201 bp, Homo sapiens
gtctcgctctgtcacccaggctggagtgcagtggcgcgatctcggctcactgcaagctccacctcccgggttcacaccattctcctgcctcagcctcccasgtagctgggactacgggcgccccccaccactccctgctaattttttgtatttttagtagagacggggtttcactgtgttagcaaggatggtcttgatctc

SEQ ID NO: 42286 - DNA, 201 bp, Homo sapiens
aaaataataataataataataataataataataattattattattattattattattattattataaaagaagccttaaaaagatgcagaaaaccagaatmactaaattagtcacatgataaagaaagcaattcgctatcctctgtaaaatgcattactctaccagtccccacccaggaggcttagaatatcatgaatcta

SEQ ID NO: 42287 - DNA, 201 bp, Homo sapiens
ttgtatttctgttgtatcagttgtaatgtctcctttttatttctgagtttatttgggtcttctcttttctttgttagtctagctcgtagttttttttttttttaatgttttcaattttgtttatactttcaaaaaactagtgttacatttcattcatgctttttattgtttttctagtttctgattcatttagttctgctc

SEQ ID NO: 42288 - DNA, 201 bp, Homo sapiens
ccacttcctgttgtcaaaaaaatggggaaaatataagtgattgctatcattgttgaacttcaacagacttccacaatagaagtttaaatcatttatgagcrtgaacagcaaagaagatggtgacctgggcaacatagcaagaccctgtctctaccaaaaaaaaaaaaaaaattagctgggccttgtggcgtgcgcctgtag

SEQ ID NO: 42289 - DNA, 201 bp, Homo sapiens
tggatccacattagaatacaaagtcagcgggctcccagaaaataataataataataataataataataataattattattattattattattattattatwataaaagaagccttaaaaagatgcagaaaaccagaatcactaaattagtcacatgataaagaaagcaattcgctatcctctgtaaaatgcattactctac

SEQ ID NO: 42290 - DNA, 201 bp, Homo sapiens
gattttgaaattggctaccttttgaaatcctattttaattccttttgcctccttcagatacaaaaagacaaatttttccctaatccatttaaggatgtctrtttaccaaaagagcaggcaaaaggattctgaaataaaaaggacttcatataggagatctgaaattagtactaatttctcatgggcaaatatgtagggttt

SEQ ID NO: 42291 - DNA, 201 bp, Homo sapiens
atcttgaacatccttgtgtcccttgggtaaatcccacttgatcattgggtattatttttttgatgtgctgttaaattcagtttgcttgaactttgttgggkttttttgtgtttatgtttatcagagatattgacctatacctctgtgtgtgtgtgtgtgtgtgtgtgtgtccctgtgtgcttttggtatcagaatgatacc

SEQ ID NO: 42292 - DNA, 201 bp, Homo sapiens
aaattagtactaatttctcatgggcaaatatgtagggttttttcagagaatattaattttaaaaataaaatggtcattacatttaattctgtgcatttctytgggaataaataaatatgttaaaagttcataggcttcttccactccatctggagaaattttgaaagaaattttgtaaactgtttcagctggattatatgg

SEQ ID NO: 42293 - DNA, 201 bp, Homo sapiens
cagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaagcaattcgc

SEQ ID NO: 42294 - DNA, 201 bp, Homo sapiens
ggcagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaagcaattc

SEQ ID NO: 42295 - DNA, 201 bp, Homo sapiens
catgtttatagcaacacaattcacaacttcaaaattgtggaaccaacacaaatgcccatcactcaatgaatggataaagaaagtgtgattatctatctatctatctatctatctatctatctatctatctacatatctatctatctatcatctgtctatctatctatctatctatcatctatctatctatctacctaccta

SEQ ID NO: 42296 - DNA, 201 bp, Homo sapiens
tggcagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaagcaatt

SEQ ID NO: 42297 - DNA, 201 bp, Homo sapiens
ggtttatgcagagaacctaataagaatctccagagtttgcatgtcacagaacaactgtttataagttacctttttcctccttatctgtgcctggggacttytctttcttgtctttttcctcttgttcctatttctgttcccttgctcctgcttgcttgcccatctttgcatttctttacacctggcagcaaccatactctt

SEQ ID NO: 42298 - DNA, 201 bp, Homo sapiens
ttcaaaattgtggaaccaacacaaatgcccatcactcaatgaatggataaagaaagtgtgattatctatctatctatctatctatctatctatctatctayctacatatctatctatctatcatctgtctatctatctatctatctatcatctatctatctatctacctacctacctacctacctatctatgatagaatac

SEQ ID NO: 42299 - DNA, 201 bp, Homo sapiens
gttggcagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaagcaa

SEQ ID NO: 42300 - DNA, 201 bp, Homo sapiens
attgctaagaatagaccagaacacagtgcccaaacccttaccatactgaggtccaggatggggtcacaaaaggaacacaggcaggatttcttatcaaaacragctggccaaccatgaagtaggagtgagaggagggaaagacaggtgccaggtgatgcagaggtaagaaagtcaggcagctcagtccatttctctgtcctg

SEQ ID NO: 42301 - DNA, 201 bp, Homo sapiens
tcaaaattgtggaaccaacacaaatgcccatcactcaatgaatggataaagaaagtgtgattatctatctatctatctatctatctatctatctatctatmtacatatctatctatctatcatctgtctatctatctatctatctatcatctatctatctatctacctacctacctacctacctatctatgatagaatact

SEQ ID NO: 42302 - DNA, 201 bp, Homo sapiens
gcaagttggcagatgcccagcagatccagaaagcaatggatccacattagaatacaaagtcagcgggctcccagaaaataataataataataataataataataataattattattattattattattattattattataaaagaagccttaaaaagatgcagaaaaccagaatcactaaattagtcacatgataaagaaa

SEQ ID NO: 42303 - DNA, 201 bp, Homo sapiens
catggaaaaaaatgaagggacaatggaagtggtgagtggtgatactttcttcctttaatgtatccaagctattgctttcctttcctgacttccgaaaaccragtgcctggcaagaactgccaacgatttattgaaactacattttccttacccaccatagaaacaaatcatttctgtagtgggtaaattatacaaagcact

SEQ ID NO: 42304 - DNA, 201 bp, Homo sapiens
aaattgtggaaccaacacaaatgcccatcactcaatgaatggataaagaaagtgtgattatctatctatctatctatctatctatctatctatctatctayatatctatctatctatcatctgtctatctatctatctatctatcatctatctatctatctacctacctacctacctacctatctatgatagaatactact

SEQ ID NO: 42305 - DNA, 201 bp, Homo sapiens
tttgtatcctgtagtgtaactgaatttgtttaacaactctaagggttttttggtggagtcttttgacttttctaaatatgagtatcatgtcatctgcaaasagggacaatttgactttctctttttgaatctggatgccttttctttctcttgcctgattactctggctaggactttcagtgctttgttgattaggaatgg

SEQ ID NO: 42306 - DNA, 201 bp, Homo sapiens
aattgtggaaccaacacaaatgcccatcactcaatgaatggataaagaaagtgtgattatctatctatctatctatctatctatctatctatctatctacmtatctatctatctatcatctgtctatctatctatctatctatcatctatctatctatctacctacctacctacctacctatctatgatagaatactactc

SEQ ID NO: 42307 - DNA, 201 bp, Homo sapiens
aaagtgtgattatctatctatctatctatctatctatctatctatctatctacatatctatctatctatcatctgtctatctatctatctatctatcatctatctatctatctacctacctacctacctacctatctatgatagaatactactcagccataaaaaggaatgaattaacagcattttcagtgacctggatgg

SEQ ID NO: 42308 - DNA, 201 bp, Homo sapiens
tatctatctatctatctatctatctatctatctatctacatatctatctatctatcatctgtctatctatctatctatctatcatctatctatctatctayctacctacctacctacctatctatgatagaatactactcagccataaaaaggaatgaattaacagcattttcagtgacctggatggaattggagactatt

SEQ ID NO: 42309 - DNA, 201 bp, Homo sapiens
gccaggcacggtggctcacacctataatcctagcactttgggaacccaaggcaggtggatcacccaaggtcaggagttcaagaccagcctggccaacatgrcaaaacactgtctccactaaaaatacaaaaattagccaggtgtcatggcacatgcctgtaatcccagctactagggaggctgaggaaggagaatcgcttg

SEQ ID NO: 42310 - DNA, 201 bp, Homo sapiens
ttctcactgatatatgagaactaagctatgaggatgcaaaggcataagaatgatacaatggactttggggacttgcgaggagtagtgggagggggacgagrgataaaacactacaaataaggtgcagcgtatactacttgggtgatgggtgcaccaaagtctcacaaatcaccactaaagaacttactgatgtaaccaata

SEQ ID NO: 42311 - DNA, 201 bp, Homo sapiens
agataaaatatacaagatgaggtcacaggaggagaatgtggccaagagggaggaagagaaaagggagtagaacccacaaaagagaaataattgcattggargggaattgcgagtggcatctatggtgaccacagataggctgaaatctctaaattaagacttcattcatttcaaagcaatagactaggtcaagtgagggat

SEQ ID NO: 42312 - DNA, 201 bp, Homo sapiens
acctacagaatgggaaaaaatttttgcaatctacccatctaacaaagggctaatatccagaatctacaaagaagttaaacaaatttacaagaaaaagcaaycccatgaaaaagtcaggaaaggatatgaacagacacttttcaaaagaagacatttatgcagccaacagacacatgaaaaaatgctcatcatcactggtca

SEQ ID NO: 42313 - DNA, 201 bp, Homo sapiens
aaacactacaaataaggtgcagcgtatactacttgggtgatgggtgcaccaaagtctcacaaatcaccactaaagaacttactgatgtaaccaataccacytgtaccccaataacttatggaaaaattttaaaaaaggaaataaggaaagcaaaacaaaacaaaaccaaaacccaaatgcaaatgaaatacaaaactgaaa

SEQ ID NO: 42314 - DNA, 201 bp, Homo sapiens
aatatccagcatctgaaatgaggagcaataaaaatatgtccttatggtcattgacagtttctatttggaactgatttagccaagggaaaggaggctacatygtagatgatagtaacatgttgaaagtagatgcatgctaacaattttagaatgaacaatgttttcggataatcattcactgcctattttggtttcaaaaat

SEQ ID NO: 42315 - DNA, 201 bp, Homo sapiens
tagacctaaaaccataaaaacactagaagaaaacctaggtaataccattcaggacataggcatgggcaaagacttcattacccaaacacccaaagcaatgrcaacaaaagccaagatagacaaatgggatctaattaaactaaagagcttctgcacagcaaaagaaactaccatcagagtgaacaggaaacctacagaatg

SEQ ID NO: 42316 - DNA, 201 bp, Homo sapiens
aattaaagacttaaatgttagacctaaaaccataaaaacactagaagaaaacctaggtaataccattcaggacataggcatgggcaaagacttcattaccmaaacacccaaagcaatggcaacaaaagccaagatagacaaatgggatctaattaaactaaagagcttctgcacagcaaaagaaactaccatcagagtgaa

SEQ ID NO: 42317 - DNA, 201 bp, Homo sapiens
agtgaaaagaaaatattagaaagtttctttaaatttgttatctaaaacgtaaacattgtagccttcccaggatttaatgtatgattggcattgacactctsctttagtgtatatcccagacaagagagctttattaaagggttgtctgtggtgctgtcacttgttctgtagctttcaacattatcacaatcaaagatacct

SEQ ID NO: 42318 - DNA, 201 bp, Homo sapiens
aaggtacacattttcacttataagatgaacaagttctggggacctaataaacagcacgagtgatgatagacgtgttaatttaatggtggtagtcattacamaatgtgtatatatctctcaatcatcttgttgcacactttgaatatattcaatctttgtcaatcaaatatttcaaaacaaaaaataaaattctagatagat

SEQ ID NO: 42319 - DNA, 201 bp, Homo sapiens
agtacagatttcccattgtgtccagagagggtgtcaacgaataatgacttttagtcttttggtttgttgggtgtgggggggtgttggtgaggaggacattscaggggtaactttcccatgtacaagggaagataaaaatggctttgcagcatggtgcagtggctcacacctgtaatcccagcactttgggaggccgaggcg

SEQ ID NO: 42320 - DNA, 201 bp, Homo sapiens
cttgtgatcatgtattgttactggattttctccatttctcctttggccatgggcatattacctgaagtgttggttttctgtgtttcttattttgaacactytttttttttttttttttttttttttgagacagagtctcgctgtcgcccaggctggagtgcagtggcgcaatctcggctcattgcaagctccgcctgccgg

SEQ ID NO: 42321 - DNA, 201 bp, Homo sapiens
atgcaagaatttcattgccattggaagaaagagcagagaagagtggcagtgtttcttagacagctgtgctctttagatgttatagaaaacaaacttagtcmcaaaataggctgaagtccttagaagaacttctacctagaaaccacaattttcactagggtaaagtttctcagctaacattaatggctacttttgttggtt

SEQ ID NO: 42322 - DNA, 201 bp, Homo sapiens
acctacatagaactatttctaatttagatctcaagcccaattttgctctatgttcttaacttttatagtcattccttacagcaaaaaaaaaaaaaaaaaaatcatttgagatatgtatgtgagctttaattttctgcttcagttgtaaacttctttttattgagtggtattatcatcttgtaagttcatttggaaaatatg

SEQ ID NO: 42323 - DNA, 201 bp, Homo sapiens
tataaacaattattgaatgacccttttgttcagtccttattcactactgaaaggtgtcatgatcttaatgacaatggtcttttcaattttatggaacttttaagtttataaagcagtaacctataaagctagattgtaaaatctgttagggtaagagttgtttctcttttgttttcctctgtttcttacatgtctggtatg

SEQ ID NO: 42324 - DNA, 201 bp, Homo sapiens
tatgatactgttcaagtgtttcagacttttctgtactatttgttcttcttaggattccacatcttgttttattggcatatggatttcttttttttttttttgagacagagatttgctctttttgcacacctggagtgcaatggcatggtcttggctcactgcaaccttcacctcccaggttcaagtgattctcctgcctca

SEQ ID NO: 42325 - DNA, 201 bp, Homo sapiens
aaaaaaaaaaaaaaaaaaaaggaaaagaaaagattccctaatcccgtgaatgaacctgtacaattttcaggatcaccatgagctatgcatgtacggacagstccaaaacagtacatcaaacctactgagagctaaactgaaatttaatccctatcattctcagaaggtaaaacagaacttacaaacggaacttgagttgaa

SEQ ID NO: 42326 - DNA, 201 bp, Homo sapiens
cttctattccagtaaaaatggctttataattttacaatttatgatctatctgttgtcatgaattaacttttaaaaaatcctgctttctttctgagaccttwaagaaagaattttcttttgagtattttcatttttatttcaagagaacaatttaaaatatgttttctcacagatagtaggcatttaattagtgatcatgaa

SEQ ID NO: 42327 - DNA, 201 bp, Homo sapiens
tcatgggggcaggatgtgtttttagtattagcatctttggggtgaattatgatgttgttgaaggcatttaattcaacgagtactcatttttattgtgtcastttttaccaatactgctaaagtaacagaacattctattcctctaatttgcctgagcaatatatcgtagtcattagcaagaattagaactgtacctaccaa

SEQ ID NO: 42328 - DNA, 201 bp, Homo sapiens
cgagtgtgaggtctgtggcttagaagtcttaagatgaatattgtgattcctagtgatactatctttgcttggtttttataagcagagttttaaagtctttwcattaatggcccaggcaagttcatggttcatagtagtaaatgttggtgctgtattatgctttaaatcaatgtcttaataccatgattaggaaggggctac

SEQ ID NO: 42329 - DNA, 201 bp, Homo sapiens
gatatttcacctcattggtttattcctatgtaatttttttggtagctagtggaaatgggattgctgttctgttcttctgtttttgtttttgttttgctttkcttttttttgctatttcattattggtgtatagaaatactactttaaaaaaatgttgattttgtatcctgtagtgtaactgaatttgtttaacaactctaa

SEQ ID NO: 42330 - DNA, 201 bp, Homo sapiens
tgtttgtacttattaacctacctctcttcaccctccgctaccaacccagtcaaccttcccagcttctagtatctatcattcttctctctaccattatcagrtcaatctttttagttcccacatatgaatgagaatatgcaataatttgtctttctgtgcctgggttatttcacttaacataatgacatccatgttgctgca

SEQ ID NO: 42331 - DNA, 201 bp, Homo sapiens
aatgctatccaaagtggcatgttgctgctaaatattttgatatgtatagggcattttcatgtccatgtcctatgtagagaatctgtaggtgtcctcttggmaaatgccagtgacctaatgtagcatagaatcagcatgtgtatttggcactcctccacaactcgagaaggtcatttgttaaggctttctgaactatttcag

SEQ ID NO: 42332 - DNA, 201 bp, Homo sapiens
tcagcctcccgagtagctgggactacaggcgtgcaccaccaagcccaactaatttttgtattttttttagtagagacagggtttcactattttggccaggwtggtctcgatctcttgacctcattatctgcctcccaaagtgctgggaatacaggtgtgagctactgcatccagcctaaaatttcactttttatggataca

SEQ ID NO: 42333 - DNA, 201 bp, Homo sapiens
tttttcttgtgtgtgtgtgtatatatatatatatatatcacatttattatgaagctcttagaaatttaaaaacacacttttctttttttttttttttttttgagacagagtcttgctctgccatccaggctggagtgcagtggcacagtctcggctcactgcaacctctccctctcgggttcagccatttctttgcctcag

SEQ ID NO: 42334 - DNA, 201 bp, Homo sapiens
ttttttcttgtgtgtgtgtgtatatatatatatatatatcacatttattatgaagctcttagaaatttaaaaacacacttttctttttttttttttttttttgagacagagtcttgctctgccatccaggctggagtgcagtggcacagtctcggctcactgcaacctctccctctcgggttcagccatttctttgcctca

SEQ ID NO: 42335 - DNA, 201 bp, Homo sapiens
tttttttcttgtgtgtgtgtgtatatatatatatatatatcacatttattatgaagctcttagaaatttaaaaacacacttttctttttttttttttttttttgagacagagtcttgctctgccatccaggctggagtgcagtggcacagtctcggctcactgcaacctctccctctcgggttcagccatttctttgcctc

SEQ ID NO: 42336 - DNA, 201 bp, Homo sapiens
ttcttttcacactctctttctaaatatcaatatacacaatggaaaaaattttaataatcatattatagggtcctaagaattgcacttgaagatttttaaarggagagaataagattagagataatatttttgagggaaaattgatagggtaattgattctagaatgcaaaatttgaacgacaatggcaaagaaatatatgc

SEQ ID NO: 42337 - DNA, 201 bp, Homo sapiens
ctttttttcttgtgtgtgtgtgtatatatatatatatatatcacatttattatgaagctcttagaaatttaaaaacacacttttctttttttttttttttttttgagacagagtcttgctctgccatccaggctggagtgcagtggcacagtctcggctcactgcaacctctccctctcgggttcagccatttctttgcct

SEQ ID NO: 42338 - DNA, 201 bp, Homo sapiens
tgattgccagaaactactacagggagtttctaaaaacgaaatatactatcacttgcctttgacgaaaattgttggtggaagccactgtcattgtgagtagytttcggcaaatgggaaaatgttgccattaacagtagcttgcaagtaagagccacagctaatgtaaaaatccacccttgaaaatgaatatcaagatatttt

SEQ ID NO: 42339 - DNA, 201 bp, Homo sapiens
aggtatttctacaaagaattgatatcagcaggattcatttcaaccctgtaattctgaattctttttttcttgtgtgtgtgtgtatatatatatatatatatcacatttattatgaagctcttagaaatttaaaaacacacttttctttttttttttttttttttgagacagagtcttgctctgccatccaggctggagtgc

SEQ ID NO: 42340 - DNA, 201 bp, Homo sapiens
cctgatacttttatggtttaattttttttgctataataatgagatagtttattccattgtttttaaagtgaaagactataaaaatggatgatactcagcttaatttaatttataaagaactgtaattttaataatctgaaaaagatgcataagaatgtaaactacaaactaattttacttatgattaagaatgctaccatt

SEQ ID NO: 42341 - DNA, 201 bp, Homo sapiens
aaggtatttctacaaagaattgatatcagcaggattcatttcaaccctgtaattctgaattctttttttcttgtgtgtgtgtgtatatatatatatatatatcacatttattatgaagctcttagaaatttaaaaacacacttttctttttttttttttttttttgagacagagtcttgctctgccatccaggctggagtg

SEQ ID NO: 42342 - DNA, 201 bp, Homo sapiens
ctgatacttttatggtttaattttttttgctataataatgagatagtttattccattgtttttaaagtgaaagactataaaaatggatgatactcagcttaatttaatttataaagaactgtaattttaataatctgaaaaagatgcataagaatgtaaactacaaactaattttacttatgattaagaatgctaccattc

SEQ ID NO: 42343 - DNA, 201 bp, Homo sapiens
tttatgaacattgtatacattaaactttgataaaaagcatgtgtgtgaatatatatgtgtgtgtatatatgtgtgtgtgtgtatatatatatattctttayatgaagaatgtagcacattaaaactacaaatgtgtatataggtaaaactaaaattctaggaaaaagaacttgggagaaggaagaggaaggttccattagt

SEQ ID NO: 42344 - DNA, 201 bp, Homo sapiens
tctatacaaattaaaattgaatccagagttcaatttttataaacacatcttacatacttttataagcatattaatatacatacatgctaatataaacatarcatactatacatacatactatacatactatacatacatactatacatactatactaaacataatatgcatactaatataaacatattttacatactttta

SEQ ID NO: 42345 - DNA, 201 bp, Homo sapiens
ttttcagtgactctctaagtacaattttaagtcaacctctcttatatgtgctgttattttggggatattttgtcactatcagatgaataaattatttatcrtttatataaaatcaattcactggagtatgacaaaaacaataaaactttaatctatatttatctgtacctcatccctccaaatctcacttaaatatgttga

SEQ ID NO: 42346 - DNA, 201 bp, Homo sapiens
catgtccttcacttgaaaaatatgacacaatgagagggacaattatgatggtctattgtagtgtgagaaatgtcataatttgaatatttttataaaaatayatataggagaaaaggggggaacacaaccctcactctcaaaatctaaaagtgacttgtaaaacctagaaagcaagagttgggaaacctctgaacacacata

SEQ ID NO: 42347 - DNA, 201 bp, Homo sapiens
aacaatgcaggcttttaaaattgagtaatcatttttatcagccatttttcaacagtggctcttttcatgcatggttaagtgtgattttggctgttaaatcsttcttctcgaatgaaataagcattttaattcagcaatctgaaaatcatcaataacagacattgtcttgcccttttgctctcccaatttacctaatcagtt

SEQ ID NO: 42348 - DNA, 201 bp, Homo sapiens
tctcattttggatacaaatgttatcaaagtagagatagaatgcttgtcagttttgttgaagggacactgtctacaatcaggttggactctaattgattttsaatgaagcactctcagctactacttcagttaggcaccagtttggctataatagatgattttttaaggtccttaatagatttctatttgaaaaaaatgtca

SEQ ID NO: 42349 - DNA, 201 bp, Homo sapiens
catatttataccaactggctttctaaatcagatgcctctattgccagtaccattggtcagttcgtctgaaggatgtttccttctatagaaatcataaactwtcataaagagactgtttgggaccatagagagaagactttagatcataagggtagtggtatctaatttaggtttatttaagtaaacagtggcaggaatttc

SEQ ID NO: 42350 - DNA, 201 bp, Homo sapiens
catgtgtcaactagtcaaaaacattttcattcaactcaaaaataaatacgcccactcaattcatgaaaattgcttttgcgtttgattttgaattgtttgamtacttcagacgtgattatttcaattatgtaagctaagctgcatttcaatctgggcacagacttatcatcaaaatgttcctgttgagaagaaccagtttct

SEQ ID NO: 42351 - DNA, 201 bp, Homo sapiens
gaacttaaaacaatgaaagaatacatatttcttttataataaaatatattttaaatgaaaaggcattaaaaatagtggacacaatattctctaacaattakgtactatgaagtactatttctgtgactaaatttaggatatagtttattcattatattgatagtttagaataaatttgcctatgttaaacttttatcagag

SEQ ID NO: 42352 - DNA, 201 bp, Homo sapiens
ggtttatgatactgattgtcagaaagtgatggagaaaagtgttaataatgtagactaaacttatattttgctgtgtgtataacaattaccttgtaacaccaaaaaaaaaaagtgaagaaattactatttagtgtttgaaaactattatccaatttagtaaaaagtagcttatgccatgattaagttctggcatacatcttt

SEQ ID NO: 42353 - DNA, 201 bp, Homo sapiens
ttcatggaaaaatttctggacagatatgcaagagctgaatagttggtgctttgggggattagtttggagacttttaaaatttttacttgatgttctttagygtggtaaattatttaaaagtaatggacacgtattatagtacttttataataaaaagaagtttagatttaaaaacttaaaaaatagtggatgtggtaatta

SEQ ID NO: 42354 - DNA, 201 bp, Homo sapiens
attgaataatattatcaaaggatcctgaaaggcattatttcaatgagcatttcccagtgagaaatatcagtgagagagatttttttcccatgggatttttcttcctagcaacatcagcttctgggctgaatgctatgttctgctccctaccaggaagagtaggagagacggaacatacctagatgattccagtcagttaat

SEQ ID NO: 42355 - DNA, 201 bp, Homo sapiens
tctcttcaaggagaactacaaaccactgctcaacgaaataaaagaggactcaaacaaatggaagaacattccatgctcatggataggaagaatcaatatcrtgaaaatggccatactgcccaaggtaatttatagattcaatgccatctgcatcaagctaccaatgactttcttcacagaattggaaaaaaactacttaaa

SEQ ID NO: 42356 - DNA, 201 bp, Homo sapiens
caaaccgaatccagcagcacatcaaaaagcttatccaccatgatcaagtgggctttatccctgggatgcaaggctggttcaacatacacaaatcaataaaygtaatccatcatataaacagaaccaaagacaaaaaccacatgaattatcttaatagatgcagaaaaggcttcgacagaattcaacaacccttcatgctaa

SEQ ID NO: 42357 - DNA, 201 bp, Homo sapiens
ttggcaaaccgaatccagcagcacatcaaaaagcttatccaccatgatcaagtgggctttatccctgggatgcaaggctggttcaacatacacaaatcaawaaatgtaatccatcatataaacagaaccaaagacaaaaaccacatgaattatcttaatagatgcagaaaaggcttcgacagaattcaacaacccttcatg

SEQ ID NO: 42358 - DNA, 201 bp, Homo sapiens
tatcctttctgtagagataatcttaccaatggggttctactatgtatggtttattatataaagctcttactctgttggaaactgtttggatgaatatcacmaactttcttttttccatggttgacacagtccctttttgattgataattcctttttttagatataccaaaacttttagttaatttatagtcaaggttagcc

SEQ ID NO: 42359 - DNA, 201 bp, Homo sapiens
aatttaattcatgttttcatgttgaaggccttagattacacatttcttaggcttggactttccatgtttgaatcaactgtggagaatagataatgggattaaaaaaaacacaattaatggaaagactgtaaaaacagatttaaaaaataaagattggaacaggactccaagatggctgactagaggcattcagcaattgcc

SEQ ID NO: 42360 - DNA, 201 bp, Homo sapiens
tctgttcttttacatctgctgaggagtgctttacttccaactatgttgtcaattttgtaataagtgcgatgtggtgctgagaagaatgtatattctgttgrtttggggtggagagctctgtagatgtctattaggtccacttgatgcagagctgagttcaattcctggatatccttgttaactttctgtctcgttgatctg

SEQ ID NO: 42361 - DNA, 201 bp, Homo sapiens
ttcaaagggaatgcttccagtgtttgcccattcagtatgatattggctgtgggtttgtcatagatagctcttattattttgagatatgtcccatcaatacktaatttattgagagtttttagcatgaagggttgttgaattttgtgaaaggccttttctgcatctattaagataatcatgtggttttgtctttggttctgt

SEQ ID NO: 42362 - DNA, 201 bp, Homo sapiens
cctgagactttgttgaagttgcttatcagcttaaggagattttgggctgagatgatggggttttctagatatactatcacgttatctgcaaatagggacartttgacttcctcttttcctaattgaataccctttatttacttctcctgcctgattgccctggccagaacttccaacactatgttgaataggagtggtgag

SEQ ID NO: 42363 - DNA, 201 bp, Homo sapiens
aaatcataattgtattacatttatagcatagaatttgatgttttggatgtatgtatacagtgtggaatgattaaatcaaattaattaacatatccattacytcactatttaacttttttcttgtggtgatacatttgaagtttactctcttagttattttgaactatgcaatatgttgtttttgactgtagtcaccctgct

SEQ ID NO: 42364 - DNA, 201 bp, Homo sapiens
gtatactttatgaacattgtatacattaaactttgataaaaagcatgtgtgtgaatatatatgtgtgtgtatatatgtgtgtgtgtgtatatatatatattctttatatgaagaatgtagcacattaaaactacaaatgtgtatataggtaaaactaaaattctaggaaaaagaacttgggagaaggaagaggaaggttcc

SEQ ID NO: 42365 - DNA, 201 bp, Homo sapiens
ttatagagcagtacagctgtgagatgtatactttatgaacattgtatacattaaactttgataaaaagcatgtgtgtgaatatatatgtgtgtgtatataygtgtgtgtgtgtatatatatatattctttatatgaagaatgtagcacattaaaactacaaatgtgtatataggtaaaactaaaattctaggaaaaagaac

SEQ ID NO: 42366 - DNA, 201 bp, Homo sapiens
ctcccctatgttatttatttatatatcctttaatagctacttctgttggtaaatcggtattagtgtttttccattatttgcatttattaatgtatttgccrtatctccacaattacaatcaaataactttgagtcaaggtactaacaatgttttgttttgtcttttccatctatttagaaagctaacacaagagtaaactg

SEQ ID NO: 42367 - DNA, 201 bp, Homo sapiens
tacttcacttctacctttaaataaatctacagttttattttttaaaaacaagttaaattggacaatactttaacagtataattaaaacaataactgagtascctatgacacagtcattccaagtatacacccaatagaaagcatatatgtgcaccaaaagacaagtactagccaaaagttggaaaaagaacaaatacggaa

SEQ ID NO: 42368 - DNA, 201 bp, Homo sapiens
gtaatatacttcacttctacctttaaataaatctacagttttattttttaaaaacaagttaaattggacaatactttaacagtataattaaaacaataacygagtaccctatgacacagtcattccaagtatacacccaatagaaagcatatatgtgcaccaaaagacaagtactagccaaaagttggaaaaagaacaaat

SEQ ID NO: 42369 - DNA, 201 bp, Homo sapiens
ggtatgacttgaccaggtgtggtggctgacacttgtaatcctagcactttgggaggctgaggcaggagggtcacttgagatcaggaattcaagaccagccwgttcaacatggtgaaacctcgtctctactaaaaatccaaaaatcagctgggcgcggtggctggtgcctgtaatcccagctactcaggaggctgaggcatg

SEQ ID NO: 42370 - DNA, 201 bp, Homo sapiens
aatacaaagtatttcttcagcaagaagagtaaattaaaaaagaaagcacggtaatcaatagcttttgaaagtgtatcagtaatatacttcacttctacctytaaataaatctacagttttattttttaaaaacaagttaaattggacaatactttaacagtataattaaaacaataactgagtaccctatgacacagtcat

SEQ ID NO: 42371 - DNA, 201 bp, Homo sapiens
ggttagagctgcactctttgcctttagatttgcttgcaggggagatgtagaacaggtgagcatcttcctcagaacaacccttcattgtcttcattgaaaasaattattaagaagctcattgttggccaggtgcagcggctcatgcctataatcccagcactttcagagatcaaggcaggaggatcccttgagcctaggagt

SEQ ID NO: 42372 - DNA, 201 bp, Homo sapiens
aaatgaggagtttacaatccacaaatacaaagtatttcttcagcaagaagagtaaattaaaaaagaaagcacggtaatcaatagcttttgaaagtgtatcrgtaatatacttcacttctacctttaaataaatctacagttttattttttaaaaacaagttaaattggacaatactttaacagtataattaaaacaataac

SEQ ID NO: 42373 - DNA, 201 bp, Homo sapiens
ttcccacaagttttattccagaaaagtatcttgtagtatttttattaggataggattcaactatattaacataggagaatttacatatttgtgatgtttatttgtagatcatggggtgcctttctattttttttcaagtacattttgtatgttctggagttttaaaaaaatgttattttaggtgctggggtacttgtacag

SEQ ID NO: 42374 - DNA, 201 bp, Homo sapiens
agctactagaaagaaaaacagattgcttgcataggaaaaaaaaaagattggcttttaacttcttaagaacaaagcaattaagttttatgtgaaaatcactrccagcctagaaatgtacttgtagctaagctatcctttaagagtgaaagcaaaatagagacattttcaaatattcaaaaaatgaggagtttacaatccaca

SEQ ID NO: 42375 - DNA, 201 bp, Homo sapiens
gtacatgaacaacgtaggtgactggtttgccttcccatccctagcccctcttcccttgtactttgaatataggctgagatactttccgtatacaaaatagrgtaaattacaaatgagtatgtgattttacataggttgattttctaagtgagttctgcttggttatttacagggaacaacaaccctgggaatttctaggga

SEQ ID NO: 42376 - DNA, 201 bp, Homo sapiens
tatgcacttctctaatgatcagtgatattgagctttttttcctatgctcattggacgcatgtatgtcttcttttgaaaagtgtctgttcatgtccactttycaatgggattgtttgcttttgtcttatagatttgtataagttccttatagatgctgactattagacttttgtcagaaaatatttgcataatttgcaaata

SEQ ID NO: 42377 - DNA, 201 bp, Homo sapiens
tagaattgaagagtgggatgatctttcaaattgaaagacttcattgagggccaaacaggtcaataaacacaatccttaactggttatatcatggaataaasaaagaagttaatggtaagaggcaatttaaaagctactagaaagaaaaacagattgcttgcataggaaaaaaaaaagattggcttttaacttcttaagaac

SEQ ID NO: 42378 - DNA, 201 bp, Homo sapiens
ctgcttgcctgtaccttaatagaagttttttgtttgtttttgttttttgagacagagtttcactcttattgcccaggctggagtgcaatggcacaatctcrgctcactgcaacctccacctcccaggttcaagcaattctcctgcctcagcctcccgagtagctgggattacaggcatatgccaccacgcccagctaattt

SEQ ID NO: 42379 - DNA, 201 bp, Homo sapiens
atagaattgaagagtgggatgatctttcaaattgaaagacttcattgagggccaaacaggtcaataaacacaatccttaactggttatatcatggaataargaaagaagttaatggtaagaggcaatttaaaagctactagaaagaaaaacagattgcttgcataggaaaaaaaaaagattggcttttaacttcttaagaa

SEQ ID NO: 42380 - DNA, 201 bp, Homo sapiens
ggctggagtgcagtggcgcgatctcagctcactgcaagctccgcctcctgggttcacgccagtctcctgcctcagcttctcaagtagctgggactacaggygcccgccaccaagcctggctaatttttttgtatttttggtagagacggggtttcaccgtgttagccagcaggatggtctctatctcctgacctcgtgatc

SEQ ID NO: 42381 - DNA, 201 bp, Homo sapiens
gtccctactggggcactgtctagtggatctgtgagaagagggccaccatcctccagaccccagaatggtagatccactgacagtttacaccctgtgcctakaaaagccacactcaatgccagcccataaaagcagtcgagagggagcctgtaccctgcaaagccacagggacggagctgcccaagaccatgggaacccacc

SEQ ID NO: 42382 - DNA, 201 bp, Homo sapiens
atattagacaggaaagccctttgataccacatgggctctttattggttcctcatcagcaactaccacagtatctggcatattaatgagtgcttatttaataaaaaaaattgattgaatacatgaacgaatgaaaaacaagaatgagaacctaattatcctgtctttttacctaagaatgactgaatttaccccttactcag

SEQ ID NO: 42383 - DNA, 201 bp, Homo sapiens
acaaagaaaaactaaaatagcaagtacataatcattctttgaatacagcatctaagacagaacactggaattcaacagaggagtgtcatgaaacacctgargcaagaaaaaaaacagggaagtaaagctgccagcttggtcaggatcacctgggagcttggagagtcaccccagtgtgggaaaatggtatatgccccagca

SEQ ID NO: 42384 - DNA, 201 bp, Homo sapiens
aaatacagagcataattcttccttaggtgttgtccaaatatttgttttgtcgcattctagttttctattttatatataagctgccaacttaagctactttaatttagcagtgtagggaattcttatgtcccataaagcaaacttcaatccagtaaccttgaataatatgtccaaaagtctaatatagatctgaattactgt

SEQ ID NO: 42385 - DNA, 201 bp, Homo sapiens
gaaacaaaaattctggaactaagaattcaatgaatgaaatacaaaattcatgtgagagcttcaacaacagattttattatgcacaagaaataattttatarcaggaataaaggattttttaaataacttggtcaggcaaaatagaataaataataaaaaaagattgtacaaatcctgtgtaacaaatggggctccataaag

SEQ ID NO: 42386 - DNA, 201 bp, Homo sapiens
agtgcagcttccctgacattgctaatggcctctcttcttgagccccatggccctcatctctcagttcccacatcattttatataaattagctattacttgrcatctgtctcattgttacctacacattttacttatttctctctccatctcttatgtatcctttgtattcccagaacgtaaaatggtgctagaacagtaaa

SEQ ID NO: 42387 - DNA, 201 bp, Homo sapiens
ttcctaggtattttattctctttgaagcagttgtgaatgggagttcactcatgatttggctctctgtttgtctgttattggtgtataagaatgcttgtgayttttgcacattgattttgtatcctgagactttgttgaagttgcttatcagcttaaggagattttgggctgagatgatggggttttctagatatactatca

SEQ ID NO: 42388 - DNA, 201 bp, Homo sapiens
gagcaacacccccctacagtaatgtgtaatttctttcatatttttttttgaccagtgaaataggagtgtcagttttggccgtcctgcttatccttacttarcatccgtggctggaacacagcaggcagttttttgctttattactgtgcctaggattactttgcaaatgtaaccagatgaatttggttaggattgttgata

SEQ ID NO: 42389 - DNA, 201 bp, Homo sapiens
gaagagaatgatgttaagtcaaatataaaggaaaccttattaaaactaacagcagatttttcagcagaaaaattacagatcaggagagaatgagatgatayattcagagagctgggaggagaaaaaccaaaaaaaaaaaatgtcaatccagaacactatacccagcaaaattgatccttcagctataaaaaagaaataaac

SEQ ID NO: 42390 - DNA, 201 bp, Homo sapiens
cttgggcagtatggccattttcatgatattgattcttcctacccatgagcatggaatgttcttccatttgtttgtatcctcttttatttcattgagcagtrgtttgtagttctccttgaagagatccttcacatcccttgtaagttggattcctaggtattttattctctttgaagcagttgtgaatgggagttcactcat

SEQ ID NO: 42391 - DNA, 201 bp, Homo sapiens
aattacagatcaggagagaatgagatgatacattcagagagctgggaggagaaaaaccaaaaaaaaaaaatgtcaatccagaacactatacccagcaaaaytgatccttcagctataaaaaagaaataaactctttcccagataagcaaaaactgaggaaatttattactttcctttgttttcgtgactcctttaaagggt

SEQ ID NO: 42392 - DNA, 201 bp, Homo sapiens
ctcaggtttgtcaaagatcagctggttgtagatgtgtgtggtattatttctgagggctctgttctgtttcattggttgatatctctgttttggtaccagtmccatgctgttttggttactgtagccttgtagtatagtttgaagtcaggtagtgtgatgcctccagctttgttcttttggcttaggattgtcttggcgatg

SEQ ID NO: 42393 - DNA, 201 bp, Homo sapiens
ggtacaactacagaaaaacaccaaaccataatgataaacaataagaaagaaaggaacgaagtatacacaaaacatccagaaaacaatttacaaaatgacaraaataaatcctcacacataaataataactttgaaggtaaatggattaaattttgctcttaaaagatatagcttggtgactcagacctttaatctcagcac

SEQ ID NO: 42394 - DNA, 201 bp, Homo sapiens
aatgattttaatttgtgaaaatggaaacaggctcctcattctaaagaaacatgaccttgtaatcctactttttgcagacatatttcccttttatgtttccyattatattcccctatatagtttccttttccatcatcagttcttaatttccttattacttagcaaaaacgctatttcttagtgataaattagtaaattgag

SEQ ID NO: 42395 - DNA, 201 bp, Homo sapiens
ccttttatgtttcccattatattcccctatatagtttccttttccatcatcagttcttaatttccttattacttagcaaaaacgctatttcttagtgatawattagtaaattgagtgttggaaagaaactcttttaatatacccttattagaagaaagcatttaactcttttaatacacccttattagaagcaagcattta

SEQ ID NO: 42396 - DNA, 201 bp, Homo sapiens
tctattatttttatttatttcaaagaattttttggttactgccttaatttcattgtttacccaaaagtaaatttattagtccattttcacattgctatgargatactgagactagctaatttattaaaaaaaaaaaaagagaggtttaattgactaacatttcacatgtctaacacttttagtgagttgttgaagttcctc

SEQ ID NO: 42397 - DNA, 201 bp, Homo sapiens
gtatcccctgccctagtcactctctgtatctattaatgtatgttatttttattcatacctcatatttttatctgacatacagtaaatcctcacttaacatygctgataagttcttagaaactgtaactttaggcagcatacatataatgaaagccaattttatcacaaagctaattgatataaacaggagttaagatttta

SEQ ID NO: 42398 - DNA, 201 bp, Homo sapiens
tatcccctgccctagtcactctctgtatctattaatgtatgttatttttattcatacctcatatttttatctgacatacagtaaatcctcacttaacattrctgataagttcttagaaactgtaactttaggcagcatacatataatgaaagccaattttatcacaaagctaattgatataaacaggagttaagattttaa

SEQ ID NO: 42399 - DNA, 201 bp, Homo sapiens
tattgttgttccacctctgtttacaagagcaaaaatatgataaatgacttcaaatgtccatgttaccaatagaaaactgggtacatttcctctagttagakaaacacattatacacattgcaaaaattcatttgtctaatcactaatctttcttcagtgcctactgtatagtttgaagtgcccagatactgaccctataga

SEQ ID NO: 42400 - DNA, 201 bp, Homo sapiens
aatgaaggaatttatttaaagatgttttccttttcagaaatagtcacttttttagagaattaaaaagatatcaagaacatctaattaatagttatcttaaygacagatgacagtttaattaaatgtgaaaagcaaatttgaaagcatcttagtctgtaaaactacttcatgtataaaaaataaacatttgacagaactctc

SEQ ID NO: 42401 - DNA, 201 bp, Homo sapiens
acgtgagatgggtttcctgaatacagcacactgatgggtcttgactctttatccaatttgccagtctgtgtcttttaattggagcatttagtccatttacrtttaaggttaatattgttatgtgtgaatttgatcctgtcattatgatgttagcttgttattttgctcattagttgatgcagtttcttcctagaattgatg

SEQ ID NO: 42402 - DNA, 201 bp, Homo sapiens
ctccatccttttattttgagcccatgtgtgtctctgcacgtgagatgggtttcctgaatacagcacactgatgggtcttgactctttatccaatttgccartctgtgtcttttaattggagcatttagtccatttacgtttaaggttaatattgttatgtgtgaatttgatcctgtcattatgatgttagcttgttatttt

SEQ ID NO: 42403 - DNA, 201 bp, Homo sapiens
tatcagagactaggattgcaacccctgcctttttttgttctccatttgcttgatagatcttcctccatccttttattttgagcccatgtgtgtctctgcaygtgagatgggtttcctgaatacagcacactgatgggtcttgactctttatccaatttgccagtctgtgtcttttaattggagcatttagtccatttacgt

SEQ ID NO: 42404 - DNA, 201 bp, Homo sapiens
ttgacaatgggatgttgaagtcttccattatcattgtgtgggagtctaagtctctttgtaggtcactaaggacttgctttatgaatctgggtgctcctttwtatggtgcatatatatttaggatagttagctcttcttgttgaattgattcctttaccattatgtaatggccttctttgtctcttttgatctttgttggtt

SEQ ID NO: 42405 - DNA, 201 bp, Homo sapiens
ccccctacagtaatgtgtaatttctttcatatttttttttgaccagtgaaataggagtgtcagttttggccgtcctgcttatccttacttaacatccgtgkctggaacacagcaggcagttttttgctttattactgtgcctaggattactttgcaaatgtaaccagatgaatttggttaggattgttgatactatacctg

SEQ ID NO: 42406 - DNA, 201 bp, Homo sapiens
tgttaactttctgtctcattgatctgtctaatgttgacaatgggatgttgaagtcttccattatcattgtgtgggagtctaagtctctttgtaggtcactmaggacttgctttatgaatctgggtgctcctttatatggtgcatatatatttaggatagttagctcttcttgttgaattgattcctttaccattatgtaat

SEQ ID NO: 42407 - DNA, 201 bp, Homo sapiens
agttttggccgtcctgcttatccttacttaacatccgtggctggaacacagcaggcagttttttgctttattactgtgcctaggattactttgcaaatgtwaccagatgaatttggttaggattgttgatactatacctggcagcttaacgatttctgaaagtaaaagacatcgtgtcagtttatatctctatctctatct

SEQ ID NO: 42408 - DNA, 201 bp, Homo sapiens
ttctcgttggtttcaaagaacatctttatttttgccttcatttcgttatgtacccagtagtcattcaggagcaggttgttcagtttccatgtagttgagcrgttttgagtgagtttcttaatcctgccttctagtttgattgcactgtggtttgagagacagtttgttataatttctgttcttttacatttgctgaggagt

SEQ ID NO: 42409 - DNA, 201 bp, Homo sapiens
acttaacatccgtggctggaacacagcaggcagttttttgctttattactgtgcctaggattactttgcaaatgtaaccagatgaatttggttaggattgktgatactatacctggcagcttaacgatttctgaaagtaaaagacatcgtgtcagtttatatctctatctctatctctatctctatctctatctctatctc

SEQ ID NO: 42410 - DNA, 201 bp, Homo sapiens
gttctcgttggtttcaaagaacatctttatttttgccttcatttcgttatgtacccagtagtcattcaggagcaggttgttcagtttccatgtagttgagyagttttgagtgagtttcttaatcctgccttctagtttgattgcactgtggtttgagagacagtttgttataatttctgttcttttacatttgctgaggag

SEQ ID NO: 42411 - DNA, 201 bp, Homo sapiens
cctggcagcttaacgatttctgaaagtaaaagacatcgtgtcagtttatatctctatctctatctctatctctatctctatctctatctctatctctatctatctatctatctatcatctatctatctatctatctatctatctatctatctatctatctatcatctatctatctatctatattccccattgggaagtcaa

SEQ ID NO: 42412 - DNA, 201 bp, Homo sapiens
aatgtgtcccagatattctagtatgttatgtctttgttctcgttggtttcaaagaacatctttatttttgccttcatttcgttatgtacccagtagtcattcaggagcaggttgttcagtttccatgtagttgagcagttttgagtgagtttcttaatcctgccttctagtttgattgcactgtggtttgagagacagttt

SEQ ID NO: 42413 - DNA, 201 bp, Homo sapiens
ctggcagcttaacgatttctgaaagtaaaagacatcgtgtcagtttatatctctatctctatctctatctctatctctatctctatctctatctctatctwtctatctatctatcatctatctatctatctatctatctatctatctatctatctatctatcatctatctatctatctatattccccattgggaagtcaaa

SEQ ID NO: 42414 - DNA, 201 bp, Homo sapiens
aaagacatcgtgtcagtttatatctctatctctatctctatctctatctctatctctatctctatctctatctatctatctatctatcatctatctatctrtctatctatctatctatctatctatctatctatcatctatctatctatctatattccccattgggaagtcaaaccacaacatctctttccctcaaaatct

SEQ ID NO: 42415 - DNA, 201 bp, Homo sapiens
gctgaggctggagtgcagtggggtgatcttggctcatggcaacctctgcctcctgggttcaagtgattctcctgcttcagcctcccgagaagctgggattwcaggcacgtgccaccacgcccaactaatttttgtatttttagtagagacggggtttcaccatggtggccaggatggtctcgatctcttgacctcgtgatc

SEQ ID NO: 42416 - DNA, 201 bp, Homo sapiens
tcttggctcatggcaacctctgcctcctgggttcaagtgattctcctgcttcagcctcccgagaagctgggattacaggcacgtgccaccacgcccaactratttttgtatttttagtagagacggggtttcaccatggtggccaggatggtctcgatctcttgacctcgtgatctgcctgcttccgcctcccaaagtgct

SEQ ID NO: 42417 - DNA, 201 bp, Homo sapiens
acggggtttcaccatggtggccaggatggtctcgatctcttgacctcgtgatctgcctgcttccgcctcccaaagtgctgggattacagatgtgagccacygtacccaaccgatatatatatatttttcattttattttcctctttctcacacacatacacggacaatatgagttttaaataattagactatatatatata

SEQ ID NO: 42418 - DNA, 201 bp, Homo sapiens
gtccactgacacacttctatgcatgctataggtgaaaattgaattcatctcaagcttagtataacttagagccagagtaccactaatcatcatggacatgaaaaaaaaaatacaatgagatatcacttcacacttcttaggatacctattatcaacagccacagaaaagataagtgttggtgagtatatgaagaaattgga

SEQ ID NO: 42419 - DNA, 201 bp, Homo sapiens
tctaaagctgaacttcaaattagccctgcaaatcagctcaagccattcccatctcagaaactgaaaactctattcctccagttttggcccaaggacaaaargcctgtgagataattttcaacttatttcatcttctccagctcctcatcagcaaatcctgttggctcaatcttcaaatatatatggactttcactaatttt

SEQ ID NO: 42420 - DNA, 201 bp, Homo sapiens
cttaccaactatgtgagatgacccccgtttctgaagaaatcttctatgtccacaccagatcactaggaggtctcctcctagtgacacaattagacaccctrttgctaaatttcactctcaacttctgactaacatgcctgattgcttattcaacctccctacttgcttttccagtacatttctcaaaataaaatgctctaa

SEQ ID NO: 42421 - DNA, 201 bp, Homo sapiens
aagaacagaggactgcagagctgggtacttgattttacttggtatttctattttctcacagctctaagcacaattccactatataaatacttgttgaaatmagtttttcagaatacctgaaatttagcaagattatcaacctaagttacctctgttttcctcgatcagatgaatctagttattggttaacatagggagcac

SEQ ID NO: 42422 - DNA, 201 bp, Homo sapiens
gagctgggtacttgattttacttggtatttctattttctcacagctctaagcacaattccactatataaatacttgttgaaatcagtttttcagaataccygaaatttagcaagattatcaacctaagttacctctgttttcctcgatcagatgaatctagttattggttaacatagggagcactaatttaactttctgaa

SEQ ID NO: 42423 - DNA, 201 bp, Homo sapiens
catcaattcataaaaactgaaaattcaaaggatttacaaaaattatcagttttacttacttctcatcttcattttaaaggtcaaggaatttaagcataggaaaagtctgagattggcctaacaaaaaacaactagtttagttaggacacccaagtatcctaacttcaagttccattaatatcccaccgtaacacaagccta

SEQ ID NO: 42424 - DNA, 201 bp, Homo sapiens
tctttattcattcatccaatgaaagacacctaggttgcttccatctcttagctattgtgaacatggaagtgcagatatctcttaggcatattgatttgaattttttttttttttttttttttagacagagtctcattctgtcacccaggctgcagtgcagtggcatgatattggctcactgcaacctccgcctcccaggtt

SEQ ID NO: 42425 - DNA, 201 bp, Homo sapiens
catttcatgagtggaaaacaagacaaacaacatccctattttcatgtaagttaagttctagtagggataaaataaaaaatgtaacccacctgccaaaaaarggaaaaaaatgaagaaaaaatataattttaggtgaaaatcatgaaaaaggacctaaagaaaatatatacactaatataagaaataaatgaaatggggaaa

SEQ ID NO: 42426 - DNA, 201 bp, Homo sapiens
ggatatataccaaaagagggattaccggatcatatggtagttctatttttaattttttgatgaacttccatattcttttccataatggctatactgatttycattcccattaacagtgtggaagggctcacttttctgctcacccttgccaacacttataatctttcattttttgtataatattcatccttacaggtgtga

SEQ ID NO: 42427 - DNA, 201 bp, Homo sapiens
aacaagacaaacaacatccctattttcatgtaagttaagttctagtagggataaaataaaaaatgtaacccacctgccaaaaaaaggaaaaaaatgaagaraaaatataattttaggtgaaaatcatgaaaaaggacctaaagaaaatatatacactaatataagaaataaatgaaatggggaaaagggttaactttagtt

SEQ ID NO: 42428 - DNA, 201 bp, Homo sapiens
tatagaaaggattgaactccttgtgggaaaaaggatatatatatgaaatgtattgtgaccctgaagtcttaatgtattactactatgtcattgctgtcctggcttctatgtaaacacctcagcctgaatgttttcagcttcaacttctatatttgtttttggcttcttttgcttgaatcaagtgagatagcaacagtaatg

SEQ ID NO: 42429 - DNA, 201 bp, Homo sapiens
aaagagatctcttacatggattttagaaggaagcagtgcatgggtaattatattaaaccctgtttagcacaatgacattagataatcaaactcaggtaactgtaactagaggcaactagtaaatgtaccatgtcaacccaaaataatgtctgtgtagaatctaaaggacagaaacattggtggcttatccaaagttccaaa

SEQ ID NO: 42430 - DNA, 201 bp, Homo sapiens
aagagatctcttacatggattttagaaggaagcagtgcatgggtaattatattaaaccctgtttagcacaatgacattagataatcaaactcaggtaactgtaactagaggcaactagtaaatgtaccatgtcaacccaaaataatgtctgtgtagaatctaaaggacagaaacattggtggcttatccaaagttccaaat

SEQ ID NO: 42431 - DNA, 201 bp, Homo sapiens
taaggtgggaggattgcttgaacccaggaggtggaggtagcagtgagcggagattgtgtccactgcactccagcctgggtgacagagtgagagactgcctaaaaaaaaaaaaaaagaaagaaaagaaaagaaagaaaaaagaaaaaaacaacatttaatttttctagatgtataatgattttttaaaaaaagagaaaaaaa

SEQ ID NO: 42432 - DNA, 201 bp, Homo sapiens
ctattgtttttgtaagaagcaccaagagtgcctgggtcttagggtcaccatccctaagattaatcttggctctttttattagtgacagtatgacatttagwaatatatatatatatatttctctgagatactggttccttatatttcaactcagagaatacctaccttgtaatattataattagaaataatgcatataaag

SEQ ID NO: 42433 - DNA, 201 bp, Homo sapiens
gcattgaaaacctttataaaagtgcattctctttgtcttctagaatgtttgcccagatacatttggagaactgcagaaagatattcaccactcagtatacmcacacacacacacacacacacacacacacacacacacacacacacaaaacacctacctatctacataaatatgaaacaactgataaccattaataacatg

SEQ ID NO: 42434 - DNA, 201 bp, Homo sapiens
aaggagagggaaggcttcatttaggaagcttctttagctctgtgtgtgtttgtgtgtgtgtgcacgtgtgtgtgtgcatgcacaagtgtgtgtgtgcatgygcaagtgtgtgtgtgtacataatgttggggagtatcaagaggaagaaatagtgactagtttttattctttaagcgttaaatttcctcccctttataattt

SEQ ID NO: 42435 - DNA, 201 bp, Homo sapiens
acttaagtgtaaatatttcagctgtgatatttccatgttcgatttccctctcaaaattcttaataaccagggtttaattgcacgactgccttcccatacgrtagctttgtaataatttgaagcaaaaagtaaaactatctgattttcaggtaagaaaattgcagaatttattttaaacaatatttagtgactaagattgct

SEQ ID NO: 42436 - DNA, 201 bp, Homo sapiens
ttaataattataatttctcatttgtttagcatcaccatctttctctcttatagattctcttcatcagaagtaaaatgttcacatttctgtcgtcttaaaawaataactatctgttaaggtttagtactagattgtatatatgttacttttcaaaaaagaaacatgaaaaatctttttaattgtgcaaatatctttaaagag

SEQ ID NO: 42437 - DNA, 201 bp, Homo sapiens
ttttggagcattttggatttcagatttttagattagcaacgctcaacctgtatagcacatttttcacagtactaaaacacaattgtgtcagagaatgctcscataagagctccagtttatctcagacaatgcattctgtattttaggattaaagaagaagacatttccaaattgttcctccttctgagacctcttctcttt

SEQ ID NO: 42438 - DNA, 201 bp, Homo sapiens
ttcattctggcccttggctgggtgtgagtatgaaacctgaaatttatgagtggagaaaatagaagttgaattggaacactatactggctaaatcaattgayttattggaaaggccagtgtgaattataggggttttcttctgtatttgtggctgaatgagagctgagaagtgctgaattgtagattaagagaattttgaaa

SEQ ID NO: 42439 - DNA, 201 bp, Homo sapiens
ttggttgagtctttgggttttctatacataatattatataatctgcaaacagagaaaattttacttctttttttcctgatttgtatgccttttatttcttyttcttgcttaattgctctggctaggacttccaggaatatattaagtggaaatggtgagagtgggacaatatgtttaattttgtaagaaaccgccaaactg

SEQ ID NO: 42440 - DNA, 201 bp, Homo sapiens
ttattggatttgtaattcaatgagaaatacagccctcacataggtgtctgacttaatgactcctgctgaagttgaattgtgagatgttatccatctcctcyctgaaatatgaattctagtttagcagaattcgttgtccttagggagttggtaatatcacctttggtatgacttaaaaaaaagcccattaacgatatattt

SEQ ID NO: 42441 - DNA, 201 bp, Homo sapiens
ggctttggtgagtatctgtgatcataggataatgttttcttgtttacttaagccctcacttctttttactcctcactaagaagatctctagcaaagagaaaaaaaaatagttttagactttcctttagggaagggactctttttcttcaggaaaatatgctgcaccgtgttgggagatgagactctgatggatgaatatat

SEQ ID NO: 42442 - DNA, 201 bp, Homo sapiens
ggaagcttctttagctctgtgtgtgtttgtgtgtgtgtgcacgtgtgtgtgtgcatgcacaagtgtgtgtgtgcatgcgcaagtgtgtgtgtgtacataaygttggggagtatcaagaggaagaaatagtgactagtttttattctttaagcgttaaatttcctcccctttataatttctgtaattcttccagttggccat

SEQ ID NO: 42443 - DNA, 201 bp, Homo sapiens
gcagaattcgttgtccttagggagttggtaatatcacctttggtatgacttaaaaaaaagcccattaacgatatattttaagatgaaaagtaatagaatgmaggttattcatatatttattttcagcttgacagttgaaattacatgctaacattttactcttatcgtaaaagttataaaacattcctaaattaacttata

SEQ ID NO: 42444 - DNA, 201 bp, Homo sapiens
tttgctgacatacatatgacaattcaggtgcatattttacattgtttttaattttttattttgaagtaattttataattacagaaagctgaaaaaagtacrgagatcctataggcctttcacctaatttcccctaatgttaacaacttgcatacccagggttcatttgtcaaaatgaagaaatgaccattggtattatact

SEQ ID NO: 42445 - DNA, 201 bp, Homo sapiens
ttataaactcttacaatatggagctaaattaaagaccacatcaaggaaaacaacaattgtcaactagtggcttcagactttcttttggggagggcagaatrgggggaaactggagaagaaaggaacaacagaaaggggatgacacagcatgttatcccctaggggaatggctggagtggcctataagaacaagagttttta

SEQ ID NO: 42446 - DNA, 201 bp, Homo sapiens
ctatgtttcatccagtttcatggatagagaaattagcaaagttatatgatttacctaagaatttaatttccatgaaaaaaagttatagttaaggaaagccaaaaaaaaaattgtggaaagggaaagctactaatgaagacacatggactgaaacatcacatctgtcactagccagctggagagttcttttaagtcatttcc

SEQ ID NO: 42447 - DNA, 201 bp, Homo sapiens
tctatcatgtatatttccttcctcaaaacttcgaacaccaagttttattttgtgtgagtcatggaaaagagctgacttgtacatatggatgctgctctgcrgaatgctgtgatactccgtaaactgaactgctttgatagaagctgcagcttagctccctgagcatgtaagcctatggtgatttacagaaaccttggggag

SEQ ID NO: 42448 - DNA, 201 bp, Homo sapiens
gacactataatcttgataaatcacttaatgtttcagagagactcgatttcctcacttacaaaattgggataataataattcctcatagggctgctatgaaktttaaatgtttcttgtgtttggtaacacattccaagatcaatagttacacaatataatcttattcagatggcagtgattgaaaaagcctttgacagttat

SEQ ID NO: 42449 - DNA, 201 bp, Homo sapiens
acactataatcttgataaatcacttaatgtttcagagagactcgatttcctcacttacaaaattgggataataataattcctcatagggctgctatgaagyttaaatgtttcttgtgtttggtaacacattccaagatcaatagttacacaatataatcttattcagatggcagtgattgaaaaagcctttgacagttatt

SEQ ID NO: 42450 - DNA, 201 bp, Homo sapiens
tatatccagaagataaatatattatatttaaatatataatatataatgtacatacataattttatgtagataaaacatacgtatatgtttgtagatatagwtatataaaatatacaaagacagaagctaaccacttgggaatgggcaagtgacttaaatatactaataacaaatgacaaaacccaaatatctaatgaacat

SEQ ID NO: 42451 - DNA, 201 bp, Homo sapiens
taatcttgataaatcacttaatgtttcagagagactcgatttcctcacttacaaaattgggataataataattcctcatagggctgctatgaagtttaaakgtttcttgtgtttggtaacacattccaagatcaatagttacacaatataatcttattcagatggcagtgattgaaaaagcctttgacagttatttctatc

SEQ ID NO: 42452 - DNA, 201 bp, Homo sapiens
tctttataaacttttcatacgtgcatcatctgtatccatatctgtactatacttcagggaacctatccaaaggaaataatataaagtgataaactttttatttttttttgagatggagtctcgctctgtcatccaggctggagtgcagtggcacgatctcggctcactgcaacctctgcctttggggttcaaacgattctt

SEQ ID NO: 42453 - DNA, 201 bp, Homo sapiens
atcagaagtaaaatgttcacatttctgtcgtcttaaaataataactatctgttaaggtttagtactagattgtatatatgttacttttcaaaaaagaaacrtgaaaaatctttttaattgtgcaaatatctttaaagaggtaactattctaatttctactttctaaaccttaagtaattttttaaatgacaaataaaattg

SEQ ID NO: 42454 - DNA, 201 bp, Homo sapiens
cctcaggggaaaatggaactgagcaacaggagaacagaaaaaaatcagagaaaaacttttgcttctgaagctgcttctaagtccttcattttggcgtatattttttttttctgagccccaacaggataactatagaattatttaaaataatagaaaaattgggatgattaaacaaatggttgcctgccacatgaaaagagt

SEQ ID NO: 42455 - DNA, 201 bp, Homo sapiens
ttaagtatttgctagctcctttctttctctcaggagtaactcaagggcttgcaatgcgtgaacgagtgctcttaaagtaatagggaaagggtactgaaccaaaaaaaaaaaatagttctacctttaaggtgcagtgatgtgaagttgaaataccactgtggctcagagaagttttatgcaagaaggttctcaaaagatatt

SEQ ID NO: 42456 - DNA, 201 bp, Homo sapiens
tttattagttggaatattaacgcaatttattgttaataaataaatttattgagaacacattatgttctagacatcaggtcacttatttaatataaatcacrtaatttaacaccacaaccatagttttctgtgtcaagcagtctatcaaaaactttgattagatctaagccagagctgtgtagcaaggagtgcaatcatggt

SEQ ID NO: 42457 - DNA, 201 bp, Homo sapiens
tttagatgttaatttttggttttacaatgtccattcattcttttaccaaacatgattgagcacaacttgtgtgttaaggcctgtgcgaggcacttatttcwtctgaattttgtccatttacatataagcttctcatggagtctgaggtgcagccgcattctttttctttttttttttcttttttgcttgagatcacagaat

SEQ ID NO: 42458 - DNA, 201 bp, Homo sapiens
aaaacccacaggaaaaacctcataatgttttaagaaagtttacaaatttgtgttgaactacaccacattcaaagctgtcctgggccacagggctgcaggtyggagaagtctgacctaaagtgtcttatttaaacatcttatgtgaatgtattcataagttgttctctaaaataacattaggcaaagtgttgttacttttat

SEQ ID NO: 42459 - DNA, 201 bp, Homo sapiens
tgaaatcttctgatttgtaaaatttctgaatagtgtgaattatttattaaaattctaaataagaatgcctcattatttgttgttttataattctcaaactygaaaaacattatcaaaatgccagggtatgctgattgatagtgtgttacactcaaattggactaagagagtttgatcggcgcaggagctgcattctttgaa

SEQ ID NO: 42460 - DNA, 201 bp, Homo sapiens
tattaaaattctaaataagaatgcctcattatttgttgttttataattctcaaacttgaaaaacattatcaaaatgccagggtatgctgattgatagtgtrttacactcaaattggactaagagagtttgatcggcgcaggagctgcattctttgaatattgactatggaccaggcactgagctatgcattttatatactt

SEQ ID NO: 42461 - DNA, 201 bp, Homo sapiens
cgtgagccactgcacccggcctcttttgactttctgctcaaactgtccccttacttatagttgaagaagacaagaattgcattttccaagccatgattgtycctagtacctagtagtagtagtagatgagtgatgttcacaagctatattaatgtgtaaaataagtaagcatcatgactgcctgagagtaaactgggaata

SEQ ID NO: 42462 - DNA, 201 bp, Homo sapiens
tctagcaggctatttgaagagctattagtgtattttgaccctggaagaaaagaatacattttgtgctttagtgaaatatttattttatgtggttgataaayacttatagaatatttactcagtaccagttactgttttagaaactttatacatcatttaattctcataaccattctgtgagataggtgttattattatccc

SEQ ID NO: 42463 - DNA, 201 bp, Homo sapiens
tttactcagtaccagttactgttttagaaactttatacatcatttaattctcataaccattctgtgagataggtgttattattatcccaggcttttagatkagaaaatgggcacagaggttaaataacttgtaaaagttcaccaagttgtctggtccagaacttaaaacttcaggctattttgcctctcagtgctgcattc

SEQ ID NO: 42464 - DNA, 201 bp, Homo sapiens
atagaaagaaaatagctgcttttgccctgagtcttagacgccaagttgatatcagtaatttagggccattatcaaacaaaaatggccctcactatggctastctgttgaacccagcatgtcttctcagttctacattttcagaggctgaactctattccaagggggtaattttgacttggtcattgtcacataatgtgggt

SEQ ID NO: 42465 - DNA, 201 bp, Homo sapiens
gctagtctgttgaacccagcatgtcttctcagttctacattttcagaggctgaactctattccaagggggtaattttgacttggtcattgtcacataatgygggtattaccgtacatgaccacacttcccagggataatggcacagctgggctgccaattgggcttaggagaatgacgtcgggtttattttgctcccagca

SEQ ID NO: 42466 - DNA, 201 bp, Homo sapiens
agttctacattttcagaggctgaactctattccaagggggtaattttgacttggtcattgtcacataatgtgggtattaccgtacatgaccacacttcccrgggataatggcacagctgggctgccaattgggcttaggagaatgacgtcgggtttattttgctcccagcaatcctaggaggacaaaacttgctttggttg

SEQ ID NO: 42467 - DNA, 201 bp, Homo sapiens
gagaccagccaggttaacagggtgaaaccctgtctctactaaaaatacaaaaattagctgggtgtggtggtggtcacctgtaatcccagctactcaggagsctgaggcaggagaattgcttgaatccgggaaggggagaggttgcagtaactccatcttaaaactccatcttaaaaaataaaaataggccgggtatggtgg

SEQ ID NO: 42468 - DNA, 201 bp, Homo sapiens
catacaagtttaaggcacagaataatcaagagatttattaatttgaacctaggatatattactaaaaacacagaaatttcttatattttctgttaaagcartctcagtccacatttattaaaatactcatctagcttggtttttgggctatatcctcatcaaacgatggtaataggaaatgaaccaaagtgacatctgtag

SEQ ID NO: 42469 - DNA, 201 bp, Homo sapiens
taaaatactcatctagcttggtttttgggctatatcctcatcaaacgatggtaataggaaatgaaccaaagtgacatctgtagtctcagcaacttaaagtytgcttgcaatgattagttttcctttcccaaccctctgaaataaggtcttctcaagctttaggatgcgttcaacattaagtcttcagttaagacatcttgc

SEQ ID NO: 42470 - DNA, 201 bp, Homo sapiens
gttcaaaagaaagtggacaagaaaaagaaaaacagtcgttactatttttggcatggattttcagtggggcaaaaataacatgtctgattatttctctgctytgtatttagcacatccatcttttgatattgccccctaagtagttctacttttctttttattatttatgtttgctaatcaagctttcaaagccttgtggat

SEQ ID NO: 42471 - DNA, 201 bp, Homo sapiens
tttatagttataatcaatttgagtaacagctgagaaagtacaatagaaatcatatagttttacttttatcccatcaaagtcatgaaatattctgacagggmaatttcatctacttgcctcttcctataaatctttaaaaatctgttttaataataggctaatttccctaccacataaaccaaatatactctcagtggattt

SEQ ID NO: 42472 - DNA, 201 bp, Homo sapiens
taaaactaaaaatacttaatacttaacatacttaaaaacctttaaaaacttaaaactaatgatgaaaatattattttcattaattacccttatgttttacrcttgattaacaaattgcttcgaatctagaccatttttatatagcatctgaaagatacgtttttatttcctaacttgttttcttgccttctaaaacaggtc

SEQ ID NO: 42473 - DNA, 201 bp, Homo sapiens
tgtttccaaggatcttttggatgcttggtatgtttgttcgcttttatctttatagttttaagattatgtctgccctcttggtattttgtctgcatcccagwtgggaggagaacaaaggggaaaaagtcaaaggaatatattctagtgaatcttgactactaatggtggggggaaaaattcttccctggggaactgtgccta

SEQ ID NO: 42474 - DNA, 201 bp, Homo sapiens
ttagcatttgctttatgacatggtaaaaggattgaaagtttttggattggctagcagccaaaatttttatattttaatttttgagtagtttcttataaaartggataatcccaattttaactcacataattatgtatctaggagtccaaaaaatcagtcttgtcttaaagtcttgaaatacttaaaactacttgaaatact

SEQ ID NO: 42475 - DNA, 201 bp, Homo sapiens
tgtaccagctattaaactaagcataaaagccatcatgattaaaacagtatagtactgacacaaaaataatcaaatagatctatggaaaacagtacagaacrtataatcagatccatttggaataggaattttaggtagcattttggataattctagaaaaataatatatttgttttggcaattggctgtctattttggaag

SEQ ID NO: 42476 - DNA, 201 bp, Homo sapiens
gatacaaggaaacacatgaaattagtaccaccattcttttattccctgccatctgtgtcaacctaacaaaatacaagctccaggagtcacccatattcatkaatgaacttatcattatactatttcattctctgtatctctagatatttcctccctttgtttttcatctcccaacccttcccataattctccagaaccata

SEQ ID NO: 42477 - DNA, 201 bp, Homo sapiens
gaggaatccaccagctccagtttcccagaacttggcttttaatgagagggtttgtgagagtggccccataaaatctctagcatccatcgtattattttatkaggaaattcattcatgatatgctgcagtaatatacattcctttttttgtgttcttcacccatcatggtgccaacctgtagcagagctcatcatgggatac

SEQ ID NO: 42478 - DNA, 201 bp, Homo sapiens
acaagtgaaatagaggcatatagaggataagctgcttgaataaattgtatcatataaacacatcctcagaatacaatggaaacaccaaagaaaggtacctracccaaccctcttggctcagaaaaggcttcctagagcattctaggcaaaggaaagagcataacgaggagacatgggagagcatagtgtattctgagttct

SEQ ID NO: 42479 - DNA, 201 bp, Homo sapiens
ttccagcagagctctggtcattgattacagactcacctggcttaacttgaaaaatgatttttcccaagcctcctgtctgagaggcctaattcagtccttgyagatataaaattattactgcccctttagccatgaatgccaacattattggtgataatctttggttagtatgttagtatatgtcagaataacaatactgtg

SEQ ID NO: 42480 - DNA, 201 bp, Homo sapiens
gttataagacaaaataaaattaaataatggtgttaataaactagagctgttattgtaattgtattatgctgcagtggtgaattgactctgctatttttgtrgctatgcacatagaatagatactatttagttggcatgaattaactggccgttcattggaataatttttttccaggactagcatacatcaagcagatactc

SEQ ID NO: 42481 - DNA, 201 bp, Homo sapiens
ttaggttactattactaacatcatttcttctaggtctttcataatttatttttacttttattctattgaagactttgttatgttattgtaaatcttttttyggacaaagggtaaagacaaagttagaaaataaaataattaaaaagacctttttttaaaaaaatgaataatgtacattttcttaaaatgtactattcataa

SEQ ID NO: 42482 - DNA, 201 bp, Homo sapiens
atttcagttagctattagcatgctaagaaaacttgggtaattccacccacttcacattaatttgctcttgttgattatttgctgtaatgtgttaaataatkgctcttgaatcggtcatgaaaagcagtcatttacccgtttgattgctataaatatctatgaagtcatccaaatgtgcttccatattattcagaactcttc

SEQ ID NO: 42483 - DNA, 201 bp, Homo sapiens
actttatttttgataataacatttgaaaatcattgaaatgctattcattgcttttggaaggtcaccactcaaatcaaatggtcaacattctatcatctgartaagtcactccttagaagaattttaaatgcctttgaggtgcattatgtatttcaggttcatgattcatctgctttggggaaaagtattatttcctggcac

SEQ ID NO: 42484 - DNA, 201 bp, Homo sapiens
caggttcatgattcatctgctttggggaaaagtattatttcctggcacgtgttcaaatgctgtaatttaagacatttatagtaaattattataccactgcygcaaatgcaattgatatgaccccaggagttatgcctggggaatagttgactcatctagttggatctggctgattgttctttagcaagctagagaaaaaga

SEQ ID NO: 42485 - DNA, 201 bp, Homo sapiens
agtaaaggaattggtgagaaatgcattcaatataggaactttacttcttatactgagaaagattttaatcatatatggaagtagctcagatgaagggaagmaatggaaggctaatcaggactttacttgacagaaaaaaaattgttgagtttctaatacacgaatattcttgcaaatgatccagaagagaaagtgcagaat

SEQ ID NO: 42486 - DNA, 201 bp, Homo sapiens
aagattgcaagagggattttgctaagctaaaaacccttgcagagaacgcctagaatggcattgcttagatttaagctttttcttggaaatgtgagaagtgrcgcagctgacagtcttgtcttgttcttccagtggtggaaggtgataatgagccatcagggtccaaagggtaggctgttagggaagagaaacattgtgcct

SEQ ID NO: 42487 - DNA, 201 bp, Homo sapiens
gataccttgatgatactactccatcattaaatatcagtttcctcataaatgaaatatactattagtatctatattataaagttgttttgacaatgaaatgmaataatttgtgtaagattgtaagatgcttaacatatacactgggagctaataagtcctcaagaaatgttgtattattatttttagtatcattgtcaggta

SEQ ID NO: 42488 - DNA, 201 bp, Homo sapiens
ccccctccccccaccccaaaacagtccccagagtgtgatgttcccctttctgtgtccatgtgttctcattgttcagttcccacctatgagtgagaacatgyggtgtttggttttttgtccttgcgatagtttactgagaatgacgatttccaatttcatccatgtccctacaaagggcatgaactcatcattttttatggc

SEQ ID NO: 42489 - DNA, 201 bp, Homo sapiens
agggcctcaggctgcccccacttgtggaggaaggtgaaggggagcaggcatcacatggtttcagaaagggagagagatgccagcctctttttaacaatccrttctcaaaggaactaatagagcaagagctcagtctttactttgagaagggcaccaggccattcatgaaggttctgcccccatgactcaacacctcccaca

SEQ ID NO: 42490 - DNA, 201 bp, Homo sapiens
ctcattacttacaaatcaacctgttaacatgcattaaatctttgctcccacctttgaattatacttcaaagtaaatggtacacagcttacagaatttctcrtactttcaaaactggaattactgttatttcttaaatcagcttgtctatatgtccagcatatcaagtaactcaaattggaatggctatgcacacatattaa

SEQ ID NO: 42491 - DNA, 201 bp, Homo sapiens
cttcatctagtctatggttgaagcttttaaatgtattttgtaattcattcaatgattctccatttataggatttctgtttgatacttttctacgttatctrtcactttgttacatttctcattcttatcctgaattgtttttctgattcctttgttttgtttttttagaattctcttatatctcactgaaattatttagaa

SEQ ID NO: 42492 - DNA, 201 bp, Homo sapiens
atcacttccccaatgaaatttgaataccacagatatttaagtacataacatatctgttaatgtactttatgtacattatatgtgctttatacattaaaaaagtaagttttttttccccaagaaccagttttcagcctcttgggggtgatatcactcctgttgagcatttatgggctttatttaatagagaatattctagaa

SEQ ID NO: 42493 - DNA, 201 bp, Homo sapiens
tatggttgaagcttttaaatgtattttgtaattcattcaatgattctccatttataggatttctgtttgatacttttctacgttatctatcactttgttamatttctcattcttatcctgaattgtttttctgattcctttgttttgtttttttagaattctcttatatctcactgaaattatttagaatcaataattgaa

SEQ ID NO: 42494 - DNA, 201 bp, Homo sapiens
tttttgggggttggtcgtagggacactgggcttttcccatttctttgaatgccaatgaattgactgtatcctaatcccatcattgtctatacaccaattcrtaatgatgtcatgataatcacatcgatctaaaaggcgtaggagagcagcatagcttttattctatttatttttttacttttatttttgacacagggtctc

SEQ ID NO: 42495 - DNA, 201 bp, Homo sapiens
ttccatgtacctcaagacttatcagtcacccttctccaagcaagttttgcacttgcttccttttctgtccaggctgcatgcttgcaaactgaaagaggaarcaaattttatctctggttttgaggaaattttttttgggggttggtcgtagggacactgggcttttcccatttctttgaatgccaatgaattgactgtatc

SEQ ID NO: 42496 - DNA, 201 bp, Homo sapiens
gagggggtaaggaaaactattaacaactatacaataatgcctcctctcattatatttgtatgtggccatttaaagtagttaaataaattcccagatacttyagataattcatctatttacttaggtcaaatgactctcaaggtcaaggcttaaaattaaacctgaaatgtaaaagtaaacaactgtttactttttacagaa

SEQ ID NO: 42497 - DNA, 201 bp, Homo sapiens
gggaggtacgagactgaggaagagttcatataggacttcagtgttatctacaatgctttatcctttaaaaattagagcaaaatccaatgggaaaaaaagtkcatgttattattgaggtagatagattattttctatattttatgatctctacttttcttaaacatttataataaaaaatacatattgaataggagaagtag

SEQ ID NO: 42498 - DNA, 201 bp, Homo sapiens
ggaggggggagggatagcattaggagatatacctaatgctaaatgacaagttaatgggtgcagcacaccagcatggcacatgtatacatatgtaactaacytgcacattgtgcacatgtaccctaaaatttaaagtataataataataaaataaaataaaataaagaaactatctgaatgcaagagaacactcttataatt

SEQ ID NO: 42499 - DNA, 201 bp, Homo sapiens
gtgtatcaaatacataacagtgattaactttagagagggaggtacgagactgaggaagagttcatataggacttcagtgttatctacaatgctttatcctktaaaaattagagcaaaatccaatgggaaaaaaagtgcatgttattattgaggtagatagattattttctatattttatgatctctacttttcttaaacat

SEQ ID NO: 42500 - DNA, 201 bp, Homo sapiens
gaagaacaaaataacaatatgtggcacctgggttatgttgccaggaatccccctctaggtttattgaagaaacttgtgcacatattcataaggaaaacccsgtacaagtatgatcattatagagttttttttttccatcaatggggaaatgagcaaatagcagcaaacacagtagttaagacaaatgagctagtttcatat

SEQ ID NO: 42501 - DNA, 201 bp, Homo sapiens
agtagttatcaggctaaaataataggttataagatagtatttgcaagcctcatggaagcctcaaaccaaaaatatacaatggatacaatcagaaaataaamaaaacaagaaactaaacattaccagagaaaacaccttcattcaaagggagacatgaagggaagaaagaaggaagagaagaccacaaaacaaccagaaaac

SEQ ID NO: 42502 - DNA, 201 bp, Homo sapiens
gtagaagaaactataaataaagattagagcagaaataaatgaaattgaaatgaaaacaatataaaagatcaatgaaacaaaaagttggtgttttaaaaagytaaacaaaattgacaaacctttaggcagagtaagaaaaaggagagaagatccaaataaataaaatcacatatgaaaaagggggacatacaactgatacca

SEQ ID NO: 42503 - DNA, 201 bp, Homo sapiens
ttagttattcattcaattatttatttatatcactatgaactcatggatatttattgtagtctatggagtttaaccttatttcactgaccaaattgtccaayctttgatatagaaagttttttttgtgtttttttggtattgaaagtttttttctttttttaaattttacttttttcctatttcatgattattattacagat

SEQ ID NO: 42504 - DNA, 201 bp, Homo sapiens
gcagtgcagattgagggcagagtccagtgcatatacagagtgttatgcagcaaaacatacaaattgttgaatgtaaccctgcaaaattaattacagtgttrgaactggaacattcaagggaaatgttcctctctgctctgaaatttagaaaaaaaaaaaagaatgaaaaacgaatgaagtcttcttgccttgactcttaag

SEQ ID NO: 42505 - DNA, 201 bp, Homo sapiens
ctgaaatttagaaaaaaaaaaaagaatgaaaaacgaatgaagtcttcttgccttgactcttaagaccaagaatttttttctctgaaatacaaatcagcttmcattatcttactttatctattctgcttacctttatctcagaaggaaaacaaggtaaacttgactaaataagtgctgacaagatccactttatagtgatta

SEQ ID NO: 42506 - DNA, 201 bp, Homo sapiens
aaaaagaatgaaaaacgaatgaagtcttcttgccttgactcttaagaccaagaatttttttctctgaaatacaaatcagcttacattatcttactttatcyattctgcttacctttatctcagaaggaaaacaaggtaaacttgactaaataagtgctgacaagatccactttatagtgattacataaatgtattctgcag

SEQ ID NO: 42507 - DNA, 201 bp, Homo sapiens
gtttttatgaaaaatgccaaaggattttttaaagaggagattcggccttatgtgaattttcttaacctctagtatattcaatctattgataaaaagaaagrcttactttggaacctaggtttggttgtcaggtctggcactgagtgaaatataatcttatttatgttatttggtgagctattagcactctataatgttgta

SEQ ID NO: 42508 - DNA, 201 bp, Homo sapiens
  misc_feature (1)...(201): n = A,T,C or G, or insertion/deletion polymorphism (see Tables 1-2)
tagaagtagttattgtctaatgagttcagttttacaggctcatttactaccacatagcatgtgccaccctgtagaaaactatctagagtgaaaatttatanttttgagaaataattatttgaatacagtatacattttatatattgggaattctcatggctgcctttgccatactgcacactcttcataattctcaagagt

SEQ ID NO: 42509 - DNA, 201 bp, Homo sapiens
tttcctactctctgtaggagggtagaagcctattcagtaagtaccatttagcaaacacagatggtctaatgacattgaccatctccactaatgtcctccartacttttctactagctcaccccagtgcttaaaaactctccttcacttcgcttcagcagagttgagttccatctctgcctccattgcagcagtattgaata

SEQ ID NO: 42510 - DNA, 201 bp, Homo sapiens
aataaatcacatgcccttcacttaccttggtatgtgtaatttttgtcttctttgttgttttttaccacatcttcaacccagataccaggagcatctttgtkgtccacaatcagaattattctagatatttcagataacatttctgtatggtggtaatggtgccacaatgagaagacacaatgatattagatccagtgtgct

SEQ ID NO: 42511 - DNA, 201 bp, Homo sapiens
ctctccttcacttcgcttcagcagagttgagttccatctctgcctccattgcagcagtattgaataaaattttccttggctgtttaactcagtcagtgaarttattatttgacaactatgattggctttaggaaaagtcatggacttgcagagttttggctttggttgttgatgtaaatgtggaagcgatacttttttacc

SEQ ID NO: 42512 - DNA, 201 bp, Homo sapiens
ccttaggaataatttcgattctgctacactagtagtgtcttgacatcaatgatatttgccctagcagtaattttccagtgatgtgccaagtctcatatcastgtctcgtatcaacatcaatgctatgtacctttcacataaaaagtacaaagttagatggttaaaaataactaattactaatggtctttttcccattcata

SEQ ID NO: 42513 - DNA, 201 bp, Homo sapiens
cgcttcagcagagttgagttccatctctgcctccattgcagcagtattgaataaaattttccttggctgtttaactcagtcagtgaaattattatttgacmactatgattggctttaggaaaagtcatggacttgcagagttttggctttggttgttgatgtaaatgtggaagcgatacttttttacccatattctacatc

SEQ ID NO: 42514 - DNA, 201 bp, Homo sapiens
tttgccctagcagtaattttccagtgatgtgccaagtctcatatcactgtctcgtatcaacatcaatgctatgtacctttcacataaaaagtacaaagttrgatggttaaaaataactaattactaatggtctttttcccattcatatgtaatatttgagtttgtgattataaaggataagaatagttttttaaagtttct

SEQ ID NO: 42515 - DNA, 201 bp, Homo sapiens
ctcagtcagtgaaattattatttgacaactatgattggctttaggaaaagtcatggacttgcagagttttggctttggttgttgatgtaaatgtggaagcratacttttttacccatattctacatctttaagtaaaaatcagagatattgcaatgttaagtcattttactttgtaaaattctcatgttgtccctaaacat

SEQ ID NO: 42516 - DNA, 201 bp, Homo sapiens
gtgtctttatagcagcatgatttatagtcctttgggtatatacccagtaatgggatggctgggtcaaatggtatttgtagttctagatccctgaggaatcrccacactgacttccacaatggttgaactagtttacagtcccaccaacagtgtaaaattgttcctatttctccacatcctctccagcacctgttgtttcct

SEQ ID NO: 42517 - DNA, 201 bp, Homo sapiens
gagagaaaaaaactcaaagcaggttatcagattccgcaaatattccatgtagatctgattgctatactttgactttttttaaagtggatatggaaaagacytacgtaaagttaaggaatataatgagttggaagaattcacacatgaagaccatcccttttaaaagataaagcctgagagggaataacatctaatttcata

SEQ ID NO: 42518 - DNA, 201 bp, Homo sapiens
actatttacaatagcaaagatatgcaatcaacctcagtgtccatcaatagatgaatggataaagaaaatgtagtatatatacacacacacacacacacacmtatgtgtgtatatatatacacatacacacacacacatatgtgtgtatatatatacacatacatatatatacaaaacctaggcattaccattcaggacata

SEQ ID NO: 42519 - DNA, 201 bp, Homo sapiens
cactatttacaatagcaaagatatgcaatcaacctcagtgtccatcaatagatgaatggataaagaaaatgtagtatatatacacacacacacacacacacatatgtgtgtatatatatacacatacacacacacacatatgtgtgtatatatatacacatacatatatatacaaaacctaggcattaccattcaggacat

SEQ ID NO: 42520 - DNA, 201 bp, Homo sapiens
cttgtatgtttattgcagcactatttacaatagcaaagatatgcaatcaacctcagtgtccatcaatagatgaatggataaagaaaatgtagtatatatayacacacacacacacacacatatgtgtgtatatatatacacatacacacacacacatatgtgtgtatatatatacacatacatatatatacaaaacctagg

SEQ ID NO: 42521 - DNA, 201 bp, Homo sapiens
acctacagccaatatcatactgaatgggcgaaaaccggaagcattccctttgaaaacgagcacaagacagggataccctctctcaccactcctattcaacrtagtgttggaagttctggccagggcaatcaggcaagagaaggaaataaagggtattcaattaggaaaagaggaagtcaaattgtctctgtttgcagatga

SEQ ID NO: 42522 - DNA, 201 bp, Homo sapiens
gataggaatttttgttccgctgatatatcctaagaataatgcttgacacatagtaggtactcagtacatttttgctgagtgaatgattatacctcaatgamctttttcagattatattcattggcaggtaaatgctggaagccattactattccccttccttctttgttttctgggagtgtagaaactcccaatttctaat

SEQ ID NO: 42523 - DNA, 201 bp, Homo sapiens
tggtaccattccttctgaaactattccaatcaatagaaaaagagggaatcctccctaactcattttatgaggccagcatcatcctgataccaaagcctggmagagacacaacaaacaaagagaattttaggccaatatccctgatgaacatcaatgcaaagatcctcaataaaataagggtgaaacaaatccagcagcaca

SEQ ID NO: 42524 - DNA, 201 bp, Homo sapiens
caggtattaagcctagtacccattagttattttccctaatcctcttcctcctcccatcctctactcttcagcaggcaccagtgtctattgtttccctctawgtgtccatctgtgttcctcatttagcttccacttataagtaagaacatgaagtatttggctttctgttccatgttagtttgctaagaataatggcctcca

SEQ ID NO: 42525 - DNA, 201 bp, Homo sapiens
tggtgccatctcagctcactgcaacctccaccgcccaggtttaagtgattctcatgcctcagcctcccaaatagctgggattacagacgtgcaccaccacmcccggttaatttttgtgttattagtagagacgggttttgccatgttggccaggctggtctcaaacttctggcctcaagtgatccgcccacctcggcctcc

SEQ ID NO: 42526 - DNA, 201 bp, Homo sapiens
atttcatcagtgttttacagttttctttgcaaagaccttttacttcttcattaaatttattcttacgtgtgatatatatttttagctattgtaaatgttaytgctttcttgttttttattttcagattgatcactgttagtttgcagacacactattaatttttgtgtcttggttttgtatcctgaagctttgctaaattt

SEQ ID NO: 42527 - DNA, 201 bp, Homo sapiens
gagatactatctcacatcagtcagaatagctattattaaaaagttaagggccgggcgcggtggctcacgcctgtaatcccagcactttgggaggccgaggygggtggatcatgaggtcaggagatcgagaccatcctggctaacaaggtgaaaccccgtctctactaaaaaaaatacaaaaaattagccgggcgcggtggt

SEQ ID NO: 42528 - DNA, 201 bp, Homo sapiens
tatgtctatatggtgatttaacgaacaaaaatctttaacaaagagataagcatgatggaatacataaacaaaggtggtatgcaatctgactaaagtggtgytaaatggtgataaattctgttttcaaatatttttcatgctatttgttatcagctgtggacatttaatgcctcattagcaatagattgaatcagtacttta

SEQ ID NO: 42529 - DNA, 201 bp, Homo sapiens
aggcagagagagggtacctttggctttcctgtcatgcgtgattgatgctttccctttatcactctagctcatgtatcctagaatttttttctctcttgctrccacagtcataattaatgattaaggtacagtaactagcataacacctggctattaatttcaggaagtagattggggtgcatagcatttgacctcacagac

SEQ ID NO: 42530 - DNA, 201 bp, Homo sapiens
aatcctttggctcatccctgtcaagaaattaaaaatcttgaccatagcaatataattttgatgaaataaagaggagaaatataaattttatggaacacatrtgtgtttatgaattaagctggtttcattttattacttacctaaacattgctatctcatcaagagaatgcccaggtatgctatcaaatattgcactgaata

SEQ ID NO: 42531 - DNA, 201 bp, Homo sapiens
taacagctcaagtagaatctcctcagtgatgaggtcactgaagtcctggggttggtcctcactgttgggaatagaaactctttagtgttgatgcccctaawcaaatcaaccaggcttttaaagattgactcttgctaaacaaatttaccaacccttcaatatataattatatatacatataattttagaggaaagagtata

SEQ ID NO: 42532 - DNA, 201 bp, Homo sapiens
aaattggcatccttaaatatattatttacatatattccttaaatatatacatgtatatatttatgcatgtatgtttgtgtatgtatcacactgtctttaarttctcaatttacttaaagaaatgttttaatttctaaaaaatacacttgatgatgactttattctttttcattttgatgcctctactatctgtttcattta

SEQ ID NO: 42533 - DNA, 201 bp, Homo sapiens
cctggggttggtcctcactgttgggaatagaaactctttagtgttgatgcccctaaacaaatcaaccaggcttttaaagattgactcttgctaaacaaatytaccaacccttcaatatataattatatatacatataattttagaggaaagagtataaaggcttggatcttcaccttctggataaaatatatattgcaata

SEQ ID NO: 42534 - DNA, 201 bp, Homo sapiens
ctgaattttggtagctttatgggtgtcttgcaaatttgtctttcagtaatgcccctagtccatctaagtaacagggagagtcttatgtaatgcaggcaccktttatctttgcaataaaaaatcttaactatttaaatgatgtggccacttttgaatatattttgtgttttatgaagcattttgtttcagttttgcaagaaa

SEQ ID NO: 42535 - DNA, 201 bp, Homo sapiens
gttatttgtgtttcattttttattgtgaaaaattaaatgcacagaaatgtttaatcactagtacaatacagactcatattcccattacctagaaataacartttaaccatagttccagagccatatttgggtttttcttaaactacatcaaagtaatttgaaacatcatagcattttatatctaaatatttcagcaggaat

SEQ ID NO: 42536 - DNA, 201 bp, Homo sapiens
agtacaatacagactcatattcccattacctagaaataacagtttaaccatagttccagagccatatttgggtttttcttaaactacatcaaagtaatttraaacatcatagcattttatatctaaatatttcagcaggaatatcccaaaataatgaacattctcttatataaccacaatatgatcacaacactgaacaaa

SEQ ID NO: 42537 - DNA, 201 bp, Homo sapiens
gcatctgccaggttgcataaaaatcttgcacctgttttagttcaagtaacgttttttaaagaaaatccttcagatgagtttcattttatagggatgaggtmttgctatgaatttcttcaaaatttatatttatatccacataagtatgaaaaaaaatatactgtttcttccaccccttcatccatttatctatccatctat

SEQ ID NO: 42538 - DNA, 201 bp, Homo sapiens
aatagagttctgagattcactgcagagagtaaagaactgaatctatttgtgtaagtaatggttgacagttaacatcactttactcaaaaagtgtgttcttrcatatcatttgatgtccaaaacagcctgtcaggtaaagatcatggtatataatttaaagatttggaaacttaggttctaaacaatgtgactattctttgg

SEQ ID NO: 42539 - DNA, 201 bp, Homo sapiens
ttgggtgaatgaaaccaattccctgattttacaagcaagccattttaaacaccatgttcctagggtggaattatgtgtaggatatgatgagagtggagggmaagatcttctgctgttgctatgaggctttatatagataacgtcatgtttaagctggccaggttggtcttatttatatattgctgttatttcattgatatt

SEQ ID NO: 42540 - DNA, 201 bp, Homo sapiens
tgattacttacattttaataaaatatgtgtagcttttgcaagtaaatcagactcttaaaaagtatgtaatgggaaccatcccaatgtctatggggagaackaatgtattttgaatgccttggctgtttattttagtgatttcttaattatttattaagggacatgaaactgagacatatatgtattattgatagggtagag

SEQ ID NO: 42541 - DNA, 201 bp, Homo sapiens
aaaaaaggatgtatctttaggagaaagggcccttcttggaaataacatattcctatctaattcctgcacggtttccttttttctcctgcgggccagctgakttattcaaagaccttagtgctttcctaggaggcttgtgaagtaattgagaatttggtaggaaagaaagtgattctcaacttcttactatagtaaatgcat

SEQ ID NO: 42542 - DNA, 201 bp, Homo sapiens
tttatctttggtttgaatgtaatatgacagtgaaacctgttatttgtattcaatttttaaagaaacgcttttagattttaaaagtcaggcttctctatgtkctcaaatgaatctgacttactttataagaagaagggcttggcattctgatggagtcctggaaatagattcttggagacacagctatgtattggtcttcct

SEQ ID NO: 42543 - DNA, 201 bp, Homo sapiens
aatagatgaaaaaaagcaatatggttgaaggtaaaatactgttccaggtttcaaaatttagccaattaatggaaaatatgggagagtcaattttgtgtcartagagttttaaaaactaatcagagctattaaaatgtaatagctttgattttcaagtaggtcataggaccagtttttctgtacaaaccaaataaattagat

SEQ ID NO: 42544 - DNA, 201 bp, Homo sapiens
ctcaacatcactaattgtcaaggaaatgcaaattaaaaccacaatgtataccaccttacccgagccagaataaccattattaaaaagtcaaaaaaaaaaaatccccaaaagatgctcgggtggacgtggtgaaagaggaacacttatatgctgctggtggaaatacacattagtacaacctctatggaaaagagtatggag

SEQ ID NO: 42545 - DNA, 201 bp, Homo sapiens
ggttttggcaggaggagttgaggcagaatggacatagggatatctgttttttacatagaaagttttaagattatagctggaagggaccttagactagttgtactcaaagtttgacctatggtccagttctggtcagtccattacaatgacccaagttgataggaagattttaaaatcttttgtattagtctattctcacac

SEQ ID NO: 42546 - DNA, 201 bp, Homo sapiens
atcacgaggtcaggagattgagaccatcctggctaacacagtgaaaccccatctctactaaaacaaacaaacaaacaaaaaaacaaaaaacaaaaaaaaaacattagtcgggcatggtggcatgtgcttgtagtcccagctactcaggaggctaggctaaggcaggacaatcgcttgaacccgggaggtggaggttgcagt

SEQ ID NO: 42547 - DNA, 201 bp, Homo sapiens
tatgaacacagtgtcacttacaaaagctacaaaaagaataaaatacctaggaatacagcttactaaggaccttaaagaaccttgcaaagagaattacaaarcaatgctgagagaaatcagagacaatgcaaacacatggaaaaatattcttcctattccatggataggaagaatcagaattgttaaagtgaccatactgcc

SEQ ID NO: 42548 - DNA, 201 bp, Homo sapiens
gccctggcagacttcgcttcccaggttggtttcctttgtcattctgccccatgtatgtaaattgtcctgttatcagtttctctttgtttactattcctagkattccatgcgtttctgctaacatctgatttggtacaagcagaagaatgcaaagaagataccagagttgcagccagcattgctggatttgaactttggttc

SEQ ID NO: 42549 - DNA, 201 bp, Homo sapiens
aagacaacatgactctgcttagaaaaccccatagattctgccagaaggcttctagaactgataaatgaccttagtaaagtttcagagtataaaatctatgwgtaaaaatcagtagcatttctatacaccaataatgtccaagctcagaacgaaattatgaacacagtgtcacttacaaaagctacaaaaagaataaaatac

SEQ ID NO: 42550 - DNA, 201 bp, Homo sapiens
attgtcctgttatcagtttctctttgtttactattcctagtattccatgcgtttctgctaacatctgatttggtacaagcagaagaatgcaaagaagataycagagttgcagccagcattgctggatttgaactttggttctattgctccctagctttgtgacagcaggcaaaccccttacccttcttggactgcagtctc

SEQ ID NO: 42551 - DNA, 201 bp, Homo sapiens
actgcactccagcctgggcgaaagagcaagactccatctcaaaaaaaaaaaaaaaaaaaaaaaaaaatatatatatatatatatatatatacacacacacmtatatatacacacgtatatatatatacatatatatacgtatatatacacacatatatacgtatatatacacacatatatacgtatatatatacacatata

SEQ ID NO: 42552 - DNA, 201 bp, Homo sapiens
gatagcgccactgcactccagcctgggcgaaagagcaagactccatctcaaaaaaaaaaaaaaaaaaaaaaaaaaatatatatatatatatatatatatayacacacacatatatatacacacgtatatatatatacatatatatacgtatatatacacacatatatacgtatatatacacacatatatacgtatatatat

SEQ ID NO: 42553 - DNA, 201 bp, Homo sapiens
agatagcgccactgcactccagcctgggcgaaagagcaagactccatctcaaaaaaaaaaaaaaaaaaaaaaaaaaatatatatatatatatatatatatwcacacacacatatatatacacacgtatatatatatacatatatatacgtatatatacacacatatatacgtatatatacacacatatatacgtatatata

SEQ ID NO: 42554 - DNA, 201 bp, Homo sapiens
ggtggagcttacagtgaaccgagatagcgccactgcactccagcctgggcgaaagagcaagactccatctcaaaaaaaaaaaaaaaaaaaaaaaaaaatatatatatatatatatatatatacacacacacatatatatacacacgtatatatatatacatatatatacgtatatatacacacatatatacgtatatatac

SEQ ID NO: 42555 - DNA, 201 bp, Homo sapiens
gtcttgaacttctggccccaagtcatcctccttcctaggtctcccaaagtactaggattatagatgtgagccaccacacccagactgattttattttttgkacgataagagggaagtgtgactctgaaagaaaactgaagaataattgtcttttgtagcaaacacacacatagtcagcacatatacacaagcagattggga

SEQ ID NO: 42556 - DNA, 201 bp, Homo sapiens
gaggtggagcttacagtgaaccgagatagcgccactgcactccagcctgggcgaaagagcaagactccatctcaaaaaaaaaaaaaaaaaaaaaaaaaaatatatatatatatatatatatatacacacacacatatatatacacacgtatatatatatacatatatatacgtatatatacacacatatatacgtatatat

SEQ ID NO: 42557 - DNA, 201 bp, Homo sapiens
actaggattatagatgtgagccaccacacccagactgattttattttttgtacgataagagggaagtgtgactctgaaagaaaactgaagaataattgtcytttgtagcaaacacacacatagtcagcacatatacacaagcagattgggaaagagaaagacagagagacacagacagagagagtgagagagacaaaaaaa

SEQ ID NO: 42558 - DNA, 201 bp, Homo sapiens
tatacatttgaagcagatacatagatgatccagatattacaggtaactggcaaggacttaaaaggtggactaaaaaaagtgaaggaaaagaaaattcgatwagagaagtgggacacatagaaaataatcaaacaggttgggcatggtggcttatgcctataatcccagcactttgggaggctaaggtggaaggatcacttg

SEQ ID NO: 42559 - DNA, 201 bp, Homo sapiens
tagcaaaaagccatctctactaaaaatacaaaaaattagctgggcttggtggtgcatgtctgtaatcccagctactcaagaggctgaagcatgagaatcamgtgaacctgggaggcagagattgcagtgcgctgagatcgtgcacagcactccaacctgagcaacagaatgagactgtgtctcaaaaaaataattaataaa

SEQ ID NO: 42560 - DNA, 201 bp, Homo sapiens
atagggacaaagtaattatctttgcagcattagataagggaaaaagtgaatacgagcaaatcatttttggtgggggagggttagtaactttttgcttagtrtatggtttattgctcaataaatattaaacatgcagtattaaattaaagtggttactgaattattccatttgtcataaaatgattctaatacgaacagaca

SEQ ID NO: 42561 - DNA, 201 bp, Homo sapiens
tgcttagtgtatggtttattgctcaataaatattaaacatgcagtattaaattaaagtggttactgaattattccatttgtcataaaatgattctaatacraacagacaaatatataaatatacacacatacttaaaaattgtttcacttctgtggtatatttctccatatagtttgctaagatttattatatgacatgct

SEQ ID NO: 42562 - DNA, 201 bp, Homo sapiens
gagtcttgcactgtcacccaggctggagtacagtggagtgatctcagctcactacaacctccacctcctgggttcaaataattctcctgcctcagcctccygagtagctgggattataggtgcctaccaccacgtccagctaatcttttgtatttttagtaaagacggggtttcactatgttggccaggctggtcttgaac

SEQ ID NO: 42563 - DNA, 201 bp, Homo sapiens
aatgatgaaacagagactcaaaggagttgcccaaggccatacagcatgtgtatggtcaacgtgggatttgaaactgtgtctcccgatatgtgtcaaatacsctttttttctaggaaaaaataaatacatacagtttatcaggtgtcagagggaaccatggtgccttgaatttcttacctcatgtcataggatcatgggcat

SEQ ID NO: 42564 - DNA, 201 bp, Homo sapiens
aaacctgggaactatggagatctttttttttctgctttgaggagaatattaacccatttttgctgattttagtaacttcacagagaagttttttaaaaaawttcatatggatgggggtctcactatattgcccaggctggtctcaaatcctggtctcaagtgatcctccagccttggcttcccaaagtattaaggctgtag

SEQ ID NO: 42565 - DNA, 201 bp, Homo sapiens
cctcatgtcataggatcatgggcattgctctgttttcgggatgtcacatgtctactgaggctttatgggacttgctatgtaggaccataagtgttggtggyatatggaagctgtggaaattatatggctcttttataactccaaggagggtctgggcagttacatgcattttctttattgaaagttcttcttgcctcatat

SEQ ID NO: 42566 - DNA, 201 bp, Homo sapiens
ggagggtctgggcagttacatgcattttctttattgaaagttcttcttgcctcatataacttttttctcctcagaactagcttaaaggtacctgcaaataygtacatataaatttcctagagaattcatctgtccctctgactgaaaagaagttaccacatctaatgtatgtgaagtaaaagtgagattgaaattactgtc

SEQ ID NO: 42567 - DNA, 201 bp, Homo sapiens
gagggtctgggcagttacatgcattttctttattgaaagttcttcttgcctcatataacttttttctcctcagaactagcttaaaggtacctgcaaatatktacatataaatttcctagagaattcatctgtccctctgactgaaaagaagttaccacatctaatgtatgtgaagtaaaagtgagattgaaattactgtca

SEQ ID NO: 42568 - DNA, 201 bp, Homo sapiens
ggaggtggagcttacagtgaaccgagatagcgccactgcactccagcctgggcgaaagagcaagactccatctcaaaaaaaaaaaaaaaaaaaaaaaaaaatatatatatatatatatatatatacacacacacatatatatacacacgtatatatatatacatatatatacgtatatatacacacatatatacgtatata

SEQ ID NO: 42569 - DNA, 201 bp, Homo sapiens
gggaggtggagcttacagtgaaccgagatagcgccactgcactccagcctgggcgaaagagcaagactccatctcaaaaaaaaaaaaaaaaaaaaaaaaaaatatatatatatatatatatatatacacacacacatatatatacacacgtatatatatatacatatatatacgtatatatacacacatatatacgtatat

SEQ ID NO: 42570 - DNA, 201 bp, Homo sapiens
tagtcccagctacttgggaggctgaggcaggagaatggcgagaacccgggaggtggagcttacagtgaaccgagatagcgccactgcactccagcctgggsgaaagagcaagactccatctcaaaaaaaaaaaaaaaaaaaaaaaaaaatatatatatatatatatatatatacacacacacatatatatacacacgtata

SEQ ID NO: 42571 - DNA, 201 bp, Homo sapiens
agcctcaacctgcaagactcaattgatcctcctacctcagcctcccaaggagctgggctgacaggtgtgtcattaggctcagctagttttcatatttttttgtagagatggggtttcgccatgttgcccaggctgctgaagagtattcttggagcaatagggaattactacatatacctcaagaattaaataaacatagca

SEQ ID NO: 42572 - DNA, 201 bp, Homo sapiens
aattctcaaagtcttccatttccaatgtgcactctatctgaagtcagaagttaacataattataatatgctagatttgtatgattttaaacacagacacaygcaaaaactaatttgattcatttacttacagaaagccatatcttggaagatgtcaacaagtgtatcatagccttaagagaccaggatgctgataatttag

SEQ ID NO: 42573 - DNA, 201 bp, Homo sapiens
ctgcaagctccacctcccaggttcacgccattctcctgcctcagcctcctcagtagctgggattacaggcgcccgccaccacgcccggctaatttttttttgtattttttagtagagacgggtttcaccatgttagccaggatggtctcgatctcctgacctcgtgatccacctgcctcaacctcccaaagtgctgggatt

SEQ ID NO: 42574 - DNA, 201 bp, Homo sapiens
cctggagaatcatttttcatgttatgcatatggaatatgaaatttgatatgcacattgtttagccaaaagagtagaagggacaaagatgagtcattttttwaatttttcttttatatttgaagccactccttgaaatgaattaagagaaacaaaccaacagttgaataatattcactagagactaggtctgaagtgctatg

SEQ ID NO: 42575 - DNA, 201 bp, Homo sapiens
ctctgccctaagtgtctcaggcttgccccaagttctcctaattttggatgattaatggattcattgattcattgattcatggatacacacacgtgcacacwtacacacacaggagatttcaataataattgattcactgctgtatgtcaagtattcttctaggtatttgggggtattaaaataggcatttggtccctgctc

SEQ ID NO: 42576 - DNA, 201 bp, Homo sapiens
agataaattatgtcctatatcccaaatataatgaatataaaataatcctgggttattatgtataaacagcatcttattattagcgtaacggtatagtttaygatgtcccaattttgttattttagttactcagaaaaattttggtgtatctttgaaaaagctttccatttttgtttatgtctaattccaaactattctcca

SEQ ID NO: 42577 - DNA, 201 bp, Homo sapiens
cttgctagattggggaagttcttctggataatatcctgcagagtgttttccaacttggttccattctccccgtcactttcaggtacaccaatcagatgtasatttggtcttttcacatagtcccatatttcttggaggctttgttcgtttctttttgttcttttttctctaaacttcccttcttgcttcatttcattcatt

SEQ ID NO: 42578 - DNA, 201 bp, Homo sapiens
ctgccttgctagattggggaagttcttctggataatatcctgcagagtgttttccaacttggttccattctccccgtcactttcaggtacaccaatcagaygtagatttggtcttttcacatagtcccatatttcttggaggctttgttcgtttctttttgttcttttttctctaaacttcccttcttgcttcatttcatt

SEQ ID NO: 42579 - DNA, 201 bp, Homo sapiens
aaataaatccacatttatagattactaattatgacactaaacgtaatgtatgcttttcccaatttattgatttctatcagtggtgttatctttctcccagwgtaacgggcacataatttttaggtcaactttgattcatcttctcttatttcttaaatacaaaaaagtacctaatttggcagtttcttcttattctgtatg

SEQ ID NO: 42580 - DNA, 201 bp, Homo sapiens
gggctgaatttggatgttgaatttagccataagacaatttatactttgaagattagatttaagctttatttttcattatttaatatgctgaagataagagsagccaaaatgggaaatatgagaaatttagcttaaatgtataaactctcacaaacccagttcttacagctatgatagaagtcctattgtggatttactgca

SEQ ID NO: 42581 - DNA, 201 bp, Homo sapiens
aattcagaacatttgcaaagaagaatgttaggtaaatattgaggtcatccagatgtttccccacccaatttttatattttgtgttctaagtttgcctgccktaatgccccatatctacacgcagacacacagacacacacacactttcaaccaaaaagaatggctagagaaatattgaaatacaatgaatgtacttaattt

SEQ ID NO: 42582 - DNA, 201 bp, Homo sapiens
ttgcaccaattctataaaactctgcatgaatctagaacataacttgattctttatcagtaatgttaaatattctccctctcatctgcttatctgccaatgrggaatttgttttgtaatgaagctgtcctttcttattaaggattaagctagaatgcatcaactatttagaaacaaagatacatattagaatatgcacacaa

SEQ ID NO: 42583 - DNA, 201 bp, Homo sapiens
aggaatcacttctgtggaacatcctttctcttctgctaaaacattgctacaattcacaggtagccttcctattggcccttatattcattttttgatatgcmtgttaagggacaagggaagtgcagcctccactccagctaaagatgcagaacagagataagaagagccaaatggtatggagagaagcaggagagagaaaaa

SEQ ID NO: 42584 - DNA, 201 bp, Homo sapiens
cagaacagagataagaagagccaaatggtatggagagaagcaggagagagaaaaataaaaacccaggacagggggagttaacaataaaggaactctgataycacatctaaaaattactttgctgatgaaccaaacgtttctattttgtaaatagtgctgtcatcatgtagttcacatattggtgtagcaatatgcacctga

SEQ ID NO: 42585 - DNA, 201 bp, Homo sapiens
aaaatttttagtcatgataaaaataatttcttgcctttttttggtgatttatggcttacaatgtccttgacgcctgcctagaagataggcaggtgtagtcrtactaagtatcttcattttatgatcttagaaattgatatgtgtctaagaatcattagaaaacagcctagaactcagattttctggtttgtagatgctctg

SEQ ID NO: 42586 - DNA, 201 bp, Homo sapiens
ggcctgccttgctagattggggaagttcttctggataatatcctgcagagtgttttccaacttggttccattctccccgtcactttcaggtacaccaatcrgatgtagatttggtcttttcacatagtcccatatttcttggaggctttgttcgtttctttttgttcttttttctctaaacttcccttcttgcttcatttc

SEQ ID NO: 42587 - DNA, 201 bp, Homo sapiens
cgaggagtgtctttgtggtgtcctctgtatttcctgaatctgaatgttggcctgccttgctagattggggaagttcttctggataatatcctgcagagtgktttccaacttggttccattctccccgtcactttcaggtacaccaatcagatgtagatttggtcttttcacatagtcccatatttcttggaggctttgttc

SEQ ID NO: 42588 - DNA, 201 bp, Homo sapiens
ttggaaaagagttatcttacagctgggctggaactctccatgattacctggaggtctgacactgacttttggccacaataagaaggcttgaactagtttakatttataatacattgtttaagtttgaaatcaccttgttggtaccaagagtcagcttgtttacaatgtttaggggtgtgtagattgatggcttacgcatgg

SEQ ID NO: 42589 - DNA, 201 bp, Homo sapiens
ttgaaaatccttttctttaagaatgttgaatattggcccccactctcttctggcttgtagagtttctgccaagagatctgctgttagtctgatggtcttcyctttgtgggtaacccgacctttctctctggctgcccttaacattttttccttcatttcaactttggtgaatctgacaattatgtgtcttggagttgctct

SEQ ID NO: 42590 - DNA, 201 bp, Homo sapiens
gcacattctttcttctgctatgttgcatttcttacattgaataggtcttccttgagtagtttccatagaattttgcaaaccctttcaattatccaacaccrtctgtaactgttgtagttataactcatttattttattttaaaaacccactgaagatactagaacacacacacacaaagacacacacatacacatctacct

SEQ ID NO: 42591 - DNA, 201 bp, Homo sapiens
tgttagctggttattttgctcgttagttgatgcagtttcttcctagcctcgatggtgtttaaaatttggcatgcttttgcagtggctggtaccggttgttkctttccacgtttagtgcttccttcaggagctcttttagggcaggcctggtggtgacaaaatctctcagcatttgcttgtctgtaaagtattttatttctc

SEQ ID NO: 42592 - DNA, 201 bp, Homo sapiens
ctgcgtgtgagatgggtttcctgaatacagcacattgatgggtcttgactttatccagtttgccagtctgtgtcttttaattggagcatctagtccatttwcatttaaagttaatagtgttatgtgtgaatttgatcctatcattgtgatgttagctggttattttgctcgttagttgatgcagtttcttcctagcctcga

SEQ ID NO: 42593 - DNA, 201 bp, Homo sapiens
gctcagtaagcttttataattagaccatctcagttcatccaggctgctataacaaaatatcttagtctgggcaagttataaacaacagaaatttattgctsacagttctggagctggagaaattcaagatcaaggcaccagcagattcaatgtctggggaggatgcatccctcatagatgatgtgttctaagtggtggaaa

SEQ ID NO: 42594 - DNA, 201 bp, Homo sapiens
tgttgacagtggggtgttaaagtctctcattattattgtgtgggagtctaagtctcgttgtaggtcactcaggacttgctttatgaatctgggtgctcctrtattgggtgcatatatatttaggatagttagctcttcttgttgaattgatccctttaccattatgtaatggccttctttgtctcttttgatctttgttgg

SEQ ID NO: 42595 - DNA, 201 bp, Homo sapiens
aacctcctgggatcatgtgatcctcttgcctcagcctcctgagtagctgggactacaggcgcacaccaccatgcttggataattctttaatttttttttttaatagagacagagtttcactttattgcccaggctgatcttgaactcctgacctcaaatgatcctcctgcctgggcctcccaaagtgttgggattacaggc

SEQ ID NO: 42596 - DNA, 201 bp, Homo sapiens
atctatatatccatatatatatagatatatctgatatatatacacacataaatacacatatgtatatatacatatatatttctataataaaagtaataaargtggtaaaagattaaatttcttctaagaggaagattttcttgtttccttttttaaaagcagtgaatgaaatctgagattctccaggtatattttgtggat

SEQ ID NO: 42597 - DNA, 201 bp, Homo sapiens
ttttcctaggatttattcttctagactccaatacaatttccccaaatctccatttgtctaaggaaggtaagttttgctttctgatagatatctatatatcyatatatatatagatatatctgatatatatacacacataaatacacatatgtatatatacatatatatttctataataaaagtaataaaggtggtaaaaga

SEQ ID NO: 42598 - DNA, 201 bp, Homo sapiens
tacatacatatataatccatatattttgtgtatcagtgtttgtgtatataaatttttttcccaaagtttattggaggtttgtatgtgtgcgtgtgtatacygtgtgtttgcttttcctaggatttattcttctagactccaatacaatttccccaaatctccatttgtctaaggaaggtaagttttgctttctgatagata

SEQ ID NO: 42599 - DNA, 201 bp, Homo sapiens
ccatctatcctatctcctgacccttgcctcctgggtcctaatgcctgtcagacaaacttcctctcgcctctcttctctgaggctagtccacttctaaaaascactccctgtctctggtgcttttctagtttctcctataagaatgatttctagtataaacttcaggactcttttaccttctttaggcacccgggctcacca

SEQ ID NO: 42600 - DNA, 201 bp, Homo sapiens
ttcttttcttccttcctgtcttccttttagtgaaggcaattttcattagtggtgtgatgaatttattgctttttatgttttgtgtatctgttgtatatttygatttgaggttactatgaagcttgcaaatactatcttataatctattattttaaactaatgacaacttaaagttgatggcataaacaaacaaatgagaaa

SEQ ID NO: 42601 - DNA, 201 bp, Homo sapiens
aagcagaaccaaccaaatcatagggagaaatagataagttcaaactcatgatggaaaaatgagttttaatttttaattttttatagagatgggtcttgctwtgttgcacaggctggtcttgaactcctggatttaagtgatcctcctgcctcagcctcatgatagaatatttgagtacaatgctatcagaaattgaaagct

SEQ ID NO: 42602 - DNA, 201 bp, Homo sapiens
gtgagccccaaaattggggcttagtccagaagggttcttgactttgctcagaagataattcaagagtgagctagtggtgaaagaaagcctatttattgaaktgtcagtgtaccgcagaatgacagctccttgtggagcagcactaacccagagcctgagcatccacagtagcagcatgtggactattggctagcagtattt

SEQ ID NO: 42603 - DNA, 201 bp, Homo sapiens
tattgaagtgtcagtgtaccgcagaatgacagctccttgtggagcagcactaacccagagcctgagcatccacagtagcagcatgtggactattggctagyagtatttatacccacttttaattacatgcatgttaaggagtgggttactcagaactctctagaaaacggccagtaacttctgggtgttgctgggcatttg

SEQ ID NO: 42604 - DNA, 201 bp, Homo sapiens
ttgcatgatttaataaggcaatataaaaatccttttgacctagattatatatggttttggtggcaaatgaggctctttcctctcccaccagaagttagtargattctagaagaaaatttacatgtgggaatgggtagggggaaacaagcaaaacatcagattagtaaaaaatgaagtcaaagaaagagaagaaccgacaac

SEQ ID NO: 42605 - DNA, 201 bp, Homo sapiens
atggtaaccttctttcaaagcaataccccatccagcgacagtcctgtctttcttcttttcctcatgctaagtttctgaaagattttaggtgcgctgacctscttactaactacatccatttttggacagaagcgagggagtcgaatgtttcctggagctagttttgttaactggtgttctatttccattaagtatcagatg

SEQ ID NO: 42606 - DNA, 201 bp, Homo sapiens
agggttgacagagaggaaagccattcagctccggggtcccaacaacaagttggttgaccctgcggccatgagtggaactctcaaaatcatgtcacccaagygagacttgcccatctatcctatctcctgacccttgcctcctgggtcctaatgcctgtcagacaaacttcctctcgcctctcttctctgaggctagtccac

SEQ ID NO: 42607 - DNA, 201 bp, Homo sapiens
atagttcatcctaaactcacctggtaatttgaataactgtctctgttcactaattgcctttatccaaaggaactttttatatctttttgacagaagacaartttgtaacttggagccaggcacccaccaaagttaggctcctgccttcccacagaaactgggagatagggacactacgttctttgatgattatatttaaaa

SEQ ID NO: 42608 - DNA, 201 bp, Homo sapiens
gatctgatataaccaacccccatcttgcctttaacctccaaactgcccttaattattctgggccagggccaagctaactttgggagaaatttagtttatartttaaatgttaataacccttcccccaaactaaactgcctttgtaaagctaataaaagaccaccaggttacgaagagatgaggatcctgaattctgctaag

SEQ ID NO: 42609 - DNA, 201 bp, Homo sapiens
cttaagttacactgtataaacatttatctcctcttgagaggtgaagctggctaggcttcagggtcaggtggggacttggagaacttttctgaatagctaarggattgtaaatgcaccaatcagtgctctgtgtctagtctagctaaaggtttgtaaacgcaccaatcagcactctgcaaaaatgcaccaatcagcgctctg

SEQ ID NO: 42610 - DNA, 201 bp, Homo sapiens
gtaattgcacagaatgatcactctgcacctttcaccaatgtaaaagatgaagctcatttcccacagtgctaaaggtttacgtgccaagatctttattacckaatgtaaaatctgatgtgttttaaatttcattttgtaattcactgaactcaaaattttctgcttaattagacactaacaagtgatacgaaatgtgggatt

SEQ ID NO: 42611 - DNA, 201 bp, Homo sapiens
caaagagctataagcatagatttttgatagatagatttcctaaaaggacaatccaatcgctagtggacttttattatctatgtcttcttctggcttatgaytggtacaattctaattttctccctattttatttcttctgaaaaatgtccataaatacaaatgatatgttggaagatggtggagaattattttatttgtct

SEQ ID NO: 42612 - DNA, 201 bp, Homo sapiens
ggcgttataagtgcttcttattatttatttttcagctttattaaggtataattggcaaatattttttatatttacagtatataacatgatgtttgatataygtatacattgtaaaatacttactacaatcaagctaataaacatatacattacttcacatagttattattttcatgtgtgtgctgagaagttatgatttct

SEQ ID NO: 42613 - DNA, 201 bp, Homo sapiens
gagacgttggttaatggatacaaaattacagctagatgcaataaaggaggaataggttatagggttctatagcattgtggggtgactatagttaagaatawgtcaatgtatattttcaaatagctagaagaaaggattttaaatgttcctagcgcaaagaaatgataaatttttgaggtcataaatataattattctgatt

SEQ ID NO: 42614 - DNA, 201 bp, Homo sapiens
agaatgaagaagtaacctgtagaatgggagaaaatatttgcatactactcatttgacaagggattaatattaagaactcaaagaagtcaacagcaaaatayccaaataacctcatttttaaaatgagcaaaatatctgaatagacatttctcaaaataagacatacgagtggctaataagtatatttaaaaatgttcaata

SEQ ID NO: 42615 - DNA, 201 bp, Homo sapiens
agttctttgtagctttctcaagcttttataacaaatgtgtatatgcaagggtttatttctggggtctctaatctattccattggtctatgtgtctgtttttatgccagtaccatattgttttgattactatacctttgtgatataatttcaaaatcagggagtgtgatgcctctagatttgttcttcttgctgaaaattgc

SEQ ID NO: 42616 - DNA, 201 bp, Homo sapiens
aacaaaagaacaggagtaaattctcaacattcaataaaatctttggtaaatggtttaaattatcaaattaaaagttttgctgactgggctatatagatttwaaaaattgacctaactatatgctgcatacaagaagctcactttacctggaaatacacatgcagactgaaagtcaaagaatggaaaaagttattccttgtg

SEQ ID NO: 42617 - DNA, 201 bp, Homo sapiens
tttcttgattttactgataatccatttttgatctacttcataaaagtttgagtactcttaaaggcattggttgaagatccattgatacccaatgtttgacrgatgaggtacctgcagtcttgcaagatatagtgacacagctggtttgtaacaaaaagactgcaattcatgcctcctgtctcacacaataaagtgtgagaa

SEQ ID NO: 42618 - DNA, 201 bp, Homo sapiens
cattgaaattactgtcaaccacataagtagaactcactaaacctaaacttaatgcattcccaaatttacttcctctaagccagattctgtcaaaaacaacmccttctgtccaatttttgcatgatagatacatcaacattttaaaagctctgaaatattatataaaagattcaaaagataaacccaaatacaaacaagatt

SEQ ID NO: 42619 - DNA, 201 bp, Homo sapiens
ctggtacagcagatgcacaagtaagaaagagaaagaagtaaaatgatctcactacagaatacctccatactgcaatgttaaacaataagaggcagagaagraaacaaagggtttacaacacaaccagtaaacaattaacaaaagaacaggagtaaattctcaacattcaataaaatctttggtaaatggtttaaattatca

SEQ ID NO: 42620 - DNA, 201 bp, Homo sapiens
aaaactcactggtacagcagatgcacaagtaagaaagagaaagaagtaaaatgatctcactacagaatacctccatactgcaatgttaaacaataagaggmagagaagaaaacaaagggtttacaacacaaccagtaaacaattaacaaaagaacaggagtaaattctcaacattcaataaaatctttggtaaatggttta

SEQ ID NO: 42621 - DNA, 201 bp, Homo sapiens
gcattgtttatggcaactattttattttattttattttatatttttttgagatgaagtttaactcttgttgcccaggctggagtgcaatggcgcaatctcrgctcaccacaacctccacctcctgggttcaagcaattctcctgccttagcctcccaagtagcttggattacaggcatgtgccaccatgcccagctaattc

SEQ ID NO: 42622 - DNA, 201 bp, Homo sapiens
aaaaaaaaaactggatcctacaatttcttcttatcgaaaaacatgatgtattcttccaggcaatttggggctacctgagctgccacatctgtattccatascccagcagttcccgtgatgagcacccagttcagccacagagctgcgttggagcccagaaggcaggagagccccgtaccgcgcacacgctcagctcacttc

SEQ ID NO: 42623 - DNA, 201 bp, Homo sapiens
agtgaggtctaaagccttactatattatacaagggaaacagaacaacaaactgatatttatatagattagatttgctttcagtttacaggttatttctccmagctatatttatgttagtactccaaacaaagtgtttttattttctggaaaaaataccaaaactcttctagcatgtgacttaaacataactgcaaaatatc

SEQ ID NO: 42624 - DNA, 201 bp, Homo sapiens
atctgaaagagacatttagcaaagagatagatattgtttaaaaagatccaacctgaaatcttgaaattgaaaaattcaataagtgaaataaaaaatacaayagaaaaacttcaatagtagaactgaattaagcagaaaaaaaatttctgaaggtgaatagagaaattacccaatgagacaaaaaagaggagaaaagaaaag

SEQ ID NO: 42625 - DNA, 201 bp, Homo sapiens
aattctgtttttattttttgaggaaactccatactgttttccacaaaagctgtgtcattttacattctcattaacagtggacaaaggttccaggttctccrtatctttgctgacatttgagttgttgttgtatttttctataatagccatcctagcaggtgtgtggcgataactcataattttgatttgcatttcccttat

SEQ ID NO: 42626 - DNA, 201 bp, Homo sapiens
gaagggactgtcctacaagatcttaaatatcaatttaagaacaggaaaaacatgaaagagcaaagaaacatggcattttcaaagcaacatcataattctcyagtaacagacccaaatttaaaataatgatcttaagtaaactcagtgagacatgagaacacaaatagacaatccaagaaaaaataatagcttatgatctga

SEQ ID NO: 42627 - DNA, 201 bp, Homo sapiens
ccatgtagctgtgtggttttgagtgagtttcttaaccctgagttctaatttgattgcactgtggtctgagagacagtttgttgtgatttctgttcttttayatttgctgaggagtgttttacttccaatcatgtggtcagttttataataagtgcaatgtggtgctgagaagaatgtatattgtgttgatttggggtggag

SEQ ID NO: 42628 - DNA, 201 bp, Homo sapiens
gctatagatgatatctactattgttaagttccatttatattggaggcaactgagatatggaaagaacaaatacctggcccatgatcacaattttggcaacygctaaaaccggaaaaatgtttgtagtcttatgttactttatcttcaaaaaagttagacttgtgtcttgaagagtgagttggggttaaagtaattgggtta

SEQ ID NO: 42629 - DNA, 201 bp, Homo sapiens
cctctgtgggctctcctggagaccaaggaccaaccaacctggcatccctgtccccagtaaagctctgccacagatttcacaaataattgcagcctagaccrctgatgcactctcagacactgatgacattgattacagctttagaaatcatatggataatatacaacagtgcccacctagaaccttaaccaaagcactcta

SEQ ID NO: 42630 - DNA, 201 bp, Homo sapiens
aaactaagaaaattcatcaccacgagaccagccccacgtgaattgcataagagagcctgacacgtggatgtgaaaggatgatatctgccattatgaaaaamcacaaaagtataaaactcactggtacagcagatgcacaagtaagaaagagaaagaagtaaaatgatctcactacagaatacctccatactgcaatgttaa

SEQ ID NO: 42631 - DNA, 201 bp, Homo sapiens
ttctatatgaactttacagtagttttttccaattctgtgaagaaagtcattggtagcttggtgaggacgactttgaatctataaattaccttgggcagtayggccattttcatgatgtaaattcttcctatccatgagcatggaatgttcttccatttgtttgtgtcctgttttatttaattgagcagtggtttgtagttc

SEQ ID NO: 42632 - DNA, 201 bp, Homo sapiens
acttacgtgatcatcttgtcttaactcacacaactaaaactaccactattaatcattattgcaatcaagcattggttagatttacttaaagactatcacaygaaggcaattgccttcactatgtgaaggcatagtctttaagtgtatgtgagtgtatgtgtgtgtatgtgtgtgtacacgtgctattgaatccactcaaaa

SEQ ID NO: 42633 - DNA, 201 bp, Homo sapiens
catcaccatcagggaccctgcttcatccaaaatggggccatcacaagactgtgcacgctctccataaacttgaggactgtcccatgaggagcctgtcaccrccacaggcaatcttgacccctccacaggcaacgtgactgtgcacctctgtgggctctcctggagaccaaggaccaaccaacctggcatccctgtccccag

SEQ ID NO: 42634 - DNA, 201 bp, Homo sapiens
ttgatagttttctgtttaaaattctagagaataaaattctgattttttttccatgccatcttataggttgctatctggcttatgagttggctattctaggwaaaggtgatcaccctaagtttccagcagaagtgatggttaagggtagtgataaagttggtagagtcatattgtataagacttggcagatgctttaagcga

SEQ ID NO: 42635 - DNA, 201 bp, Homo sapiens
acacgtgtcaagcataaaaagtgtcttgcacatagtaactgttcactaaatatttgttatagctacttacgtgatcatcttgtcttaactcacacaactamaactaccactattaatcattattgcaatcaagcattggttagatttacttaaagactatcacacgaaggcaattgccttcactatgtgaaggcatagtct

SEQ ID NO: 42636 - DNA, 201 bp, Homo sapiens
cccgggaggcagaggttgcagtgagctgagattgcaccactgcactccagcctgggcgacagagcgagactctgtcaaaacaaaacaaaacaaaacaaaamaaaacaaatcatatttttgaaaggtataaggaaaactagcatctattgcctttaagattttctgtgggatttaggtctcaggggtaatgtggagagacac

SEQ ID NO: 42637 - DNA, 201 bp, Homo sapiens
cttaaataagactcccaaaacatagccataaagtaaaaaactgaaattattacattaatgcaaaaattaattaattaaaagactgaaaaaacaataaaaakaaacaaaaactaccagttgacagggtatgtttacattcatccatataaagtggattgcattgttgtttcccaatcctcttgctccctatatccatcccct

SEQ ID NO: 42638 - DNA, 201 bp, Homo sapiens
agtggtgcaatcatagttcactgcaaccttgaattcctgggctcaagtaatcctcctgcctcagcctcctgagtagctgggactacaggcatgtaccaccrtacccctttaattattttattttattttaattttttagtagagatgaggtctcactgttttgcccaggctggccttgaaacaatcctttcaaccttggtc

SEQ ID NO: 42639 - DNA, 201 bp, Homo sapiens
gtcaacctgggaggcagagtttgcagtgagccgagatcgtgccactgcactccagcctgggggacagagtgagactctgtctcaaaaaaaaaaaaaaaaaagaaggcaccctgccagtgggcaaggttttggtggtggattttgtgttagcaagattagacagagagcttgcttcaggtacatgtatttagactccactcc

SEQ ID NO: 42640 - DNA, 201 bp, Homo sapiens
aagccaagaggagctttccactgcagaaaaaagaaaagcaagagatcctcagtagtccacattcccacgatgaatactcacactcctactaacaggagagmttcacagccattgcaggagctgagtcaagtatagagagctgcctggagtccatgcaactgcattgtcccagaaagaaaattcacattgggtcctcttcac

SEQ ID NO: 42641 - DNA, 201 bp, Homo sapiens
catgaggtcaggagatcgagaccatcctgggtaacatggtgaaaccctgtctctactaaaaatacaaaaaattctccggccgtggtagcaggtgcctgtartcccagctactggggaggctgaggcaggagaatggcgtcaacctgggaggcagagtttgcagtgagccgagatcgtgccactgcactccagcctggggga

SEQ ID NO: 42642 - DNA, 201 bp, Homo sapiens
ctgctcaaagtcgaactagactgaaatcaaggcattggacagtgtctgattttgggggaagttattactctctttaggattaactctgaaaacctcaactstatgtaattagaacacactgtgggttgtatttcattagatattcttggatctgtatcttctgtttagactgggaaattaaatttctgtttagatggtgaa

SEQ ID NO: 42643 - DNA, 201 bp, Homo sapiens
cttaaattttaaaattatttttaaaatttgcacagaaaggtcctgggatttttatgtacattgcattgactctgttgattaacttaagagaactgaaatcyttacaatattgaactaaactgtattagttttctatagatgtatagcaagttaccacaaatttatcagcttaaaacaacataaatttattatctcatagat

SEQ ID NO: 42644 - DNA, 201 bp, Homo sapiens
tatatatatatatgtcaaatgccgaagctttccaaacactcaggcatttcagataatcctatttgcctgcagcactccatttcttggctccaatatccaaytctagctatgtacctagtacttcaccattttccagaacaggatccctatttcctggattccatgtatttattttcttagtttaccactcattttgttgaa

SEQ ID NO: 42645 - DNA, 201 bp, Homo sapiens
cttattaacccatcgagacttcctttccttttggctcttttattactgataatagtttgcccactttcttctagacatcaggattagtcaataccttagtmatcttggaattcttcctttgcattacctccctgcatctaatcagcaataaaatcgtgaagtttctatctcagtaccaaatgtcccaacctgttcatttcc

SEQ ID NO: 42646 - DNA, 201 bp, Homo sapiens
aagtaggagaatcgcttgaacccgggaggcagaggttgcagtgagctgagattgcaccactgcactccagcctgggcgacagagcgagactctgtcaaaamaaaacaaaacaaaacaaaacaaaacaaatcatatttttgaaaggtataaggaaaactagcatctattgcctttaagattttctgtgggatttaggtctca

SEQ ID NO: 42647 - DNA, 201 bp, Homo sapiens
agttcttagatcatcatcaagtataacatatttagctttagaagatacggcaagttccaaagttttatatatatgtttaatccaccagaagtgaaatagtrttgctttttaagttggtccacattttggccaacactcaatgatatcagtccttttaattttaactattctagtctatatgcagtgctggagcactgtaat

SEQ ID NO: 42648 - DNA, 201 bp, Homo sapiens
agcaaatgccacagatccttaataaaaataaaattaacttgtttattcaatgagtatttattaaactcttacactgttcttcgtgctggggatacagtagwgaataagacaaagtgccttccactggaggacttcttgcattcttgttgatgagatggtaaaaaataaaaatagctacacactgcaatgtcaactagtaat

SEQ ID NO: 42649 - DNA, 201 bp, Homo sapiens
catgtgctttaacacacatttaagtacattttcaattccacctgggagaagagttcttagatcatcatcaagtataacatatttagctttagaagatacgkcaagttccaaagttttatatatatgtttaatccaccagaagtgaaatagtattgctttttaagttggtccacattttggccaacactcaatgatatcagt

SEQ ID NO: 42650 - DNA, 201 bp, Homo sapiens
gttataatcaatttgagtaacagctgagaaagtacaatagaaatcatatagttttacttttatcccatcaaagtcatgaaatattctgacagggcaatttyatctacttgcctcttcctataaatctttaaaaatctgttttaataataggctaatttccctaccacataaaccaaatatactctcagtggatttggaatt

SEQ ID NO: 42651 - DNA, 201 bp, Homo sapiens
tggtagctgtagctgtggccattcccagttgaacagttcccttaagaatgttggggaatgcttaggatactcttgcaactaacagcagagcccccatgtgscaatattgtaactcgagcaaaaatttacttagtcccgggtagcaaatgccacagatccttaataaaaataaaattaacttgtttattcaatgagtattta

SEQ ID NO: 42652 - DNA, 201 bp, Homo sapiens
caggagtcctgctgtttagtagggggagacagattcttgttgaagaaccatacctgatttatgaccaaatatatatatttttggattatttatttggtaawcatgttgttgaagtgtaacatatgtaaaaagaagtgtaaaataaaaaatataaatgactttatataaagtgaaaacacccatgaaagcattcatggatta

SEQ ID NO: 42653 - DNA, 201 bp, Homo sapiens
aggtagtttttgaacagaaagttatgaaatgatttgcaaaattagcccccaaacaatagcaaatggatttccattcaaatgaactagacagaggcaacatytttgcatatggccttggagggcagtagagccaaaagatttgatgaaaatctaaatgcgagattgcataaagactaggtaaggaaacatttggactcaaca

SEQ ID NO: 42654 - DNA, 201 bp, Homo sapiens
aagttaatagttcaagcctatactcaagagaagggagttttgcatagttgtaaataataagaggaagggatctgtgggggccattttaaaattgagttacwacaccttgcaaaataacagttgattctcatgatacttttcacctgccttagggatgtaggtcaccatttaaggatttcctacttcatgttgtcagtctca

SEQ ID NO: 42655 - DNA, 201 bp, Homo sapiens
ctattgtaaatgttactgctttcttgttttttattttcagattgatcactgttagtttgcagacacactattaatttttgtgtcttggttttgtatcctgmagctttgctaaatttattgatctattccaagaattttttggtataataggcctttctaaatataaaatcacgctatatacaaacgaggataattagactt

SEQ ID NO: 42656 - DNA, 201 bp, Homo sapiens
tcgtgcttttgtttagaagacttcatagtcattttaatatggtgatgaatcagaaaatgaaattcctttatagttataatcaatttgagtaacagctgagraagtacaatagaaatcatatagttttacttttatcccatcaaagtcatgaaatattctgacagggcaatttcatctacttgcctcttcctataaatcttt

SEQ ID NO: 42657 - DNA, 201 bp, Homo sapiens
agaatcctgattgggagaagtgagagcccttaaaaataaaaagaaaacatggagaattgttaataaagttattaattatcattacaacatttgctggaaakgataagatagaagctgtttttcttttttttcaataaaatggattattattgcttatagaagttctgttgttagaaagtataattgtaaaatacattgtac

SEQ ID NO: 42658 - DNA, 201 bp, Homo sapiens
tactccaatcatgtttaatcctatactcactgcagactggatgttttcaacctaacaggtcctaattttcatattggccatagtgacttttttttttttttattttgagatggagttttgctcttgttgcccaggatggagtccaatggcgcgatcttggctcactgcaacctccgcctcctgggttcaagcaattctcct

SEQ ID NO: 42659 - DNA, 201 bp, Homo sapiens
ccagcatttttaggtttgtgaactcagaaaatctgagacaggtctcagttaatttagaaagtttattttgccaaggtcgaggacccacgcctgtgacacarcctcaggaggtcctaatgacatgcatctaagatggtgagaacacagtttggttttatatattttagtgagatacgagacatcaatcagcatgtgtaagat

SEQ ID NO: 42660 - DNA, 201 bp, Homo sapiens
accctcccatctttctacatatacttaaaggcagttaaattgctgctaaaaatgtgaaatggaggtgtgaacatttctagaggcaattaagtagttctgcmttttactggtaaattctatcattcttaaaaaaagagagaggtttatataaaaatggagaaaaaggaaattgcatgtgcagatgtaaaataccatctgtgc

SEQ ID NO: 42661 - DNA, 201 bp, Homo sapiens
caagaaactcaggtttgaagtttgttaaagaggaaactggcagggagttttgaaggatgtccaatacactgaacttaagtttccatcacatccaaaggcgraaaaatgttgacatcacaaggatctcagtcttttctccagataatatgcaagttcagagatgttcagtgtctttccctagacctctctggtgtaagtgta

SEQ ID NO: 42662 - DNA, 201 bp, Homo sapiens
tctattcttagaaggacattttctctagataaatttgtatgaaaagagttaaagtgggttgggcgcggtggctcacgcctgtaatcccagcactttgggarcccgaggtgggtggattacaaggtcaggagatcgagaccatcctggctaacatggtgaaaccccatctctactaaaaatacagaaaattagccgggcgtg

SEQ ID NO: 42663 - DNA, 201 bp, Homo sapiens
cctatattatcccgctaatgccccctattcctatatggtgagatcagtgcaacagttttaaatcctgggatgaaactgcttaattctttactagaagattyggataagtagtagcctacatggttctgaaaatgataaaagatttattggaacagtcagaaaattgctttcgctaactgggaaaataattgtgtttttaga

SEQ ID NO: 42664 - DNA, 201 bp, Homo sapiens
aaggtctgcttcgaagcttacgtggtcattgacagaattcagttcttctcaggctgttagactgattgttggacagagactactttcacttccttgtcatrtgtgctgatccaaagaacaggacacagcatagcagatggcttcaattgcaggaatcaaatgagaaagtgagaaagagcctgtgaaggagattaaagtcac

SEQ ID NO: 42665 - DNA, 201 bp, Homo sapiens
ttaggcccgtgattctgaaccactcagaaatctagagcttttccatttcatagttacagtatccattcctctctgcacacattgttagaatcacaaaacatgtgagaaagctatccttttaggtgtgcattgggaacacaagccctgtgaaattggaggctgctgcctgtgtctagcaagtctgctggtatttgccaagca

SEQ ID NO: 42666 - DNA, 201 bp, Homo sapiens
aatctggccctacatttgtcagattaatagctttgttcatttttatcataactatctgggtatttgcctttcacactccaatatcggatatgttcatggcrgatctattttcttatttacttgcttccaatttaactaaatatgtgaccaaactacttagaactatccacgaaaattctacaaatatacttaaaattagtt

SEQ ID NO: 42667 - DNA, 201 bp, Homo sapiens
aaaacataatctgaaatcttgctaaatctggccctacatttgtcagattaatagctttgttcatttttatcataactatctgggtatttgcctttcacackccaatatcggatatgttcatggcggatctattttcttatttacttgcttccaatttaactaaatatgtgaccaaactacttagaactatccacgaaaatt

SEQ ID NO: 42668 - DNA, 201 bp, Homo sapiens
tttaggcccgtgattctgaaccactcagaaatctagagcttttccatttcatagttacagtatccattcctctctgcacacattgttagaatcacaaaacatgtgagaaagctatccttttaggtgtgcattgggaacacaagccctgtgaaattggaggctgctgcctgtgtctagcaagtctgctggtatttgccaagc

SEQ ID NO: 42669 - DNA, 201 bp, Homo sapiens
aactgatctaggaaacaagataaaagtaaataaagaagagatactttattcataagaaaacttgtgtttagttctgacttatctttctttgagcttttctrtatctcattgtctccgtttgttcctttgtttttccattcttacttttcctaatttacaggtattaagggaagataaagatacacatctttgtcttcttct

SEQ ID NO: 42670 - DNA, 201 bp, Homo sapiens
tgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatctattc

SEQ ID NO: 42671 - DNA, 201 bp, Homo sapiens
ttcccactcatggtgcagacttttcatcctctcttttatgcatggttcattggaattaacctgctactttaggcagagttctccagggcaaacaccactcyagcacttactttctcttctgggattatattttttgtaatttctgaggatttaaaaaaattattcttctacccccatggtacaattttttaactatattta

SEQ ID NO: 42672 - DNA, 201 bp, Homo sapiens
gtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatctatt

SEQ ID NO: 42673 - DNA, 201 bp, Homo sapiens
aatataaaattgctactgatttgatgattttacattttccttaaaaattatggatagttctgactttagatttcccaaatgcaatatattttataaaaacygacaggtgacattccctctaaaaagaagaaattgtgcttcctcaaggaaacctaccaaaatatcttacagattaaatattactaaatatttagataattg

SEQ ID NO: 42674 - DNA, 201 bp, Homo sapiens
ctcttagggaggctgaggcaggtgaatcacgaggtcaggagttcaagaccagcctggccaacatggtgaaaacccgtctctactaaaaatataaaaaattagccaggcatggtggcaggcacctgtagtcccagctactcgggaggctgaggcaggagaattgcttatacctgggaggcagaggttgcagtgaaccgagat

SEQ ID NO: 42675 - DNA, 201 bp, Homo sapiens
agtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatctat

SEQ ID NO: 42676 - DNA, 201 bp, Homo sapiens
caatttcagaaacaaaatataaaattgctactgatttgatgattttacattttccttaaaaattatggatagttctgactttagatttcccaaatgcaatrtattttataaaaactgacaggtgacattccctctaaaaagaagaaattgtgcttcctcaaggaaacctaccaaaatatcttacagattaaatattactaa

SEQ ID NO: 42677 - DNA, 201 bp, Homo sapiens
cagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttgtatttaaataagcataccatcta

SEQ ID NO: 42678 - DNA, 201 bp, Homo sapiens
ttagttaatacaagacttgactaatgtgctgtgcaattttgtaaattactgatactttgaaaaaaatggttataagacacttttaaatgattggtttattygctgccatttttatggttggaactcagtcttacgtagccctaaaaggcaacttctgaatcaccactattgtaggtcattattgcaattgtaatactacat

SEQ ID NO: 42679 - DNA, 201 bp, Homo sapiens
ttgaacccaggaggcagaggttgcagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtcttg

SEQ ID NO: 42680 - DNA, 201 bp, Homo sapiens
tgaaataagcatagtttctatgacaatttagaaaaaaaatttatcatttatagcaaatgatttgatttgaaaatgcatagaataaatttattttcttagamgaaaccacagatgcaagaatttgggaaaataactcattgtaataaatgataaacccactgtaccataatgtcaagtatcaaagcattgatatggactttg

SEQ ID NO: 42681 - DNA, 201 bp, Homo sapiens
gcttgaacccaggaggcagaggttgcagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtct

SEQ ID NO: 42682 - DNA, 201 bp, Homo sapiens
tagggtgaacctgctttatattttggatttgaaataaaatgtaattaattaatagataaatctatcttttaaatatggacttgtcttttccttcaagtagyatgaatttgattattttatatgttgaaataagcatagtttctatgacaatttagaaaaaaaatttatcatttatagcaaatgatttgatttgaaaatgca

SEQ ID NO: 42683 - DNA, 201 bp, Homo sapiens
cgcttgaacccaggaggcagaggttgcagtgaaccaagatcacgccactccagcactccaggtgacagagcaagactctgtcttaaaaaaaaaaaaagacagttgtgtgtgtgtgtgtgtgtgtgtgtgtatttaatgttaaagaaaaagctggcaatagccttgtgataaatacagtgcagcaaggcaaaatgacttgtc

SEQ ID NO: 42684 - DNA, 201 bp, Homo sapiens
tggcgtgacctcagctccctgcaacctccgcctcccgggttcaagtgattcccctgcctcagcctcccaagcagctgggaagacaggcacacgccaccatrcccagctaattttctgtattttactagagatggggtttcaccatgttggccaagatggtctcgatctccggaccttgttatctgcctgccctggcctccc

SEQ ID NO: 42685 - DNA, 201 bp, Homo sapiens
ttctaatagcccacttgctttccaactggcattttcttccttactatattgatgtagtcttcacattctttataaaacagactacgtttttgacatgcctsatctaaaaatagtttgtcctgctttggcaggacttggatattgcagaggagcatttcaggatttgctgaacccaagcagctgacatccaaacaggctttc

SEQ ID NO: 42686 - DNA, 201 bp, Homo sapiens
cactgtttctaaaagttactgaatggaggagtagagtggtaagagtttagaaaggaagacagacaataagttattttgacattttcatacatgctaggctrtttgaattttgttccaaagcattgataactattgtaatagctttaacaggggaggggcatgatccaatttgcattttaagaagtttcctcttgattttgt

SEQ ID NO: 42687 - DNA, 201 bp, Homo sapiens
tatttaaatttcatcacttttgcttccccaattaaaagaataaaaagcaaaaactatagggtgaacctgctttatattttggatttgaaataaaatgtaaytaattaatagataaatctatcttttaaatatggacttgtcttttccttcaagtagcatgaatttgattattttatatgttgaaataagcatagtttctat

SEQ ID NO: 42688 - DNA, 201 bp, Homo sapiens
attgaaacattagaaattatattttaaaaatgtaagaataaaatcatttgtagtcttatcacccagagataactatttcaagtgttttctgtgaagatatwtgaaaaaaattatatatatatatatatttggacatttattagtattccaaaatgggatcagattatacaaattattctccaatctgtttttactcccatt

SEQ ID NO: 42689 - DNA, 201 bp, Homo sapiens
gaatggcattagagtttctttgttgattctccattaactataacctcctcataaatacaaaccatattcatcttaccaaggtattactgacagtatttttyacattggaaaacaaaggatgcttacttcatggtcacataaaacaattatttttcttaaaaattatccagtaatgcatgtttataattgaaacattagaaa

SEQ ID NO: 42690 - DNA, 201 bp, Homo sapiens
tgcttgaaccagggagttggaggtttcagtgaaccgagattgcgccactgcactccagcctggcaacagagcaagactccatcttaaaaaaaaaaaaaaaattgatgtctatgcactgataaaacaacaaatccttgagaatggggcaacaccactttctagcccaaattctgcttggctttgtcaccttccatttcagat

SEQ ID NO: 42691 - DNA, 201 bp, Homo sapiens
taatataccccagactggggagcagaagattgggcataatcataccttagcttttttcaatctccaaagttaaaagaataaaagcagaagactagcatacwttatattttagaattaaaataaaatgtaattaaatttaattaattaattatattttagcattaaaataaaatgtaattatttgtaaaatcaattgactaa

SEQ ID NO: 42692 - DNA, 201 bp, Homo sapiens
catctctactaaatacacaaaaaattagccgggcatggtggcgggtgcctgtagtcccagctactcgggaggctgaggcaggagaatggcgtgaacccacraagcggagcttgcagtgagctgagatcgcgccactgcactccagcctgggcgacagggcgagactcagtctcaaaaaaaaaaaaaaaaaaaaaaaaaaaa

SEQ ID NO: 42693 - DNA, 201 bp, Homo sapiens
gtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgtctt

SEQ ID NO: 42694 - DNA, 201 bp, Homo sapiens
cgtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgtct

SEQ ID NO: 42695 - DNA, 201 bp, Homo sapiens
tgtcaaggaaaaatgcccaatttaacagttaagtagcctagtaacatatgccacagcaacatgtcttgtcccaaacaatgcgcatagttgaaagagaataygaaaaaaacaacaaaccagtatcaatgccacctgaaactcataagggaaatgcttaaaatgttccatgtaaaacatatatgaaatatgtccacctcaaag

SEQ ID NO: 42696 - DNA, 201 bp, Homo sapiens
tctcccctgtaaagttacactttttccttttataattagtaaatatcttgaaggagatattttgagactatgaaattattttgtttctcctcaaactttcrcatactaatttggacatccattggtagatttttttaaacttttaagttcagggatacatgtacagatttgttattatagataaacttgtgtcatggagat

SEQ ID NO: 42697 - DNA, 201 bp, Homo sapiens
tcgtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgtc

SEQ ID NO: 42698 - DNA, 201 bp, Homo sapiens
ccatagggctttacttttagaatcctggagtttcctaagaaaatagaaaggtagaaagtggcaattatagcccacattcctactaagcagctataaatgcwaaaatatgctgatatatcaattaccattataataaaaatacaaaaatataagttacacaatgtaggcaatgtatttgttaacacttatggatatctataa

SEQ ID NO: 42699 - DNA, 201 bp, Homo sapiens
tcagcctatatatcagggagtacatcatgtcagtatgtcttattactggtgataattaaccttgatcatttggttaaggtggtgtctgctggctttctccyctgtaaagttacactttttccttttataattagtaaatatcttgaaggagatattttgagactatgaaattattttgtttctcctcaaactttcgcatac

SEQ ID NO: 42700 - DNA, 201 bp, Homo sapiens
atcgtctggatctcttgacctcatgatccacctgccttagcctcccaaagtgttgagattacaggcatgagccaccatgccgagccaaaaaacaaacaaacaaaaaaaccccaaaaaaacccagctttttaaacacaacctggaggagactagtacctaaatccagggcattgtctgccttccaccgtggctcccagctgt

SEQ ID NO: 42701 - DNA, 201 bp, Homo sapiens
cagaaaaaaagtgtgataatttcaaatgagccgtttacataagttaatgttgatgttagagttgtgatttgcatttcccgattttggttcttcatttgaartgttattgatttatttccatagggctttacttttagaatcctggagtttcctaagaaaatagaaaggtagaaagtggcaattatagcccacattcctact

SEQ ID NO: 42702 - DNA, 201 bp, Homo sapiens
acaataagttttcagggtatgttatttgaacagaaagcaaaagagacacaatattttaaggtttaggtagataaaacctagcactgtggcaggagtgtctrttggaagcaaatgtcatttcctcccagtatagagtagtttggtttttgagttgtttctttaggttcagagtaaataggatgctctctaaaatctgctcta

SEQ ID NO: 42703 - DNA, 201 bp, Homo sapiens
gatctcggctcactgcaacctctgcctccccagttcaagcgattcccctgcctcagcctcctgagtagctgggactataggcacctgccaccacacccggstaatttttgtatttttagtagagacagggtttcaccatgttggccaagatcgtctggatctcttgacctcatgatccacctgccttagcctcccaaagtg

SEQ ID NO: 42704 - DNA, 201 bp, Homo sapiens
gactaaataggagcaggacattttatgagatgggtttgaggggtatatttggctttctctgattcttactgaattgaaagctttggcaaatataggtaagktggctgtcattgaccaaatcatgtccattctgggtctattgctacataagctgtggtttaatttccaggactggttgctgcagaggttatggtcaaagct

SEQ ID NO: 42705 - DNA, 201 bp, Homo sapiens
tacgtggaagttcgttagacattttgggaactgtcttgccctcctgggaaatatttagtttggtttaattacaaaaaaaaaaaaacagcttttttttttttcttttctttcttttttgagacggagtcttgctctgtcgccaggctggagtgcagtggtgcgatctcggctcactgcaacctctgcctccccagttcaagc

SEQ ID NO: 42706 - DNA, 201 bp, Homo sapiens
agaatgatggcttactttttttcctattggatagtgtgttagagtaattataagcaataatcattgcctttcccataaatattctccctgtaaataatccrtttattttactttatgtagtcttgaatcactagaaactatttagtaatgctgatgagaaatgctttaatataaaggagactgattttatctgtcagttac

SEQ ID NO: 42707 - DNA, 201 bp, Homo sapiens
gtttatagtttaaatgttaataacccttcccccaaactaaactgcctttgtaaagctaataaaagaccaccaggttacgaagagatgaggatcctgaattmtgctaaggtgtagacataaacaattaccagccattattctggaggtcacaagatttgcaactcccgcaattactcctgcagataacatcactattacaga

SEQ ID NO: 42708 - DNA, 201 bp, Homo sapiens
ttgtaaagctaataaaagaccaccaggttacgaagagatgaggatcctgaattctgctaaggtgtagacataaacaattaccagccattattctggaggtyacaagatttgcaactcccgcaattactcctgcagataacatcactattacagagcgagcctaagattggccttttgagatatcttttcaggtttttacat

SEQ ID NO: 42709 - DNA, 201 bp, Homo sapiens
atgtaaagctgcccccagtggtgaagaacattatgggcatgtgcagaaatgtctctcttttatcttgcaaatgagcaggctctctgctggaaaatgaatgrttcttttgggtggctcagtaggaactgaatggtcaccgtgatcaataactagcaacattttctgtgatttccaagtcttgttttacaatttggcaacgtc

SEQ ID NO: 42710 - DNA, 201 bp, Homo sapiens
acataaacaattaccagccattattctggaggtcacaagatttgcaactcccgcaattactcctgcagataacatcactattacagagcgagcctaagatyggccttttgagatatcttttcaggtttttacatttctgaggacagtctacccctgcccatctgtcatgtggccccacccaaactgactccttgtcccacc

SEQ ID NO: 42711 - DNA, 201 bp, Homo sapiens
tgatccaacaatcccttttctgggtatatatccagaggaaatgaaatcagcaccttgaaaatatatctgcactcctacattcattgcaaccttagccacartatacaagatatggaatcaacctaaatgtctgttccagtgaatggagaaggttgaaatacagatatgaaatacagatgtgattgtttatgtgtatctgtg

SEQ ID NO: 42712 - DNA, 201 bp, Homo sapiens
gatttcagaacaaaaggaattttttaaatgatccggtagaataataatacttttgttagtgtcctcatatcttgatattctcagatattaggacattgctygaagcataaatcttgatgagtttcttggatgttttgtttcatctcttgtgctttttctttttagctaatgtaatcatagatttaatgtaatagccctatc

SEQ ID NO: 42713 - DNA, 201 bp, Homo sapiens
gtttcatctcttgtgctttttctttttagctaatgtaatcatagatttaatgtaatagccctatctctaagttgctgtcccccacgttttatctctcagtratataggctttagggcctgatatcagtacagagctatttattagttcaggatttcattttgtcataagattttgcatcttacgtgaactattttttgcat

SEQ ID NO: 42714 - DNA, 201 bp, Homo sapiens
ataaacagaaaaaaagtgtgataatttcaaatgagccgtttacataagttaatgttgatgttagagttgtgatttgcatttcccgattttggttcttcatytgaaatgttattgatttatttccatagggctttacttttagaatcctggagtttcctaagaaaatagaaaggtagaaagtggcaattatagcccacattc

SEQ ID NO: 42715 - DNA, 201 bp, Homo sapiens
tgcatcttacgtgaactattttttgcatttctggacgatttcttctattacttcaatattatcttgtgagtgtgatacacttgtgttactgatgaggattrtgaatcttaagcaggagtctgcccactccacaaccatatgaaataccacttaacatttttttgtaatcagtgccacaggccctttaaagctcatttctga

SEQ ID NO: 42716 - DNA, 201 bp, Homo sapiens
cagttatccctgtttttcaaactttccaatatttagagatgtgaggtttctgagtttgctcccaatctctatttttaaaactttatttattttttgttagmaaaaaggttaacaaagagcatctgttcctttaattttgtagtctgttcctttaattttgtagtactatagcgcatctggtaacccagtaggctatttgtt

SEQ ID NO: 42717 - DNA, 201 bp, Homo sapiens
cagtaaccgttttctctacgtggaagttcgttagacattttgggaactgtcttgccctcctgggaaatatttagtttggtttaattacaaaaaaaaaaaaacagcttttttttttttcttttctttcttttttgagacggagtcttgctctgtcgccaggctggagtgcagtggtgcgatctcggctcactgcaacctctg

SEQ ID NO: 42718 - DNA, 201 bp, Homo sapiens
aatatatttatttactcaaaattcatcctttggttcttgatgtctctcttctttgttatcaaagattttctcttcatttttagcttgatgtttttaagcarcattttcagttatccctgtttttcaaactttccaatatttagagatgtgaggtttctgagtttgctcccaatctctatttttaaaactttatttattttt

SEQ ID NO: 42719 - DNA, 201 bp, Homo sapiens
actgacctacagttggctatgttaaaaagcttctttgaatctgatagctcatttttagctatttctttgaataatctgaaaggtatatcctgaaaaaaaaatatattacatagccgagttaacccagctgcatattaattctttaaaatgataaatatatgacatttggttattttaaaaagtaatgacatcaaataaatt

SEQ ID NO: 42720 - DNA, 201 bp, Homo sapiens
tgtgagtgtgatacacttgtgttactgatgaggattatgaatcttaagcaggagtctgcccactccacaaccatatgaaataccacttaacatttttttgkaatcagtgccacaggccctttaaagctcatttctgataccacctgcaggtattttgggtaagtgatagatggaaggaataagcgcacacacattgtaaga

SEQ ID NO: 42721 - DNA, 201 bp, Homo sapiens
ctggaacctccgcttcctgggttcaagcaattctcctgcctcagcgcccccagcagctaggattacaggcacatgccaccacacccagctaatttttgtakttttggtagagacagggtttcaccatgttggccaggctcgtcttaaactcctgacctcaagtaatctgcccaccttggcctcccaaagtgctgggattac

SEQ ID NO: 42722 - DNA, 201 bp, Homo sapiens
ctaaaagaataaatggttcagggagatgaaaacattgttttgagaccaccattggcctgagtcagtgtagcaatgcttatgaggcgattggaaccaaagakaatatgctagcacagtttatacactatatctctcttatgcagctttagtttattgctcacgatactcattcacgaatccttgaaaattgcttcaaagagg

SEQ ID NO: 42723 - DNA, 201 bp, Homo sapiens
caatgagtatatttgcttttgcagtcagaaaataaagcaatggatgttattttaaaagaaatagctcataaagtaaatatatatatttacatataatattwgtttatttatttatttattttgagatggagtctcattctgttgcccaggctggagtgcagtggtgtgttctcagctcactggaacctccgcttcctgggt

SEQ ID NO: 42724 - DNA, 201 bp, Homo sapiens
attgaatagcaactccccattctcttaattatctaggatcatattttcaggaacgtcatcgcatgtgtgtgtgtgtgtgtgtgtgtgtatatatatatagtgtgtgcaaatttatttcactcatgatgttatactaaagtatggatttctatatacaaccttgattattccacacttaggaataaaagtttgactaagtgt

SEQ ID NO: 42725 - DNA, 201 bp, Homo sapiens
ctattgaatagcaactccccattctcttaattatctaggatcatattttcaggaacgtcatcgcatgtgtgtgtgtgtgtgtgtgtgtgtatatatatatagtgtgtgcaaatttatttcactcatgatgttatactaaagtatggatttctatatacaaccttgattattccacacttaggaataaaagtttgactaagt

SEQ ID NO: 42726 - DNA, 201 bp, Homo sapiens
ctcatcatcttaaggccccacctcttactgctgccacattggggattaaatttcaacttgagttttggaggagacaaatattcaaatcatagcagtcttgycctaaattaaaaataataataattaaaacagaaaaactggcagctccaaggttttgaaagtattctcctgtattttgttttaggagtggaatggtcttag

SEQ ID NO: 42727 - DNA, 201 bp, Homo sapiens
cagaaaaccaccaaaccacaaaaataataaaagaagaaaggaactaaggctatacagagcaattacaaaacaactaacaaaatgacaagaataaatcctcrtcttatcaataacaaccttaaatgtaaaccgtttaaattccctaattgaaatatataaactggctgaattaaaaaactgagacccaactatttgctgctt

SEQ ID NO: 42728 - DNA, 201 bp, Homo sapiens
tgcaaacaaaaagtgtgcaaaagtagcaaacttatatcagacaaaatagacttttattaaaaataaaaagataaaaagacacagaggtcattatatagtgrttaaaaaatcaattcagcaagaggaaagaacaattgttaatatatatccaccgaacaccagagcactcagatatatagggcaaatattattatagttaaa

SEQ ID NO: 42729 - DNA, 201 bp, Homo sapiens
aacaaaaagtgtgcaaaagtagcaaacttatatcagacaaaatagacttttattaaaaataaaaagataaaaagacacagaggtcattatatagtgattaraaaatcaattcagcaagaggaaagaacaattgttaatatatatccaccgaacaccagagcactcagatatatagggcaaatattattatagttaaagaga

SEQ ID NO: 42730 - DNA, 201 bp, Homo sapiens
caggtcattgttcagaggtgcccatactttatgtaagtgagaatgccataccaactccttaatgacttgaacttctggcaaagatgctgttctattttggmatatggatacctgaaaactagttagaaaaatacatttttattgccccccccccttacgtctctttcacccaatttttagatgggctaagttgtctccatt

SEQ ID NO: 42731 - DNA, 201 bp, Homo sapiens
tttttacagttatggaggctaagtccaaggtcaaaggtccacatctggtaagggtcttcttgcagatgagggctttctgcagagttctgaagtggcacagkgaatcacatggcaggggggctgagcatactcatcatcttaaggccccacctcttactgctgccacattggggattaaatttcaacttgagttttggagga

SEQ ID NO: 42732 - DNA, 201 bp, Homo sapiens
tctctcctggatcaggaaaagacctggaaagggaagagaattctctacagaatgttgattttccccacaagaggcagctttacagggctgtttaaagatayatcgaagaaatatatttcagggtaaaatacttcaatttcttacagggcctggtatatgtcattttgtgatgtatctgattgccacaaagagtctgtttgg

SEQ ID NO: 42733 - DNA, 201 bp, Homo sapiens
ctgacaataaatgaaatcatattctgaaagaacgtcatcattcgttgaaatattttcatttctggtaaatacattgtcttgacttaaaaagtgttttttttggtagcggatgactcctagaatagtacctggcatgtgttaggtgctcaataactatttactgatggaatgaacacaggctctagtgtaaacagatgagac

SEQ ID NO: 42734 - DNA, 201 bp, Homo sapiens
gccagtggcaaaggcagccatgtttatgtccttcccttccgggtggaaagttctgcgcaggcccagatggagatgctgtctggaagccagggattgaagtmaaaaacgttagaaatctacctgatgttctattctactgtggctaagctggcactcaaaccacaagacaaagtccttcccattcttccctacctctttcca

SEQ ID NO: 42735 - DNA, 201 bp, Homo sapiens
tttaagtgtgactttagtcatcaagtacatacaagaaaaaaagcataaaggaatgaaaattaagagggtaaaacttctgcaggctatatttactatttacyctaataatattaaaaggaatcatgaacgcattgagaagtattttgaagatcaagtttatgtagcagtttattttttaatctatcctcatggctttgttgt

SEQ ID NO: 42736 - DNA, 201 bp, Homo sapiens
tctgctttaacggggaccctaagcccagttacactagggttattgcagcctcataaatgtgccgcctttgttgtcttggataagatccagaagaattctcygaattaccaggcagattgtttttctcttttcttactttctctcaaatgttgtttctctctgagctgagccacttggagctggaagtgggatgacacaggg

SEQ ID NO: 42737 - DNA, 201 bp, Homo sapiens
ggaaataaaaattaaatcaataataaaattgcatctcacagccattagatgataaaaattaaagcatgacaatacatatgtctgggaggtagagaaactgraactttcattcactgctggctggaatgtaaattgatattagttctttggagagcaatttggcaacatctgataaggctgaggaagtccatatcctaattg

SEQ ID NO: 42738 - DNA, 201 bp, Homo sapiens
tacttttcaatatcagcagttactgtcttgttattttattgaatccacttgttatttatgatttagaagattattggactcctcattaaggagtgaggcarcattcaatattattaatatgtcaaagagctttgagatatcaaaattgtctatttaaatgtctccaaggactcttgggctactagaaaactgaccataata

SEQ ID NO: 42739 - DNA, 201 bp, Homo sapiens
atcttgataaatcacttaatgtttcagagagactcgatttcctcacttacaaaattgggataataataattcctcatagggctgctatgaagtttaaatgtttcttgtgtttggtaacacattccaagatcaatagttacacaatataatcttattcagatggcagtgattgaaaaagcctttgacagttatttctatcag

SEQ ID NO: 42740 - DNA, 201 bp, Homo sapiens
gatgcttcagtgaaaaccctgctcaaatgagactttggtcttgcaaattagggtggcagtatggcaaccctgtcaacctctcttccaggtatgcctcaggmactactgcccactctggaaaatatttaaaccagcagagtggctgcttaatggagctgagcagcagcctgcatttcttggcacatttgacaagcaagttca

SEQ ID NO: 42741 - DNA, 201 bp, Homo sapiens
tgtataagtttcttatacatactagataatagacctttggctgggtgcgatggctgacaactgtaatcccagcactttgggaggctgaggagggcagattrcttgaggtcaggagttcaagatcagcctggccaaatggtgaaacttcatctctactaaaaatacaaaaaaaatttagcctggcatggtggcacatacctg

SEQ ID NO: 42742 - DNA, 201 bp, Homo sapiens
ttctttgattacctaattttggagagagctttatgggacaactgtccaggccaacaaactcattaaaaggacctaggccatttgttgaaagtcttgatacycagttctgcttcaattcagtatgtttcaaaaaaaatttttataccactgcttactctgcctatttcagaagcagctctaaccttcattccccctctgccc

SEQ ID NO: 42743 - DNA, 201 bp, Homo sapiens
cttgatactcagttctgcttcaattcagtatgtttcaaaaaaaatttttataccactgcttactctgcctatttcagaagcagctctaaccttcattcccyctctgccctaagtgtctcaggcttgccccaagttctcctaattttggatgattaatggattcattgattcattgattcatggatacacacacgtgcacac

SEQ ID NO: 42744 - DNA, 201 bp, Homo sapiens
ctttttggttttaggtaaatttccatgagtacctagcattctagaagtgaactcacagcccagattttatgattttattattagtttatttaatttttttytctttttttttcttttttttttttttagacagagtctcactctgtcgtcaggctggagtgcagtggctccatctcggctcactgcaacctccgagtccct

SEQ ID NO: 42745 - DNA, 201 bp, Homo sapiens
aagaacaattgttaatatatatccaccgaacaccagagcactcagatatatagggcaaatattattatagttaaagagagagatagagacaccaatgtaayaatagttgagaactttaacacctcaccctcctcaccctcagcattgcacagctaatctatacagaaagtcaacaaagaaacattgtacttaagcttcatt

SEQ ID NO: 42746 - DNA, 201 bp, Homo sapiens
aactgttattactaacattattggcaggccagtgttaaaatttaaaccagtatgagaaagataaatctctttaaggagcacttttgttcaacctgtcccartaatagactatatagttaaccaaaataactgaagaattatcttaagagctagggtgcatgactatcagatattaaaagtaaaaaaaatctgataatttca

SEQ ID NO: 42747 - DNA, 201 bp, Homo sapiens
aatagttactatctgacctttttaaaaaaacttttaagttcaggggtacatgtgcgggtttgttacatagggtaagctcatgtcacggggcctgaagcattgctccaggaacatagcccccccatgggtatttttacacaaaaactggaggctattcaaaagatacacatgaagtctattcctggagattattttgtcacc

SEQ ID NO: 42748 - DNA, 201 bp, Homo sapiens
caccaatgtaataatagttgagaactttaacacctcaccctcctcaccctcagcattgcacagctaatctatacagaaagtcaacaaagaaacattgtacytaagcttcattttataccaaatgaacctaatagacatttacagaacattttttccaatggctacaaaatgtacattcttctcatcagcagatggaacatt

SEQ ID NO: 42749 - DNA, 201 bp, Homo sapiens
tattagaacggatcaaggttacaggcaataatgatggtttccactgaaaaaaaaagccacaaatatcttgtgtttcaaaatttctgtgatcagcattttttgagggaagaagcattatgggaagaaaaagctaacagagatgaagtatcagacaccatgccatggggctgtccttacatgtgtcatcattttaacagggaa

SEQ ID NO: 42750 - DNA, 201 bp, Homo sapiens
ccctgagtcatctgtgattacattttcatgttacagtatattgttcagggatcattgtggagactgaagagaaatgtacacatggctttatgtaggtcatrgtgaaagacagagagaaagtgtgtattcagaaatgattgaataggcttccccaaagtaatccattattgctttattggtaattatgttttgaattactgc

SEQ ID NO: 42751 - DNA, 201 bp, Homo sapiens
cttggcttccaatctagagtttcttctataattttgggcaagttatttcatctctttgtgcctccattgtcttgtcagcacattggagatactgataagakctttctcaggggatgaaaaacaatacaaatcaagtaattagaaacatgcccggcacattgcaggtcctcagtaatgttatttttataactcctacactat

SEQ ID NO: 42752 - DNA, 201 bp, Homo sapiens
cctttcttcttccaagctcagcaaatctaaaaacttcaacacaattaagtaagttatcctacaaactctatagtataattgacctcaatatcatttttttyctcaataaattatggaatatatgaaatgcctcccaaaagaaaatattatctttcattagaatatagagtctagaagataatcaccgtcttccatatgttc

SEQ ID NO: 42753 - DNA, 201 bp, Homo sapiens
ctaaagcaaatcacagagatttattggtttgttcttcatgaaatttcagtcttcatacaggtattttttcagggattcaaatgatattgaccttatttggkttctctctctcagctctgctttttactatattggtttaatactcaaaatatttattgtattttcctgttgcttcaagaacattctttccatttacctcat

SEQ ID NO: 42754 - DNA, 201 bp, Homo sapiens
acagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaacatt

SEQ ID NO: 42755 - DNA, 201 bp, Homo sapiens
cagtagtgcaatcacagctcactgcagcctcaacctgcaagactcaattgatcctcctacctcagcctcccaaggagctgggctgacaggtgtgtcattakgctcagctagttttcatatttttttgtagagatggggtttcgccatgttgcccaggctgctgaagagtattcttggagcaatagggaattactacatata

SEQ ID NO: 42756 - DNA, 201 bp, Homo sapiens
cacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaacat

SEQ ID NO: 42757 - DNA, 201 bp, Homo sapiens
gcacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaaca

SEQ ID NO: 42758 - DNA, 201 bp, Homo sapiens
atatagaaaaaacaaatactgaggatgccatttgagtccctggagcaggatccgcatgctgactgaatttgtgtggaagacaagccaatcaattcctgtaytggtgtaagctagtttgagttggttcttgtcataacataaactgtgcatatggaaataaagatacaaaaattatgagtgttatataagtagatcaaatga

SEQ ID NO: 42759 - DNA, 201 bp, Homo sapiens
gacttctgacttctgaccaagaaagccttaaatttctccttgtcttgatgggattccttctgagtacaggcccctggcctcccttttcttaaagcatctaytttagagaacttcccattgtaaattctttctctgtccctttgtgatgtacatcttgtcccagtttcttgccaatttaacaaaatataatatctttcttaa

SEQ ID NO: 42760 - DNA, 201 bp, Homo sapiens
tgcacagcacgtgaatggactttgaaatagcattgcatgtctgagaattctgtctctttaaattgtctgctttgcttattggaaatgataacaatgattgtttgaagttattattaatttttttagttttaacaaatcctaataaaggaaaacatatctattaaaaactgaaataactactcactgaaataaacagcaaac

SEQ ID NO: 42761 - DNA, 201 bp, Homo sapiens
agaaaaaacaaatactgaggatgccatttgagtccctggagcaggatccgcatgctgactgaatttgtgtggaagacaagccaatcaattcctgtactggygtaagctagtttgagttggttcttgtcataacataaactgtgcatatggaaataaagatacaaaaattatgagtgttatataagtagatcaaatgatttt

SEQ ID NO: 42762 - DNA, 201 bp, Homo sapiens
ctttcagaaggcgcttattgccctagatctcaggttcattggttgacttctgacttctgaccaagaaagccttaaatttctccttgtcttgatgggattcyttctgagtacaggcccctggcctcccttttcttaaagcatctactttagagaacttcccattgtaaattctttctctgtccctttgtgatgtacatcttg

SEQ ID NO: 42763 - DNA, 201 bp, Homo sapiens
tattacttgaagtttttatataggacatatatcatctcaatgaaagaatagtcattcttttaaaaaattacagccttaccaccatctcttctttagaattwttttccattagctactaaagaaagtctttggcaaatacattataaattttggaattgaagtacaaaataaaagagatcataggaacagtatcttctccaa

SEQ ID NO: 42764 - DNA, 201 bp, Homo sapiens
acttgccagtgtcaggtggcatctacccaaggcaagcaaacacttacatcatatctctttcagaaggcgcttattgccctagatctcaggttcattggttkacttctgacttctgaccaagaaagccttaaatttctccttgtcttgatgggattccttctgagtacaggcccctggcctcccttttcttaaagcatctac

SEQ ID NO: 42765 - DNA, 201 bp, Homo sapiens
ggtcaggagtttgagaccagccttgccaacatggtgaaaccccatctcaacttaaaaaatacaaaaattagctgggcgtggtggcacacccctgtagtccyggctacttgggaggctgaggcaggagaatcgcttgaaccctggaggcggaggttgcagtgagccgagattgggccactatattccagcctgggtgacaga

SEQ ID NO: 42766 - DNA, 201 bp, Homo sapiens
tgatttgcggggcacccatttttcattgtatttgatgtccttgtccacaaggcggaatggcaagaggcttagaaatctaaccatgtaccggttatgttgtrtttgctttgagcctatatcctcattgaaaacagctgctgaactcagagttattatgaagactcctggagagaaagcagaatggaataaatgggaagagca

SEQ ID NO: 42767 - DNA, 201 bp, Homo sapiens
ccgccacccgggttcaagctattctcctgcctcagcctcctgagtagctgggattataggcgtgcaccaccacgcccggctaatttttttgtatttttagyagagacagggtttcactgtgttagtcaggatggtctcgatctcctgacctcatgatctgcccgcctcggcctcccaaaatgctgggattaaaggcatgag

SEQ ID NO: 42768 - DNA, 201 bp, Homo sapiens
tttacaggcgtgagtcaccccacccggcctcttgtggtttcttttaaaattcattaatattggttataaataacttttgagcaagttaaaatatttaaagsaacatcaatgacatgccaaagaatgtttagtaggctctgaaggtccttccaaataaataatttaccaatatctgagcattaacaagatcaatgaaccaat

SEQ ID NO: 42769 - DNA, 201 bp, Homo sapiens
cgatagtttactgagaatgatgatttccaatttcatccatgtccctacaaaggacatgaactcatcattttttatggctgcatagtattccatggtgtattatgtgccacattttcttaatccagtctatcattgttggacatttgggttggttccaagtctttgctattgtgaatagtgccgcaataatcatacgtgtgc

SEQ ID NO: 42770 - DNA, 201 bp, Homo sapiens
cttgaacccaggaagcagaggttgcagtgagccgagatcacaccactgcactccagcctgggtgacagagcgagactgtgtatcaaaaaaaaaaaaaaaaagtcatgaaagaaaaaaaaggcaagtcattatcattgacagaaatataggtatttaatattttctgagtcattaaagtaatccaggaataccaattttaga

SEQ ID NO: 42771 - DNA, 201 bp, Homo sapiens
acaggtccttcttttttgagcaattacttactttttgccaccataggatgattcatactcaactaatttgtcaactcttctagctgaattctacttgccartgtcaggtggcatctacccaaggcaagcaaacacttacatcatatctctttcagaaggcgcttattgccctagatctcaggttcattggttgacttctga

SEQ ID NO: 42772 - DNA, 201 bp, Homo sapiens
gcatttagccatcctttataagaattttgtcattgagaacatgtgttataaattatacataacagatatgacagcagtttaaaacacaatttgattataasttggggcctgacagtatttttagtcaattaaggaattagactacatagcaattgttgactacactgctcatgttcatacagagaaagaatattaccattt

SEQ ID NO: 42773 - DNA, 201 bp, Homo sapiens
tattacagatggggtcttgctatgttggccagtctggtcttgaactcctggcttcaagcagtccccctgccttagcccctgaaagtattggaattacagcsatgagccaccaggcctggacatcctgtttctttttaacaggtccttcttttttgagcaattacttactttttgccaccataggatgattcatactcaact

SEQ ID NO: 42774 - DNA, 201 bp, Homo sapiens
atggggcaggtttttcccatgatgttctcatgatggtgaataagtctcacaggatctgatggttttataacagggcagttcctctgcacacactctcttgyctgccaccatgtaagacatgactttgttccttcttgccttgattgccatgtaagacatgattgtgaggcctccctagccctgtgaaactgtgagtcaatt

SEQ ID NO: 42775 - DNA, 201 bp, Homo sapiens
tttaaaaatttaaatctaaataacacttaacatcacatattatctctttgtaattaaagagaattgtctttagtgttttgtttttttaaatagttaaacamggaaacatgccactaagcaaataaattcatagtcttagagcagagcaaggtaatctctaaaataattaaggcagaattattacacacactagaggttttt

SEQ ID NO: 42776 - DNA, 201 bp, Homo sapiens
gctcttaagactttggaaacaaacagtcgcgtcataatgtaaaaaagacttaaatgaggtgattttatttttaaaaagcttataataattgagtggtgtaycctcaagactgactagggtgatttcaaatgtaagtttagtaccagtttctttctagtgatggtgtggtatctatgtggggagagagtgcgtgggtgcagc

SEQ ID NO: 42777 - DNA, 201 bp, Homo sapiens
aattcttatacaacaagatttctttattttcttttaatttttacctttaattcttattattgtgcattgtataacccccagatgaaaagattaattggttyggggaaagctcaagaaatactagtcttgacagagtctgaggtcattccaaagctctcccaacacagaaaatgagacagaccctcttagattttacacatt

SEQ ID NO: 42778 - DNA, 201 bp, Homo sapiens
ctttaaattgaaaccccattaactatgttataattctacattctaatatgaaatggataatagaggtagttatgtggataaccgagtccagactgccttttctgggattagccctgtgaatatttaagcttagctattgtatttcataaggcagtctgaaatttgttgtatttctttttcacttttattttatgtaatgat

SEQ ID NO: 42779 - DNA, 201 bp, Homo sapiens
atcagtcttagaggaataggaaaagaggaaatttttaaagaaacccctgaggttcctcttccaaatattggcaaacattcaatcttatttagaatgttgcrttgcctagcaaaatgaaggatatagtacatcgtatccttattaaatcttgtagcagctaatatggtaaaagtccttttgctacaagagcctaaggtgatt

SEQ ID NO: 42780 - DNA, 201 bp, Homo sapiens
ggtattttgatatttttcccattagtaacttgcagtatattagtgagctgtgcaatatttcctgtattcctattttgcatatattattgcttttgtacctsacagtgaatgaaaatcatcattctttatgttaggtctgagaacagtaagaggtttccttggtgttgatcatcatgtaaggaatttatctatgtactggct

SEQ ID NO: 42781 - DNA, 201 bp, Homo sapiens
ttttaaagaaacccctgaggttcctcttccaaatattggcaaacattcaatcttatttagaatgttgcattgcctagcaaaatgaaggatatagtacatcrtatccttattaaatcttgtagcagctaatatggtaaaagtccttttgctacaagagcctaaggtgattgaagagggaggtagtaaccaaccactttattt

SEQ ID NO: 42782 - DNA, 201 bp, Homo sapiens
aatcacttgaacccctgaggcagaggttgcagtgagccgagatggtgccactgcactccagcctgggagagagagtgagactccatctcaaaaaaaaaaaaattgtaggatagactacaatgtgtataacttcactcctcttgtataaagatgtgtgggccgagtgcagtggctcacgcctgtaatcccaacactttggga

SEQ ID NO: 42783 - DNA, 201 bp, Homo sapiens
aattttgagctgccaaacttaggaccaagtgagttgaagcagttgttgaatggtgactccagcacattgatggcagaatgagtcagggtaatatgcagtcrctccccaaagtcctattctagaggaccagaaacaatttctctcttacataatgaacaaatggctaattcttctagaaagcactcttatgacatatttcaa

SEQ ID NO: 42784 - DNA, 201 bp, Homo sapiens
ttgtgaagcccatttcgttctaggcctaagaagggacagcctagtgaagcccatggaatagacagtaaggcattggccgcttagtgcttttaatgagagaragagagagagagagagagagagagagagagagagtgatgagtgggtgtgaagattcttctgtgttatcccaccttgatcatctgtactgagtaggaagag

SEQ ID NO: 42785 - DNA, 201 bp, Homo sapiens
tgtttcttcctgatgttctggggtaaatttttatatctccacattgttgacaaatttatattattggggtacagcctttttatttataaagttttttttttaataaccaggaggcactgactgatcttgaagtacctcctgaattatcattgccttcttacgtgaatatgtggaattataaaggagcgatggatactaagc

SEQ ID NO: 42786 - DNA, 201 bp, Homo sapiens
actaaggaaggttcccatgactctttgaggttattttgacaggtcacttctggatgcctttttcttcattcacacagctttagtttgttctaccagtcaasataggctagtctatgctgcactgtcaaaaacaatttaaaaaaactagttaaagtcatagcttaaaacaaaaatgtatttctttttcatgtcatatatgta

SEQ ID NO: 42787 - DNA, 201 bp, Homo sapiens
ccttataggagcttatatgctataagttacaataaagaatatgggcttttgatcacactgagtaaggtttagtacttgagtgactttaaacaatttactcygtgggttttaacgttcttatctataaaatggggatacaaatatcatccacctgcctcaaactttgttatatgatcctaagagataatgtatatatatata

SEQ ID NO: 42788 - DNA, 201 bp, Homo sapiens
gaatacgagcaaatcatttttggtgggggagggttagtaactttttgcttagtgtatggtttattgctcaataaatattaaacatgcagtattaaattaaagtggttactgaattattccatttgtcataaaatgattctaatacgaacagacaaatatataaatatacacacatacttaaaaattgtttcacttctgtgg

SEQ ID NO: 42789 - DNA, 201 bp, Homo sapiens
gagtggtgtgataaggaaatggagcttaaaactgtggctggaacaaagactaaaatgagtaagattattacagcagaatgaactgtaggtaaggaccaacstggggacggttttagactatgaattactgaaaagaaatatggtgtttgtttttagtcaactaggattttatcaaaggttatcagcaagtggggggcatga

SEQ ID NO: 42790 - DNA, 201 bp, Homo sapiens
tttgatcttgactgctaactaatgatttctccataaattctagttcaaattttcaagattgattaacacaacacaactttttatgtcaaacctcataaccatcaccagccagccaacagattaactcttcttgaattgggtacctgcctatgacctaaatagtgttgaagtgggagaaaataataccaaacctgccctcct

SEQ ID NO: 42791 - DNA, 201 bp, Homo sapiens
gccataacaactttatttattatagcaaatgaaataaacaaaccaaatgccagtcacaaagataatgaattaacaaattgcagtatatgtataaaatgtartacttctcagcaataaataaaataaactactggtacatgcagcaacatacgtgaagcttacacatgtaatgccatgtgaaacatcacacaaaaaattaca

SEQ ID NO: 42792 - DNA, 201 bp, Homo sapiens
aaaagaaaaagaaaacaaaacatacgttgtcaagctaaaaggctgtatctgatactttgtttaaccatcatagaaatatttgggcaatgtaaataatatayatatcattgtcttttttactctcatcaacactgccttcttttcaaagttgcccttaatatatattaaaacttgacatatgtctcaaagaagtgactctgt

SEQ ID NO: 42793 - DNA, 201 bp, Homo sapiens
tcttaacattttaatccttgaaaattgtactaagttatttcaatactttttaaaattaagtttagtaaactacatcattaattattttgcctgattacatwccatgtattaggataaaactggttcaatataactaaaagggaattttagtatccctcttttaatatctaaataagtatagtttattcagttcaataagat

SEQ ID NO: 42794 - DNA, 201 bp, Homo sapiens
tgcacatgaaccccctgaatctgaaacaatataaataaataaataaaaattacagagagtatcaagaaatagagaactcttaagagaacaattactgatgytggtgaaattgggatcttgttcagaggttacagaatggctatgattaggatctgttagagaatcttctagaaagctttgtggcaggttcatggagaaact

SEQ ID NO: 42795 - DNA, 201 bp, Homo sapiens
tgcaaagatgtagccatttgttgacattccagttgggctttgatgaatgagtcaagagttggatagttggaattatggctcagcacatttgcaaggatacrgaggtcaagacaggagaaagaactacaattaggtgaagggtacctggacgccagtgtacaggtggaggaggagtagaaacataagcagagttaaaatttt

SEQ ID NO: 42796 - DNA, 201 bp, Homo sapiens
aaagtataggctgcaaaagagttcagaactggttctgaatttggctgtgtaaaatagacaagatactttgaagtcgccggggtgttgaccaaaaggccgcytttgtttgataaatctacactccaaagttcagaacagcttatcctacctggcatttccattgattagaatggatgtgtttaaggtatccctctctttgat

SEQ ID NO: 42797 - DNA, 201 bp, Homo sapiens
cttaatgatttatacaattataaaaatagtgtcatgtatctaaagactttttattttattgtgcttataggacttcaaatagctaaacatattttgtttarattgggtaaataaatcaaatctcagtttggcaatactgccaaattttagtccaatatgaaactgagttgccagatataaacttagaaattcataactgaa

SEQ ID NO: 42798 - DNA, 201 bp, Homo sapiens
acattgatggcagaatgagtcagggtaatatgcagtcgctccccaaagtcctattctagaggaccagaaacaatttctctcttacataatgaacaaatggstaattcttctagaaagcactcttatgacatatttcaaacatcacatcacatccgatacatcagtcaataaatatgcatccaaatgcttttctccagccat

SEQ ID NO: 42799 - DNA, 201 bp, Homo sapiens
ccatttattaaataaggaatcctttcctcatttcttgtttttgtcaggtttgtcaaagatcagatagttgtagatgtgtggtattatttctgagggctctrttctgttccattggtctgtatatctgttttggtaccagtatcatgctgttttggttactgtagccttggagtatagtctgaagtcaggtagcaagatgcc

SEQ ID NO: 42800 - DNA, 201 bp, Homo sapiens
tggcacaaactgtttcatcagtgaaattccacaaagtttatgtagacactggagatcacctctgtgccatatacacagcttatgcaacatttaaggctacrtatgatctcagtccccaagagttgtatttgccaagagtagagataagaaaaaattccttcaatgctctcctgtctacctttttagcttcctctctcatca

SEQ ID NO: 42801 - DNA, 201 bp, Homo sapiens
cttatgcaacatttaaggctacgtatgatctcagtccccaagagttgtatttgccaagagtagagataagaaaaaattccttcaatgctctcctgtctacstttttagcttcctctctcatcattctctctgccttattattatcattgttgccatgctaaattgcttatatttctttgcataccaagctcattcttacct

SEQ ID NO: 42802 - DNA, 201 bp, Homo sapiens
tgatgtctgtaatcccagcaccttgggaggctgaggcaggaggatcacgaggtcaggagattgagaccatcctggctaacacagtgaaaccccatctctastaaaacaaacaaacaaacaaaaaaacaaaaaacaaaaaaaaaacattagtcgggcatggtggcatgtgcttgtagtcccagctactcaggaggctaggct

SEQ ID NO: 42803 - DNA, 201 bp, Homo sapiens
tgaatacgagcaaatcatttttggtgggggagggttagtaactttttgcttagtgtatggtttattgctcaataaatattaaacatgcagtattaaattaaagtggttactgaattattccatttgtcataaaatgattctaatacgaacagacaaatatataaatatacacacatacttaaaaattgtttcacttctgtg

SEQ ID NO: 42804 - DNA, 201 bp, Homo sapiens
gtgaatacgagcaaatcatttttggtgggggagggttagtaactttttgcttagtgtatggtttattgctcaataaatattaaacatgcagtattaaattaaagtggttactgaattattccatttgtcataaaatgattctaatacgaacagacaaatatataaatatacacacatacttaaaaattgtttcacttctgt

SEQ ID NO: 42805 - DNA, 201 bp, Homo sapiens
gtggcatgtgcttgtagtcccagctactcaggaggctaggctaaggcaggacaatcgcttgaacccgggaggtggaggttgcagtgagccgagatcaagcyactgcactccagcctggtgacagagaatccgtgtcaaaaaaaagatactgctcaccattaatatggtgaatgcttttcttatgaggaccttcaggagaaa

SEQ ID NO: 42806 - DNA, 201 bp, Homo sapiens
agtgaatacgagcaaatcatttttggtgggggagggttagtaactttttgcttagtgtatggtttattgctcaataaatattaaacatgcagtattaaattaaagtggttactgaattattccatttgtcataaaatgattctaatacgaacagacaaatatataaatatacacacatacttaaaaattgtttcacttctg

SEQ ID NO: 42807 - DNA, 201 bp, Homo sapiens
aggttgcagtgagccgagatcaagccactgcactccagcctggtgacagagaatccgtgtcaaaaaaaagatactgctcaccattaatatggtgaatgctyttcttatgaggaccttcaggagaaatttttctcagctcacagtaacataaataattctgttttggagaaattggtttacttttattgtatgagtattaaa

SEQ ID NO: 42808 - DNA, 201 bp, Homo sapiens
aagtgaatacgagcaaatcatttttggtgggggagggttagtaactttttgcttagtgtatggtttattgctcaataaatattaaacatgcagtattaaattaaagtggttactgaattattccatttgtcataaaatgattctaatacgaacagacaaatatataaatatacacacatacttaaaaattgtttcacttct

SEQ ID NO: 42809 - DNA, 201 bp, Homo sapiens
ggagaaatttttctcagctcacagtaacataaataattctgttttggagaaattggtttacttttattgtatgagtattaaatatgtaacttgcgatttcrtcaccctttgcattgctgcttgaaagtgtagtgtcagagtgtgatccagagatcagtaaatggtatcaagtagtttgcatgttgtgtgtaagtcacagtc

SEQ ID NO: 42810 - DNA, 201 bp, Homo sapiens
ttctttcttttttttttgagatggggtcttgctctgttgccaggctggagtgcagtggcgtgacctcagctccctgcaacctccgcctcccgggttcaagygattcccctgcctcagcctcccaagcagctgggaagacaggcacacgccaccatacccagctaattttctgtattttactagagatggggtttcaccatg

SEQ ID NO: 42811 - DNA, 201 bp, Homo sapiens
gctcacagtaacataaataattctgttttggagaaattggtttacttttattgtatgagtattaaatatgtaacttgcgatttcatcaccctttgcattgytgcttgaaagtgtagtgtcagagtgtgatccagagatcagtaaatggtatcaagtagtttgcatgttgtgtgtaagtcacagtccaactttatcttcatt

SEQ ID NO: 42812 - DNA, 201 bp, Homo sapiens
tgagagaagataactgcaaacctacaattctgtaactaatacaaatatatctattgaaaatatcgaaacaaagacattttctgaccaaaaaaaaaaaaaaacccaaaatacaaaaacaaaacaaaaacagagaattaatcagtatgaggcctgcactaaaaggaataccaaagggaattgttgtaagtagaagaatgaccc

SEQ ID NO: 42813 - DNA, 201 bp, Homo sapiens
ttgagagaagataactgcaaacctacaattctgtaactaatacaaatatatctattgaaaatatcgaaacaaagacattttctgaccaaaaaaaaaaaaaaacccaaaatacaaaaacaaaacaaaaacagagaattaatcagtatgaggcctgcactaaaaggaataccaaagggaattgttgtaagtagaagaatgacc

SEQ ID NO: 42814 - DNA, 201 bp, Homo sapiens
cccgggaggcggagcttgcagtgagccgagatcgtgccactgcacttcagcctgggcgacagagcgagactccgtctcaaaaaaaaaaaaaaaaaaaaaaagagttaaagtggcagctgggcacggtggctcatgcctgtaatctcagcactttggggggccaaggcgggcagatcatgaggtcgagagatcaagaccatc

SEQ ID NO: 42815 - DNA, 201 bp, Homo sapiens
tctactaaaaatacagaaaattagccgggcgtggtggtgggcgcctgtagtcccagctactcgggaggctgaggcaggagaatggcgtgaacccgggaggyggagcttgcagtgagccgagatcgtgccactgcacttcagcctgggcgacagagcgagactccgtctcaaaaaaaaaaaaaaaaaaaaaaagagttaaag

SEQ ID NO: 42816 - DNA, 201 bp, Homo sapiens
gtcctttctaacacgaattttctactgtttggattccaattcttgattatgcctgaaaaattaatatctatcatgaatcttctcaaaagactattttttayatatgctacaagttatctggattttatagttaatttgttcctttctactaaatttgtatgtattattataacataatatataaagacatattgatgtttt

SEQ ID NO: 42817 - DNA, 201 bp, Homo sapiens
cctgagactttgctgaagttgcttatcagcttaaggagattttgggctgagacagtggggttttctagatatacaatcatgtcatctgcaaacagggacartttgacttcctcttttcctaactgaataccctttatttctttctcctgcctaattgccttggccagaacttccaacactatgttgaataggagtggtgag

SEQ ID NO: 42818 - DNA, 201 bp, Homo sapiens
ataatgttttcttgtttacttaagccctcacttctttttactcctcactaagaagatctctagcaaagagaaaaaaaaatagttttagactttcctttagsgaagggactctttttcttcaggaaaatatgctgcaccgtgttgggagatgagactctgatggatgaatatatatatgacaatacttaaaaagtgtgctta

SEQ ID NO: 42819 - DNA, 201 bp, Homo sapiens
cttagcctggggggaaaatgcagactctggctttattttctgcatgggaatcacgtgggtagcttaaatattccaggcatcttgacttggcatattgaacrcattttcttattccataagctgttctacatgtcgttagagtgacagcagtgagtagtaaaataagcactggctttggagtcaggtagacctggattctta

SEQ ID NO: 42820 - DNA, 201 bp, Homo sapiens
tgaccataatagctctaagtagtaaatattcatcaacagttgaattaataaataaactgccttgcatttacacagtggaatactacaaaacaatgaaaatraatgaaacagtcatatgatacaaattattctcacaaacataatgggttgaataaaaaatacaaaaaatacattgtagatgattaagtgatataaagtaca

SEQ ID NO: 42821 - DNA, 201 bp, Homo sapiens
acaaaaaacaaaacaaaacaaaacccaaattagctgggcattggtggctcatgcccatagtcccagctacttgggaggctgaggctagagaatcgcttgascctgggaagcagaagttgcagtgagctgagatctctagcctgggagacagaatgagaccctgtctcaaaaaaaaaaaaaaattctaggattacttattat

SEQ ID NO: 42822 - DNA, 201 bp, Homo sapiens
atatgatacaaattattctcacaaacataatgggttgaataaaaaatacaaaaaatacattgtagatgattaagtgatataaagtacaaaatgacaaaaarcaattttatgctggtagaagtcagaatgtggtcatccttggaaaaagagcagtgggtctggatggggaacgaaggagcttctggggagctggtaatgttg

SEQ ID NO: 42823 - DNA, 201 bp, Homo sapiens
tttaacattatttttcttacctttgacttttattttggaatattctggtaatattatttaaacataattttaaatgaaatttgacttttaaaaatacaatmagcaaacttataaatccctcctccttcctcctgcccttgttaggtattatattttatttgtacaaagccatagcaaacattccaagcattcttttctata

SEQ ID NO: 42824 - DNA, 201 bp, Homo sapiens
cataatgggttgaataaaaaatacaaaaaatacattgtagatgattaagtgatataaagtacaaaatgacaaaaagcaattttatgctggtagaagtcagmatgtggtcatccttggaaaaagagcagtgggtctggatggggaacgaaggagcttctggggagctggtaatgttgtgtattcttaatctcagtcctggtt

SEQ ID NO: 42825 - DNA, 201 bp, Homo sapiens
aatgattccatgaaagaggggagcaaacttcaagtcttatgactcttatctcatgctgtattcattggttgaagaataggttgcttgttacatggaaacaratgtttacagatatcatcaaagaaatgttgacatcgaaaagactgttacatattttttgctttttggtggctacagcaagattggcagaaatgtctttta

SEQ ID NO: 42826 - DNA, 201 bp, Homo sapiens
gtagatgattaagtgatataaagtacaaaatgacaaaaagcaattttatgctggtagaagtcagaatgtggtcatccttggaaaaagagcagtgggtctgkatggggaacgaaggagcttctggggagctggtaatgttgtgtattcttaatctcagtcctggttccatatgtgtggttggtttgtgaaagtttatagagc

SEQ ID NO: 42827 - DNA, 201 bp, Homo sapiens
agccattcatagaggatagctttttgctgatgcagccagatgcagtggggccctttgacaaaacaagtgaggttccttttgagatggatgtgctgtccaakgccaaaattcttagaccttttctcaaacaggggattcaccaccttgttggccttctgcttctttatgataagggactagagccaccttctctgccttggc

SEQ ID NO: 42828 - DNA, 201 bp, Homo sapiens
agatggatgtgctgtccaatgccaaaattcttagaccttttctcaaacaggggattcaccaccttgttggccttctgcttctttatgataagggactagarccaccttctctgccttggccttctttcctttcagcagcttgggtggctggaggaagcaacaagaccaaacattttgtataaaggatcttatgatatttta

SEQ ID NO: 42829 - DNA, 201 bp, Homo sapiens
aatgcacttttcttccttttatttttctagacttaatcacacagattcctataagtaattaggtttttcattctttctaaactctttatcttagcacttcrttcattcagtcatgacatagtaatgtttgtggaatcccagttgcttttattgagaatggctatatattctctcattaagtaattatttttctttatgttt

SEQ ID NO: 42830 - DNA, 201 bp, Homo sapiens
caggtgataaaaatgaagaatacttctggggtaaaatcaaatttattggagtggaatgaagttcctcaggcaaggcatgctgaagtaatcacacccatctsaagccttcagttactgttgatcaacttattttctctagtccagacccaacttctaactacagactcctgtttctacctcccaacagacttctccatataa

SEQ ID NO: 42831 - DNA, 201 bp, Homo sapiens
attcatagccagtaattctgccttcttggtgtgcttcaaatctgtctcagattgaaatggcttcgcattcctgtctgctactgacttagtctaggatttcrtgatttctcatttgaattattagatgaacaccttggcactaccagatccaccctgctcaccacctagatatcctacatcatgctgctagagtgatctttt

SEQ ID NO: 42832 - DNA, 201 bp, Homo sapiens
gatttcgtgatttctcatttgaattattagatgaacaccttggcactaccagatccaccctgctcaccacctagatatcctacatcatgctgctagagtgwtcttttaaaaacaaaacattgaccgtattacacccttacttaaaaccttttaatgagtcaccagtgtgctcaggatgaatccagaatccttagggaaata

SEQ ID NO: 42833 - DNA, 201 bp, Homo sapiens
atcttgaaaagactgcaggtagggaataggggaaaggctagtaaaggctttctgagtcaggataattatgagagcacaaaagcatagatgagggaactagyaggtcagggagcagatggcctaggttctagtggtaagtagtcctacaggctttccctcgtttttatccttgttgttcagggaacataaataatcaccagt

SEQ ID NO: 42834 - DNA, 201 bp, Homo sapiens
aagtgagattgtatggttttggcaggaggagttgaggcagaatggacatagggatatctgttttttacatagaaagttttaagattatagctggaagggaycttagactagttgtactcaaagtttgacctatggtccagttctggtcagtccattacaatgacccaagttgataggaagattttaaaatcttttgtatta

SEQ ID NO: 42835 - DNA, 201 bp, Homo sapiens
ttaaagattttaagtatcagacaatataaagagagacatttaaaaaatatctcatattgaactcctggttctgccaatgacctgactaatgattttggacwgttaaccctgttaattgtttcaccttaggaattgataggaaaattttgtaagcaattcttggttgacaagtacttggttgaaagaccagataacaaaaat

SEQ ID NO: 42836 - DNA, 201 bp, Homo sapiens
ccaatccagcagaaaatggctctagcctgcaaaacaatccagtagctcacgtaaaaggaataattttctttcttgagaagagggaattttttaacgaaatrcaagcacttggggctgtcaccccttctggttcttcttgccatgccctccctgcctctttggatcccagcaagaggcaggttaaattctgcatgctgtagg

SEQ ID NO: 42837 - DNA, 201 bp, Homo sapiens
gtccattacaatgacccaagttgataggaagattttaaaatcttttgtattagtctattctcacactgctaataaagacataccagagaccgggtaatttrtaaaggaaagaagtttaatggaccttataaaggaaagaggttccacatggctggggaggcttataatcatggcagaagggaaatgagaagcaaaagcaca

SEQ ID NO: 42838 - DNA, 201 bp, Homo sapiens
tattctctttgaagcaattgtgaatgggagttcactcatgatttggctctctgtttgtctgttattggtgtataagaatgcttgtgatttttgtacattgrttttatatcctgagactttgctgaagttgcttatcagcttaaggagattttgggctgagacagtggggttttctagatatacaatcatgtcatctgcaaa

SEQ ID NO: 42839 - DNA, 201 bp, Homo sapiens
gataatgatttagaattctaattgatgtcctcattgatatttgggaggttttttttttcttcactctgtaaaagagcaaacacactgctatgcaaaggagyaatagggtaatattactgaagattattgcacattatctctatgtggtgagaaaactgaggcatagttaatataccttgcccaaggtaaaatagctaggaa

SEQ ID NO: 42840 - DNA, 201 bp, Homo sapiens
ttcctagttattttattctctttgaagcaattgtgaatgggagttcactcatgatttggctctctgtttgtctgttattggtgtataagaatgcttgtgakttttgtacattgattttatatcctgagactttgctgaagttgcttatcagcttaaggagattttgggctgagacagtggggttttctagatatacaatca

SEQ ID NO: 42841 - DNA, 201 bp, Homo sapiens
tcactctgtaaaagagcaaacacactgctatgcaaaggagtaatagggtaatattactgaagattattgcacattatctctatgtggtgagaaaactgagrcatagttaatataccttgcccaaggtaaaatagctaggaaagtgctaacccaaggctctagaaagacctacattcagtgcccataaccttaattacacta

SEQ ID NO: 42842 - DNA, 201 bp, Homo sapiens
tacttcaccttttctatgcacatctataagatgatgaagatgatgcctattgaataaatccaataagcaagcttaagcataggaatgataaataataaaayataaatttcctctctgaggagaaaaaaaaatctcatgtcagtagatgtattgcgatgctgggacctaacattctaagtgggaattatatgcagaattcag

SEQ ID NO: 42843 - DNA, 201 bp, Homo sapiens
cgtaaaaaagtcttaaggaaattttgatacataacccccaaagcattgatagcacctcaactttgacatctcatggtaccattttcatcttttttccctamtttttattactttcaataggaaagtggctttcttgttcaatttaaatcagtgagtcaaaaggaaggatggcttggggttgctagtgtttgtttgcaagac

SEQ ID NO: 42844 - DNA, 201 bp, Homo sapiens
ctatctggagctattgtaatttgaacatttaaacaccttttatgagaatggagagaatgataatgaccggtagtcaagatggagaaaacccatttctattygtgagtcagtttaatgggttggtggcttataatttacttaacgtgcttgcatattacttttcatttcagaagtagtgagctgtgtcttcatttacgtgct

SEQ ID NO: 42845 - DNA, 201 bp, Homo sapiens
ggcattgaatctataaattaccttgggcagtatgccattttcacaatattgattcttcctatccatgagcatggaatgttcttccatttgtttgtatcctyttttatttccttgagcagtggtttgtagttctccttgaagaggtccttcacgtcccttgtaagttggattcctagttattttattctctttgaagcaatt

SEQ ID NO: 42846 - DNA, 201 bp, Homo sapiens
ggagtaacctaatgcactccaattcaaatattaaaaaaatgatttcaatagatggttttcagcaattgtacaaaattaatatggatcaaatagcttttgtratattgttattgcgtcatattttaactataaaaatgcaattaatgctcttatagcatattttatggggttaatttccagaagaattacagttaaactaat

SEQ ID NO: 42847 - DNA, 201 bp, Homo sapiens
actaaatgaagtgatattctgtcccaactaaatgaagtgatattctgtatgcatctgccaggttgcataaaaatcttgcacctgttttagttcaagtaacrttttttaaagaaaatccttcagatgagtttcattttatagggatgaggtcttgctatgaatttcttcaaaatttatatttatatccacataagtatgaaa

SEQ ID NO: 42848 - DNA, 201 bp, Homo sapiens
taactctgctgttcaaactgccagaatgcaaatgtatttattttaagatcttggtctatgctagcatattggatggcttatcctttttcgtggaattctcrtctatctaatgttatgtgtatggagccccttgcctcatcattaaaggtgagggaagtgttctcatattgtcaaaagtcaccaagagcaatctcataacct

SEQ ID NO: 42849 - DNA, 201 bp, Homo sapiens
ccattccaatacatgcctagcaagcagaagacagaggattccatgtaggaaaagcatttcttatctccccatttggcatctctcaatttttcactcattcwctcactcacttactctctcactcttgttcttgctttctttctctttaaattatcatggtatttccacatgatattattatatgtctgtttttagattatg

SEQ ID NO: 42850 - DNA, 201 bp, Homo sapiens
cataactcacttggggatttattaaatgaatctttagctgaaggaggcttagagaaaatagaaaaattcagtgtgtatacagataaaacattttcaactartcaagatgagtcctttttctaagaattttttttctaattccaaaaattctctttagaaaaaacattatttagtaaacatctattttaggtactgcctaca

SEQ ID NO: 42851 - DNA, 201 bp, Homo sapiens
ttgcaagaatctcattaactgtagggccatctgccacgttgctactcatttggctcatttaatcacaggtgggtaggaaggtctcaatagttttggttccyattcaattctgatttttgcttgggaaacagaaggaaggtctcaatagttttggttcctgttcaattctgatttttgcttgggaaacagaaaaggccagtg

SEQ ID NO: 42852 - DNA, 201 bp, Homo sapiens
attctttgtctttggaaagaagtgggatttaaagtatactttattctgggaaattggcatccttaaatatattatttacatatattccttaaatatatacrtgtatatatttatgcatgtatgtttgtgtatgtatcacactgtctttaaattctcaatttacttaaagaaatgttttaatttctaaaaaatacacttgat

SEQ ID NO: 42853 - DNA, 201 bp, Homo sapiens
attattagtgttaattatcctattatttggttaggatacaatagaacaagagtgattctcaaactttagcattcacaaaaatcaccacccacttctttaastagtcaaccccctgccacccaagtttttcatccagtaggtctggtataggtcctggaatccacatgtcttacaagttcctatatgatgctggactattaa

SEQ ID NO: 42854 - DNA, 201 bp, Homo sapiens
gaacattctttttgcaaatatttattgactatttggctttctaattcggtgacttgcttatatcgttttccaattttccgatttttgttaggttgtattttgtaattaatttgcttaggtttgttaaaaatatctctgttgcccatgtcttttgaaatattttttaaataatttttcagtcacagaagatttgaagaactt

SEQ ID NO: 42855 - DNA, 201 bp, Homo sapiens
tcataactcacttggggatttattaaatgaatctttagctgaaggaggcttagagaaaatagaaaaattcagtgtgtatacagataaaacattttcaactmatcaagatgagtcctttttctaagaattttttttctaattccaaaaattctctttagaaaaaacattatttagtaaacatctattttaggtactgcctac

SEQ ID NO: 42856 - DNA, 201 bp, Homo sapiens
ataaaaagcatgtgtgtgaatatatatgtgtgtgtatatatgtgtgtgtgtgtatatatatatattctttatatgaagaatgtagcacattaaaactacamatgtgtatataggtaaaactaaaattctaggaaaaagaacttgggagaaggaagaggaaggttccattagtactttaaatatgctaagattcttgtctta

SEQ ID NO: 42857 - DNA, 201 bp, Homo sapiens
gtgaatatatatgtgtgtgtatatatgtgtgtgtgtgtatatatatatattctttatatgaagaatgtagcacattaaaactacaaatgtgtatataggtwaaactaaaattctaggaaaaagaacttgggagaaggaagaggaaggttccattagtactttaaatatgctaagattcttgtcttatttagttggtaggca

SEQ ID NO: 42858 - DNA, 201 bp, Homo sapiens
aagaggaaggttccattagtactttaaatatgctaagattcttgtcttatttagttggtaggcaggacatactaaaatttaatctctgtcagaaattatgygtatctgagtgtgtgtacagttacacaattaataaaaggaaaaaagagagcacatgaaaatcaaaaaagcaagaaataagatcctcccctaaaaacaata

SEQ ID NO: 42859 - DNA, 201 bp, Homo sapiens
atgctaagattcttgtcttatttagttggtaggcaggacatactaaaatttaatctctgtcagaaattatgcgtatctgagtgtgtgtacagttacacaaytaataaaaggaaaaaagagagcacatgaaaatcaaaaaagcaagaaataagatcctcccctaaaaacaataaagaaggaattctaaacagaacactaaaa

SEQ ID NO: 42860 - DNA, 201 bp, Homo sapiens
aatattgatgagaatggaaaggagtgtatctatacaaggaacaattctgaggaaaatatgtttagaagcaattatccattgggtgttaagggtgaaaaagragaaagaattaagaatttcctaaaggttttgaggttaaatagtttacttagtcaacaatggcatcgttaactaaacagtgtatatagaaggaagaccatg

SEQ ID NO: 42861 - DNA, 201 bp, Homo sapiens
aatacccagaaaatttccccctaaacctgatttttattgcttgatttgtggtttaaagtattttcataatatttataagtaaaggtggtttcagcaagtaygaattccaccattttgtccacaggattagtggggagggattttgaattcagatcttagctttggtgctggatgcctttaacaaattgctgtaattgcttt

SEQ ID NO: 42862 - DNA, 201 bp, Homo sapiens
aatgaaaaattagaaatatattgcaagacaatgagaattcatttcacaacctgtggaatgcaactgaatgcgtctaaatctgcaatgactgtggaaattayagtattaaactttttaatttaaaactaagaaaaagggacacagttatttaggcatttatctctgaaaactgtggaaagaacaacagagttaatccagaaa

SEQ ID NO: 42863 - DNA, 201 bp, Homo sapiens
tcatgtcagctgtgagtactgcctagcacttacatgatcacaggtggaagatgcttgaaacagagtaactacacccttgtttacatgaccaaatcttttargtaaaattagtttagaaaaactaaattggagtttttattaaaagtacatgtatttaaactagcaagaaatcttaaactagcagatttcttaaagaaaggt

SEQ ID NO: 42864 - DNA, 201 bp, Homo sapiens
ttcagcaagtacgaattccaccattttgtccacaggattagtggggagggattttgaattcagatcttagctttggtgctggatgcctttaacaaattgcygtaattgcttttcctttatccgtattttacttctctttggcagggtgaaataccagtttatcccaggtatcgtctgaggaaggtttggggagtgatctgt

SEQ ID NO: 42865 - DNA, 201 bp, Homo sapiens
ttaagttctactcccaccaactgaaaatctgcagtcaagttaaagctgagatccagaacctgggaggagagctcatcatgtcagctgtgagtactgcctakcacttacatgatcacaggtggaagatgcttgaaacagagtaactacacccttgtttacatgaccaaatcttttaggtaaaattagtttagaaaaactaaa

SEQ ID NO: 42866 - DNA, 201 bp, Homo sapiens
aatttgggtgacagctacagaagggaatttaataatgccttttactattttgaaagccagaataaaaagtaaaagaaaccctttagaataaattttgaaargttaagttcagagctacttaattattatatggatttggaagtataggcatttaaaaaatactttatattttcaagggggaaaatcattaatcacctcctc

SEQ ID NO: 42867 - DNA, 201 bp, Homo sapiens
aaattattttaagactaaatacgatataaagaacatgattaaatttgttagtataattttaacatccacagcagtcaggagaagaaaaaaattataggccrgcttcacatataaacatatatgtaatgggaaatcatgaaaaacaaagcaaatcttatctgacagcgtattttaaagtttttaaaacttttaaacatcatg

SEQ ID NO: 42868 - DNA, 201 bp, Homo sapiens
tctttgcctcagcctcccgagtagctgggactacaggcgtgcaccaccaagcccaactaatttttgtattttttttagtagagacagggtttcactatttkggccaggatggtctcgatctcttgacctcattatctgcctcccaaagtgctgggaatacaggtgtgagctactgcatccagcctaaaatttcacttttta

SEQ ID NO: 42869 - DNA, 201 bp, Homo sapiens
ctggaatactcttcccaggaaagccagatatgtgaagggttttaccttggatggatgggatctagaagtcaggtaaaatccttaatccttgtatttttttwtaaaaaaatccaccagcagagggctctagagaggctcagagccaaagctatcaagaaaatggtccaatgcagtgtgatgatctggggttgtgggagactg

SEQ ID NO: 42870 - DNA, 201 bp, Homo sapiens
tggaatactcttcccaggaaagccagatatgtgaagggttttaccttggatggatgggatctagaagtcaggtaaaatccttaatccttgtattttttttwaaaaaaatccaccagcagagggctctagagaggctcagagccaaagctatcaagaaaatggtccaatgcagtgtgatgatctggggttgtgggagactga

SEQ ID NO: 42871 - DNA, 201 bp, Homo sapiens
aagaaggggtaattagtgatagaagccaatgctaaataaatacagaaattccattctactgaagtccacttcatgggggcaggatgtgtttttagtattarcatctttggggtgaattatgatgttgttgaaggcatttaattcaacgagtactcatttttattgtgtcactttttaccaatactgctaaagtaacagaac

SEQ ID NO: 42872 - DNA, 201 bp, Homo sapiens
gcactccaattcaaatattaaaaaaatgatttcaatagatggttttcagcaattgtacaaaattaatatggatcaaatagcttttgtgatattgttattgygtcatattttaactataaaaatgcaattaatgctcttatagcatattttatggggttaatttccagaagaattacagttaaactaatgtttctctagtaa

SEQ ID NO: 42873 - DNA, 201 bp, Homo sapiens
gttttcagcaattgtacaaaattaatatggatcaaatagcttttgtgatattgttattgcgtcatattttaactataaaaatgcaattaatgctcttatarcatattttatggggttaatttccagaagaattacagttaaactaatgtttctctagtaaatacttaggaataattgaatttgcagtttggttcttaattt

SEQ ID NO: 42874 - DNA, 201 bp, Homo sapiens
agagtgaggggaaatcccagcatagagaaagtctgataagaagattccctaatcccggccaagagtggtggctcatgcctataatcccagcaccttgggargccaaggcgggtggatcaagaggtcaggagatggagaccgtcgtggctaacacgatgaaaccccgtctctcctaaaaatacaaaaaattagccgggcgtg

SEQ ID NO: 42875 - DNA, 201 bp, Homo sapiens
attaatgctcttatagcatattttatggggttaatttccagaagaattacagttaaactaatgtttctctagtaaatacttaggaataattgaatttgcartttggttcttaatttatactgataattgcttcctacaaaaagacatctctaattgtaatcaaataatatcctctctcctttgtttaaacagcttctccca

SEQ ID NO: 42876 - DNA, 201 bp, Homo sapiens
ttctctagtaaatacttaggaataattgaatttgcagtttggttcttaatttatactgataattgcttcctacaaaaagacatctctaattgtaatcaaakaatatcctctctcctttgtttaaacagcttctcccaagaaatccaagtcctgttttaaaacacaaaacaactcaaacaaaagcattcttaatggaaactt

SEQ ID NO: 42877 - DNA, 201 bp, Homo sapiens
taaaacacaaaacaactcaaacaaaagcattcttaatggaaacttctaatagaaaagctttatcattagccatgaagttatccacttgagtaatcaaatamtatttaagaatgcttcatttagagaaatgttatgtttcatagactgagaaatataaatcaaactgccaatttctggttggcaggtctgtttgaatctggt

SEQ ID NO: 42878 - DNA, 201 bp, Homo sapiens
ttttcctcttgttcctatttctgttcccttgctcctgcttgcttgcccatctttgcatttctttacacctggcagcaaccatactctttcttgatcctgcwaaggttaaacattgttagggccgaatttagaatttctctaatttaaaaaaaaattctaataaggcccagatttcaatcatggctgcaggtgagttgaaga

SEQ ID NO: 42879 - DNA, 201 bp, Homo sapiens
ggtaatgttttgaaggaattttgaatatgaaactaatattactaatcattgacgtttaaagaaaaaggagattagcctagattatccaggtgagatcaatrtaatcacatgaaccctttaagggcagaatcggagaacagaaaaatcagtcggtgaggggagcctagaagagaagaggtagaaggggaggttagaaggatt

SEQ ID NO: 42880 - DNA, 201 bp, Homo sapiens
ggagcctagaagagaagaggtagaaggggaggttagaaggatttaaaatgtgagaaggacacagcctattgttgctgcctttaagatggaggaaggggacsctgagccaaggaaagtgattgatctctggaagttaagaaccatccctggagaagagccccaaggaaattgagatgtcagttctatggtagcatggaattg

SEQ ID NO: 42881 - DNA, 201 bp, Homo sapiens
tgcaagaatctcattaactgtagggccatctgccacgttgctactcatttggctcatttaatcacaggtgggtaggaaggtctcaatagttttggttcccrttcaattctgatttttgcttgggaaacagaaggaaggtctcaatagttttggttcctgttcaattctgatttttgcttgggaaacagaaaaggccagtga

SEQ ID NO: 42882 - DNA, 201 bp, Homo sapiens
  misc_feature (1)...(201): n = A,T,C or G, or insertion/deletion polymorphism (see Tables 1-2)
taaaactggaatatatcttcctgaaagattcctccaaacaccctagagttttacctttgaaagcttaactaattgaagccttacttttaatttccttttgngctcatttatagacatggcttcatctatatcctgtctcagtactaagataggctcatgtgtcagctgctgcctcttgagcagagggtcttatttctagtg

SEQ ID NO: 42883 - DNA, 201 bp, Homo sapiens
tcattttcacactttctactcatttgactcattctttccttaatggaattataggcttttctactgtggccttggaagagtctcttgatagagacagcatrttttgcttaaacttgagtgattgcaattggttattggtcaagaatctgattactagtttgacagtttgattttatcagagttgtatagtggtgctggtct

SEQ ID NO: 42884 - DNA, 201 bp, Homo sapiens
cactgtctttagacaaaaacaagagcaaaaacaaaaacgtgggtatctcctaagaggcctgtgacttgttatacattttaccaataaaataatcatttacrtgaaatttaaagacttactctagatgaaatgaataatgagaaaacagcactaagttcagagaataaaattgtattgacgaagaaagtaaatagatcagtg

SEQ ID NO: 42885 - DNA, 201 bp, Homo sapiens
aaattaattttgactgtgactagactaaaagtcagttgaaaaaccaagcaaagatgtcagctagactggaaattatcttatatgcatagctttatattatwattttgcaaccttctaaacttacagtgaagttttatgtattacttggtgaccatttttttttcctcaaggaattggctttaggtctgttttccttcaaat

SEQ ID NO: 42886 - DNA, 201 bp, Homo sapiens
taatttgcctgagcaatatatcgtagtcattagcaagaattagaactgtacctaccaattactgaacaaaaattagggctgtaaataatcacaacacctcrgtctaggcagatgacctcatctgcttattttcctgccacgtataacaaaataatggttggtaaaggatattaacagctgttttaatttgaaattaaactt

SEQ ID NO: 42887 - DNA, 201 bp, Homo sapiens
ttgtatgccgtttctgtaattaatttgccttttgtgagttgatttttccatgaacctttagaggctgaaggagttttcccttggtctctacaacttttatytttcatttttcatagaaagctgtgttaacactagtaaatcatgtgaagaggttacagtaatatgcaaagctttctttttgtgtgtgagtggcggtgtggc

SEQ ID NO: 42888 - DNA, 201 bp, Homo sapiens
tttttctgatccatgaacatgggatgtctttacatttgtatgtgttctcttcaatttctttcatcagattcttatagttttccttgtagagatatttcacytcattggtttattcctatgtaatttttttggtagctagtggaaatgggattgctgttctgttcttctgtttttgtttttgttttgcttttcttttttttg

SEQ ID NO: 42889 - DNA, 201 bp, Homo sapiens
cctcctgccctggcctttcatgtagctaggactacactactaaacttacctatcatttagtacctgaatgaagctttatgggtgacagacagaggattttrgaaaaactttctgaaaactttctttgggtccagaatttgagcaggtcacaaggaggtaatcttattacaggtgccagagtacaatgtgactcagtgttag

SEQ ID NO: 42890 - DNA, 201 bp, Homo sapiens
tgcctttgatcataatcagccatttacatacaagtttctcccactagattgtaatgtccttaaagacagacaccacactttctttatttttattttccccrgtagcatctacacatagcagaggggcccaatgatcaatgatcaccaagtccttctccaaaatttaaatttaaaatgtactgcaagattacactgtgatac

SEQ ID NO: 42891 - DNA, 201 bp, Homo sapiens
gtgatttttttgggtaccaattttaagtttggtaagaatggaaagatgcttaaataatagataactttaagtaagtaattgcagagggggcagataaaagrcaccattcatcaagtgtcaactctgtgccagctatttagctaagtgctttacatgagctatataatgtaatcttcacattaaccctgtgaggtaggtaat

SEQ ID NO: 42892 - DNA, 201 bp, Homo sapiens
aaggttctttagcaagcttttgaacaattgatcatgaatattgtgtattcaattacttacaagaaccatcattgaactacgtctgttgaaagatccgactsaacctaattttggtaatgcttccagcaaatccctgtaaggggtagtaactgtgctttcacatttgggagccattgttggcgaatttcctcccctttaagc

SEQ ID NO: 42893 - DNA, 201 bp, Homo sapiens
ctgttgtgatgaaatctgaagtatacacaaaaatcaaacacatttcctgcctgtaggaacctttgtaaaaaacaaacattaattatataaaaacatattcytaggccacacaatattaattttaaataattgagtcagtacaaacatatttttctattttatatagaatggattttctcttttcctttctatgtactttcc

SEQ ID NO: 42894 - DNA, 201 bp, Homo sapiens
tgttaagccaaatatgtccactgggaatgctataagcttattccaatgttttctccattggttataacattttaaggaaagttactcttttggaatgaggkttttgtagttaggttatgatccaagtgcaaatattaccctgattactttatagccatcaattggcttagataaaaaaatgatgatacattcagcctgatc

SEQ ID NO: 42895 - DNA, 201 bp, Homo sapiens
tagaaatatgattgttcaaaaggatattgttagtggtggcgagtccaaacaggtccgcagcaaccttcaattcttgcctcctctgaagaaagaatttgacygaggggcataaggcagagtgagagacccagacaagttttggaggaggagtgaaagtttattaaaaagttttagagcaggaatgacaggaagtaaagtaca

SEQ ID NO: 42896 - DNA, 201 bp, Homo sapiens
tgaaacccacagctgagcagccactgaaaaaagaagaatggatttggagctgcctcaaaagctccatacccctgagacaatttcataaattgtaaaactgygtttattgctttataatgtttaaagatgtaatttgtatcaaataatgtaagagcaaaacataaaatgtgagaaaagaaaacataaaagtagacttaggtt

SEQ ID NO: 42897 - DNA, 201 bp, Homo sapiens
attgcatattgtgtaggcagatgcattttaaaatgaaatagtgacttttagaagtatctggtgactcttcaacaatacctggttttccaaacaaaattaawacaaaggctttctttcaaatgttctttatctcaatttcatttaatttcctaggagagttagtgatttgcctagcactttctgtttcgttgtttatcctaa

SEQ ID NO: 42898 - DNA, 201 bp, Homo sapiens
taaaaaaaactattatccctttaaggagtccctaaaaatgtttttttctgatcacttccccaatgaaatttgaataccacagatatttaagtacataacayatctgttaatgtactttatgtacattatatgtgctttatacattaaaaaagtaagttttttttccccaagaaccagttttcagcctcttgggggtgatat

SEQ ID NO: 42899 - DNA, 201 bp, Homo sapiens
gcctagcactttctgtttcgttgtttatcctaatatatgctcagttttctgtttaactagtttgttgttgttgcttttcttttccgacaagttttcagagyggaattcttagaaatgcttagtgaagctaccctatggcccattttaccaactatcagatctttccctgaagaaataacagtaaggaaaataggaaaatat

SEQ ID NO: 42900 - DNA, 201 bp, Homo sapiens
ttatgtacattatatgtgctttatacattaaaaaagtaagttttttttccccaagaaccagttttcagcctcttgggggtgatatcactcctgttgagcayttatgggctttatttaatagagaatattctagaaagaagaaagaaaaattctgttcttagcagtccttacaataatgtgtttaattctgaataccacatt

SEQ ID NO: 42901 - DNA, 201 bp, Homo sapiens
cccatgggatttttcttcctagcaacatcagcttctgggctgaatgctatgttctgctccctaccaggaagagtaggagagacggaacatacctagatgaktccagtcagttaatagtcatgtttctagatttcaggcttgtcgtagtcatggcaccaaagataatgagcctgtatctgtcatttcccaaagggcctgaca

SEQ ID NO: 42902 - DNA, 201 bp, Homo sapiens
agatggtgaaagagcagaaattaattttgactgtgactagactaaaagtcagttgaaaaaccaagcaaagatgtcagctagactggaaattatcttatatrcatagctttatattattattttgcaaccttctaaacttacagtgaagttttatgtattacttggtgaccatttttttttcctcaaggaattggctttagg

SEQ ID NO: 42903 - DNA, 201 bp, Homo sapiens
ctagcaatagaaaacaagagataaaaatctcagtcttcttagaagttagtttccagtagagtgggagagaaaggcagcaaactggagagatacaaaataaytgcttttattcatttgtaatgtgtcaggtggtcttaagcctaggtgaaaagcaaagtgggaaaggcataattgggttactggtgaggatttttttttttt

SEQ ID NO: 42904 - DNA, 201 bp, Homo sapiens
ctatgacaatgtcaacttagaattaattgatttaccttctataatggcccattattgcttaagtagtacatcatcatgatgcacatgcatgtgtgcgtgcmtccacacacacacacataaatacacacacaattaatttttccattaggtatgatatcctaatgtcatcaaatgaaaaacaagacggcataccctgaatcg

SEQ ID NO: 42905 - DNA, 201 bp, Homo sapiens
gattatagtaagataagactggtactttattataatagctctaggaaactcatacagcaattaaggtgaggacgaagaatgtgccattggattcagctccyggaggtcagtggtaaattagacagaagcaatttcagtgaagaagggtcaaaatcttgactggagtgggttcaagggaggaaagaccatagaatgaattga

SEQ ID NO: 42906 - DNA, 201 bp, Homo sapiens
atatcctaatgtcatcaaatgaaaaacaagacggcataccctgaatcgtctccaaggcccttcgtagcttaaaaaatttactttctggctgctacagatgygttgcttatgtcttttgtctctgaagatttgattttacctcctgatgagctgttgaaaggtagtagctcttagattgagtataaaagtgacatctgtctc

SEQ ID NO: 42907 - DNA, 201 bp, Homo sapiens
atagtaagataagactggtactttattataatagctctaggaaactcatacagcaattaaggtgaggacgaagaatgtgccattggattcagctcctggargtcagtggtaaattagacagaagcaatttcagtgaagaagggtcaaaatcttgactggagtgggttcaagggaggaaagaccatagaatgaattgaaagt

SEQ ID NO: 42908 - DNA, 201 bp, Homo sapiens
cctgatgagctgttgaaaggtagtagctcttagattgagtataaaagtgacatctgtctcttttcaaagcctcagaacttttgtatgcatctgggaagctytgtcccctgcatagtttcaattacaatgagtattcttttcattttggatcttagcaaagacttttgccactgtgtggctgtgtgacagctgctgtacacc

SEQ ID NO: 42909 - DNA, 201 bp, Homo sapiens
caattgtagtagaaatacccctaagaggcaaaaggagatgggatctggtgcttaagaggaaggattggccttaggactgagacagaaaggacagaggaagraaggccatgggcatagactgagagagtgaatagatgttgagaaagtaagtagaagagctcttccagttgcttctatttgttaatgaaaggggaagaaagt

SEQ ID NO: 42910 - DNA, 201 bp, Homo sapiens
tgacattagataatcaaactcaggtaactgtaactagaggcaactagtaaatgtaccatgtcaacccaaaataatgtctgtgtagaatctaaaggacagaracattggtggcttatccaaagttccaaatcaaaaataaatttggattatactggattaaaattattaaatttggaataaaggtgattaaaatttggataa

SEQ ID NO: 42911 - DNA, 201 bp, Homo sapiens
tctttcatgaaatgtttggtgtttcttgggtgtcagtctaggtttgaatgaagcattaaaaggctgatttgcagatctgtttctaggccttgtcgattgayctgtttcattttggaatctccggggtgttaggacctagcactttgctggagaacctcaagctgagaataaagatatttttctctgcggcaggtcagtttt

SEQ ID NO: 42912 - DNA, 201 bp, Homo sapiens
agaaggaagggttaggaacaacatccttaccaagatgaagcagggaggctggagagtggaagatcgaggtcttctggtatcactttaaatcctttcttgarggatgagttgtttttccttttttataatgaataggtgcttgtaacaaatgatggcaaccatctgcccttgttaatataccccttggactgtcatatcaaa

SEQ ID NO: 42913 - DNA, 201 bp, Homo sapiens
gtcatatcaaaggaaaagattctgcacaattcttcatgccacaaatcaacgcatttgtagccttttctccacctctgacttatatctctcagaacggggcmaagacatacaggaaagttgttgaaagtgatgtttatgatgccgtaataaaaagatcccagatcacaatagtactaggtctgaaatcactgcaattcaatc

SEQ ID NO: 42914 - DNA, 201 bp, Homo sapiens
cccttatgatttagtattccatcctggggtgctatttctgactaatataagttggggaatctcatggtcactagtaataagctttcctcccctttcaaacwctgcattagtacctccaggggtcagctgcagagccagtttatcctcttgcgtggatgttctgcttcatgacttttgaaaatagtcacagaaaagtcaaga

SEQ ID NO: 42915 - DNA, 201 bp, Homo sapiens
aaagttgctctatattcataaatctggtgatgttacgcaatgtagttctaagccagaattaatgagaaagcatacctctgtttcctccttactctgcttgmttatgcattatataatcagttttcacattaagatgccttaatttgttagtcatcgcaaaatgcctcactcttggcaaccacagtgttggtatttctgaca

SEQ ID NO: 42916 - DNA, 201 bp, Homo sapiens
atgcattatataatcagttttcacattaagatgccttaatttgttagtcatcgcaaaatgcctcactcttggcaaccacagtgttggtatttctgacatamagtttcccaaatgttgtttttgaagaccattcatatatttttcacatttcatggttaattttaagaccttttaactccttgaactcagttaaattgcagg

SEQ ID NO: 42917 - DNA, 201 bp, Homo sapiens
ctacttacaaagagaaggctaattataaaggaacagcaaatgtcatagtgttttgaatccttttcatacataagacttccattctgcactgtggctacttkgggtcctcttccgagtgtagcatcttctgagtttctgttcctcagaagctaggttcttgcccactctttccttctccattatcatgctgaatgagaaaca

SEQ ID NO: 42918 - DNA, 201 bp, Homo sapiens
tcctatgagctcatcatctctaacttttatttagcttttagcactaatgcttcatagtgtcaagtgcattttgtgtgccattttgtctcctctatgctcayagtaagttttttgaaggtaggcactttgtctgattttttttttttttttgagacggagtctcattctgttgcccaagctggagtgcaatggtttgatatt

SEQ ID NO: 42919 - DNA, 201 bp, Homo sapiens
aaatttttacaaactaactgtgagctgaattgtaattccaccatacgttgattcgactgtttaacattttcactaaaaattaataagaaatgttgaggcayttaaatctcttaccttgctgcttttgccatctctctgggaacatttaccctgttggcagactctcagcaattttacattaatctcttcggtgataaagcc

SEQ ID NO: 42920 - DNA, 201 bp, Homo sapiens
tgtctgattttttttttttttttgagacggagtctcattctgttgcccaagctggagtgcaatggtttgatattggctcactgcaacctctgccttctggrttcaggcgattctcctgcctcagcctcctgagtagctgggattacaggcacccacccctatgcctggctaatttttgtatttttagtagagatggggttt

SEQ ID NO: 42921 - DNA, 201 bp, Homo sapiens
atgttgaggcacttaaatctcttaccttgctgcttttgccatctctctgggaacatttaccctgttggcagactctcagcaattttacattaatctcttcrgtgataaagcctgcatcaacaaccttcaggctaataaaagttagccttccagcaatagtggccaaggtgtacattgtacatagttgttggttttttattt

SEQ ID NO: 42922 - DNA, 201 bp, Homo sapiens
tctcttaccttgctgcttttgccatctctctgggaacatttaccctgttggcagactctcagcaattttacattaatctcttcggtgataaagcctgcatyaacaaccttcaggctaataaaagttagccttccagcaatagtggccaaggtgtacattgtacatagttgttggttttttattttgtttttgttttgtttt

SEQ ID NO: 42923 - DNA, 201 bp, Homo sapiens
gttggcagactctcagcaattttacattaatctcttcggtgataaagcctgcatcaacaaccttcaggctaataaaagttagccttccagcaatagtggcyaaggtgtacattgtacatagttgttggttttttattttgtttttgttttgttttgttttggtgcacttaaaaccctggagaccaagaggggatatgagag

SEQ ID NO: 42924 - DNA, 201 bp, Homo sapiens
gttttgttttggtgcacttaaaaccctggagaccaagaggggatatgagagtagagatcaatgctttatacctcaagacttacttcttctgccttatgaarttatttttaactaatataaatgttttaagaggtttaaaaagaaaatgacatttgatatgggttggctgtgtcctcaccaaaatctcagcttgaattgtat

SEQ ID NO: 42925 - DNA, 201 bp, Homo sapiens
gtattttatttattttgttcattgatacttgctttttgttcccaataacgacatggtgaggcttgaacttagacgtgagagctattttttatttcagtctyggctagaagagcaatctacctcagaaaatagaggcgaggagtcaggtgctttatgttcttcctctctgtaccctcatcctctgaagccaaagttacactc

SEQ ID NO: 42926 - DNA, 201 bp, Homo sapiens
ctgccttatgaaattatttttaactaatataaatgttttaagaggtttaaaaagaaaatgacatttgatatgggttggctgtgtcctcaccaaaatctcarcttgaattgtatctcccagaatccccacgtgttgtgggagggatttgaatcatagggggcggtctttcccatgctattctcgtgatagcgaatcagtctc

SEQ ID NO: 42927 - DNA, 201 bp, Homo sapiens
caggacagaagtagcaggaagatagaccttgtggagagttccatcttggcagtgtgttgtggtattagctgagcccatgttttccacttgttgcatttggrtttcctagttttacatttcatattgtaacatttggcagattttaaataacttgtacaatgtatagaaattctcaaaggactgatgttttgtaaaacttct

SEQ ID NO: 42928 - DNA, 201 bp, Homo sapiens
atctcagcttgaattgtatctcccagaatccccacgtgttgtgggagggatttgaatcatagggggcggtctttcccatgctattctcgtgatagcgaatmagtctcacaagaaccgatgggtttatcaggggtttgtctcttgccaccaccatttaagaagtgccttttgcctcccgccatgattctgaggcctcccagc

SEQ ID NO: 42929 - DNA, 201 bp, Homo sapiens
gtttccataggatttttttaaaattcaagaatatttgcatatacttttctttaggcaaggaattattgattcaatacttattaaaagacagaaggcaaagsattatacattctccacagctcaaaaatgttcccatgattttcttgtgaaattgatcaataacaaaagcttgtcagtaattaaattgtttgctcctttatt

SEQ ID NO: 42930 - DNA, 201 bp, Homo sapiens
gctgaatccgacagatcagaattcaaattctgtctcatgtgattacacctcaatttctttacctataaaatgggttaagaccaaactccctgcactgtgcraagcctctaaaatctctctctatgcccctcacacagtgtggcccttatatgaactcatgcttttttgtttttgtaaggattaaatagttgcagctgaata

SEQ ID NO: 42931 - DNA, 201 bp, Homo sapiens
tatttattttaagatcttggtctatgctagcatattggatggcttatcctttttcgtggaattctcgtctatctaatgttatgtgtatggagccccttgcytcatcattaaaggtgagggaagtgttctcatattgtcaaaagtcaccaagagcaatctcataacctagaaaaatcgacagacagctgagccaaataggca

SEQ ID NO: 42932 - DNA, 201 bp, Homo sapiens
cagcttgaattgtatctcccagaatccccacgtgttgtgggagggatttgaatcatagggggcggtctttcccatgctattctcgtgatagcgaatcagtmtcacaagaaccgatgggtttatcaggggtttgtctcttgccaccaccatttaagaagtgccttttgcctcccgccatgattctgaggcctcccagccatg

SEQ ID NO: 42933 - DNA, 201 bp, Homo sapiens
atgagacatccattgtcccagcccatgtaaccctttcaggtctaccactgtttccatgacaagtttgtggcacggggctatggtgagatttgaaacactgktctgggcttactggatgacattttctctgaagtcttttttatccatattggattgtcaaggagtagggcaagttagtactgattatggaatcataaactt

SEQ ID NO: 42934 - DNA, 201 bp, Homo sapiens
aatttatcctcaaaattgtgctgggacatgaagtattgttcccattttacagatgaggaaactgataccatgccgtgctaccaggctaaccaaaactgcascccaggtttatttaacttcaggtctagtggattcgaagtctacgatctccctcctacaccatgaaatcaaagtaagtcttccacgaacagacttaatttg

SEQ ID NO: 42935 - DNA, 201 bp, Homo sapiens
gcagaatgaaaatagtgatatgaatggtctaacatgactgatctaattgtttagtatcaaaaaatatatatttcagttggtttatgaataataattatagstataatttattcagtatttactatgtacgaggcactgtactgagcacttaatataccaaactctaacaaaaacacactaagaactcattaattcacttaa

SEQ ID NO: 42936 - DNA, 201 bp, Homo sapiens
cagtgatggactgcatataggataatggtcccctaagaaggctataatggaactgaaaaattcctatcacctaatgacattgtattatttgttctcacatycctataaagcactacctaagactgggtaatttataaataaaagagacttaattggcacacagttccacaggctgtacaggaagcatggctggaggggcct

SEQ ID NO: 42937 - DNA, 201 bp, Homo sapiens
tggtctaacatgactgatctaattgtttagtatcaaaaaatatatatttcagttggtttatgaataataattatagctataatttattcagtatttactaygtacgaggcactgtactgagcacttaatataccaaactctaacaaaaacacactaagaactcattaattcacttaaccaatattagttgccataggcctt

SEQ ID NO: 42938 - DNA, 201 bp, Homo sapiens
ccatggtggccaggatggtctcgatctcttgacctcgtgatctgcctgcttccgcctcccaaagtgctgggattacagatgtgagccactgtacccaaccratatatatatatttttcattttattttcctctttctcacacacatacacggacaatatgagttttaaataattagactatatatatatacatatatgcac

SEQ ID NO: 42939 - DNA, 201 bp, Homo sapiens
agtaaaggcctctctctgctccttaatgatgcttttattgtaaaatcttgcatttttttaattttaatttttcttctcaaaactttcttttacctgaagcytactgttgtttcaccatcttatatccttcagctcagttaagactaagtttccatttcctaatttaagttggccaagaacattaaattagcaggtgtttgt

SEQ ID NO: 42940 - DNA, 201 bp, Homo sapiens
taattttaatttttcttctcaaaactttcttttacctgaagcctactgttgtttcaccatcttatatccttcagctcagttaagactaagtttccatttcytaatttaagttggccaagaacattaaattagcaggtgtttgtgttattttgtttcctaatagaacatgaagctgcccaatgaccagtgaagcaattggta

SEQ ID NO: 42941 - DNA, 201 bp, Homo sapiens
attgtttactgttatatctccagcacctagaataatgccctaaatgtagtaagtgctaggtaaatatcaatgaatgcatgaatgaatgaatgcaataatayggcatgccattttgtgattttgcagtgaaaagcattttttccttacccttatttttttctccttcctccgactgaaagtggatgtatttgggggtatatg

SEQ ID NO: 42942 - DNA, 201 bp, Homo sapiens
attttcttttctcttctaaaactcttattaagatgaatgttggtctgtctggatgagtcttgtggcttttaatttttgtctcatactttgcatatcctttycattctgtgagaatttttggctttcttttctggtcactgattttgatgttagctattttcattccgctctttaagtcttcaactgtctagtttttatttt

SEQ ID NO: 42943 - DNA, 201 bp, Homo sapiens
  misc_feature (1)...(201): n = A,T,C or G, or insertion/deletion polymorphism (see Tables 1-2)
tctgtctggatgagtcttgtggcttttaatttttgtctcatactttgcatatccttttcattctgtgagaatttttggctttcttttctggtcactgattntgatgttagctattttcattccgctctttaagtcttcaactgtctagtttttatttttgcaataccattttaaatttccaagaataccagtggtgttttc

SEQ ID NO: 42944 - DNA, 201 bp, Homo sapiens
gttcttcctctctgtaccctcatcctctgaagccaaagttacactccataaaaataacacagaatgtgagagctaatagagcctcagtttatccttctttrtatctccccctggaatgtcctgggcagtgccttatttcccatttgcaaatgtgaggacaatatgcaattaagagcttcaaccttgtcattggtttggtgt

SEQ ID NO: 42945 - DNA, 201 bp, Homo sapiens
ttattcaccaccatgagagcagtatgggggaaaccacctctatgattcaattatctctcatcaggttcctcccacaatatctgggaattatgggagctacratttaagatgagtatgggagaggacacagccaaaccatatcagtcatgttagttttccgtctatcagctattctttttctttttttatttttccttttca

SEQ ID NO: 42946 - DNA, 201 bp, Homo sapiens
tacacaagtagaaatagagcaaagcccctttctccattcttttagtcaatgagcagtcaccagttgtatgagcaaatgggcaggtaagatcttggaacccrtgtgcataggttaattcactattctctcttagaatgaggaataggctgggcacagtggctcatgcttgtaataccggcaatttgggagactaaggcagaa

SEQ ID NO: 42947 - DNA, 201 bp, Homo sapiens
gcaaagcccctttctccattcttttagtcaatgagcagtcaccagttgtatgagcaaatgggcaggtaagatcttggaacccgtgtgcataggttaattcmctattctctcttagaatgaggaataggctgggcacagtggctcatgcttgtaataccggcaatttgggagactaaggcagaaggatcttttaagaccagg

SEQ ID NO: 42948 - DNA, 201 bp, Homo sapiens
acacctcttcttttttccgctttttacttcttttgtgtttgcatgcaaactctccaatgctggcacttaacggtagcctcactcattggctttgtcaaaawtatgtgataacacagaacattgacctcctctcttatattttcactgaggcagaataattcccccactgagttgttcaggaattttaaaaggtaatttatt

SEQ ID NO: 42949 - DNA, 201 bp, Homo sapiens
aataataacactatttactggccgtgtactaaaatttatgtaaaacatttaaacagaagattcagtaagtactcaataaacgtttactactacttcttctrttattcctatgacagatatgagccacgtcttccatattgaatctgcttttctgtaagtcccaacatttcggtggatggaattgagcctgaagttacttaa

SEQ ID NO: 42950 - DNA, 201 bp, Homo sapiens
ttccctctacacactgctttaaatgtgtcccagatattctagtatgttatgtctttgttctcgttggtttcaaagaacatctttatttttgccttcatttygttatgtacccagtagtcattcaggagcaggttgttcagtttccatgtagttgagcagttttgagtgagtttcttaatcctgccttctagtttgattgca

SEQ ID NO: 42951 - DNA, 201 bp, Homo sapiens
attgagcctgaagttacttaatacttgtatatactttctgccatttacctatcactgctcctaaaattgtgtacttatccaacttaagatgagttttgagrcttcaatgctctttggcaattcttctgtaattcctagttatctccctcagtgtctctgcagtgctttcacccgcttcaccctctcaaacctaaaatcctg

SEQ ID NO: 42952 - DNA, 201 bp, Homo sapiens
atgttagggtgtcaattttggatctttcctgctttctcttgtgggcatttagtgctataaatttccctctacacactgctttaaatgtgtcccagatattmtagtatgttatgtctttgttctcgttggtttcaaagaacatctttatttttgccttcatttcgttatgtacccagtagtcattcaggagcaggttgttca

SEQ ID NO: 42953 - DNA, 201 bp, Homo sapiens
cttaatacttgtatatactttctgccatttacctatcactgctcctaaaattgtgtacttatccaacttaagatgagttttgagacttcaatgctctttgrcaattcttctgtaattcctagttatctccctcagtgtctctgcagtgctttcacccgcttcaccctctcaaacctaaaatcctgccattccttccttact

SEQ ID NO: 42954 - DNA, 201 bp, Homo sapiens
ctgctctgatcttagttatttcttgccttctgctagcttttgaatgtgtttgctcttgcttttctagttcttttaattgtgatgttagggtgtcaattttrgatctttcctgctttctcttgtgggcatttagtgctataaatttccctctacacactgctttaaatgtgtcccagatattctagtatgttatgtctttgt

SEQ ID NO: 42955 - DNA, 201 bp, Homo sapiens
atcagaattgtcctcctactttgctgagaaaattgaagccactagactagagatgcatccttatcctatcaccagacttttaatcatactgcattcattcyatgttttcttcctttctgcccattatactggaatattccctcctggcagggcaaagcatgagtgaatctttccacctgtcttgcttctatcccagatacc

SEQ ID NO: 42956 - DNA, 201 bp, Homo sapiens
tgggatcggtggtgatatcccctttatcattttttattgcatctatttgattcttctctcttttcttctttattagtcttgctagcggtctatcaattttkttgatcttttcaaaaaaccagctcctgaattcattgattttttgaagggttttttgtgtctctatctccttcagttctgctctgatcttagttatttctt

SEQ ID NO: 42957 - DNA, 201 bp, Homo sapiens
agtttgtatttctgtgggatcggtggtgatatcccctttatcattttttattgcatctatttgattcttctctcttttcttctttattagtcttgctagcrgtctatcaatttttttgatcttttcaaaaaaccagctcctgaattcattgattttttgaagggttttttgtgtctctatctccttcagttctgctctgat

SEQ ID NO: 42958 - DNA, 201 bp, Homo sapiens
tggactttttttgttggtaagctattaattattgcgtcaatttcagagtctgttattggtgtattcagagattcaacttcttcctggtttagtcttgggarggtgtatgtgtagaggattttatccatttcttctagattttctagtttatttgtgtagaggtgtttacagtattctctgacggtagtttgtatttctgtg

SEQ ID NO: 42959 - DNA, 201 bp, Homo sapiens
agaaggaatgataccagctcctctttgtatctttggtagaaatcggctgtgaatccgtctggtcctggactttttttgttggtaagctattaattattgcstcaatttcagagtctgttattggtgtattcagagattcaacttcttcctggtttagtcttgggagggtgtatgtgtagaggattttatccatttcttcta

SEQ ID NO: 42960 - DNA, 201 bp, Homo sapiens
aagctttttgatgtgctgctggattcagtttgccagtattttattgaggatttttgcattgacgttcatcagggatattggtctaaaattctcttttttgsttgtgtctctgccagctttggtatcaggatgatgctggcctcataaaatgagttagggaggattccctctttttctattggttggaatagtttcagaagg

SEQ ID NO: 42961 - DNA, 201 bp, Homo sapiens
gtgtatgttgaaccagccttgcatcccagggatgaagccaacttgatcgtggtggataagctttttgatgtgctgctggattcagtttgccagtattttaytgaggatttttgcattgacgttcatcagggatattggtctaaaattctcttttttgcttgtgtctctgccagctttggtatcaggatgatgctggcctca

SEQ ID NO: 42962 - DNA, 201 bp, Homo sapiens
taaattttgtataaggtgtaaggaagggatccagtttcagctttctacatatggctagccagttttcccagcaccatttattaaataaggaatcctttccycatttcttgtttttgtcaggtttgtcaaagatcagatagttgtagatgtgtggtattatttctgagggctctgttctgttccattggtctgtatatctgt

SEQ ID NO: 42963 - DNA, 201 bp, Homo sapiens
cctgagttctgttacaattcccacagaggttcttaagctacagttcatggggattcatatgtagaattcagggtgtctgtggacttggatgagaaaaatamatagttctttattttataaagttctatctgaaatttatcactttagttattaatattattaaatacaaaccacagtgcataagatacctaagactttgtc

SEQ ID NO: 42964 - DNA, 201 bp, Homo sapiens
gaactgacagttgtagtgactggaagtggcccaagatagcttagatatccaatggatctatgcttggaagaatggtgacatcatatcttcagtaggagggygtattagtctgttctcacactgttaataaagacatacctgagactggataatttatagaggaaagaggtttaattgattcacagttccacatggctaggg

SEQ ID NO: 42965 - DNA, 201 bp, Homo sapiens
  misc_feature (1)...(201): n = A,T,C or G, or insertion/deletion polymorphism (see Tables 1-2)
actgagccttccaaatcacgtagctgatcgtggatgaatcttttggtttctttcaggttgacttggactctgcttagttcccatcacctgataagaactcncctttaaacatgtgaaatggaggatataattgcaattaaagtaaagcctgataatttaggttgattattgacatctaatcagtttggactaaatgcaagt

SEQ ID NO: 42966 - DNA, 201 bp, Homo sapiens
aggatccaaaagagcaatgtctaaaagcttcagagtaaaaggaaaaaatggaaagcacatgtaccctaaaacttaaagtataataataaaaaaataataawaaaaaaagaatagacataaggtgcctgccaatactctgactcctctccaagcctactataagccaatcaattggcatatgtcatgtcctgcagatggaaa

SEQ ID NO: 42967 - DNA, 201 bp, Homo sapiens
aaggaggtgtagtatctctacaagaaaaataaaacacggctgaaagaaattgtagatgacaaaagcaaatggaaatacattctttgctcatgggttagaasaatcaatatcatgaaaatgaccatacactccaaagcaatctacagattcaatgcaatttctatcaaattaccaacactattttttacagaattagaaaaa

SEQ ID NO: 42968 - DNA, 201 bp, Homo sapiens
aaaaagaatagacataaggtgcctgccaatactctgactcctctccaagcctactataagccaatcaattggcatatgtcatgtcctgcagatggaaaagsagtatgtgcaaacatgtactgtacagatgcatggatctgctctgcagctgctggaggttatatttgttaagcagcctgacaatatccatgagttttgaaa

SEQ ID NO: 42969 - DNA, 201 bp, Homo sapiens
  misc_feature (1)...(201): n = A,T,C or G, or insertion/deletion polymorphism (see Tables 1-2)
gtaccttttcttttcttctttgtcgatgaattgttttctgggagaactccacaggaataacaattgacataaacctcggaaatgacaggaactattcaaangtttgtttaaattttgcagatttgttgtcatttaggcttggaatcataagcctcatggacatagaaggtgggacacacatgatgttactgagaaattaag

SEQ ID NO: 42970 - DNA, 201 bp, Homo sapiens
  misc_feature (1)...(201): n = A,T,C or G, or insertion/deletion polymorphism (see Tables 1-2)
atttaggcttggaatcataagcctcatggacatagaaggtgggacacacatgatgttactgagaaattaagatttaatatacttaaaaatattggggcatntactttagttttaatgacaatcttattgtgtataaaaatcatctgtattttctctaagttcaatgtagacagaataagttaatcaccattgcgtctatat

SEQ ID NO: 42971 - DNA, 201 bp, Homo sapiens
tatggtaagattaattcaatataatattcaatatcacaacaaaatcaacagattcctggaggtgcttatgttactattcttttatacagagattgtgaaartaggagaatccttcaaagtttatcatattattgatataaaaagataaaaaactgaaagaattcatgatgtgtggtgctgtgcataggctggtttgcttaa

SEQ ID NO: 42972 - DNA, 201 bp, Homo sapiens
ttttcttccagggtttttatggttttaggtctgacatttaagtccttaatccatcttgaattaaattttgtataaggtgtaaggaagggatccagtttcarctttctacatatggctagccagttttcccagcaccatttattaaataaggaatcctttcctcatttcttgtttttgtcaggtttgtcaaagatcagatag

SEQ ID NO: 42973 - DNA, 201 bp, Homo sapiens
tcccaagtagctggaactacaggcacctgccaccactacgcccggctaattttttgtatttttagtagagatggggtttcactgtgttagccaggatggtmttgatctcctgacctcgtgatccacctgccttggcttcccaaagtgttgggattacaggcgtgagccaccgcacctggcgtatcccagaacttaaagtat

SEQ ID NO: 42974 - DNA, 201 bp, Homo sapiens
cgcaatctctgctcactgcaagctccacctcccgggttcatgccattctccttcctcagcctcccaagtagctggaactacaggcacctgccaccactacrcccggctaattttttgtatttttagtagagatggggtttcactgtgttagccaggatggtattgatctcctgacctcgtgatccacctgccttggcttcc

SEQ ID NO: 42975 - DNA, 201 bp, Homo sapiens
ttttttctgtgagatggtctcgctctgtcacccaggctggagtgcagtggcgcaatctctgctcactgcaagctccacctcccgggttcatgccattctcyttcctcagcctcccaagtagctggaactacaggcacctgccaccactacgcccggctaattttttgtatttttagtagagatggggtttcactgtgttag

SEQ ID NO: 42976 - DNA, 201 bp, Homo sapiens
catcaaacaaccatgtcacaagtatgcctatgtaacaaagctgcatgttctgcacatgtataccagaactttttttttttttttttctgtgagatggtctygctctgtcacccaggctggagtgcagtggcgcaatctctgctcactgcaagctccacctcccgggttcatgccattctccttcctcagcctcccaagtag

SEQ ID NO: 42977 - DNA, 201 bp, Homo sapiens
atgagttgatgggtgcatcaaacaaccatgtcacaagtatgcctatgtaacaaagctgcatgttctgcacatgtataccagaactttttttttttttttttctgtgagatggtctcgctctgtcacccaggctggagtgcagtggcgcaatctctgctcactgcaagctccacctcccgggttcatgccattctccttcct

SEQ ID NO: 42978 - DNA, 201 bp, Homo sapiens
aggagaaatacctgatgtagatgatgagttgatgggtgcatcaaacaaccatgtcacaagtatgcctatgtaacaaagctgcatgttctgcacatgtatamcagaactttttttttttttttttctgtgagatggtctcgctctgtcacccaggctggagtgcagtggcgcaatctctgctcactgcaagctccacctccc

SEQ ID NO: 42979 - DNA, 201 bp, Homo sapiens
catcattctcagcaaactaacaaaggaacagaaaaccaaacaccctatgttctcactaataaatgggaattgaacaatgagaacatatgggcacagggaarggaacatcacataccctgttgggggttgggggcaagggtagggatagcattaggagaaatacctgatgtagatgatgagttgatgggtgcatcaaacaac

SEQ ID NO: 42980 - DNA, 201 bp, Homo sapiens
gcccatcaatgatagactggctcaagaaaatgtggcacatatacaccatagaatactatgcagccataaaaaaggatgagttgctgtcctttgcagggacrtggatgaagctggaaaccatcattctcagcaaactaacaaaggaacagaaaaccaaacaccctatgttctcactaataaatgggaattgaacaatgagaa

SEQ ID NO: 42981 - DNA, 201 bp, Homo sapiens
tgggagtgtaaattagttcaaccattgtggaagacaatgtggcaattcctcagggatctaaaaccagaaatgccatttgacccagcaatcccattagtggrtatatacccaaaggatcataaatcattctactataaaaacacatgtacacatatttttattgcagtactattcacaatagcaaagacttggaaccaaccc

SEQ ID NO: 42982 - DNA, 201 bp, Homo sapiens
gacgttactaccttaggtgaaatgagtgaaatcagatgagtgaaatttttatcactgttctggtttaaccatcattacagtattagggccatttaaatgtwatatgttcattacttacaagatttttaaaggagtctgtatgtattatatttaattgataagtatattgagtatctctaaaatattttctttttttctgtt

SEQ ID NO: 42983 - DNA, 201 bp, Homo sapiens
acgttactaccttaggtgaaatgagtgaaatcagatgagtgaaatttttatcactgttctggtttaaccatcattacagtattagggccatttaaatgtamtatgttcattacttacaagatttttaaaggagtctgtatgtattatatttaattgataagtatattgagtatctctaaaatattttctttttttctgttg

SEQ ID NO: 42984 - DNA, 201 bp, Homo sapiens
ctaccaccaaaattaggtgtagggaaccccctttatgtttcagtgactatttgatttgagtgactcagccagaagttgagagaggacacacacgtacacamtcttccgtgggtttcctgctgtaaaggccagctgcgtctcagccagcaaaagcttaatcaacacacaggaggtgatcctaggatgatcaggagccttggc

SEQ ID NO: 42985 - DNA, 201 bp, Homo sapiens
ttacctatataacaaacctgcacaggtactccgacttaaaaggtttaggaaaattatgtttagtttttaaaatttgaattaaaacaattttaaatattcarttgacaaagaaggtatatattaaaggtacacaatgtgatgatttgatatacatgtgcattgtgtaatgattaccccaatcatattaattaacataccaat

SEQ ID NO: 42986 - DNA, 201 bp, Homo sapiens
tcagatgatcactgttggctttaaaaggaagagacgtctagttgacttatttgaaggaaagcttttctgagtggaatcagaccaaagctgaggccttttakgtttcttgtgctttggctaggtatgccgttagcctctgtctctgactgaaagtgctgcagtgaagccacatactcctgttcaaaggggagattaacactt

SEQ ID NO: 42987 - DNA, 201 bp, Homo sapiens
  misc_feature (1)...(201): n = A,T,C or G, or insertion/deletion polymorphism (see Tables 1-2)
tactgttttacaaggttacaacatttaaagatagcattcaagtattcatgaaactaggtataggaggagagagaaacatatgagcaagtgattgccttacntagtgataattcagtaaacatgtacagctatggagaaaggtaaaaggggaacgtgatcaactccatttggggaaagggtcatgaagggctttacattttg

SEQ ID NO: 42988 - DNA, 201 bp, Homo sapiens
caaacctgcacaggtactccgacttaaaaggtttaggaaaattatgtttagtttttaaaatttgaattaaaacaattttaaatattcaattgacaaagaakgtatatattaaaggtacacaatgtgatgatttgatatacatgtgcattgtgtaatgattaccccaatcatattaattaacataccaattaccatctatgt

SEQ ID NO: 42989 - DNA, 201 bp, Homo sapiens
tccgacttaaaaggtttaggaaaattatgtttagtttttaaaatttgaattaaaacaattttaaatattcaattgacaaagaaggtatatattaaaggtayacaatgtgatgatttgatatacatgtgcattgtgtaatgattaccccaatcatattaattaacataccaattaccatctatgttgtacattagatcccca

SEQ ID NO: 42990 - DNA, 201 bp, Homo sapiens
catctatgttgtacattagatccccagaacttatttatcttataactgaaagtttgcccccactggtcaacatctccccatttcccacaccctctcatctktggcaactgctgcttcactctgtttttatgatttatgtaaaatcaaaacagtttgattttacatataagtggtatcatattgtatttgtctttctgtgtt

SEQ ID NO: 42991 - DNA, 201 bp, Homo sapiens
attcagttttcccagcaccatttattgaagagactattctttccccattgtgcttttacagaatattagttgactgtatatgtgtgggtttattcctgggytcttaattctattcaaatggtgtttgtgtatgtttttatgctagtactatactgttttgattgctatagctttgtaatgtactttgaaatcaggaagtgt

SEQ ID NO: 42992 - DNA, 201 bp, Homo sapiens
agcttgttatcactgatcattagagaaatgcaaatcaaacccacaatgagataccatttcatgccagttagaatggcaatcattaaaaagtcaggaaacarcagacggtggaaaggatgtggagaaataggaacacttttatactgttggtgggagtgtaaattagttcaaccattgtggaagacaatgtggcaattcctc

SEQ ID NO: 42993 - DNA, 201 bp, Homo sapiens
atatccagaatctataaagaacttaaatgaatttacaagagaaaaacaaccccatcaaaaagtgggcaaaggatatgaacagacacttctcaaaagaagayatttatgcagccaacaaacatgaaaaaaagcttgttatcactgatcattagagaaatgcaaatcaaacccacaatgagataccatttcatgccagttaga

SEQ ID NO: 42994 - DNA, 201 bp, Homo sapiens
taccatcagaggaaacaggcaacctacagaatgggagaaaatttttgcaatctatccatttgacaaagggctaatatccagaatctataaagaacttaaaygaatttacaagagaaaaacaaccccatcaaaaagtgggcaaaggatatgaacagacacttctcaaaagaagacatttatgcagccaacaaacatgaaaaa

SEQ ID NO: 42995 - DNA, 201 bp, Homo sapiens
aggcatgggcaaggacttcatgactaaaacaccaaagcaatggcaacaaaagccaaaattgacaaatgggatctaattaaactaaagagcttctgcacggygaaagaaactaccatcagaggaaacaggcaacctacagaatgggagaaaatttttgcaatctatccatttgacaaagggctaatatccagaatctataaa

SEQ ID NO: 42996 - DNA, 201 bp, Homo sapiens
atgtgcagaaaactgaaactggattccttccttacacctaatacaaacattaactcaagataaattaaagacttaaaggtaagacctaaaaccataaaagycctagaagaaaacctaggcagtaccattcaggacataggcatgggcaaggacttcatgactaaaacaccaaagcaatggcaacaaaagccaaaattgaca

SEQ ID NO: 42997 - DNA, 201 bp, Homo sapiens
atttaataaaagctgttgggaaaactggctagccatgtgcagaaaactgaaactggattccttccttacacctaatacaaacattaactcaagataaattraagacttaaaggtaagacctaaaaccataaaagccctagaagaaaacctaggcagtaccattcaggacataggcatgggcaaggacttcatgactaaaac

SEQ ID NO: 42998 - DNA, 201 bp, Homo sapiens
ggctgcagtaacaaaaacagcatgatactgttaccaaaacagatatatagaccaatggaacagaacagaggcctcagaaataacaccacacatctacagcyatctgatctttgacaaacctgacacaaacaagcaatggggaaaagattccctatttaataaaagctgttgggaaaactggctagccatgtgcagaaaact

SEQ ID NO: 42999 - DNA, 201 bp, Homo sapiens
gctcctttctttctctcaggagtaactcaagggcttgcaatgcgtgaacgagtgctcttaaagtaatagggaaagggtactgaaccaaaaaaaaaaaatasttctacctttaaggtgcagtgatgtgaagttgaaataccactgtggctcagagaagttttatgcaagaaggttctcaaaagatatttctggattgcatgc

SEQ ID NO: 43000 - DNA, 201 bp, Homo sapiens
cttcaaactacactgcaaggctgcagtaacaaaaacagcatgatactgttaccaaaacagatatatagaccaatggaacagaacagaggcctcagaaatarcaccacacatctacagccatctgatctttgacaaacctgacacaaacaagcaatggggaaaagattccctatttaataaaagctgttgggaaaactggct

SEQ ID NO: 43001 - DNA, 201 bp, Homo sapiens
aatatgagaagccttcagaagacaaacatggagtgacaactttgatagagaagcagatcttgatatataaaaggtaatcgactaggaatatatatatatattatatatatatatagagagagagatttatacatacatatccaactggatatataaatctatatatagatctatctatctatctatctatctatctatatc

SEQ ID NO: 43002 - DNA, 201 bp, Homo sapiens
aagttcatatggaaccaaaaaagagcccatatagccaagacaatcctaagcaaaaagaacaaagctggaggcataatgctacctgtcttcaaactacactrcaaggctgcagtaacaaaaacagcatgatactgttaccaaaacagatatatagaccaatggaacagaacagaggcctcagaaataacaccacacatctac

SEQ ID NO: 43003 - DNA, 201 bp, Homo sapiens
atgagaagccttcagaagacaaacatggagtgacaactttgatagagaagcagatcttgatatataaaaggtaatcgactaggaatatatatatatattatatatatatatagagagagagatttatacatacatatccaactggatatataaatctatatatagatctatctatctatctatctatctatctatatctat

SEQ ID NO: 43004 - DNA, 201 bp, Homo sapiens
gaaaaaactactttaaagttcatatggaaccaaaaaagagcccatatagccaagacaatcctaagcaaaaagaacaaagctggaggcataatgctacctgwcttcaaactacactgcaaggctgcagtaacaaaaacagcatgatactgttaccaaaacagatatatagaccaatggaacagaacagaggcctcagaaata

SEQ ID NO: 43005 - DNA, 201 bp, Homo sapiens
aaaaggtaatcgactaggaatatatatatatattatatatatatatagagagagagatttatacatacatatccaactggatatataaatctatatatagatctatctatctatctatctatctatctatatctatatctatatatatatatatatatacatgtatccagtcattggctggaaaggagcagaactgaaact

SEQ ID NO: 43006 - DNA, 201 bp, Homo sapiens
aaaggtaatcgactaggaatatatatatatattatatatatatatagagagagagatttatacatacatatccaactggatatataaatctatatatagatctatctatctatctatctatctatctatatctatatctatatatatatatatatatacatgtatccagtcattggctggaaaggagcagaactgaaacta

SEQ ID NO: 43007 - DNA, 201 bp, Homo sapiens
tctgtttactaaaaaatataaaattaaaataaaaccagggatttttatatatcttcttttgtctctaaaattaatggtttgggattaaattcacgactccyatttaccaaaaactcacattgacaatgcatttacaaatagctaatctcttccagtggattttgcttatttaactcttagagtacaaacttattttaggtt

SEQ ID NO: 43008 - DNA, 201 bp, Homo sapiens
aaggtaatcgactaggaatatatatatatattatatatatatatagagagagagatttatacatacatatccaactggatatataaatctatatatagatctatctatctatctatctatctatctatatctatatctatatatatatatatatatacatgtatccagtcattggctggaaaggagcagaactgaaactac

SEQ ID NO: 43009 - DNA, 201 bp, Homo sapiens
aggtaatcgactaggaatatatatatatattatatatatatatagagagagagatttatacatacatatccaactggatatataaatctatatatagatctatctatctatctatctatctatctatatctatatctatatatatatatatatatacatgtatccagtcattggctggaaaggagcagaactgaaactact

SEQ ID NO: 43010 - DNA, 201 bp, Homo sapiens
tggattgcatgcatcagaattattttaccaaatatctagggacagagcctggtaactgcagcataattagctttgaagagcatttacatgtgcatactaaracttgggaaccactcagagagggtgagatcagtttcatctaagcatggaagaatttttagaagaggtggttaatctagttgttggagaatagggatgacc

SEQ ID NO: 43011 - DNA, 201 bp, Homo sapiens
agaggtcagataaattgcccaaggacacacaagcaaagttaattttgaatggaggttggtccgacttcagaatttgggcacctacccattgtacaacaagwctttaccctgtgctaaacacaggataagacccaatcagttctttcctcaaggaagaaacaaattgacacatcagagataacaataattatgttatgtgtt

SEQ ID NO: 43012 - DNA, 201 bp, Homo sapiens
gatcacctaggatgcatttccttaaaagttgcagaaaaattatggggtaaaaggcaaaacataactcttccttgaataaataatacaaaccagtatattayctttgcaaaaataatgactgttaagagtgtaccacctttagtgtgaatattattaaagtaataaaattgaaaatacctaaaagaaagtaaagctgctcta

SEQ ID NO: 43013 - DNA, 201 bp, Homo sapiens
aataatattatattcattctggtaaacaaagaaagcattttgtctatttgattccaaaataattagttgattaatacttgaatctaaaagagtaataaacrtttggtccataattatcttttttaaaatttaagaatttgaatttttaattactttgtatttttataagtaatatgaaatgaagcctagttattaaaaaat

SEQ ID NO: 43014 - DNA, 201 bp, Homo sapiens
cgagaattttttaaagtttattgtaaacacagtattttggcaatagaaaatacactcggagagtataaaaatatgttatatctttgtttatggaaacaatyagtattttgaaatttaaatcttggcatttaagtagttaccataaaaaagtattcattgcaggttttcaaaaatgtatgcaactaattatatttagtaaaa

SEQ ID NO: 43015 - DNA, 201 bp, Homo sapiens
aatatgatatagaagcaaacacatttagaattcatgttgaagaggaggagctaacaaaggagattggcaagaaataactgggaaagatagaaaaccgagaracggctgtctcagaaactaaggcaagtgtatttaaattgtgcacaatataacttagaagacttaaaaagataacaagaaaatatgttcattgcatctggg

SEQ ID NO: 43016 - DNA, 201 bp, Homo sapiens
actttcaatccccaaatatttatcagaatgtaatgtaacacaatgataagtataagattttatatataaacacacacacatatacttatttacatacttamacacctctacctatataaaatacatatacatatctataatcttatacataagattatatactaggaagatcttataatatcttcacagtgtgtttgtgtg

SEQ ID NO: 43017 - DNA, 201 bp, Homo sapiens
tgcaactaattatatttagtaaaagaatacatttaaaggaaataataagtggaattgttgagaataacttgaatgattctaaaacaggctaagagtttttyattagtttcactttctaattttatctatagttcactttaattgcacagttaagttacttcttaggatttccaccaagtccaaccctcttctacctccaac

SEQ ID NO: 43018 - DNA, 201 bp, Homo sapiens
tcactggagtaaaaatcaaattgttggaggaatgcattattttctggagtctctagggaagagtccattatttttgccttttccagtttctagaggtcacyctcattccttggctcatggccctctgcctccatcttctaagccagcaacgtcatgtttctctgaccctgcttccaacctcacatctctttctctgaccac

SEQ ID NO: 43019 - DNA, 201 bp, Homo sapiens
ttgttgggacagtctttcagaaaataaacatataaggaaacatataaagaaaggcagattggcagagaagccaacttacaatggaaatcttagctgtcctrtggggagtgttggagctgggatggcctttcagaattgtctcatattgaaacgggggaatggacccttagaattcctgcaactgtcaatcattgatggcat

SEQ ID NO: 43020 - DNA, 201 bp, Homo sapiens
ttgctatctaaaacctgtagagaatattaatcttttcaataaattgggcagccaaatcaagattacaatgtcaaataaaatatggcatgaaccttcttttrgcatcaggtccaagtagagaccatcttaacttcttaacatgtagcttcctcgtgccattctcttaagagagagagaaaataaaatcttctcattaaaact

SEQ ID NO: 43021 - DNA, 201 bp, Homo sapiens
tgatcatcagagacgattataaatattgatatactcacacactagaaaacctagaagaaatggagaaattcctggaaacataccacctgccaagattgaascaggaaagaatagaaaacctaaacagaccaataattagtagcaatattgaattagtaataaaaaaactcccccaaaagaaaagcccaggaccagatggat

SEQ ID NO: 43022 - DNA, 201 bp, Homo sapiens
ggtcaggctggtctcgaactcccaacctcaggtgaaccgcctgtctcagcctcccaaagtgctgggattatgggcgtgagccactgcgcctggcctagaartaccaaaatatttactttgaatatgcttatatgtctcacataagatttagcaagaagcaattaaaatgcctgaaaaccatttaatggtacaaaaaccatg

SEQ ID NO: 43023 - DNA, 201 bp, Homo sapiens
cttttagattttaaaagtcaggcttctctatgtgctcaaatgaatctgacttactttataagaagaagggcttggcattctgatggagtcctggaaatagrttcttggagacacagctatgtattggtcttcctacatttgtctctgtgattgtggattatgatgcaggtggactttgctcctttcccctgtgctatgcag

SEQ ID NO: 43024 - DNA, 201 bp, Homo sapiens
ggcagattgctcaggatcaagttagtgaataatgaaaggccattagaagttagtatccaataacagtgatattacagggatcatgagctatgtttgaaggygtgtaaagagcccatgcaggttgttatgtttttttgttgttgttgttttatggagatagacagggtcttgatctgttgcccaggctcaagtgcagttggg

SEQ ID NO: 43025 - DNA, 201 bp, Homo sapiens
ttaaaaaattcaagactgtggtagcagagcatgaaaacccaagcctgggacccctgtctaaaattgggatcctatgtgcagtagcaggtccctgaagctgsccctgtgtataataaacacatatcacatcaaaataatggtgattttatggttttcttaaactgagcaaattggactgaactaatgaatattgtaattaag

SEQ ID NO: 43026 - DNA, 201 bp, Homo sapiens
tatttatggatcattggctcatgggaatgctagtctagagatttaaaaagtgtgattttctgattcttgtttggatactggattttaagtgagatggtacwgcggggtggaactccggagtttagcaaagttgcaaatctaatggaaagtgacagataattgaggctgcagaatttttgaaggtgaacaggactgttagcc

SEQ ID NO: 43027 - DNA, 201 bp, Homo sapiens
gataagcatgaaaactgaaagtgattaattcatcaaaacctgtgagtcttttaggtgaaggggacttcagagattggcttaaattttgcaaatctgttgcrtccagccagagcagttccgcaatgagaaatgaatgcagcttatgtttgtctcaggctcagtccacacaaccatatgactcctctgagtctaaataaattc

SEQ ID NO: 43028 - DNA, 201 bp, Homo sapiens
atagtgtttatttatggatcattggctcatgggaatgctagtctagagatttaaaaagtgtgattttctgattcttgtttggatactggattttaagtgasatggtacagcggggtggaactccggagtttagcaaagttgcaaatctaatggaaagtgacagataattgaggctgcagaatttttgaaggtgaacaggac

SEQ ID NO: 43029 - DNA, 201 bp, Homo sapiens
cattatatcaatactagtcttccctagtctctttggtggaatcattatcaatcctttcatttcgaatccattatagacagcatccctcatacactttaagytctgtgcaggcagatcacatgtctgttttgtttagttttatcccaagcctcaggcacaatgcatagaatttagaaaaagctgaattgtatttttggatga

SEQ ID NO: 43030 - DNA, 201 bp, Homo sapiens
aatcaatatcttgaaaatggccatactgcccagggtaatttatagattcaatgctattcccattaagcaaccattgacttttttcacagaattagaaaaaactactttaaagttcatatggaaccaaaaaagagcccatatagccaagacaatcctaagcaaaaagaacaaagctggaggcataatgctacctgtcttcaa

SEQ ID NO: 43031 - DNA, 201 bp, Homo sapiens
gtttgcatgtttctattttttttggaatagaagggattaagatttaagaagagaagttggcaacccaaactggcctgaagagaaattatgcgctttgtaaygaaaacttgaaaatagtgtttatttatggatcattggctcatgggaatgctagtctagagatttaaaaagtgtgattttctgattcttgtttggatactg

SEQ ID NO: 43032 - DNA, 201 bp, Homo sapiens
tattcaagtaggaggagaggaggtcaaattgtctctgtttgcagatgacatgattgtatatctagaaaaccctgtcatctcagccccaaaatctccttagrctgataagcaacttcagcagagtctcaggatacaaaatcaatttgcaaaaatctcaagcattcctatacacctataatagacaaacagagagccaaatca

SEQ ID NO: 43033 - DNA, 201 bp, Homo sapiens
acaggcaaggatgccctctctcactactcctattcaacatagtattggaagttctggccagggcaatcaggcaagagaaagaaataaagtatattcaagtrggaggagaggaggtcaaattgtctctgtttgcagatgacatgattgtatatctagaaaaccctgtcatctcagccccaaaatctccttagactgataagc

SEQ ID NO: 43034 - DNA, 201 bp, Homo sapiens
agcattccctttgaaaaccagcacaggcaaggatgccctctctcactactcctattcaacatagtattggaagttctggccagggcaatcaggcaagagawagaaataaagtatattcaagtaggaggagaggaggtcaaattgtctctgtttgcagatgacatgattgtatatctagaaaaccctgtcatctcagcccca

SEQ ID NO: 43035 - DNA, 201 bp, Homo sapiens
aactcacagccaatattatactgaatgggtaaaagctggaagcattccctttgaaaaccagcacaggcaaggatgccctctctcactactcctattcaacrtagtattggaagttctggccagggcaatcaggcaagagaaagaaataaagtatattcaagtaggaggagaggaggtcaaattgtctctgtttgcagatga

SEQ ID NO: 43036 - DNA, 201 bp, Homo sapiens
atgcaaaaaaggcctttgataaaattcaacaccccttcatgctaaaaactctcaataaattaggtattgatggaacatatctcaaaataataagagctatwtatgacaaactcacagccaatattatactgaatgggtaaaagctggaagcattccctttgaaaaccagcacaggcaaggatgccctctctcactactcct

SEQ ID NO: 43037 - DNA, 201 bp, Homo sapiens
aaaagcccaggaccagacagattcacagccaaattctatcagaggtacaaagaagagctggttccattccttctgaaactatttcaaacaatagaaaagawattatcataaaataactcattttatgaggccagcatcatcctgataccaaaacctggcagaaacacaacaaaaaaaagaaaatttcaggccaatatccgt

SEQ ID NO: 43038 - DNA, 201 bp, Homo sapiens
tgaataaataatacaaaccagtatattatctttgcaaaaataatgactgttaagagtgtaccacctttagtgtgaatattattaaagtaataaaattgaaratacctaaaagaaagtaaagctgctctaagcaccaacatgcttaaaactatttattcaaagatatgccaaagtgacatccctatcctcatgaaattgtat

SEQ ID NO: 43039 - DNA, 201 bp, Homo sapiens
taagttttatttggaagttagaatattggcatatacttatattgtacattatagtttctgagtgcctttttatgcatttcatttttagatgctcgaaacartgtagagacataagcagataaggtgatggtatttccattttgtatattatttaaatgtccctttactgcactgtatgtgaccaggaggtcacattaatat

SEQ ID NO: 43040 - DNA, 201 bp, Homo sapiens
tgaaattgaggcagtaattaatagcttaccaaccaaaaaaaagcccaggaccagacagattcacagccaaattctatcagaggtacaaagaagagctggtwccattccttctgaaactatttcaaacaatagaaaagaaattatcataaaataactcattttatgaggccagcatcatcctgataccaaaacctggcagaa

SEQ ID NO: 43041 - DNA, 201 bp, Homo sapiens
tcctgacaaacaaattctgtaagtacatagataagcaacaattaactcacacactaatgcattctatttgctttttagtttcatgtatgttgggtaaatgsgaaagaaaaattactgtattcttgtttttatttgttgaacatttatgtagttgcctatgtaatgtgtttttaatttatagctatggagccaggtatgcaa

SEQ ID NO: 43042 - DNA, 201 bp, Homo sapiens
ccactgggattatagagtatgcattatatttagaagaaaatctcacttatccaaattcgcgtgcacacatacacacacacacacacacacacacacacacatatatatatatatatatatctcccagcaactccacctgcaaatgatcttactcagctgattccactaactattcatagatgacttggttgatctagggac

SEQ ID NO: 43043 - DNA, 201 bp, Homo sapiens
gtgcccacaggagaaagcaggaaagatctaaatttgacgccctaacatcacaatgaaaagaactagagaagcaatagcaaacaaattcaaaagctaacagragacaagaaataactaagatcagagcagaactgaaggagatagagacacaaaaaacctttcaaaaaatcaatgaatccaggagctggttttttgaaaaca

SEQ ID NO: 43044 - DNA, 201 bp, Homo sapiens
atgtgtcatatacctctagggggttattttaaacagtactgggatttgcttttctgtgtccaaaagcacagattttatatttggacactcaagttgttctrtattttgaactatgagaaaggaataatacccgattgaatactgactgtttttttataagacaatcgagcaacagaggcattcaacattagcatccagtgt

SEQ ID NO: 43045 - DNA, 201 bp, Homo sapiens
cactgggattatagagtatgcattatatttagaagaaaatctcacttatccaaattcgcgtgcacacatacacacacacacacacacacacacacacacatatatatatatatatatatctcccagcaactccacctgcaaatgatcttactcagctgattccactaactattcatagatgacttggttgatctagggaca

SEQ ID NO: 43046 - DNA, 201 bp, Homo sapiens
tgaaaccaataagaacaaagacacaacataccagaatctctgggacacagctaaagcagtgtttagagggaaatttatagcactaagtgcccacaggagamagcaggaaagatctaaatttgacgccctaacatcacaatgaaaagaactagagaagcaatagcaaacaaattcaaaagctaacaggagacaagaaataac

SEQ ID NO: 43047 - DNA, 201 bp, Homo sapiens
taccaagattgaatgctgaagaaatccaaaacctgaatagacaaataacaagtattgagatattaacagaagtctcccataaaagaaatggctaaaagctratggcttcactgttgggttctaccaaacaatttaaaaataaataatgtcaatcctactgaaattatttctaaaatgtgaggaggagggagtacttcctaa

SEQ ID NO: 43048 - DNA, 201 bp, Homo sapiens
aaaaaaaatctgataacattcaacatcccttcatggtaaaaaccctcaacaagtatgtatttgtcctcaaaatgaaaaatatctcaataagataaacgctrtatataacaaacccacagctagcatcacactgaatggggaaaacctgaaagcctctcctttaacagctgaaataagacaaggattcccactttcaccact

SEQ ID NO: 43049 - DNA, 201 bp, Homo sapiens
aagacaaggattcccactttcaccacttttattgaacataatactagaagtcctagccagagcaattagacaagagaaagaaataaaagtcattcaaattraaaagaaatgagtcaaattatccttgcttgcagatgatatgattttatatcttttttttttttttttttttttgagatggagtctcgctctgtcgcccag

SEQ ID NO: 43050 - DNA, 201 bp, Homo sapiens
ttctgtatttttagtagagatggggtttcaccatgttagtcaggctggtctcaaactcctgacctcatgatctgcctgcctcggcctcccgaagtgctggkattacaggcgtaagccatcacgcccggccgattttttatcttaaaaaaactaaagactatcccaaaagttactggatctgataaattcagtaaagtttca

SEQ ID NO: 43051 - DNA, 201 bp, Homo sapiens
atgggcaaaataaataagagcctgtacaaggagatggggctctgaaggttattttaaaactttcaagcaatgttttcaaccacataccataatgctttccmcctttttcatattttgctttgtcttttgtccatatagttgctggcatgcacttatttaataaatatccgactctataaaataaaaggagaatccattagt

SEQ ID NO: 43052 - DNA, 201 bp, Homo sapiens
gcaaccaaagaaaataaatggacaaatgggatcacatcaaagtaaaaagcttcttctgcacagcaaaggaaatcatcaacaaagtgaaaagccaacccacrggatggaaaaaaatatttgccaatgacccatctgacaagagattaatagccagaatttataagcagcttgaacaactcaataggaaaagaacaatccaat

SEQ ID NO: 43053 - DNA, 201 bp, Homo sapiens
gaatcctgggaatacatatcagttagctgggggagtccacaggggtcatgggtagagatcctagtggagaccatcatgaaccagccagtgggatttatggycagttgttgagatattcatacaggctgccacggcccctacccccttaccctgttcctagtgtccccaagattatttcattttgctaatccccttagtatt

SEQ ID NO: 43054 - DNA, 201 bp, Homo sapiens
aaaacaccatagaaataaatcaccatgcattcctttactgtttgtgttactgacattaaatcacactaatttgataatataaattataaaatttcttttctttttttaaattttttttaattttttgagacagagtcttgcactgtcacccaggctggagtacagtggagtgatctcagctcactacaacctccacctcct

SEQ ID NO: 43055 - DNA, 201 bp, Homo sapiens
ttgccagtttacctcccatttcctcttaaactcatgccacttcttttgtcttcttctttttctttttctgtttctttcatatatatttttacatatatatwtttttttcctgtcttgctctgttgcccagagtggagttcagtggtgatctgagctgcaacctgtacctcccaagttcaagtgattctcctgcctcagcct

SEQ ID NO: 43056 - DNA, 201 bp, Homo sapiens
gattaaacagctgccattatttctgttaatatgacaacatctcaacttgtatgccatttcttaagactgtatattccactcttgaaaattgtaaaaaggartaggtgcttttatcactgatgagttaaacccagtcaaatatgtgcactggttttctaacccaagggaggggaagctccttgatgttgatgcacaatgata

SEQ ID NO: 43057 - DNA, 201 bp, Homo sapiens
tttagaattttctacctttttaaagtctttgtgggattcagcaacttagagatcttctccaagccacctctcaatagaaatttctactgataagagagtaygtaagagtttatatagagtacaagtaaccctcatttggctcatgccaattatctgtgtgacttcatacgtattaggtgtctaagtatttattctcgaaag

SEQ ID NO: 43058 - DNA, 201 bp, Homo sapiens
ttcatggggtaggggcaggtactgattaacccaaaccaactcccttattgggcatggatatatattgccacaatcaaagtgaaatagaagaatttcattakctagctagggaacttcccacccctttcatccctctttcttttttctgcttcccctctcctctatttatccccatcttctccttgatccccctctctctgg

SEQ ID NO: 43059 - DNA, 201 bp, Homo sapiens
acaatgaatgtacttaatttttaaagtttatcacctgcatacttaagagataatgctaaagcatgagtcatcgctgacatttagcaccactaattttaaamctatgcagattattgctttgaggaatagcactgctggcatgtacagaagagaagacatttttagtaagtgattttccttataggagcttatatgctataa

SEQ ID NO: 43060 - DNA, 201 bp, Homo sapiens
gcatttctgtctttagagaggaaaactgtagtaaaaaaactgttacacttacaggaagctcaaagtaatcatggaaaattatatttcctaagtgttttgtrctttaatactcagattacagcttgtttgaggtagcaacatttaaagaggggaaaaaaaaacaacctttgtttagatcccttttcaatatgttttcttttc

SEQ ID NO: 43061 - DNA, 201 bp, Homo sapiens
tcagcttctctgagtcttggtagttattaatatgccaggtatcatagaggaagcaaggtgataactctctcaaagctctgttatttttcactattctgctrttccccaaaccgttaatttttagccttagttttttttattgattgaatagaattaatgaatttttatttcaagtgtattaaaataaaatttcattgagtc

SEQ ID NO: 43062 - DNA, 201 bp, Homo sapiens
tgagtcttggtagttattaatatgccaggtatcatagaggaagcaaggtgataactctctcaaagctctgttatttttcactattctgctattccccaaaycgttaatttttagccttagttttttttattgattgaatagaattaatgaatttttatttcaagtgtattaaaataaaatttcattgagtcactaaggaag

SEQ ID NO: 43063 - DNA, 201 bp, Homo sapiens
tatatatttctaagatatttctgctgattttgttatatctctatgactggttagacctagttcatcttctctgatgtataacataattaaggaattttttyataaatggggcagagcaacgaggccctgtgaaaaaggaatgatcttcaggaaatcaattatttttacatggtgatctttctgtaattggtgaaaatagaa

SEQ ID NO: 43064 - DNA, 201 bp, Homo sapiens
ccggcctctggtaaccgccattctacctccatgagatccacagttttagtgaataagaacatgcaatatttgtctttctgtgcctagcttattttacttarcatagtgacctccagttcaatctgtattgctgcaaaagacaggatttcatttttttgtggctgaataatattccattgtatgtgtgcatgtatatacaca

SEQ ID NO: 43065 - DNA, 201 bp, Homo sapiens
ttttaaaaactcaagcccagtgagagctggaatgttttctcttttgcagattttcctgttgtctttcaataatcaattttctattttgatttgattgtgcrcagagaacacactctttgtgactaatttttttttacatatattgaggctattttatggcccaggatatggtctatcttaatatagtttaatgggcactta

SEQ ID NO: 43066 - DNA, 201 bp, Homo sapiens
tctcagaccacagtgcaatcaaattagaactcaggattaagaaactcactcaaaaccgcacaactacatggaaactgaacaacctgctcctgaatgactaytgggtaaataaattaaggcagaaataaataagttctttgaaaccaataagaacaaagacacaacataccagaatctctgggacacagctaaagcagtgtt

SEQ ID NO: 43067 - DNA, 201 bp, Homo sapiens
gagcagacctaatagacatctaccaaactctccacctcaaatcaacagaatatacattcttctcagcaccaaatcatacttattctaaaattgaccacatmattgaaagtaaaacactcctcagcaaatgcaaataaatggaaataataacaaacagtatctcagaccacagtgcaatcaaattagaactcaggattaaga

SEQ ID NO: 43068 - DNA, 201 bp, Homo sapiens
cccactgtcatattagacagataaacgagacagaaaattaacaaggatattcaggatgtgaactcagctcaggtccgagcagacctaatagacatctaccraactctccacctcaaatcaacagaatatacattcttctcagcaccaaatcatacttattctaaaattgaccacataattgaaagtaaaacactcctcagc

SEQ ID NO: 43069 - DNA, 201 bp, Homo sapiens
ccccactgtcatattagacagataaacgagacagaaaattaacaaggatattcaggatgtgaactcagctcaggtccgagcagacctaatagacatctacyaaactctccacctcaaatcaacagaatatacattcttctcagcaccaaatcatacttattctaaaattgaccacataattgaaagtaaaacactcctcag

SEQ ID NO: 43070 - DNA, 201 bp, Homo sapiens
aagataatccttgagaagagcaaccccaagacacataattgtcagattcaccaaggttgaaatgaaggaaaaaatgttaagagcagccagagagaaacgtsgggttacccataaagagaagcacatcagactaacaggggatctcttggcagaaaccctacaagccagaagagggtgggggctgatattcaacattcttaa

SEQ ID NO: 43071 - DNA, 201 bp, Homo sapiens
gaacaaaattagacagagaatgagtttgatgaattgacagaagtaggcttcggaaggtgggtaataacaaactcctctgagcaaaagaagcatgttctaascaaatgcaaggaagctaagaaccttgataaaagattcccctaggtctccctaggaactgctaactggaataagcagtttagagaagaacataaatgacct

SEQ ID NO: 43072 - DNA, 201 bp, Homo sapiens
aaaaaccagaatgtctcttccaaaggatcacaactcctcgccagcaagggaacaaaattagacagagaatgagtttgatgaattgacagaagtaggcttcrgaaggtgggtaataacaaactcctctgagcaaaagaagcatgttctaaccaaatgcaaggaagctaagaaccttgataaaagattcccctaggtctccct

SEQ ID NO: 43073 - DNA, 201 bp, Homo sapiens
ctcttgctaaaggaaaaaaaaaaaatgcatgaggatgtcaagtattttaaaatgactctaatgtgttgtgcatggataatcgagaaaaatattggtgctatttttttttttactgaaatgtgaattaaaggaaaaagataattctgaggatgatagagagttcaaaatcagatattttggatttcagaaaaaaatgagcat

SEQ ID NO: 43074 - DNA, 201 bp, Homo sapiens
ggagagctctggctggcatctggcaggtgcccctctggaataaagcttccagaggaaggagcaggcagcactctttgctgttctgcagcctccactggtgrtacgtaggcaaacggtctggagtggacctccagcaaactccagcagacctgcagaagaggggcctgactgttagaaggaaaactaacaaacagaaagcaa

SEQ ID NO: 43075 - DNA, 201 bp, Homo sapiens
atgccattctcctgcttcagcctcccgagtagctgggactacaggcacccaccagcacgcctggctaatttttttgtatttttagtagagatggggtttcrccgtgttagccaggatggtcttgatctcctgacctcgtgatccgcccgtctcagcctcccaaagtgctgggattataggcgtgagccaccgcgctgagcc

SEQ ID NO: 43076 - DNA, 201 bp, Homo sapiens
cttgagctctgctaagggacagactgcctcctcaagtgggtccctgaacccggtgcctcctgactaggaaacacctcccagcaggggtcaacagacatctyatacaggagagctctggctggcatctggcaggtgcccctctggaataaagcttccagaggaaggagcaggcagcactctttgctgttctgcagcctccac

SEQ ID NO: 43077 - DNA, 201 bp, Homo sapiens
tgtggcaattgtgaatgagattgccttgctgatttgggtctcggtttggctattgtgggtgtataggaatgctagcgatttttgtacattgattttatatmctgcaactttgccgaaggtatcagctggaggagattttgggctgacactttggggttttctagatatagaatcatgtagtctacaaatagaaatagtttg

SEQ ID NO: 43078 - DNA, 201 bp, Homo sapiens
gggcagctgtgagcacagcttcaccagacttaaacgtttctgtctactggctctgaagacagcagtggatctcccagcacagagcttgagctctgctaagrgacagactgcctcctcaagtgggtccctgaacccggtgcctcctgactaggaaacacctcccagcaggggtcaacagacatctcatacaggagagctctg

SEQ ID NO: 43079 - DNA, 201 bp, Homo sapiens
gtgggtgtataggaatgctagcgatttttgtacattgattttatatactgcaactttgccgaaggtatcagctggaggagattttgggctgacactttggkgttttctagatatagaatcatgtagtctacaaatagaaatagtttgacttcctctcttcctatttgggtgccctttatttgtctctcttgccagatagct

SEQ ID NO: 43080 - DNA, 201 bp, Homo sapiens
cagtggaattgctaatttggggttcaatgtgcatccattatttcaaagcgttcaatatttaagacaatcttccaatatacttccaagtcacatttttgtactttctttttcgtgtttttcccccacatgtccttttcttagcattgccattaaatcatttatctttttgtaactactctgagatttctcttctctctctct

SEQ ID NO: 43081 - DNA, 201 bp, Homo sapiens
agtggaattgctaatttggggttcaatgtgcatccattatttcaaagcgttcaatatttaagacaatcttccaatatacttccaagtcacatttttgtactttctttttcgtgtttttcccccacatgtccttttcttagcattgccattaaatcatttatctttttgtaactactctgagatttctcttctctctctctc

SEQ ID NO: 43082 - DNA, 201 bp, Homo sapiens
gtggaattgctaatttggggttcaatgtgcatccattatttcaaagcgttcaatatttaagacaatcttccaatatacttccaagtcacatttttgtactttctttttcgtgtttttcccccacatgtccttttcttagcattgccattaaatcatttatctttttgtaactactctgagatttctcttctctctctctct

SEQ ID NO: 43083 - DNA, 201 bp, Homo sapiens
tggaattgctaatttggggttcaatgtgcatccattatttcaaagcgttcaatatttaagacaatcttccaatatacttccaagtcacatttttgtactttctttttcgtgtttttcccccacatgtccttttcttagcattgccattaaatcatttatctttttgtaactactctgagatttctcttctctctctctctt

SEQ ID NO: 43084 - DNA, 201 bp, Homo sapiens
atatttattgtcatgatctaggacactagtgataatcatccctgattcctctctttgccactcccccatcagtcaccaaatcctgggcatttgaatatgtrcaactcgtgtctttcttcatttctccaagtcctatcactgttccattttgggacttcattatctcttggagagaatactgaaacattcatttaatgcctg

SEQ ID NO: 43085 - DNA, 201 bp, Homo sapiens
ataatcatccctgattcctctctttgccactcccccatcagtcaccaaatcctgggcatttgaatatgtgcaactcgtgtctttcttcatttctccaagtmctatcactgttccattttgggacttcattatctcttggagagaatactgaaacattcatttaatgcctgcaggctctactcttagttaccagtcctccac

SEQ ID NO: 43086 - DNA, 201 bp, Homo sapiens
ttgtcccttcctcaccttttatgtccttcaaggaaaaggcacttttggtaactttgtcaggatatgatagcataagtaggttactgagaatgaaagagtcmgtgcttttcaagtcccctcaaaatcagaaagagaagacctcagcattcacatgtgactcacttgtcgactcacttaacaaatgatctagcactccttatt

SEQ ID NO: 43087 - DNA, 201 bp, Homo sapiens
atatttatttatttcctacatacagcatatgtcttaagtatattcaaggtaattcatttcagacaaattaaaagtagatattgaagtaccttatatgtgakgtttgcaaatcaaaattccatggaatttccaaatacacatttaagcattaataagtttagcttattaaagagagattgcttgatattccaagtttaataa

SEQ ID NO: 43088 - DNA, 201 bp, Homo sapiens
ctcagcggatcccacccccatggagcccaacaagctccatggcttgaaattctcgctgtcagcacaggagtctgaagttgacctgggatgctccagcttgstgtgggtgagaggcatccaccattactgaggcttgagtaggcagttttcccctcacagtgtaaacaaagccacctggaagttcaaactgggtggggccca

SEQ ID NO: 43089 - DNA, 201 bp, Homo sapiens
agaaaatataaatttataatctcattatacaaatacaaatagtactatttgatatattgtactttatgaagtatttctttataagtattttatcttataawgttataattagattacaaccattatattaaaaatgtgtatcatgaggaatagaagatggctgaataggaacagctccggtcttcagctcccagggagatc

SEQ ID NO: 43090 - DNA, 201 bp, Homo sapiens
catgctaacctatcagcttttttaatgtgtgttcttcatagggtcattgttgtgatgatgtaaatagtatcctttttttaagaaaaagattagaaaatatmaatttataatctcattatacaaatacaaatagtactatttgatatattgtactttatgaagtatttctttataagtattttatcttataaagttataatt

SEQ ID NO: 43091 - DNA, 201 bp, Homo sapiens
cagattttattttgtcagcatttaaaacttgatatgaagaagataacataaacattaagtgaaaagataagctgcagacacagagaaaataccatgcatayagcacatatggtgtttaaagtgtttcaggttttatatacaaaatattacaaatcaataaaaaaatttcactagaaaagtaggcaaatctgaaatagaaaa

SEQ ID NO: 43092 - DNA, 201 bp, Homo sapiens
tagtgaagtggttaaaagcatataatctggagtcagatgggtagtgtatagttacaaaagtcactaaagattggtcattttgatcatcgtaagagcttgargccctaaggaaaatttgacagattttattttgtcagcatttaaaacttgatatgaagaagataacataaacattaagtgaaaagataagctgcagacaca

SEQ ID NO: 43093 - DNA, 201 bp, Homo sapiens
tagcacttattgtgtgccaggccctaatctaatctctttaattatatttactcaactgataaacaagaaactgtacacaggaaagttgagtaactcatttmatgtcgtagagctagtcagatgagggtgccccaggatttaaacctacataatctggctccagatttgatgcttttaactactaccctattctcaagtttc

SEQ ID NO: 43094 - DNA, 201 bp, Homo sapiens
tggagggaacaaataataacaaatgtttatttagcacttattgtgtgccaggccctaatctaatctctttaattatatttactcaactgataaacaagaaactgtacacaggaaagttgagtaactcatttcatgtcgtagagctagtcagatgagggtgccccaggatttaaacctacataatctggctccagatttgat

SEQ ID NO: 43095 - DNA, 201 bp, Homo sapiens
ttgcaaaggaaattatctcattctttttatggctgcatagtattccatggtgtatatgtaccatagttactttatctagtataccattgatgggcatttargttgattccatgtctttgctattgtgaatagtgttgcaatgaacatacacgtgcatctatctttacaatagaacaatttatattcctttgagtatttacc

SEQ ID NO: 43096 - DNA, 201 bp, Homo sapiens
ttagagaaacagacatgtttggagggaacaaataataacaaatgtttatttagcacttattgtgtgccaggccctaatctaatctctttaattatatttaytcaactgataaacaagaaactgtacacaggaaagttgagtaactcatttcatgtcgtagagctagtcagatgagggtgccccaggatttaaacctacata

SEQ ID NO: 43097 - DNA, 201 bp, Homo sapiens
tgtgtgggcagtcttatttctggactctctattctattaagttggtctaaatatctgttttgtaccattaccatgctgttttggtttctgtagccccatartatagtttgaagttgggtagtctatgcctccagctttgctctttttgcttaggatttcctgggctattctttggtttcatatgaatttcaaaatagtttt

SEQ ID NO: 43098 - DNA, 201 bp, Homo sapiens
tacaggtgtgagccatggcacccaaccctaatatttattaattactctgttttttgtgcctggcttggtgccagagaagtacatagtaggaactcacttacagttattaataaatgagaaaaatggaataaaatcttgatataaacatcacattgttggaatttatacaaaaacatctacttagagaaacagacatgtttg

SEQ ID NO: 43099 - DNA, 201 bp, Homo sapiens
gaatgcttctagcttttgtccattcattatgatgttggctgtgggtttgccatgatggctcttattattttgaggtatccagggaaacttctcatcctttsatgcctccatcaagtggtcttccaacaataatgataatttgcatttttttaaagtgtgctataattttgaaagctctcacacattcattacttaatttaa

SEQ ID NO: 43100 - DNA, 201 bp, Homo sapiens
ctacaggtgtgagccatggcacccaaccctaatatttattaattactctgttttttgtgcctggcttggtgccagagaagtacatagtaggaactcacttacagttattaataaatgagaaaaatggaataaaatcttgatataaacatcacattgttggaatttatacaaaaacatctacttagagaaacagacatgttt

SEQ ID NO: 43101 - DNA, 201 bp, Homo sapiens
ataacaagggcctttcctgaacggcatttattttcatttcaaatgagggatgaacacaagggcaaggcaggatacttcaccatggattaacttttcttgaccgtactggaatccactttgctatgagaatgtatcatatcatggtttactctgtatttccaggtagtgcactggcaaagtctttaaataagtttaattctc

SEQ ID NO: 43102 - DNA, 201 bp, Homo sapiens
taagcacgttgttcaattcaacaaaaaatagagaatgtatgttctttcagatgcttagttctgaattgagcaagtcatgaaagcaatgcttaataagcacmtagtagccacaaagatatgactatgaaaatgaaaaaaaattgcagttgtattattttaaatgctaacacttttttactttttaataaaattgtatatatt

SEQ ID NO: 43103 - DNA, 201 bp, Homo sapiens
gctactcgggaggctgaggcaggagaatggcgtgaacccacgaagcggagcttgcagtgagctgagatcgcgccactgcactccagcctgggcgacagggygagactcagtctcaaaaaaaaaaaaaaaaaaaaaaaaaaaattggaactactatataaattttatgcatttctatgataagtctctgtaatatagtccag

SEQ ID NO: 43104 - DNA, 201 bp, Homo sapiens
gcgtgaacccacgaagcggagcttgcagtgagctgagatcgcgccactgcactccagcctgggcgacagggcgagactcagtctcaaaaaaaaaaaaaaawaaaaaaaaaaaattggaactactatataaattttatgcatttctatgataagtctctgtaatatagtccaggccaaataattctcttttaacaactgcta

SEQ ID NO: 43105 - DNA, 201 bp, Homo sapiens
gaacccacgaagcggagcttgcagtgagctgagatcgcgccactgcactccagcctgggcgacagggcgagactcagtctcaaaaaaaaaaaaaaaaaaawaaaaaaaattggaactactatataaattttatgcatttctatgataagtctctgtaatatagtccaggccaaataattctcttttaacaactgctaagta

SEQ ID NO: 43106 - DNA, 201 bp, Homo sapiens
ttcaaagcagtgtaggggtgaaggccaaatttctcctttgccctctggaagttcgggtgaaaaatcaattgagaaaaggcagattaataggagaaaggacrtataaaatttatttcagtgtgcataacacaggggaattgtagcctttaaaaagttgttgttttttttttaactctggagaacaaaacataaaaataatta

SEQ ID NO: 43107 - DNA, 201 bp, Homo sapiens
ccagcggcaaaaaaaaaaaataccctcattccctctattcctactattccctcttcctcttttgtggaatattgacctatttcttcccaatcttttatgtmggtatatatgtatttgtttatttaaattatttgcttctaccataatactgttaacttttgtttagttatttggttattctaaattcttaggctgccaaaa

SEQ ID NO: 43108 - DNA, 201 bp, Homo sapiens
cccaaacactgcacgctggtcaaatgtggagtataaatttaactctaagctgtttaacaaaagagagtgatataaaatagttacagttattaactattttraaatttaaaattagtaactattatttagtaaaatgtactttttaaacatataattaaatgtttatggaaagcacaacacttactgatttgcaggtacacc

SEQ ID NO: 43109 - DNA, 201 bp, Homo sapiens
tcaaatgtggagtataaatttaactctaagctgtttaacaaaagagagtgatataaaatagttacagttattaactattttaaaatttaaaattagtaactattatttagtaaaatgtactttttaaacatataattaaatgtttatggaaagcacaacacttactgatttgcaggtacaccattcattttctatttttaa

SEQ ID NO: 43110 - DNA, 201 bp, Homo sapiens
ctgggaagtttaagatcaaggtgttggtagatccaatgtctcaagagggtccacttactggtttacaaatggctgtgctcttgctagtttctcacatggcygagaaaagagagtcagagagagagggagagagagagagagcaggcaagctctctcatttctttttttatagacgcatgaatcctatttatgagggctcca

SEQ ID NO: 43111 - DNA, 201 bp, Homo sapiens
tgtaccctttgaccaatgttcctctatttcccccacctttctgcccctgataaccagctttctactctttggcttctatgtatttgacatttttgtatttyacatataagtggatcatgcagtattttgctttctgtatatgtcttcattcactcagcttaatgtcctccaagttcattcatgttgttgaaaatagcagaa

SEQ ID NO: 43112 - DNA, 201 bp, Homo sapiens
cccagtgggatcttctttatttttctagttcatatatagcttttataagcaagtgataattaatggaacagacattttagttgttgttgaatcctttccakttctcttcccatcataagggccagcttcagatgctgttaggtcctaataacttcctggtgataaccatgtggcccacccatcccattaatttctgctttt

SEQ ID NO: 43113 - DNA, 201 bp, Homo sapiens
actacaggtgtgagccatggcacccaaccctaatatttattaattactctgttttttgtgcctggcttggtgccagagaagtacatagtaggaactcacttacagttattaataaatgagaaaaatggaataaaatcttgatataaacatcacattgttggaatttatacaaaaacatctacttagagaaacagacatgtt

SEQ ID NO: 43114 - DNA, 201 bp, Homo sapiens
atgatttttacgttaataaaatgtattctgcaaggcacagtggtgcgtgccttaggtccagctactcaggaggctgaggcaggaggactgcttgagcccaktagtttgaggcaagcctgggcaacatagacctcatttcatctctaaaaaaatgtattctttgatgctatatatagtataataaattttgagctgattatg

SEQ ID NO: 43115 - DNA, 201 bp, Homo sapiens
gactacaggtgtgagccatggcacccaaccctaatatttattaattactctgttttttgtgcctggcttggtgccagagaagtacatagtaggaactcacttacagttattaataaatgagaaaaatggaataaaatcttgatataaacatcacattgttggaatttatacaaaaacatctacttagagaaacagacatgt

SEQ ID NO: 43116 - DNA, 201 bp, Homo sapiens
agacagggtcttgctgtgttgctaagtctggtctcaaactcctggcctcaaacaatgctcccaccttggcctcccaggtgttgagactacaggtgtgagcyatggcacccaaccctaatatttattaattactctgttttttgtgcctggcttggtgccagagaagtacatagtaggaactcacttacagttattaataaa

SEQ ID NO: 43117 - DNA, 201 bp, Homo sapiens
cagtcttgaacagatcaatctatcataacatttttatctttcttttctgtcaattgtcacattacaattttactttcttgtattagacagcaagcaccatsagaaaagcaaccattagtgttgattttttaaaattattttaaaatgattaaatattttgtaaagacagggtcttgctgtgttgctaagtctggtctcaaa

SEQ ID NO: 43118 - DNA, 201 bp, Homo sapiens
ccagtcttgaacagatcaatctatcataacatttttatctttcttttctgtcaattgtcacattacaattttactttcttgtattagacagcaagcaccatcagaaaagcaaccattagtgttgattttttaaaattattttaaaatgattaaatattttgtaaagacagggtcttgctgtgttgctaagtctggtctcaa

SEQ ID NO: 43119 - DNA, 201 bp, Homo sapiens
gaacttttgcttaaaaattacttcgtatttgcaaggctaatttcaaaataaattgaaaatgtaattttattaattttaccttgctaaatttgtacaaatgracttcctttcccttttctccagagaaatttttatttattccttatatttcaatttaagcattatttcttcaggaaagcaacttaccagtcttgaacagat

SEQ ID NO: 43120 - DNA, 201 bp, Homo sapiens
cttatttctaatctggcaaatacacagccgtgaatctactctttgtatacattagattgccatccacccaaatgttatctatttccagctacatgtatatwgaacatttgcacacagtgtttttatattctggaaaaatataagaatgttttgaaagcatacaatggatatgtctgcaagagagtaaacgaagaaaaataa

SEQ ID NO: 43121 - DNA, 201 bp, Homo sapiens
caaatgtggagtataaatttaactctaagctgtttaacaaaagagagtgatataaaatagttacagttattaactattttaaaatttaaaattagtaactattatttagtaaaatgtactttttaaacatataattaaatgtttatggaaagcacaacacttactgatttgcaggtacaccattcattttctatttttaat

SEQ ID NO: 43122 - DNA, 201 bp, Homo sapiens
tatattttgctttaccaaaattctccagaaatcagaagtctagccttatttctaatctggcaaatacacagccgtgaatctactctttgtatacattagaytgccatccacccaaatgttatctatttccagctacatgtatattgaacatttgcacacagtgtttttatattctggaaaaatataagaatgttttgaaag

SEQ ID NO: 43123 - DNA, 201 bp, Homo sapiens
agtatcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgaggaa

SEQ ID NO: 43124 - DNA, 201 bp, Homo sapiens
cactgaacaagtctaaacatctttctcttatattttgctttaccaaaattctccagaaatcagaagtctagccttatttctaatctggcaaatacacagcygtgaatctactctttgtatacattagattgccatccacccaaatgttatctatttccagctacatgtatattgaacatttgcacacagtgtttttatatt

SEQ ID NO: 43125 - DNA, 201 bp, Homo sapiens
gtatcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgaggaag

SEQ ID NO: 43126 - DNA, 201 bp, Homo sapiens
gtagtttcagtgtgaataattatggaaaggatggattaagtaaatgtaattctttttctgcaagagtttctattttagatagcactgaacaagtctaaacmtctttctcttatattttgctttaccaaaattctccagaaatcagaagtctagccttatttctaatctggcaaatacacagccgtgaatctactctttgta

SEQ ID NO: 43127 - DNA, 201 bp, Homo sapiens
ttctcagaatgtgaccgtagttggagacagggcctttggatatagaagtaattaaattaaaatggggtcatttgggtgggccctaatccaatatgactggygtccttatcagaagagattaggatgtacagggaaagacatcattgttgtgtgcatacatgtgaggacacagagagaggacagccatctgatagccaagga

SEQ ID NO: 43128 - DNA, 201 bp, Homo sapiens
tatcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgaggaaga

SEQ ID NO: 43129 - DNA, 201 bp, Homo sapiens
gccccaagagcaagataaacttagatccagagagaatacctttgttaaagattcctataaccaattttctgcacctacatggggaacaaactagaaaatayacatgaaatgccaacaaatatttgtgtcatattatgcattttccaaaatactttaccttatttgaccttccccagtcttgtaggataacaatgattgttt

SEQ ID NO: 43130 - DNA, 201 bp, Homo sapiens
atcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgaggaagat

SEQ ID NO: 43131 - DNA, 201 bp, Homo sapiens
aaatagtaaaatggttgctgtaataaagtaaattgacatattcataatctcacagttacccatttttttgtgtgtgtagcaagagcatctaaatctactcmtttagtaaaaatcctgaatacagcattattaactatagtcttcatgttgtgtactagatttctagagctcattcttcataactgcaactttgtatccttt

SEQ ID NO: 43132 - DNA, 201 bp, Homo sapiens
tcagtcagtctctactgcataacatttaaatattttcaggtaatgcttcccatgaagtcatttagcactttctaactttaaatttcaattgttgttatataatataatataatataattaatataaatagtatgagtactttcaattcacgttcactcacactatctaattcaaatatctagatcacctgtgaggaagata

SEQ ID NO: 43133 - DNA, 201 bp, Homo sapiens
aacctacctcccaaagcatttcatgatttggcttctaccattatcttgcacctctttcctgtgatgcacctccctcatatgttcctccaaacaggaactcrcagtttcttgaatgttccgtgttgctttatgcctctgtgcatgtgttatcagctacagtcataccttacttaacaatggggacatgttctgagaagtgca

SEQ ID NO: 43134 - DNA, 201 bp, Homo sapiens
cgttcactcacactatctaattcaaatatctagatcacctgtgaggaagataaaaatagttataatttatttattgtcatatcatttcaaagcctgttctaaattcttttcttaactcatttaagtaaatcctatgaggtatatactgttaatattttacagatgcaggcattgaggcatggagaaaatatcttcataact

SEQ ID NO: 43135 - DNA, 201 bp, Homo sapiens
tcatgatttggcttctaccattatcttgcacctctttcctgtgatgcacctccctcatatgttcctccaaacaggaactcgcagtttcttgaatgttccgwgttgctttatgcctctgtgcatgtgttatcagctacagtcataccttacttaacaatggggacatgttctgagaagtgcatccatatgccattttgtcat

SEQ ID NO: 43136 - DNA, 201 bp, Homo sapiens
gaatgagtgctattgtatacacacacacacatacacatgagcacatgtgcatacatgtatgcatacatgcacacaagatttagaagacttatatgcatttwaaaaaaaaggtttagaatccagattaaacaaacaattatgccgggcacagtggctcacgcctgtaatcccagcacttcgggaggctgaggcgggcagacc

SEQ ID NO: 43137 - DNA, 201 bp, Homo sapiens
acatagtgaacacactcatgtaacctccacccacgtcaagaaatagaatattattagaaccctaagagggccccttgtccccgctaccagctactactctstcactatcctgacttctaacaccataggtgagttttgcctctttttgaacttcaaatactgagactatacagtatgttgtattttgtgtctgatttcttt

SEQ ID NO: 43138 - DNA, 201 bp, Homo sapiens
ttcatccaatccattgtttattggcatttaggttaattcaatgtctttgctattgtgaatagtgctgcgatgaacatatgagtgcacatgtctttttggtmggatttattttcctttgggcatgtacccaataataggattgctgggtcaaattatagttctatttttagttctctgaggaatctccaatcgagtttccat

SEQ ID NO: 43139 - DNA, 201 bp, Homo sapiens
cttaatgttgtatgtctgtgagagctcaccatgtagtagttcattcattcattgataataaaccataatttatctatctgttctattgctgatgaacattygaattatttctggttttttctttaatgagcattgctattatatacacatttgtgtattactttcagtgcattaatgtagactttcttttggactaatacc

SEQ ID NO: 43140 - DNA, 201 bp, Homo sapiens
caggtgaacaaagcatagatgtgaggaagatagtagatgatgagcaaaaacacattcaatgatgtaaaacacatttatctgaatttatatcttccaacagkattcagggctaggcaatattcaggaaaaaagtggtattatttaaataaaatgagcaattgctgacttgacccatgggtgtttgacattgttttccaggaa

SEQ ID NO: 43141 - DNA, 201 bp, Homo sapiens
tgttcctctatttcccccacctttctgcccctgataaccagctttctactctttggcttctatgtatttgacatttttgtatttcacatataagtggatcrtgcagtattttgctttctgtatatgtcttcattcactcagcttaatgtcctccaagttcattcatgttgttgaaaatagcagaagctcctttattaaggc

SEQ ID NO: 43142 - DNA, 201 bp, Homo sapiens
tcaggaggtagtccagtcattttggtcacttttggcctgaggtaccagataaaatacggaatgcacagttacacttgaatttcatgtaacagtgattattkttaagtattaagtatgtcccaaatattgcatgggacattctcatacttacacttatttaaggtttatcttaagtgtaaacgtaactgggcattctgtttt

SEQ ID NO: 43143 - DNA, 201 bp, Homo sapiens
agcaagatttgttaaacatgaaacaaaaagctatgaaaagacatacattttactagctcaaagttaactagtttaaattttactaattcaaatcttactasttcaaaattaagaactttgttctgtcaaaaaatttttaaaagaaaatggaaagatacactgagaaaagatattggtataaatccaacaagggatttgtaa

SEQ ID NO: 43144 - DNA, 201 bp, Homo sapiens
cttatttaaggtttatcttaagtgtaaacgtaactgggcattctgtttttttaacatttagcaaccttaatctaatggcatttgcagttctggaagaagcrgttgagaggatgaacagaacttttggcaacatctcaagaatttgaagcaaaagtctaaacaaggaactgccaaagggaagatcaccacaactttgttttg

SEQ ID NO: 43145 - DNA, 201 bp, Homo sapiens
aactagtttaaattttactaattcaaatcttactacttcaaaattaagaactttgttctgtcaaaaaatttttaaaagaaaatggaaagatacactgagaraagatattggtataaatccaacaagggatttgtaacaagaacatatagcgaaccttcacaaatcaaaaagaaaagcaaaatgaacaaaaggaaaatggcc

SEQ ID NO: 43146 - DNA, 201 bp, Homo sapiens
gtagtattagtcctgtgcacagacacttgtaatcagagccccagcattccatttgtcattaggggaaacacaaggaaaactgtacaatttggactccgaayatctgataagcagatggcaggttagcctcaatgtagtgcaaatattgtctgtttgcaagactgatatttgcacacacgtctttggcagatgatggtaaag

SEQ ID NO: 43147 - DNA, 201 bp, Homo sapiens
ccaaagtgatatctggaccttccgtcatgtcttgagaacaattggaaagggtaaatattagagtaattgcagaaaacagagttatttttctctttaaattmacttaataaagaaaaaataattatctggtggggttttcaatgtatataaaagcaataaagtataacctaaaattcaatggggcaaaaggatttataaagt

SEQ ID NO: 43148 - DNA, 201 bp, Homo sapiens
taactaacaccattttttctcaaactattccaaaaaattgaggattaagaaattcttcctaattaattctgtgaagctagcattaccctgataataaaacsagacaagggcacaacaaaaaaagaaaactatgggccaatatgtctgatgaagatagatttaaacaccctcaaccaaatactagaaaatagaacccaacag

SEQ ID NO: 43149 - DNA, 201 bp, Homo sapiens
ttccaagaaaaataattttaaagtgccctgtccactgtccctacccctatagatggatgacttaggaaatttaatttctgtaaaatctctaggatatcccwcagaggaaaatgcatggatgctggtggacactaagatatacatacaaaacaataacaataaggcaactattttttttcaaaaaacccagaaagttgggtt

SEQ ID NO: 43150 - DNA, 201 bp, Homo sapiens
gatgacttaggaaatttaatttctgtaaaatctctaggatatcccacagaggaaaatgcatggatgctggtggacactaagatatacatacaaaacaatamcaataaggcaactattttttttcaaaaaacccagaaagttgggttgggtgctcatttatgggcaaatcatctgagaagctggcagctgccatttgaaccc

SEQ ID NO: 43151 - DNA, 201 bp, Homo sapiens
tgttcaatacagaagcagccatggatgcagaaccccaggagaaagagggttgactgtataggttttcaaacaatgtactattaatattttacatactattycagtagtttcagtgtgaataattatggaaaggatggattaagtaaatgtaattctttttctgcaagagtttctattttagatagcactgaacaagtctaa

SEQ ID NO: 43152 - DNA, 201 bp, Homo sapiens
tatatttacagttattttaattgagaatattttatgtaggttttatttaaaaagcttgaggtcaagagcttttgaagaactttaggaaaaaaaaacctaakccatattatacagccatccctcggtatccatggggggttggttccaggaccttctgcagatgccaaaatccatggatgttcaagttccttatataaaata

SEQ ID NO: 43153 - DNA, 201 bp, Homo sapiens
tgatggtaacgtacagatgggtttttggtgtggatgtcctttctgtttgttagttttccttctaacagacaggaccctcagatgcaggtttgttggagttkgctagaggtccactccagaccctttttgcctgggtgtcagccgtggtggctgcagaacagcagtggctgtagaacagcggattttggtgacccgcaaatg

SEQ ID NO: 43154 - DNA, 201 bp, Homo sapiens
gatgatggtaacgtacagatgggtttttggtgtggatgtcctttctgtttgttagttttccttctaacagacaggaccctcagatgcaggtttgttggagwttgctagaggtccactccagaccctttttgcctgggtgtcagccgtggtggctgcagaacagcagtggctgtagaacagcggattttggtgacccgcaaa

SEQ ID NO: 43155 - DNA, 201 bp, Homo sapiens
tggaggaggagaggtgctctgctttttagagtttccggtttttctgctctgttttttccccatctttgtggttttatctacttttggtctttgatgatggyaacgtacagatgggtttttggtgtggatgtcctttctgtttgttagttttccttctaacagacaggaccctcagatgcaggtttgttggagtttgctaga

SEQ ID NO: 43156 - DNA, 201 bp, Homo sapiens
ttccgttgctggtgaggagctgtgttcctttggaggaggagaggtgctctgctttttagagtttccggtttttctgctctgttttttccccatctttgtgkttttatctacttttggtctttgatgatggtaacgtacagatgggtttttggtgtggatgtcctttctgtttgttagttttccttctaacagacaggaccc

SEQ ID NO: 43157 - DNA, 201 bp, Homo sapiens
ttatatcttccaacagtattcagggctaggcaatattcaggaaaaaagtggtattatttaaataaaatgagcaattgctgacttgacccatgggtgtttgwcattgttttccaggaaacaggatgggtgggttgttttcatcacctccactgtttcccaagcttcccctgtgatccacaatatgaatttacaattgggttt

SEQ ID NO: 43158 - DNA, 201 bp, Homo sapiens
ttcacttatgaagcttagtttggctggatatgaaattctgggttgaaaattcttttctttaagaatgtgaaatgttggcccccactctcttctggcttgtrgagtttttgccaagagatctactgttagtctgatggctttccctttgtgggtaacccaacctttctctctggctgcccttaccattttttccttcatttc

SEQ ID NO: 43159 - DNA, 201 bp, Homo sapiens
tgctgaaatagcagctagagcttgtgcagcaaagtttttctctgccaagttaactgggctgtatgggattaaatctgtgaccttgtcctcattaacccaaygctctaaccaactgagagagcttctccagttcactctggagtatgtgagatgtctgcaatggtggacaaatgcaaatagagtatgtaacataatggccat

SEQ ID NO: 43160 - DNA, 201 bp, Homo sapiens
ttgctttccatgtttagtgcttccttcaggagctcttttagggcaggcctggtggtgacaaaatctctcagcatttgcttgtctgtaaagtattttatttmtccttcacttatgaagcttagtttggctggatatgaaattctgggttgaaaattcttttctttaagaatgtgaaatgttggcccccactctcttctggct

SEQ ID NO: 43161 - DNA, 201 bp, Homo sapiens
actggaaatagagagaccaggtgctaagttaaaatttgctgatgtaaatatgagtcaacattctgcttcaatactgtatctctctgtctctctctctccctctctctgtttgccacttaaaactcatgaggtatgtatgttaacagataagtaacaagttcaaaactttctacattttccaaaaatgtttactaaatgcaa

SEQ ID NO: 43162 - DNA, 201 bp, Homo sapiens
taccggttgttgctttccatgtttagtgcttccttcaggagctcttttagggcaggcctggtggtgacaaaatctctcagcatttgcttgtctgtaaagtrttttatttctccttcacttatgaagcttagtttggctggatatgaaattctgggttgaaaattcttttctttaagaatgtgaaatgttggcccccactct

SEQ ID NO: 43163 - DNA, 201 bp, Homo sapiens
tcctgggcacccagagtatattgggaaaaatagatatgcaaatagctgtaataatgtctgataaatgacactgtaatggtatgaacaaaggctgtggaggsacataggaaaaagcaatcaaatagcgtttccaaatagtgtttccaaagttctttcattttccattattaagtaggggaaagtgaatctccctcatatgaa

SEQ ID NO: 43164 - DNA, 201 bp, Homo sapiens
ctggaaatagagagaccaggtgctaagttaaaatttgctgatgtaaatatgagtcaacattctgcttcaatactgtatctctctgtctctctctctccctctctctgtttgccacttaaaactcatgaggtatgtatgttaacagataagtaacaagttcaaaactttctacattttccaaaaatgtttactaaatgcaaa

SEQ ID NO: 43165 - DNA, 201 bp, Homo sapiens
tattccacaaaacagaagccaaagcaagcaggagtacttgcatcagataaaacagaatttaagtcaaaaaccataaaaaagacaagatcattatataatgrtagagggatcaattcaggaagagaatagaacaattctaaatacatgcatccaatcctggagcacccgtattcataaaacaaatatgactagatctaaaga

SEQ ID NO: 43166 - DNA, 201 bp, Homo sapiens
aggccaaggagggcggatcatgaggtcaggagatcgagaccatcctggctaacacggtgaaaccccatctctactaaaaatacaaaaaaaattagctgggyatggtggcaggtgcctgtagtcccagctactcgggaggctgaggtgggagaatggcgtgaacctgggaggcagagcttgcagtgagtgagcagagatcgt

SEQ ID NO: 43167 - DNA, 201 bp, Homo sapiens
ttctattttggagacagtcttcaaaacaattcaaaattactgtaaaaataaataataaagcctaaaatacaggtgcttaatggagcagatagagactcttytctgggatagatagattattggtgagttttgccaactgcttctttcactaaatgatagaccataagtgttccagggaagaatcgtctttcttccctgttg

SEQ ID NO: 43168 - DNA, 201 bp, Homo sapiens
gagcagatagagactcttctctgggatagatagattattggtgagttttgccaactgcttctttcactaaatgatagaccataagtgttccagggaagaawcgtctttcttccctgttggattgaagtaagggcatatgtcattcatagcacagccactgtgacaacacaaagggttttgctcccagtctgcagcctgggc

SEQ ID NO: 43169 - DNA, 201 bp, Homo sapiens
ataaagtagcagcatttctacgttttatattaactaatacaatattaactcttagtaaaccatgacagcttagatatgcatattgtaatctctagaacaarctgaaaaaaaaatcagagatttataagcagaaaatcaacagattaaaaaaaagtcagccagtagacagaaattacaatgagataataaaaatattcaaat

SEQ ID NO: 43170 - DNA, 201 bp, Homo sapiens
agcagatagagactcttctctgggatagatagattattggtgagttttgccaactgcttctttcactaaatgatagaccataagtgttccagggaagaatcgtctttcttccctgttggattgaagtaagggcatatgtcattcatagcacagccactgtgacaacacaaagggttttgctcccagtctgcagcctgggct

SEQ ID NO: 43171 - DNA, 201 bp, Homo sapiens
agccaatgtatgatattggttcatttgaacaacttttattgaacgcttattgtattcctgacactctttttggtactgaacatttaataaatgaagaagamaaagtgtttttcctcaaggaaatcacagtcagcagggaaatatacaggtaaagagggttgaacagccagaggattaataaactctatgcatctaatcaat

SEQ ID NO: 43172 - DNA, 201 bp, Homo sapiens
aaattgtgttattaaagagtagccagtgaggaactggttgttttcaggcaatgaggccatagtgtcttagaaaacccttaagcagacagtccctgagaaasagtgtgttatccaatgttaagaaaatatctatgattgattctttactacttcatgatagggaagttatgccatgtagtgatggtgtggagggtgtttttg

SEQ ID NO: 43173 - DNA, 201 bp, Homo sapiens
tggacaatattctgaatatatccctattttaatgaactatctgttgctatagtggtttcatttctaccacagcaaacaatgcctagaaagactagtctatyaggtgttgatatggttaatattctcctgatagaatcaaggaattctagctcaagtatgtatttttaaaaatcatttagcatcattttgaactccaataaa

SEQ ID NO: 43174 - DNA, 201 bp, Homo sapiens
acccaaaacacgtttctgtagggcattctttgtatgtagcgtaggactttcattttgttactccccttctgtgcattcattcctagcccatgataaaaataaaaaaaaaaaattatgcgtataatgaaaggtctaaggaaacttggatcaggacagatgttggcctgtagaagacttttattccttcacaagttgttatta

SEQ ID NO: 43175 - DNA, 201 bp, Homo sapiens
tcaaagtaccagttagtatgtataaacctaggtaaaatgaattaaattttgtacataatatattattattaaatatagatttaaggggtatagttacaaaygatttttaggagctagtgtgtctaagtgcctgagggtctattatggagagaaaggagttgttgaactttattgaagagcatgttctttacagcaaaactg

SEQ ID NO: 43176 - DNA, 201 bp, Homo sapiens
tatgaactttttaaaaatgaagtgctttttaaaaaaacagattatgaattttattagttcatttatctcagatgagggatcagcaaacattctctgtgaawggccagaaagtaaatatttcaggctttgtgggccgtacattgttgcaagtatttaactctgtgtgttgaagaatgaaaatagctatagaaatatgtaagc

SEQ ID NO: 43177 - DNA, 201 bp, Homo sapiens
tgctttgttcctttgtcagtttgttttactgtaaaccactttaggtatatgaaacttctaaccccaggagatgataataatgttgcaggaatatattttgkgtattttattatcttaaaattattgtcaaatttagctcagtggggtgggtcatggctataatcccagcattttgagaggccgaagagggaggatcacttg

SEQ ID NO: 43178 - DNA, 201 bp, Homo sapiens
gtatatacatcagcattaaatcaaatgttaaaatctgaagaacctctaaggcatgagctaattcaaaccctgtctccacaccccacctcagtgtatgcatrcctgtatttctgtgaaaataggtcctggagaggtaatatgactttttttatgggcataaaatcagtttaaagcaaagtgaaactttaacttgagcctctt

SEQ ID NO: 43179 - DNA, 201 bp, Homo sapiens
ttcattagttcattagttgtacacacacaaacgcataacttatatagtcgttttgaccgaaaccacaaccaaactatattgactaaaatttccagttttgstgtcttcatggaagaaaacttaatgacacttgcgaagctacctaactgcagaatctttcttgatcttttataatccttttccttgccttgccctgctcca

SEQ ID NO: 43180 - DNA, 201 bp, Homo sapiens
acagcccttatgagcgagcgtgggcagggaatgtccttggaataacagaagccccatttaaaaggaggctggtgagtgctttcagcagttccttggagttstgtgtactcctcctataacctcaatcaatccaattaattcctttctttttacttgcctgacaaaatccaactttaaacgaataaaaaaacttatatattt

SEQ ID NO: 43181 - DNA, 201 bp, Homo sapiens
caactaggattttatcaaaggttatcagcaagtggggggcatgatcacttcggcatttgagaaagaaatgtgtttgcattaaggagaatgtctaagagcamatagagactggaagtagaaacctacaaggctactagaatggcccagttaagatataataaggcccgaactcaaaagagactgtttcaaaggtaaactgac

SEQ ID NO: 43182 - DNA, 201 bp, Homo sapiens
gaaagatacgtttttatttcctaacttgttttcttgccttctaaaacaggtctctcttatttctctctggtgttatattcatttgtctgtctcaatctctktatcccagctctccttatccataaaatggggataattataataacatttaccttattgtgttgttacatgattaaataaaatgacacgtgtcaagcataa

SEQ ID NO: 43183 - DNA, 201 bp, Homo sapiens
gaagatttaaattatgaattcaagtcccttcatggttttaaaaatattcagagtatatatttcttcttaattgaattttggtaatctgtgtctttaaagtrtttggttctttttatttaagaagtaaaattatggccataaaattgttctagttttctctcagtatcctcttaatgcctatgatgctatggtgataattcc

SEQ ID NO: 43184 - DNA, 201 bp, Homo sapiens
ttggtagaaactaacaatgacatcatcaccaaagatgacatttttgagaagatttaaattatgaattcaagtcccttcatggttttaaaaatattcagagyatatatttcttcttaattgaattttggtaatctgtgtctttaaagtgtttggttctttttatttaagaagtaaaattatggccataaaattgttctagtt

SEQ ID NO: 43185 - DNA, 201 bp, Homo sapiens
acattagacctatttttgacgaggctgcagcaagggagggaatggctgattctcctgatctgccctatcagtataggggattatttcatttctttccagawtagagggtatacatgagtctcataacttttgtagcttactttagtcatggaaatgatttttcatatattattgtttttctggtaatttctatgcagtttt

SEQ ID NO: 43186 - DNA, 201 bp, Homo sapiens
tttagaagaggagtgctgtacgacaagacaatgtctactttaaatagctttattttaatgagcatgtatgtgagttgtgtcagggacagtgctgggcactkattagccattgtttcagaagagagaaaataaacaaatgctaaaactgattaagaaatatttgatagagcagtatagataagttagatgctcaggcagcag

SEQ ID NO: 43187 - DNA, 201 bp, Homo sapiens
aaacttgtttctttcttacgcttatttgtaaaaaaaaaaaaaaaattggaaagtgactgctccctctgttcagaccacatggtttgcctcttttgccagarcatcgttctctgttctgactttaagctctcccaaagcctacattagacctatttttgacgaggctgcagcaagggagggaatggctgattctcctgatct

SEQ ID NO: 43188 - DNA, 201 bp, Homo sapiens
tttgtatttttagtagagatggggtttcaccatgttggccaggctggtctcgaactcctgacctctagtgatccacccatctctacctcacaaagtgctgsgattataggtgtgagcctccgtgcccaaccctattttgctgtttgacagaaaatttttgattttgtaactgcctgagatacagttgctccctgtggagga

SEQ ID NO: 43189 - DNA, 201 bp, Homo sapiens
tactaggccttctggctggttacataaataggtgtgtctcaataaatgagctattaaatagttgattaactggttattatctctttgtgtccttaggcatytcccaactattgtctctaaaatgagtttggaatgcactttcatgttccactctagctctgatactatctgattatcaagatctagggagagacatgttag

SEQ ID NO: 43190 - DNA, 201 bp, Homo sapiens
tatcagagactaggattgcgacccctgcctttttttgttttccatttgcttggtagatcttcctccatccttttattttgagcccatgcgtgtctctgcaygtgagatgggtttcctgaatacagcacactgatgggtcttgactctttatccaatttgccagtctgtgtcttttaattggagcatttagcccatttacat

SEQ ID NO: 43191 - DNA, 201 bp, Homo sapiens
ttgattcctttaccattatgtaatggccttctttgtctcttttgatctttgttggtttagtctgttttatcagagactaggattgcgacccctgccttttyttgttttccatttgcttggtagatcttcctccatccttttattttgagcccatgcgtgtctctgcacgtgagatgggtttcctgaatacagcacactgat

SEQ ID NO: 43192 - DNA, 201 bp, Homo sapiens
ctgtctaatgttgacagtggggtgttaatgtctcccattattattgtgtgggagtctaagtctctttgtaggtcactaaggacttgctttatgaatctggktgctcctgtattgggtgcatgtatatttaggatagttagctcttcttgttgaattgattcctttaccattatgtaatggccttctttgtctcttttgatc

SEQ ID NO: 43193 - DNA, 201 bp, Homo sapiens
tgttaactttctgtctcgttaatctgtctaatgttgacagtggggtgttaatgtctcccattattattgtgtgggagtctaagtctctttgtaggtcactmaggacttgctttatgaatctggttgctcctgtattgggtgcatgtatatttaggatagttagctcttcttgttgaattgattcctttaccattatgtaat

SEQ ID NO: 43194 - DNA, 201 bp, Homo sapiens
ttctgttgatttggggtggagagttctgtagatgtctattaggtctgcttggtgcagagctgagttcaattcctgggtatccttgttaactttctgtctcrttaatctgtctaatgttgacagtggggtgttaatgtctcccattattattgtgtgggagtctaagtctctttgtaggtcactaaggacttgctttatgaa

SEQ ID NO: 43195 - DNA, 201 bp, Homo sapiens
gttttgagtgagtttcttaatcctgccttctagtttgattgcactgtggtttgagagacagtttgttataatttctgttcttttacatttgctgaggagtrctttacttccaactatgtggtcaattttggaataggtgtggtgtggtgctgaaaaaaaatgtatattctgttgatttggggtggagagttctgtagatgt

SEQ ID NO: 43196 - DNA, 201 bp, Homo sapiens
ctgtataatattgctttcattcacgatgtagaatttcatcatcacatattttgttttcattttaatctagaaactgtctttaatttccacctctatgtcastctaaaatctaatctactggaactagaatctaaaataatatgcagtcaatacaaatttctcttaaaaatgtaacatgttatatttcatggattttgctat

SEQ ID NO: 43197 - DNA, 201 bp, Homo sapiens
cagagattctggtatgttgtgtctttgttctcgttggtttcaaagaacatctttatttctgccttcattttgttatgtacccagtagtcattcaggagcargttgttccgtttccatgtagttgagcagttttgagtgagtttcttaatcctgccttctagtttgattgcactgtggtttgagagacagtttgttataatt

SEQ ID NO: 43198 - DNA, 201 bp, Homo sapiens
taagatgtaatgagtgaaatgtgtaccaggctctgaatcaggctcttacgctttactgcatatattcattcacttgtgtgttgagtgtctttatgtcattrtcatggcaattgctggagatatacacctaccctcacagcccaaggcttgagagaaagacaaataataagtaatcaagtaaagaagttgctactcatgcaa

SEQ ID NO: 43199 - DNA, 201 bp, Homo sapiens
tttcttgccttctgctagcttttgaatgtgtttgctcttgcttttctagttcttttaattgtgatgttagggtgtcaattttggatctttcctgctttctyttgtgggcatttagtgctataaattttcctctacacactgctttgaacgtgtcccagagattctggtatgttgtgtctttgttctcgttggtttcaaaga

SEQ ID NO: 43200 - DNA, 201 bp, Homo sapiens
acagtttctatttggaactgatttagccaagggaaaggaggctacatcgtagatgatagtaacatgttgaaagtagatgcatgctaacaattttagaatgaacaatgttttcggataatcattcactgcctattttggtttcaaaaatgattatccattatgaatgtcacctttattttgaaccttcaaaaaaatgaatac

SEQ ID NO: 43201 - DNA, 201 bp, Homo sapiens
ctctgatggtagtttgtatttctgtgggattggtagtgatatcccctttatcattttttattgcatctatttgattcttctctcttttcttccttcttagycttgatagcggtctatcaattttgttgatcttttcaaaaaaccagctcctggattcattaattttttgaaagtttttttatgtgtctatttccttcagtt

SEQ ID NO: 43202 - DNA, 201 bp, Homo sapiens
gctaacactgtgaagccccgtctctactaaaaatacaaaaaaattagccgggcacggtggtgggtgcctgtagtcccagctacttgggaggctgaggcagragaatggtgtgaacccaggaggcagagcttgcactgagccgagatcgtgccactgctctccagcctgggcaacagagcaagactccctctcggaaaaaaa

SEQ ID NO: 43203 - DNA, 201 bp, Homo sapiens
atttatccatttcttctagattttctagtttatttgcttagaggtgttaatagtattctctgatggtagtttgtatttctgtgggattggtagtgatatcscctttatcattttttattgcatctatttgattcttctctcttttcttccttcttagccttgatagcggtctatcaattttgttgatcttttcaaaaaacc

SEQ ID NO: 43204 - DNA, 201 bp, Homo sapiens
ttcaagcgactcccctgcctctgcttcctgagtagctgggattacaggtgcacaccaccatgcctagctactttttgcatttttagtatagatggagtttygccatgttggccaggctggtctcgaactcttgacctgaggtgatctgcccaccttgacctcccaaagtgctgggtttacaggtgtgagccacaaggatta

SEQ ID NO: 43205 - DNA, 201 bp, Homo sapiens
agatttatttttaattggctctgaaaacatggatttaaactccttgctattcatttgaaactgacctgtattcttatatgttggagaaaagttaaggagtrttgagcgtctaaaattctgttttcttgtttataggacaaagataatagattttaggaacagagtgggcatgcgaagcagcatatgatgtgatgtgcgcaa

SEQ ID NO: 43206 - DNA, 201 bp, Homo sapiens
tcaattaatgatgtggaacattttttcatatacctgttggccatttgtatgtcttcttttgagagatgactattcagatcatttgcccatttttaaatttsttttattcttctgttgatatgtcttatgtattctgtattttaatcccttgtcaaatagtatgaaaatatcttctatcattctgtaggttgtcttgtcact

SEQ ID NO: 43207 - DNA, 201 bp, Homo sapiens
aattacaactcacatgaaaagattggggagcaagccttttcaacttcttgattaacttcaattattggaagcagaaggtcttcagtatattttacataccrgaaaggagataccattaatatgttgctgagaggaataaaaagtttattaatctagagaggtggttaagaggaggtcttttaagacagcttctactatatc

SEQ ID NO: 43208 - DNA, 201 bp, Homo sapiens
tctgatatctgtgtatctcaacatagatttgctgcaatattttaatttcatcatgtctataactcaactaataattttgctcacccaaaccatatattttrtgttctttattttcatcactgaaataatcattaattaaatcatcaagccataaatttgagactgtccttgattccttcataattcttatctctcacattc

SEQ ID NO: 43209 - DNA, 201 bp, Homo sapiens
ttatatgttggagaaaagttaaggagtgttgagcgtctaaaattctgttttcttgtttataggacaaagataatagattttaggaacagagtgggcatgcraagcagcatatgatgtgatgtgcgcaattatgggcatgtccatgctgtgaatggctgcccttaaatgtgtgtagtgcaaaaggtgtgcagttctatgcag

SEQ ID NO: 43210 - DNA, 201 bp, Homo sapiens
ttaatctagagaggtggttaagaggaggtcttttaagacagcttctactatatcctatctatgatgttgggagatgtttctattacttttatagaaactarccccatcaaattttatgttttataaaacattttatataattttaccaacatggcacatatatacatatgtaacaaacctgcacgttgtgcacgtgtaccc

SEQ ID NO: 43211 - DNA, 201 bp, Homo sapiens
gattggtgaataaacctatattttaatatatatacacacatatacatacatatataatccatatattttgtgtatcagtgtttgtgtatataaatttttttcccaaagtttattggaggtttgtatgtgtgcgtgtgtataccgtgtgtttgcttttcctaggatttattcttctagactccaatacaatttccccaaatc

SEQ ID NO: 43212 - DNA, 201 bp, Homo sapiens
aagactcagtcatcatggaaattatgcttggcctgcattatggagtgcatccagttcttcctaatccattacatagaatgacattagctcttcaaatagamcctgccagatgctaaaagccattgtaggtttgtcacctatatttccccggagataattccttcttattcatagctttgtgtcctactactcaatctaatt

SEQ ID NO: 43213 - DNA, 201 bp, Homo sapiens
cagaaaattatccgggcctgatgatgcatgcctgtagtcccagctactcgggaggctgaggcaggggaatctcttgaacccaggaggtggagattgcggtragttgatatcatgccattgtactccaacctggtgacagagtgagactctgtctaaaaaaaaaaacaatctgcaatccatggactcagagtttctaaggtt

SEQ ID NO: 43214 - DNA, 201 bp, Homo sapiens
tctgtgaaccctattatatattgaatcaatgaatatgtactaatgcatgttatatgtgtatgatataaaccttttaccatgatgtatttgtatcacttggmcagatgcatatattagaaatcttaattgaataataaacataatgtcaagtaaaagtttgggaagttttttatctttagtacctgccccttttcattttgg

SEQ ID NO: 43215 - DNA, 201 bp, Homo sapiens
cttgtgagtgtgatacacttgtgttactgatgaggattatgaatcttaagcaggagtctgcccactccacaaccatatgaaataccacttaacatttttttgtaatcagtgccacaggccctttaaagctcatttctgataccacctgcaggtattttgggtaagtgatagatggaaggaataagcgcacacacattgtaa

SEQ ID NO: 43216 - DNA, 201 bp, Homo sapiens
gctgaggcaggggaatctcttgaacccaggaggtggagattgcggtgagttgatatcatgccattgtactccaacctggtgacagagtgagactctgtctaaaaaaaaaaacaatctgcaatccatggactcagagtttctaaggtttataaccctctgattattttgacagccttcatatatactccccctcaatgtatt

SEQ ID NO: 43217 - DNA, 201 bp, Homo sapiens
ttatgtactcttatttaatactcataaaatagtaggtttattattttatattattaaaaaaagaagaaaacgaagagtaatgatgttaagtgacttgattragatactaggacagagacattgaagcagtctggctccagagtacacactgttaattactgtgctatattgcctcctggtcatctgtttcccagtatgaaa

SEQ ID NO: 43218 - DNA, 201 bp, Homo sapiens
atgtgtatgtatttataaaaaaaatgaccaaagtacttgaatagacatttttctaaacaagacataaaaatagccaacgggtatatgaaaaggtgctcaaygtcactaatgagagaaatgcaaatcaaaccaaaatgagatatcacctcacacctattaagatggctgttatttaaaaaaaaagaaaaaaagaaaaacacc

SEQ ID NO: 43219 - DNA, 201 bp, Homo sapiens
ttttgtttttaagccatagccctagttaattgacctgtttctgatcacctgtaccatcttcttctttctcgttttaatcaaaagagaaaggaggaaggagaatgaatgccagaaatgagatgaggtcagggataggaaagagagtcaaggatgaggcagtgtcagaaatgactggcaggtttgtgccaagccaataaattt

SEQ ID NO: 43220 - DNA, 201 bp, Homo sapiens
atggacagctcaggctgtctcagcaggttttattattttattttttatttttatttatttattttttgacacaaggtcccactctgttgaccaggctggartgcagtgttgcaatcatggctcactgcagcattaacttctcgggctcaggcaatcctcccacctcagcctcctgaatagctgggaccacacctggctaat

SEQ ID NO: 43221 - DNA, 201 bp, Homo sapiens
atgtcatgtgcctcttgcaacatgtgtcagctgtaagtaaaagatggcttagtttaccttggcattgtcttcacttctaatttcattctctgaacctggcrtcgatcctagtgcatcttggcttcactctcatttcttaacatcaccccttcagaagcagactagactgggttgtgaagactaatgtatacctcaaaataa

SEQ ID NO: 43222 - DNA, 201 bp, Homo sapiens
agcaaaactccatctcaaaaaaaaaaaaaggtaaatatcattgagtactcatagttattaaaatatgcatatgtatgtgcatacccatgtatatgtgcacwtgtgcatatgtgtatgtatttataaaaaaaatgaccaaagtacttgaatagacatttttctaaacaagacataaaaatagccaacgggtatatgaaaagg

SEQ ID NO: 43223 - DNA, 201 bp, Homo sapiens
agttaattgacctgtttctgatcacctgtaccatcttcttctttctcgttttaatcaaaagagaaaggaggaaggagaatgaatgccagaaatgagatgargtcagggataggaaagagagtcaaggatgaggcagtgtcagaaatgactggcaggtttgtgccaagccaataaattttcaaagatattcctttcacttat

SEQ ID NO: 43224 - DNA, 201 bp, Homo sapiens
taactatgctctctataaataaataaataacataattatatagataatatatgataaacatatgagtataaataacttgagaaatagaaaccttaaagttkaagacatttggaaatttatcctggtttgtaaatgaattctactttgccatgtcctcttgattcaggataaagagtgcatgtttacaggtagtctgtgatg

SEQ ID NO: 43225 - DNA, 201 bp, Homo sapiens
gaatcgcttgaacctaggaggcaaaggttgtgagctgagatcatgactttgcactccagcctgggcaacaagagcaaaactccatctcaaaaaaaaaaaaaggtaaatatcattgagtactcatagttattaaaatatgcatatgtatgtgcatacccatgtatatgtgcacatgtgcatatgtgtatgtatttataaaaa

SEQ ID NO: 43226 - DNA, 201 bp, Homo sapiens
tcacctgtaccatcttcttctttctcgttttaatcaaaagagaaaggaggaaggagaatgaatgccagaaatgagatgaggtcagggataggaaagagagwcaaggatgaggcagtgtcagaaatgactggcaggtttgtgccaagccaataaattttcaaagatattcctttcacttatctgaataaaatgtccatggta

SEQ ID NO: 43227 - DNA, 201 bp, Homo sapiens
acacaatcatggtggaagcaaggaggagcaagtcacatctgatgtggatggcggcaggcaaagagagagcttgtgtagggaaactcccatctttaaaaccrtcagatctcgtgacactcattcactatcacgagaacagtgcaggaaagacctgcccccataattcaatcacctcccaccgggttcctcccatgacacttg

SEQ ID NO: 43228 - DNA, 201 bp, Homo sapiens
caggcagatcacctgaggtcgggagttcgagaccagcctgaccaacatggagaaaccccatctctactaaaaatacaaaattagccagggtggtggcacawgcctgtaatcccagctactcggggggctgaggcaggagaatcgcttgaacctaggaggcaaaggttgtgagctgagatcatgactttgcactccagcctg

SEQ ID NO: 43229 - DNA, 201 bp, Homo sapiens
gaagttccttcgaaaagataaaatgatgtaggaggctggttttcataaggaaatttaatattctaaaacatgtgtcctgtctgtttcttggcttcagttgkattcacagctgttatctaaggtagaaataatttcctttgtctgtaacagctaagtacattgaatgctgaaagtagtagaacatattatgttgctccatgt

SEQ ID NO: 43230 - DNA, 201 bp, Homo sapiens
tctcttttgttttcctctgtttcttacatgtctggtatgttgctcattgataaatatttgttgaatgaatgtcttttatttttcctcaactgatttcacarcaactgagtgaagtaggcaggcaaagacaatttgtcctgtgttatagataacacaatcaaaattggaataataatgacttgtccaaagtgatgcagttat

SEQ ID NO: 43231 - DNA, 201 bp, Homo sapiens
aaaaaaaaccaagtaacttgatttaaaaaaaatgaccaaagtgggccagctgtggtggctcacacctgtaatcccagcactttgggaggccaaggcaggcrgatcacctgaggtcgggagttcgagaccagcctgaccaacatggagaaaccccatctctactaaaaatacaaaattagccagggtggtggcacatgcctg

SEQ ID NO: 43232 - DNA, 201 bp, Homo sapiens
cattatagcaaaatatcgtgtaagcaactacattttcataaatttgtttgtttccatgattgaaatgtgagcactctttaatgcttcctcattatgatttraaattatacattcacagtgctttctaaaaaattttaaagcagaagtatatcctaaaagatgaactttcttttttattttttttaaatgaagtatgctctt

SEQ ID NO: 43233 - DNA, 201 bp, Homo sapiens
ttggctagtaattgaaaaactgtttctgaaacttatatgcaaaggacctagaatagtcaaaacaactttgataaaaggcaaaatttggggactaagactgmctgatttcaaaactcattataaaactatggttatcaagatagtgtagtgttaaaggaaactcagaaaaatagatcaatagaaatgactagagtccataaa

SEQ ID NO: 43234 - DNA, 201 bp, Homo sapiens
cagcacaagaaatcatgtcagtttataaagccaaagagagacgacgacaacgacgacgacgatggctactactactactactactactactactactactwcttttcttttttttttttttttttttgaggtggagtttcactcttgttgcccaggctagagtgccggtggcatgatctcggctcactgcaaccaccacct

SEQ ID NO: 43235 - DNA, 201 bp, Homo sapiens
agacagaaaatgttcattcagaagatgggctaaaagtgggccttgcaagacttgcataggaagagtagtggggccatatggtccaattaaaaaaaaaaaaagataagctatcttttgacaacaatgagtagattaattgaatgaaagctgcatttaagagcgagtataaatatttgttgaatggaaggaaagaagaaaagg

SEQ ID NO: 43236 - DNA, 201 bp, Homo sapiens
catgtctattatcttttcatttatacttacaaaaaaagaagctttttaatttaagtctttctcccataacccattgtaagataccactctttttatttacyttctcaggacttaaaatctccaaatcagagagatgaaattgcaggagcccgagcttcactgaaggagaactctcccctcttgcattcaatttgttcagct

SEQ ID NO: 43237 - DNA, 201 bp, Homo sapiens
caccaccacacccagctaatttttgtatttttagtagagatggggtttcaccatgttggccaggctggtctcgaactcctgacctctagtgatccacccayctctacctcacaaagtgctgcgattataggtgtgagcctccgtgcccaaccctattttgctgtttgacagaaaatttttgattttgtaactgcctgagat

SEQ ID NO: 43238 - DNA, 201 bp, Homo sapiens
ctgaagtgcagtggcatgatctcagctaactgcaacctctgtctcctaggttcaagtgattcttatacttcagccttccaagtagctggaattacaggcaygcaccaccacacccagctaatttttgtatttttagtagagatggggtttcaccatgttggccaggctggtctcgaactcctgacctctagtgatccaccc

SEQ ID NO: 43239 - DNA, 201 bp, Homo sapiens
tagctgaatagagagcttatgtttaaaagttgagatcttatttttttttaatgaggctggccgccaacttcagaaaaattctccattccaattagcctgtragagacaaattgttaattccagtttaataatcttattttcctgaggtgtttttgtttttttttttattttttgagacagtctcactccgtcacacaggct

SEQ ID NO: 43240 - DNA, 201 bp, Homo sapiens
tctagctgaatagagagcttatgtttaaaagttgagatcttatttttttttaatgaggctggccgccaacttcagaaaaattctccattccaattagcctrtaagagacaaattgttaattccagtttaataatcttattttcctgaggtgtttttgtttttttttttattttttgagacagtctcactccgtcacacagg

SEQ ID NO: 43241 - DNA, 201 bp, Homo sapiens
tatgttgtctcattgtactatctccattcaataaattttgttcacatctataatgtatttgggtgaaactatatgatttctaatattcctttcagttttaraatctcacaattctgtgggatccctatcagataatctcttggaccatgtgcagattgaacaaaattctggttaggaaccacactaatgcccagtgatgtt

SEQ ID NO: 43242 - DNA, 201 bp, Homo sapiens
ctgtaagatcattcttagcctgcatcttgggcatactgcacaactttttgaatacctagaaacaacaaattggaacatagaacaaagaataaaagtgcatkctggagcattgctggaaaataatgctgcattatgtaagaatctattgcattattgctacttgaaaggaagatttgactatttggttaatttgtttcttct

SEQ ID NO: 43243 - DNA, 201 bp, Homo sapiens
cagtggatgttgggtgaggaataaaatgacatagatatttctaaataattatatatttcatgaaatttattttaattacattatatttgcaaaattactarttacattgttgaaataaaattgtaatagcgttaagctttattactaataatgatctaaaggattaaaagcatgattattttccaaattttaaaaaattag

SEQ ID NO: 43244 - DNA, 201 bp, Homo sapiens
ggttggaatagtttcagaaggaatggtaccagctcctctttgtatctttggtagaaatccgctgtgaatccatctggtcctggactttttttggtttgtargctattgattattgccacagtttcagagcctgttattagtctattcagagattcaactttttcctggtttagtcttgggagggtgtatgtgtcaaggaat

SEQ ID NO: 43245 - DNA, 201 bp, Homo sapiens
gatacgtcccatcaatacgtaatttattgagagtttttagcatgaagggtttttggattttgtcaaaggccttttctgcatctattgagataatcatgtgktttttgtctttggttctgtttatatgctggattacatttattgatttgtgaatgttaaaccagccttgcatcccagggatgaagcccacttgatcatggt

SEQ ID NO: 43246 - DNA, 201 bp, Homo sapiens
tgatattggctgtgggtttgtcatagatagctcttattatttttagatacgtcccatcaatacgtaatttattgagagtttttagcatgaagggtttttgrattttgtcaaaggccttttctgcatctattgagataatcatgtggtttttgtctttggttctgtttatatgctggattacatttattgatttgtgaatgt

SEQ ID NO: 43247 - DNA, 201 bp, Homo sapiens
cccattcagtatgatattggctgtgggtttgtcatagatagctcttattatttttagatacgtcccatcaatacgtaatttattgagagtttttagcatgwagggtttttggattttgtcaaaggccttttctgcatctattgagataatcatgtggtttttgtctttggttctgtttatatgctggattacatttattga

SEQ ID NO: 43248 - DNA, 201 bp, Homo sapiens
ttttgtatcctgagactttgctgaagttgcttatcagcttaaggagattttgggctgagacgatggggttttctagatatacaataatgtcatctgcaaasagggacaatttgacttcctcttttcctaattgaataccctttatttccttctgctgcctgattgccctggccagaacttccaacactatgttgaatagga

SEQ ID NO: 43249 - DNA, 201 bp, Homo sapiens
tattggtgtataagaatgcttgtgatttttgcacattgattttgtatcctgagactttgctgaagttgcttatcagcttaaggagattttgggctgagacratggggttttctagatatacaataatgtcatctgcaaacagggacaatttgacttcctcttttcctaattgaataccctttatttccttctgctgcctga

SEQ ID NO: 43250 - DNA, 201 bp, Homo sapiens
ttgtagtatagtctgaagtcaggtagtgtgatgcctccagctttcttcttttggcttaggattgacttggcgatgcgggctcttttttggttccatatgamctttaaagtagttttttccaattctgtgaagaaagtcattggtagcttgatgaggatggcatggaatctataaattacctggccagtatggccattttca

SEQ ID NO: 43251 - DNA, 201 bp, Homo sapiens
tcgttttaatcaaaagagaaaggaggaaggagaatgaatgccagaaatgagatgaggtcagggataggaaagagagtcaaggatgaggcagtgtcagaaaygactggcaggtttgtgccaagccaataaattttcaaagatattcctttcacttatctgaataaaatgtccatggtattaccatcactgggttattatagc

SEQ ID NO: 43252 - DNA, 201 bp, Homo sapiens
agggctctgttctgttccattgatctatatctctgttttggtaccagtaccatgctgttttggttactgtagccttgtagtatagtctgaagtcaggtagygtgatgcctccagctttcttcttttggcttaggattgacttggcgatgcgggctcttttttggttccatatgacctttaaagtagttttttccaattctg

SEQ ID NO: 43253 - DNA, 201 bp, Homo sapiens
aatgccagaaatgagatgaggtcagggataggaaagagagtcaaggatgaggcagtgtcagaaatgactggcaggtttgtgccaagccaataaattttcaragatattcctttcacttatctgaataaaatgtccatggtattaccatcactgggttattatagcctttttcattatactttctaacccataatgttttaa

SEQ ID NO: 43254 - DNA, 201 bp, Homo sapiens
gcttcgctgctattaattgatattcattttccccctatttctttttataacatagatgttcatgtcttgagatttttcatttccatatatattttcagaawtggagtatgataaaacttaatagatttagaggaattttcataaattctttggtggccctgagttttaagctgctataaattaccatggtagaactaatgt

SEQ ID NO: 43255 - DNA, 201 bp, Homo sapiens
gtagatatgtggcattatttctgagggctctgttctgttccattgatctatatctctgttttggtaccagtaccatgctgttttggttactgtagccttgkagtatagtctgaagtcaggtagtgtgatgcctccagctttcttcttttggcttaggattgacttggcgatgcgggctcttttttggttccatatgacctt

SEQ ID NO: 43256 - DNA, 201 bp, Homo sapiens
cttatctgaataaaatgtccatggtattaccatcactgggttattatagcctttttcattatactttctaacccataatgttttaaaattatctttattayattttactttctttaattgacaaaatgtatatatttattgtgtacgagataatgttttgaagtatgtataaaaatggaatggctaattaacttatgcact

SEQ ID NO: 43257 - DNA, 201 bp, Homo sapiens
cattccttacactttgaaagggaccttccagaaggtccctttcaaatactaattttttttttttacaaactattcgctagagcttagtcatactgttatawttcactgcaaggtatgctacaaaatataaattttgtatgtttgtttgtgtgttaatcctgcacattgctttccccagtgtaatcagagttctgtttctat

SEQ ID NO: 43258 - DNA, 201 bp, Homo sapiens
tagctttctacatatcgctagccagttttcccagcaccatttattaaatagggaatgctttccccattgcttgtttttttcaggtttgtcaaagatcagakggttgtagatatgtggcattatttctgagggctctgttctgttccattgatctatatctctgttttggtaccagtaccatgctgttttggttactgtagc

SEQ ID NO: 43259 - DNA, 201 bp, Homo sapiens
acgagataatgttttgaagtatgtataaaaatggaatggctaattaacttatgcactacctcagctagtggcaggccctctacttcagagtctgatctgcttttttttttttttgattattattgtaaccactgtttattaaagacttctggcctctggtttctttaaaatattttcaatctctaaccctttcttctctag

SEQ ID NO: 43260 - DNA, 201 bp, Homo sapiens
tctttttaaaagcagtatcagtattatggtgaaggcaaaaattgtatcatgatcagttgagtactgagtatgcaatgacagataaaatatggtggcacagrctcaattttccaaaagtttgaagttgaaaggaataaaagagagagaaagaaagaaagagatacttgagggtcagagcagacagagtcaccaaaagcattt

SEQ ID NO: 43261 - DNA, 201 bp, Homo sapiens
aattgtacatagttgtttgtcccaaaggagaaaagaatgtgatgttacatttattctttagttttctgatatagagaaaagaaggttggatgcatcatgcmaggtcatcctgagtcagtaacaaattcagaattaatattcacatttcctaatatccagctttttgcaatagccatttgatcattttcactacttcataaa

SEQ ID NO: 43262 - DNA, 201 bp, Homo sapiens
cgagataatgttttgaagtatgtataaaaatggaatggctaattaacttatgcactacctcagctagtggcaggccctctacttcagagtctgatctgcttttttttttttttgattattattgtaaccactgtttattaaagacttctggcctctggtttctttaaaatattttcaatctctaaccctttcttctctagg

SEQ ID NO: 43263 - DNA, 201 bp, Homo sapiens
agagtgcagatacctcttcaaaatactgatttcatttcctttggatatatactcagaagtgggattgctggatcatataatagttctatttttttaaaatmtattttaggaaccttcatactactgttcatagtggctgtaccaatttacattcccaccaaggttcccatttctctacaagcattcccatttctgattaca

SEQ ID NO: 43264 - DNA, 201 bp, Homo sapiens
gtagtcataaacccaagtattcaaaaaatagaggttttttctcgaaataatttctgttttgagacagaatggcaaaaactaaaccttagccatttggcagytctctaatttatggggctttccatattgccaagggatgacgacctttatgcttccatttcatctgacatttgctgagactcattatcctttctagtcatt

SEQ ID NO: 43265 - DNA, 201 bp, Homo sapiens
gttctatacatagcccattgaattaaagtctgtaattaagaaccatagccgtatttatctcttacacggcatgttacagctcaacctgccctgaacaaaayaaataacactttaaattacaaattgcagatctgtgctcaacaaagaggagctcttttccagtgtatattattgattatgttttccttgggtaatttttgt

SEQ ID NO: 43266 - DNA, 201 bp, Homo sapiens
ttcagagtctgatctgcttttttttttttttgattattattgtaaccactgtttattaaagacttctggcctctggtttctttaaaatattttcaatctcwaaccctttcttctctaggtctttttctgtaggatccaatgcaataatttaagatgctatttgctgacaggagatcccaagaacccattatggaaatgaag

SEQ ID NO: 43267 - DNA, 201 bp, Homo sapiens
gttgagtactgagtatgcaatgacagataaaatatggtggcacagactcaattttccaaaagtttgaagttgaaaggaataaaagagagagaaagaaagaragagatacttgagggtcagagcagacagagtcaccaaaagcatttttgtttgttaacatttttatttatatactgcctaaagtggcagtaattgagaaat

SEQ ID NO: 43268 - DNA, 201 bp, Homo sapiens
atttagcttaacatttttagtatcacttatgggattttagcaagatgccacaatatgaacttgtaatattgcatttcttttttaactgtattattacaaayctgattttaaatcatttttttctattttagttacagcattaatacaggctaaaattctctatataaattctgctcatattagtatagcacctggtagcac

SEQ ID NO: 43269 - DNA, 201 bp, Homo sapiens
acaccaacttttaatataattcatacttttgtaatcaatataagtgagtgaagaagtaataaggaataagtatttttgtttaatggtagtcataaacccargtattcaaaaaatagaggttttttctcgaaataatttctgttttgagacagaatggcaaaaactaaaccttagccatttggcagctctctaatttatggg

SEQ ID NO: 43270 - DNA, 201 bp, Homo sapiens
ccaagaagaattctccaatagagtagtaaattttaaatggaaatgtttgtaattatttaatgagaaaacatgcttttttttccatttccagaatggaaaakatgttctttccaaactttaatacttcataactttagaaaataaataatttaattttaatatagtaattcatgaagttcgtatagttaatttatgttttct

SEQ ID NO: 43271 - DNA, 201 bp, Homo sapiens
gggagaagggaaggatccatatggttgggtttgccctgccttggtgtctttctctggagacatctatcaccactgtcaagagatttgttctccttcctttrattctgaaaactggaattttgttatagtctctctccaaatctgtacttttcttactttatttataaagcgtactttttcccctttattaagccatctctt

SEQ ID NO: 43272 - DNA, 201 bp, Homo sapiens
aacaaggtatgcatttaaaactagaggtaatttccctttcatcagcccagggtttttaaactgggaaacatagtattttgaggggaagggtactttagctkctccttagatataacactgtctatcatttaaaagatgagagccttagctgctctccttagaaacaatctttgtccattgtttaagacttgaaaaattgat

SEQ ID NO: 43273 - DNA, 201 bp, Homo sapiens
aatatggtggcacagactcaattttccaaaagtttgaagttgaaaggaataaaagagagagaaagaaagaaagagatacttgagggtcagagcagacagartcaccaaaagcatttttgtttgttaacatttttatttatatactgcctaaagtggcagtaattgagaaatgtttaggtaaagaaaaaaaagcgaccagaa

SEQ ID NO: 43274 - DNA, 201 bp, Homo sapiens
acatttttgtcttaaaaacagagagtaaataactctgggtttaagatatctaacatgtttgacctttgttatgctaaaatagtgggctagaattggatccrtaaaaaaatgatcggatgtttatccagggaaggaatcttaagttagacttggtattaaccaatgtgtgataagtaaggtaccacttgtgaacatgtggtt

SEQ ID NO: 43275 - DNA, 201 bp, Homo sapiens
catgttttacaagcccaaggggtcttaaagagtgggcattgaaatgaccgtgtgtcacctacgtataagaacaaatatactagttgatctcatttcaattsttgtttgtaataaacaacaccaacttttaatataattcatacttttgtaatcaatataagtgagtgaagaagtaataaggaataagtatttttgtttaat

SEQ ID NO: 43276 - DNA, 201 bp, Homo sapiens
cttttcttaccttaaatgtgtggtaaaattgctacagtatttctaaatggcctttccagcttgaattcattcttattttcctgttctgacctctagctaaycaagtaatataattaaaatctgaagaaatagcaaaatggtcagtttttgagcataacagttccatgggggaaatcacactttaatgtttaccttttgcta

SEQ ID NO: 43277 - DNA, 201 bp, Homo sapiens
ggatgttgggtatgtgatcctgccctgtgcccagaggacaatgggaatatttgtgaacagccttaataactattacattccctttgccttctttttagggkttccttttgttaagtctccataatgctctcaagacactttggcacccttgttacagctaactttatcagggtgggcaactgacttagtgacactcagtta

SEQ ID NO: 43278 - DNA, 201 bp, Homo sapiens
aacatgttttatctgtgagcccatggggttgtcctgtcacagatatggccattgctcatgccatgcatgctacccaggaacttaatgaaccacatggcccratactgccactgccagaacccaagaaagccacctggaggtccaagaattagccttcttagacctaattacattcgtgcccatgcacgctgcctgtgggcc

SEQ ID NO: 43279 - DNA, 201 bp, Homo sapiens
gatatgagcactctattcaagtttcattttagcaatagaacaaaataaggatgtccacatctcaatcacttttctcaacattgcttagaagagaaaataasctaagttcacagcaagtttttgagatcatgaacagagatagcatatgatagacattttttaccagagccaagctccaggacattgtctggatcttggaac

SEQ ID NO: 43280 - DNA, 201 bp, Homo sapiens
tacatattcacacctcttaatatgtacttcatgttttacaagcccaaggggtcttaaagagtgggcattgaaatgaccgtgtgtcacctacgtataagaasaaatatactagttgatctcatttcaattcttgtttgtaataaacaacaccaacttttaatataattcatacttttgtaatcaatataagtgagtgaagaa

SEQ ID NO: 43281 - DNA, 201 bp, Homo sapiens
gtccagatttaaaaaactattacagtaacagatgacacattctaaaaattttaagaaaccttctcttagaagtggaataacagccaggtgtggtggtgcgygcctgtggtcccagctacttgagaggctgagtgggaggattgcttgggcctgggaggtggaggttgcagtggtgagctgtgatcacgccactggcactcc

SEQ ID NO: 43282 - DNA, 201 bp, Homo sapiens
caaaattaatcaaacagcacaccaaaaagataacacatgttaatcaagtgggatttatccttgggatgcaaggatgattcaacatacacaaatcaataaaygtgatacatcatatcaaaagaatgaaagattaaaaaatgtgatcatctcaataggctcagtaaaagcatctgataaaattcaagatcttttcatgatgaa

SEQ ID NO: 43283 - DNA, 201 bp, Homo sapiens
tgtgacagatggtaactggaaaattgggacactcccaccctaatactgtgcttttccaatggtcttagcaaatggcgcaccaggagattatatcccacacmtggctcggagggtcccactcccacagagcctcactcactgctggcacagcagtctgagattgaactgcaaggtggcagcaaggctgtgggaggggcgtct

SEQ ID NO: 43284 - DNA, 201 bp, Homo sapiens
gccgtgggtttcaagcacaaaactgggaggccgtttgggcagacactgagctagctgcaggaattttgtttcataccccagtgacaactggaatgccagcragtcagaactgtttgctcccctggaaagggggctgaagccagggagccaagtggtgtagctcagcggatcccaccccaacagagcccaacaagctaagat

SEQ ID NO: 43285 - DNA, 201 bp, Homo sapiens
ttggtattgtacatattcacacctcttaatatgtacttcatgttttacaagcccaaggggtcttaaagagtgggcattgaaatgaccgtgtgtcacctacrtataagaacaaatatactagttgatctcatttcaattcttgtttgtaataaacaacaccaacttttaatataattcatacttttgtaatcaatataagtg

SEQ ID NO: 43286 - DNA, 201 bp, Homo sapiens
tacttcgttctattcaccagagtgattcctctaaataaaacagttgatgttttagtgctcaaacatctgcaatagttcttatgatctgcagcctccatacmtttctgactttctctcttactatgctctttgtagctcactctgccctgcttacactggcctccttgctgttctgccactgcttttctgccttaggcttct

SEQ ID NO: 43287 - DNA, 201 bp, Homo sapiens
acaaatcaataaacgtgatacatcatatcaaaagaatgaaagattaaaaaatgtgatcatctcaataggctcagtaaaagcatctgataaaattcaagatmttttcatgatgaaaactctcaagaaagtagatttagaaggaatataccccaacataataaaggccacatattacaaactcacagctaacatcatactgat

SEQ ID NO: 43288 - DNA, 201 bp, Homo sapiens
ataatgagatagtgtagtaaattatgaaaggctgggaacgtggcttcagtaaaggcagaaagtcctttattattatttttaaacctatctttctcctaacygtaaacataagccatatattcatgaatacaacccccaccagtgtgtgaggccagtctattaaaaataaaaaggcacataggagtctgtcacaccgcaaga

SEQ ID NO: 43289 - DNA, 201 bp, Homo sapiens
aaatcaaactcttaacataaaagctatgctgtacaaatattccttttgcgagcttttttttttttttcccccacgttgagctaggtgaagcttctgaaacaggaaatcaaagaaatctggcctgaaaggcaacccccgccttttaaaaaaacaaaacaaaactacctttaaaaagcacaggcatttttattgcttcaagga

SEQ ID NO: 43290 - DNA, 201 bp, Homo sapiens
tggatattccctgtctttattgtgaatctcagcttgtatcacatgtttattatttagcatttgagcatctgcagagaacttagcaccatccttccctttcyaagatttgcagcacatatgtggctaataaatacgaagctggatgatataaacaactccattggctctgtttcagctctaccactgttggaccttgacaag

SEQ ID NO: 43291 - DNA, 201 bp, Homo sapiens
agggttcagcttaagtatcacttccttacagtggatttctctgattaatctaatgtagactttcgcctcttcatagcagttatcactgtaggaaattatcytgcacatttgatctttaagttgtttattgcctggcttctccattgggacataagcacattgtctctcttgatattaagtggcactcaataaacacttgtt

SEQ ID NO: 43292 - DNA, 201 bp, Homo sapiens
cctgtattctaaactgcctaggggaaataactgatataattttgaagtacatatttttggatattccctgtctttattgtgaatctcagcttgtatcacawgtttattatttagcatttgagcatctgcagagaacttagcaccatccttccctttctaagatttgcagcacatatgtggctaataaatacgaagctggat

SEQ ID NO: 43293 - DNA, 201 bp, Homo sapiens
gcatatagtgtatggaggcatttttgctaaaagtaaaaaggagtattttaagtaagtagtatctattcactgcttattcaatctctccctacccctaagcrttatccttaattttttttaatctacaaatagaattgaggctaataaggcctttagatgtaggttcttaaggcacctgcgaaaaccaaaaaccattgagtg

SEQ ID NO: 43294 - DNA, 201 bp, Homo sapiens
gccagtggaggagacattttttgccaagggggatgtcttactgtcaaaacctataacagttatgccttggatgattggtgttatctagctgttaactgaastatgcacagaaaactgacactttcgcaggcttttttggtgttgctatttcttcctggatccaagtgctggagtggctctttggtgcttagtgcagtcagt

SEQ ID NO: 43295 - DNA, 201 bp, Homo sapiens
aaagaaacacactctgctgtgccatagcgttagtaagccaatgaaagttgatggtatattcaaatgtctcttgctgtgtgtgtgagagagagagagagagrgagagagagtgagagcgattaagagagagactgatttgacatttattaataacttctccatattttatattcagaaaaaactgctaatcagtttcagcta

SEQ ID NO: 43296 - DNA, 201 bp, Homo sapiens
aaggcaggcagatcacttgaggtcaggaattcaagatcagcctggccaacacatggtgaaaccctgtctctactaaaaatgcaaaaattagcttggtgttrtggtgcacgcctgtaatcccagctactcaggaggctgaggcaggagaatcacttgaacctgggagacagaggctacagtgagccaagactgcaccactgc

SEQ ID NO: 43297 - DNA, 201 bp, Homo sapiens
tagagctccaaaggaaagaaacacactctgctgtgccatagcgttagtaagccaatgaaagttgatggtatattcaaatgtctcttgctgtgtgtgtgagwgagagagagagagggagagagagtgagagcgattaagagagagactgatttgacatttattaataacttctccatattttatattcagaaaaaactgcta

SEQ ID NO: 43298 - DNA, 201 bp, Homo sapiens
taaaaatgcaaaaattagcttggtgttgtggtgcacgcctgtaatcccagctactcaggaggctgaggcaggagaatcacttgaacctgggagacagaggytacagtgagccaagactgcaccactgcactccaggctgggtgaaagagtgagtgaaactctgtctcaaaacaacaacaacaacaacaacaacaccccaaa

SEQ ID NO: 43299 - DNA, 201 bp, Homo sapiens
tcactatgggtcttggaacacataccttgtctataaggggggactattgcctatataaaatatattgaaaattcagatacagcatatagtgtatggaggcrtttttgctaaaagtaaaaaggagtattttaagtaagtagtatctattcactgcttattcaatctctccctacccctaagcgttatccttaatttttttta

SEQ ID NO: 43300 - DNA, 201 bp, Homo sapiens
tatagagctccaaaggaaagaaacacactctgctgtgccatagcgttagtaagccaatgaaagttgatggtatattcaaatgtctcttgctgtgtgtgtgwgagagagagagagagggagagagagtgagagcgattaagagagagactgatttgacatttattaataacttctccatattttatattcagaaaaaactgc

SEQ ID NO: 43301 - DNA, 201 bp, Homo sapiens
tgttttctactgtctctgtgaaagtatggaatgaacagggtctaataccctggaataccacctggcagtatctgctacacattactttaatcttcaactgrttaatcggaccaagttttcttttctggatttttaaaatgctggatttctattgagcaacaaattatgtcttcaggtctccgtgaagggactttttgcatt

SEQ ID NO: 43302 - DNA, 201 bp, Homo sapiens
gttgtaagaacaaagaagtgaacacattttcgtcttttttattctctcaaaaagtaatcctctgtctaaaataaattatatatacatttttccttttttgwaagagaaggattttcttggaatgtgataatattctttcttataaaatgcaaattctcatgaatatccaacttcattttttaaagttacctgatttgttcc

SEQ ID NO: 43303 - DNA, 201 bp, Homo sapiens
ggctgcatatttctgcatgattgtatattattcaagaacttattcatttatgtgctcttttggtaacatttaaacagtaattttaattattatgaacaacrttaagcatatttttgtctatttgctatctccttcatatagacttcacaaagtaaattcagtcaacaccttatattggaaaagccttttgtaatttgactg

SEQ ID NO: 43304 - DNA, 201 bp, Homo sapiens
acaacttaagcagttcaaaacataaacaagaaacagaaaactcatgtaaaggttacttaaataacaaaaacccttccttatctcatatacctagatgtttkatatacttggctttagggttactagccctagcaaacggaggacttgggtaggagcagttaagctatgtggagagggatattttcatggctaacattattt

SEQ ID NO: 43305 - DNA, 201 bp, Homo sapiens
ccctctagatcttttttgtaccagcctagatgctgtaggtccaaaataaaaccaatgaatagatgggttacctttttttttttttttttttttcagataaytaatcatagtttgaatagctgtgatgagaattggcacaatcttgcatcttctgtaggggacagattttcttagaaaagttacagatgtgtttaatagcaa

SEQ ID NO: 43306 - DNA, 201 bp, Homo sapiens
gtagttactatttgtgcaacattttataaatacatacacacataatgccttagcctgaacctgctcctgctgctataacaaattactttagagtggataawttatttatttatttctcatagtcctggaggctgagaagtacaagttcaaagacccagcagctctggtgtcaaatgagggctctctccctgcttcagagat

SEQ ID NO: 43307 - DNA, 201 bp, Homo sapiens
atcctgccctggggcctaattgctgctgcatctccacatcacaggtgcacagcctacatcccccgacaccatcccagaaggttgcagtgttacattaccarctgaacctaatggtgccacagggtctctgttacctgagcccacacagagacctaaatcccagggaataggcagtcctgcacgtcagggaggctctcccca

SEQ ID NO: 43308 - DNA, 201 bp, Homo sapiens
tggccgcttgaatcccaagttccacacaggaagaggaggggccaggctcttccttgctgcaaatggactggaacctctgtgtgactgcacccgagtgcacsttcccagtgtgcagacctgtttggagttttgccagggaccccctcacacctggctgtctcactatcacctaaatgattttgatcatggtctttaataata

SEQ ID NO: 43309 - DNA, 201 bp, Homo sapiens
tgataatgacttgaggtgatgaatgttttaattaccctgaatttataatcacacactgtatacatgtatctgtcacttggtaccccataaatatgtttcayttattatgtgtcaagtaaaattgaaagaaaaaaagagaaaaatgaacaaaatgtaataacaaaggcctttttgtccatgacatcatagtgagcatgacct

SEQ ID NO: 43310 - DNA, 201 bp, Homo sapiens
aataacaaaggcctttttgtccatgacatcatagtgagcatgacctttggcttctacaaagttttaatctaaatttgacaaagaaaatggaaaataaattkattttccatgttctttcataagctgatgccaaaaaacacataataatgttagcaagagcaaaatgttaaaattaactgcatcaaaactaagcactattaa

SEQ ID NO: 43311 - DNA, 201 bp, Homo sapiens
gaatgaaagaaaatacaatgaagaaaaatacacagaatttgctttgagagaactcacaatctggtgtatatgaatcagatttcaaaagaattgtatttgtyacgtaaacaaaatcttttacaattaatgctgctgtactgtcaggatactgaggaaatatttttaaagaaacagctgttcagctggattattgaattgaac

SEQ ID NO: 43312 - DNA, 201 bp, Homo sapiens
atctcgactgactgcaacttctgcttcctgagtagctgggattacaggcatgcgccaccatgcctggctaatttctgtatttttaatagagatggggtttyaccatgttggccaggctggtctcgaactcctgacctcaagtgatctgcccacctcggcctcccaaactgttgggattacaggcgtgagccaccgtgccca

SEQ ID NO: 43313 - DNA, 201 bp, Homo sapiens
tattttgaagccaggtcgtgtgatgtttccagctttgctgtttttctcaggattgctttggctattcagggtcttttgtggttctatgtaaattttaggattttttttttctatctatgtaaaaaatgtcattggtatttttctatgggttacactgaatctgtatattgctctgggcagtatggacattttaacaatatt

SEQ ID NO: 43314 - DNA, 201 bp, Homo sapiens
gcatttgggctgattccatatttatgcaattgcaaattgtgctgctataaacgtgtgtgcaagtatctttttcgtataatgcctttttttcctctgggtaratatctagtagtggggttactagatcagatgatagttctactttcagttctttaaggaatctccacactattttccatactggttgtactagtttacatt

SEQ ID NO: 43315 - DNA, 201 bp, Homo sapiens
aagggggatgtcttactgtcaaaacctataacagttatgccttggatgattggtgttatctagctgttaactgaactatgcacagaaaactgacactttcrcaggcttttttggtgttgctatttcttcctggatccaagtgctggagtggctctttggtgcttagtgcagtcagtagcatcttggttcctctgaagcatt

SEQ ID NO: 43316 - DNA, 201 bp, Homo sapiens
tcttcatatataaaacaaaggaatttctcttaaggtagcaaatggctattatctatttccacaaatgtagaacaaaatcagaggacaaagctcttattcargcataaatatgcttgagtgcagctagcagttatttggcactttctctatctcaggttatgctaatcactttacttattatttcctgtaatccttgaaata

SEQ ID NO: 43317 - DNA, 201 bp, Homo sapiens
aatgtaaaacaaaatcattcagcatgaaaaagtgttgctcaattttcagcaaggttttcttatgctactatagagctccaaaggaaagaaacacactctgstgtgccatagcgttagtaagccaatgaaagttgatggtatattcaaatgtctcttgctgtgtgtgtgagagagagagagagagggagagagagtgagagc

SEQ ID NO: 43318 - DNA, 201 bp, Homo sapiens
gctctgttgataatttcctttgcagaagctcttctgtttaattagatcccacttctcactttttttttggtaaatggttttgaggatttagtgataaattrtttcccaaagtcaatgtccagaatggtgtttcctaggaaatcctatagtttgaggtcttacatttaaatatttaatccattttgagttaatttttatatg

SEQ ID NO: 43319 - DNA, 201 bp, Homo sapiens
ggtatctacccaaaagaaaaggaatgaatatatcaaagagatgcctgtgtgcatatgtttattgcagcacaattcacaattgcaaagatatgcagtcaacytaaatgtccattaactgatgagtggataaagaaaatgtgatgtatgttatcatggaatactactcagccataaaaagaatggaataatgtattttgtggc

SEQ ID NO: 43320 - DNA, 201 bp, Homo sapiens
tgcctttcaggagcttagacagctttatttaagttgaactttctctagagatgcattgaaataatgaaatgcaatgccttacttgaacataaccatgtacrtaacatctagtcctgcctgatgtgtaaatttgataagagcaactcaaatattataatgattaatgttgatttttttattacaaagcaatctttgtcagca

SEQ ID NO: 43321 - DNA, 201 bp, Homo sapiens
ataggaatgtgccaaattccccattaggcaaagtgcagctgaaggaaaaaaacagagctggatgcagacatcctgatgttcacgagttgagctgaaagccrgggaaaaacacagaagaaaaggggagagaagacaaaaaaaaaaatcaagtagctgtagattctaggatagtaaagtgctggcgtcaaaatctataaaggc

SEQ ID NO: 43322 - DNA, 201 bp, Homo sapiens
atgagttagaaaggagtcctatcccttctcctcagttttttagaatagtttcagtaggattgctataaactcttctttgtacatctggtggaattttgackgtaaattcttctggtccagggcttttttttttggttggtgggctttgtattactggttcaattttggaacttgttattggtctgtccagggtttcaatct

SEQ ID NO: 43323 - DNA, 201 bp, Homo sapiens
gatcattttgggtgtggtctcctctttggagagtgcctcaagcctttaacttaattactctcttacaaggtagatctgttcagaatgggtatttttacttmattatattctatcatgtgattttctctgtagtatgtccttatactttaaaatattattttaggcttagtaaaattaatattactctctttaacaggcagc

SEQ ID NO: 43324 - DNA, 201 bp, Homo sapiens
cttaatatggatatttgatgaacactttgctgttgaatatgcactttagtagtggccctattttttgtgactgcagagttataaataaaataaaatgataygtacattaaaaaattttttaactcttttgtaaggatggggtcttgctatgttgcccaggctggtcttgaactcctgtcctcaagccatttttccacctgg

SEQ ID NO: 43325 - DNA, 201 bp, Homo sapiens
tgtgtgtgtgtgtgttccctagcaaaatcaatgaaattccatattttcccttttgattactaatgtctgaatgttattaatagcaaatcaataactcctartaataattattaaacattgatttttttcatgctttcatctgttccacagtttctcatctgcagcactattgactttgggggctggataattctttgttgt

SEQ ID NO: 43326 - DNA, 201 bp, Homo sapiens
gtggaattttgactgtaaattcttctggtccagggcttttttttttggttggtgggctttgtattactggttcaattttggaacttgttattggtctgtcyagggtttcaatctcttcccgattcaatcttggtaggttgtttccagaaatttatccatttcctttagattttctagtttatgtgcattgaggtgttcata

SEQ ID NO: 43327 - DNA, 201 bp, Homo sapiens
acatccttaaggagccataactattccaagagatggatgacaatctttaacttgtgaactaggggtgggaggatgtgaggtgggataagcagtgccctttmtattttttcctatgcctccttgcccagtaaacagactttctttccttttaaagagctggaggtataaaaatttaatttgggaaaattatgtaggtggacc

SEQ ID NO: 43328 - DNA, 201 bp, Homo sapiens
ttaataaatttgtaggcttgcaaagtagaaggagccttagactggagccctggttacatgggaagagggattctatttggcactttccacgtaccctgggraaataacataaagacattaagaccactgcttttttataacaatggaaagtagagattagtcattcatcagatgatcactctaatgaacatctcgttaatg

SEQ ID NO: 43329 - DNA, 201 bp, Homo sapiens
ctgggtgacagagtgagacattgtctcaaaacaaaaacaaaaagcataaagaagatgatgaattcactagaaattgggcctcctataataagtgtattttmttctctgggtttctagattaagagatgaagggaattatgcaaaaaaggatggtgtgtagaggattacaatgtgttaggtatagtcaagattttcttgtgg

SEQ ID NO: 43330 - DNA, 201 bp, Homo sapiens
tgatgacagagctggatgttagaattttgtagtttgtgttgtgtaagtgacagatgaagccagagcactgtctactgttgtccaagaagagaatgaaagtwaaaaaaaaaaaattgctcaggaacaaaagctgagaacaacaacacgtgcaaggaaaaaaaaaaatgcttacaatacagtctgggaaggctggtgtaaaac

SEQ ID NO: 43331 - DNA, 201 bp, Homo sapiens
atcaataactcctagtaataattattaaacattgatttttttcatgctttcatctgttccacagtttctcatctgcagcactattgactttgggggctggwtaattctttgttgtggggggcttccttgaacattgtagagtgtttaacaacatttccagtctccacccactctgatgccagtggccatccctttacctgg

SEQ ID NO: 43332 - DNA, 201 bp, Homo sapiens
taagcaaatattccaaagttattattaaatgactagacaaacggtggcaaaattttgggtaatcaaattaggtaagaagaaatatgtgctgggggtggagmtaagatggccggataggaacacctccagtctacagctcccagcatgggtgatgcagaagatgggtgatttctgcatttccaactgaggtaccaggttcat

SEQ ID NO: 43333 - DNA, 201 bp, Homo sapiens
ttagaattttgtagtttgtgttgtgtaagtgacagatgaagccagagcactgtctactgttgtccaagaagagaatgaaagtaaaaaaaaaaaaattgctyaggaacaaaagctgagaacaacaacacgtgcaaggaaaaaaaaaaatgcttacaatacagtctgggaaggctggtgtaaaactaggagaaaatctaagag

SEQ ID NO: 43334 - DNA, 201 bp, Homo sapiens
ctctgacaaccaatcgctaataactgactgagagaaggatataaagctcaggctccttgcttcaagatggaaccaactctgctgtacaatttcacaacccrctctgaggtcaggtaaagctagtctcagacttagattaataattttcttattagttccaggccctacctccccatgcttttttcttccctccccttctga

SEQ ID NO: 43335 - DNA, 201 bp, Homo sapiens
atttgtagggcaggttggcaggctggaaactcaggcaggatttctatgttagtcttaaggcagaatcccttcttatgggggatacctcagttttctgtttwtttttttttctgtttttatcttttgcttttatggcttccaacttactgggtgaagcccacctacattatcaagggtaaactctttaattaaagtcagttg

SEQ ID NO: 43336 - DNA, 201 bp, Homo sapiens
aatagtctttgtggtataaatctgaaataccagaaataattagcaagtgtatataaacaaaaccaagttacgatcagtgttcaaaccatagcacttatttmcacacacacacacacacacacacaagagaagtcagatttttagagccccttgcctctggattggttcaaacacagagccctttaatacttgtcattcaac

SEQ ID NO: 43337 - DNA, 201 bp, Homo sapiens
aataacaaatggtaacatgaataacaaatggtaacaaatggtaacaatgtcctaacctaggggtctgtaaaagacagaaatgttcaaatagacatttcttyattgaccctcaataaaacctgaagttacattaaatttcaacttagtgaaggctctttagcacggatttgtggtaataatatgacctggaaatgttacttt

SEQ ID NO: 43338 - DNA, 201 bp, Homo sapiens
tgcttgttttggattttttcctttgaacagcaggcatcataaattgataaaactttactagaaaagttgattctagcctcatcgttttcctctcttttcckttcctttcctcgtctataatctagaatatacaaactctcttattgtgaaatacttggggagggcagctttgaaaccatctttctattgcatgagagtatt

SEQ ID NO: 43339 - DNA, 201 bp, Homo sapiens
attgcaacatttaggattattgagacagagagaaagagtttagaatcattcctaggattctgcgttagataatgctatgatgagtaacagaaaaaaaaaaaggttaatacaggtgaaagtacttttatatcccttcatttcacattcacagaaactataaaagtttggtgccaatgtagctgtacaacttgttggcttttg

SEQ ID NO: 43340 - DNA, 201 bp, Homo sapiens
catttggcaaccttgggccttatttcatcatggcatcatcacttatgaattagctaaagctggggtggagctgccttctttatctaggacatctagtcttrtgctcaatgctgtccctgggccagcttcactcattcatgttacctgtgcagctcccggggaagaacatgtgagctatgatgaaacaggggcccctgctga

SEQ ID NO: 43341 - DNA, 201 bp, Homo sapiens
agaaatgttcaaatagacatttcttcattgaccctcaataaaacctgaagttacattaaatttcaacttagtgaaggctctttagcacggatttgtggtartaatatgacctggaaatgttactttctgatgatctagctaatcacaaaaaaaaacactgacaaccataggggaataagtgcattaagttgtctctgcaat

SEQ ID NO: 43342 - DNA, 201 bp, Homo sapiens
tagaccatagcttgagaattgctgttctaggaagaacttgcctcttttcctagtaaattttagtgagacagaaagcctgataatttttagtatccaagtastgtaaattctgtaaattcagcatgtttaatcaaattactcactgatcttgctttcaatgccagcttcatacatcaccaactcacaaatcatataaagtac

SEQ ID NO: 43343 - DNA, 201 bp, Homo sapiens
atgaaaatcactgtcctcacaaagcttacattctctttattataagtttattttattatattattaatgatatttacattatattattatatttaattatwatattacagttttattataaatttatttaccataaattactacatatacaaacatgtattgctgcacagtttcatatataatggggagcatactgtattt

SEQ ID NO: 43344 - DNA, 201 bp, Homo sapiens
acactcaggaaaatctattctctcaaatttcctgggcagctagcaccaattctctgtttatgaaaacatcaaccacagtttagcattttttttttttttttgagacagggtctcgctctgtcgtccagtctaggctcactgcaagctccgcctcccaggttcacatccttctcctgcctcagcctcctcagtagctgggac

SEQ ID NO: 43345 - DNA, 201 bp, Homo sapiens
tacactcaggaaaatctattctctcaaatttcctgggcagctagcaccaattctctgtttatgaaaacatcaaccacagtttagcattttttttttttttttgagacagggtctcgctctgtcgtccagtctaggctcactgcaagctccgcctcccaggttcacatccttctcctgcctcagcctcctcagtagctggga

SEQ ID NO: 43346 - DNA, 201 bp, Homo sapiens
aatctaaaggccgtgttttcatttgtgccaaacagtattttgttggaggatgttacaattattagcttctaaaaagttgtttgatttaattcacataattrtttgaaattaatgccattgcctggatcagtcttcaaaatgttgtatgaacattttattgaaactgacataacattttaaacaaaggattaatattctttt

SEQ ID NO: 43347 - DNA, 201 bp, Homo sapiens
taaattgcaaagcaaaaggctggcgcagctaagaaatattggctgaatattttccatttgtccctccacatcccctttctctcctcctatggtcctaggaraacatcgatggggcaggctcctttgttctctggcttctggttgggcaaggctaatgagaggcactaggaggtgattagaggccaggagcaaaatgatgtc

SEQ ID NO: 43348 - DNA, 201 bp, Homo sapiens
ttagtttaaatctttttctctgtctattcagtttctctctagagaaataatagaaatagttcttggactaatttttattcttaatagtctctcttttggtrgaattaattctatctatctatctatctatctatctatctatctatctatcatttaatatgtattgccatcacaaataccacatttctcttatattccaaa

SEQ ID NO: 43349 - DNA, 201 bp, Homo sapiens
gggattacaggcatgcgccaccatgcctggctaatttctgtatttttaatagagatggggtttcaccatgttggccaggctggtctcgaactcctgacctmaagtgatctgcccacctcggcctcccaaactgttgggattacaggcgtgagccaccgtgcccagccaaaatgtttatttgaagcatggaagacagaattg

SEQ ID NO: 43350 - DNA, 201 bp, Homo sapiens
aaaaatacaaagaggacaatcttctccttattctttattttaacagtaattcctgaatttgtaacacaagtgaatgttgccttggaagccttaagcaaaarctcattgaatgtgttggatgataatcaatttgtggacatctcaaagaagatctatgatacaattcatgatatcagatgttcagtcatgatgattcgggta

SEQ ID NO: 43351 - DNA, 201 bp, Homo sapiens
attagtaaaaggcccttagaggagttaaaatgaaatcattttgcactaatgaaaaggctgtgttgtatttttttgtaagattccttaaatctttcttgcarttacttcacagggcagtgaaaaacagatctttacatgactttaaatttttctttttttgccaaaatctacataggaagatggtgggaactgtatcaataa

SEQ ID NO: 43352 - DNA, 201 bp, Homo sapiens
ttttgctccatctgagacctgtgtgaaatcaagtggtttttaaaagtcaagttagctggtttgttctgatgtgtttggtctttaaaaattcatattttgtyggctgggtgcggtggctcacgcctgtaatcccagcaccttgggaggccgaggtgggtggatcacgaggtcaagagatcaagaccatcttggccaacatga

SEQ ID NO: 43353 - DNA, 201 bp, Homo sapiens
aagccttaagcaaaaactcattgaatgtgttggatgataatcaatttgtggacatctcaaagaagatctatgatacaattcatgatatcagatgttcagtmatgatgattcgggtaagtttgcttttccttccattgaattattgcaatgttcttcaccatctggaatgcctgggatgactgcaagaaatgctttatttct

SEQ ID NO: 43354 - DNA, 201 bp, Homo sapiens
tctttcttgcagttacttcacagggcagtgaaaaacagatctttacatgactttaaatttttctttttttgccaaaatctacataggaagatggtgggaastgtatcaataatagcagattgaaagtattaatagacagaattaaattattactgtattgcacacttgtttggtatatgagaaaaagcattttttagtggg

SEQ ID NO: 43355 - DNA, 201 bp, Homo sapiens
ttagataatataaaattttgtctagaattcaagtgggatgtctttattttttaatttttttttttttacttttgctccatctgagacctgtgtgaaatcargtggtttttaaaagtcaagttagctggtttgttctgatgtgtttggtctttaaaaattcatattttgtcggctgggtgcggtggctcacgcctgtaatcc

SEQ ID NO: 43356 - DNA, 201 bp, Homo sapiens
tacttaactatgtctttggagtgaatagagcatatcacagaggctagaagccattttgtcctgttctttagagtagtagttttgacggttggtttgctgtmtactccagaacctgaaggaaatgtgaaataactggacacattttcttagatgttccctcctcttttaacactacaaaagtaatgattgactcattaagca

SEQ ID NO: 43357 - DNA, 201 bp, Homo sapiens
ctgttttcatcttaggaaattaaaaatgtatgctcacagatatttcactcaaggcattttgttcagctagtaaatattgtttttttcttctttctttcagmggataaaggatatgtctcatcagtttatgtggtttaaaaaacatttccattagataatataaaattttgtctagaattcaagtgggatgtctttattttt

SEQ ID NO: 43358 - DNA, 201 bp, Homo sapiens
ttggtttgctgtctactccagaacctgaaggaaatgtgaaataactggacacattttcttagatgttccctcctcttttaacactacaaaagtaatgattractcattaagcagatttgaatgttcctataagcctgcataaatatatttttggagcttttcagttgttaacaaaaccaaaatcacatttaaatgcaagct

SEQ ID NO: 43359 - DNA, 201 bp, Homo sapiens
atttagagactgaagtgctgacctgactaacctccatggttatatctgtggccctgtggcccaggtgtccctatattatcccgctaatgccccctattccyatatggtgagatcagtgcaacagttttaaatcctgggatgaaactgcttaattctttactagaagattcggataagtagtagcctacatggttctgaaaa

SEQ ID NO: 43360 - DNA, 201 bp, Homo sapiens
caaaaataatgaataggactcaaactaaaaagcttcttcacagcaaaataaataatcattacagtaaacagacaacttaaaaactgaaatgtggacaaaasacatgaatagatatttctcaaaaaatatacaaatggtcaaaaacatatgaataaatgctcaacatcactaattgtcaaggaaatgcaaattaaaaccaca

SEQ ID NO: 43361 - DNA, 201 bp, Homo sapiens
gtattaacatgatgtgttcataaaacaacttattgagtgtccatcatttgagagatactataatacttaatgctaagagcaggtgccattcataagattayacttaaaatgaacctgagaatgagcagaatttagacatgggaagaactatgctgtggatggaaatagtagatgatgatgaatagagacagtggggctaaa

SEQ ID NO: 43362 - DNA, 201 bp, Homo sapiens
gcccagataactaaaatacatttttatgtaaaagtaaatgtgcagcatgaatagatttgagttatagaagagaacaaaaatagaactgttactgggtacaygagttttacattatcctctgggaaatcagtgctctgtaatgtgttatgggtcatatatctgtaggattttatatacttgtccttattcgtcatggaaact

SEQ ID NO: 43363 - DNA, 201 bp, Homo sapiens
acctgagaatgagcagaatttagacatgggaagaactatgctgtggatggaaatagtagatgatgatgaatagagacagtggggctaaaaattctcaatgkatttgggatatatttacatagtagagcagatggcacttagtaggtatttggatgtaaggaataaagaagtataggaggtcagataaaacacctgggtttt

SEQ ID NO: 43364 - DNA, 201 bp, Homo sapiens
aatttaaaatttgaggctaatgaatttaatttttaatagctatatgcagctagtagccaccttttattagacaatgtgcctagagaatagacagagaatargagcacagtggataatgtcagcaggtatggtggctcagaagtagggtataagtgatacattttggcagctagaggaaagaaaggaccagataaaaagagt

SEQ ID NO: 43365 - DNA, 201 bp, Homo sapiens
atggtggctcagaagtagggtataagtgatacattttggcagctagaggaaagaaaggaccagataaaaagagtgcccatgtatatcatcaaaatttcctmatatcaataacatggcaggcagaattgcaagagatggtatgccatacaagcagatacaacttaaatgtagaaaaataacatttattgatatttttatacc

SEQ ID NO: 43366 - DNA, 201 bp, Homo sapiens
tgttttgttattttaaagatagttttcatatgagaatgccaattccttttcactaattttttttattatagagaaaacatcttactaaaaggaagtttacratatttttattatttctataaggcagaattactacttttaactaaattttcttctgtttagcaactcaattgctttctttctttaaatatctttgtgttt

SEQ ID NO: 43367 - DNA, 201 bp, Homo sapiens
caaatgcaaatagagtatgtaacataatggccattggcagaatttttattttaaaataagcattcttgcagaagccaatattgcctcttaactaattactrttaaccaaagcattcaaatagatgcaaagctgtcactgctagatttagtatttaaaaacataaaagatattgctattcatgttgggaatgttttcatgta

SEQ ID NO: 43368 - DNA, 201 bp, Homo sapiens
cttggatcttcaccttctggataaaatatatattgcaataactatatggccgtgctaggatcacatctgtcaaaaggatgaggatattcacgtcagctttyttgatacctgctcacatcagcatcttgttttaggggctccatacagatcaccacctttgaaacaacttttctttttggagaaaggtttatgctacagcca

SEQ ID NO: 43369 - DNA, 201 bp, Homo sapiens
aaagttattttaaagcaaatgttacttgagaaacaacagtaaagggcaagaatgttctaccaacctagagaccgaagtttttctgtcactttcacgtaaaratttaaaaggtgggaaaagcattgttcgatgtttttaaatttaattttttttgtaaaaattgtacatatttaaggacttaagatatacaatgtaataatc

SEQ ID NO: 43370 - DNA, 201 bp, Homo sapiens
gagaaacaacagtaaagggcaagaatgttctaccaacctagagaccgaagtttttctgtcactttcacgtaaaaatttaaaaggtgggaaaagcattgttygatgtttttaaatttaattttttttgtaaaaattgtacatatttaaggacttaagatatacaatgtaataatcaacaaaattaaaagacaacctatggtt

SEQ ID NO: 43371 - DNA, 201 bp, Homo sapiens
aatatatatttaagatatacaaaatttgaataaaataaaagtattgattatatcacatttattgatgattgtcatatatttctttcccagcatcttttaattttttttaacccagagtccagaatgtatttatctttaatgcatctaaaaaataatttcaacttttatttagattcagtgggtatattgcatgatactgag

SEQ ID NO: 43372 - DNA, 201 bp, Homo sapiens
aattagtttctcaagcctttactcccttcctccctcccctgtctagtaatcctcagtttctattgtggccatctttatgtccatcattacccattctttasctcctacttgtatgtaagaacatatggtatttgggtttttgttcctgcattaattcacttgggataatggcctccagctgcatccacattgctgcaagag

SEQ ID NO: 43373 - DNA, 201 bp, Homo sapiens
tcaatgtattattctgaaatagacaaccctagtacaccagaatcatcttcatggtccctcaccctcactctttccttgggcaggacttaaagcacagcatytttagagttcagaaccattgctcctataattcgtgaagtatcaatcaagtttgtccaaagaaaggacattatcctaaggcatttctgcagataggcagtc

SEQ ID NO: 43374 - DNA, 201 bp, Homo sapiens
tcccctgtctagtaatcctcagtttctattgtggccatctttatgtccatcattacccattctttagctcctacttgtatgtaagaacatatggtatttgrgtttttgttcctgcattaattcacttgggataatggcctccagctgcatccacattgctgcaagagacataatttcattcattcctttttatggctgtta

SEQ ID NO: 43375 - DNA, 201 bp, Homo sapiens
aagaaatcacatttggcctgagtctcccagtggatgtcacttcttttaacttgtaggtttacttacactcaggaaaatctattctctcaaatttcctgggmagctagcaccaattctctgtttatgaaaacatcaaccacagtttagcattttttttttttttttgagacagggtctcgctctgtcgtccagtctaggctc

SEQ ID NO: 43376 - DNA, 201 bp, Homo sapiens
atggtgatgacttgcatagcacattactgcattaatgtaagtatttttgcctgtcaaacattaaatatggataagatctgcagtgtcatttggttcacttygctactactgaagcattgcttctccataatacatgctggcccactgttcccagtccaatttaaactataagtaatgatggtgtatttctacttcctttgg

SEQ ID NO: 43377 - DNA, 201 bp, Homo sapiens
tgtttttgtgccagtatcatgctgtgtgtgttactgtagccttatagtgtagtttgaagtcaagtaatatgatgcctctggcttctttttttttttttttyccccccttaggattgcttgtctattcaagatatttcttggtttcatatgaattttagaatagttctttttctagttctgtgaaaaatgacgttggttgct

SEQ ID NO: 43378 - DNA, 201 bp, Homo sapiens
tgtatggaagaaatcacatttggcctgagtctcccagtggatgtcacttcttttaacttgtaggtttacttacactcaggaaaatctattctctcaaattkcctgggcagctagcaccaattctctgtttatgaaaacatcaaccacagtttagcattttttttttttttttgagacagggtctcgctctgtcgtccagtc

SEQ ID NO: 43379 - DNA, 201 bp, Homo sapiens
gtttttgtgccagtatcatgctgtgtgtgttactgtagccttatagtgtagtttgaagtcaagtaatatgatgcctctggcttcttttttttttttttttycccccttaggattgcttgtctattcaagatatttcttggtttcatatgaattttagaatagttctttttctagttctgtgaaaaatgacgttggttgctt

SEQ ID NO: 43380 - DNA, 201 bp, Homo sapiens
ctatcaaattaccaacactattttttacagaattagaaaaatcaatcctaaaattcacatggaaccaaaaaatagcccaaatagtcaaagcaacctaaacraaaagaacaaatctggaggcatcacattacctaacttgaaattttactacaaggctaacgtaaccaaatcagcatggtactggtataaaagtagatcaat

SEQ ID NO: 43381 - DNA, 201 bp, Homo sapiens
agtcaagtaatatgatgcctctggcttcttttttttttttttttccccccttaggattgcttgtctattcaagatatttcttggtttcatatgaattttaraatagttctttttctagttctgtgaaaaatgacgttggttgcttgataggaatagcattgaatctgtagattgctttgagcagcatggccattttaacga

SEQ ID NO: 43382 - DNA, 201 bp, Homo sapiens
agtagaaggagccttagactggagccctggttacatgggaagagggattctatttggcactttccacgtaccctggggaaataacataaagacattaagaycactgcttttttataacaatggaaagtagagattagtcattcatcagatgatcactctaatgaacatctcgttaatgagaagagatagtgagatcaatac

SEQ ID NO: 43383 - DNA, 201 bp, Homo sapiens
gatgcatgcctaggtgttttatttatttatttatttgcagctattgtaaatggagttgagttcttgatttggttctcagcttgaatgttattggtgtataraaatgctattgatttttatacaatgattttgtatcctaaaaaattactgaagtcgtgtctcagttccaggagccttttagtaaagtattttatgttttct

SEQ ID NO: 43384 - DNA, 201 bp, Homo sapiens
tccaaagcaatctacagattcaatgcaatttctatcaaattaccaacactattttttacagaattagaaaaatcaatcctaaaattcacatggaaccaaawaatagcccaaatagtcaaagcaacctaaacaaaaagaacaaatctggaggcatcacattacctaacttgaaattttactacaaggctaacgtaaccaaat

SEQ ID NO: 43385 - DNA, 201 bp, Homo sapiens
ttttttttttgagacggagtctcgctctgccgcctaggctggagtgcagtggcgcgatctcagctcactgcaagctccgcctcccgggttcacaccattcycctgcctcagcctcccagctgggactacaggtgcccgccaccatgcccggctattattttgtatttttggtagatggggtttcacagtgttagccaggat

SEQ ID NO: 43386 - DNA, 201 bp, Homo sapiens
tatgaaagagtcagtatatgttgaacaacataatctataataacatcagagtgaatagtggccattaatataaaaaacacataataaagtgatatgttttkcctgttttctgttatgttggagtaagtgtgagagcagaacatgcctgtagtttatagattaacaatgttttaaactaatctggggctagaggtcatcaaa

SEQ ID NO: 43387 - DNA, 201 bp, Homo sapiens
actttgaaacagagtaatgactgtatatttcttcaaatccctttacaatactgagaacagtgctcaggatatggtaggttacatatacacatatttgttgwttacaggtttaactttctaatttattggtctcagaagtagtgagataaaatattgaaacaatgatgatgcaaattagccaaaaggtgatagcgattttca

SEQ ID NO: 43388 - DNA, 201 bp, Homo sapiens
ggaatcaaatactccaggatacaatatctacctaattctgagggcaattcattttctaaacttgctccagaaataactgtttcccctcagcttcaacataytcattgagatggcccctgatcattgctttccttcaaaatctttgcaggatatttgaatcagcagcctccctctttttaatgttcttagttcttatcaaag

SEQ ID NO: 43389 - DNA, 201 bp, Homo sapiens
aacatcatactgaatgagaaaaagttcaaagtatttcccctattaactgaaataagacaaggatgctgacttttatcccttctattcaacatagtacaggraatcctagccagagcaatcagacaagagaaataaataaagggcattcgatttgtaaaacatggagtcaaattatctttgtttgccaatgatataatctta

SEQ ID NO: 43390 - DNA, 201 bp, Homo sapiens
gcaagtgagtaaaagggcataattagagggataaccttgaagccactccaatttgtgagaaaacagtaaatcattttctaatttcaatatttgaactattrttattactatcaaattatggctcttgtgagacatgtcacaaataattgaaatgcaccaatgtgtctggacccctaggttaaaagctttcttctagaggac

SEQ ID NO: 43391 - DNA, 201 bp, Homo sapiens
aaataaaaataaaaataaaaaaggacttaaatgaaaaacccaaaactgtaatataaaaacgctagaagaaaattaggcaataccattcaggacataggcayggggcaaagatttcatgatgaaaacacccaaagcaattgcattaaaagcaaaaattgacaaatgagatctaagtaaaccgaagagcttctacacagcaaa

SEQ ID NO: 43392 - DNA, 201 bp, Homo sapiens
gcgggaaacagaagttgcaatgacagaggttgcaccactgcactccagcctgggtgacggagtgagactctgccaaaaataaaaataaaaataaaaaaggrcttaaatgaaaaacccaaaactgtaatataaaaacgctagaagaaaattaggcaataccattcaggacataggcacggggcaaagatttcatgatgaaaa

SEQ ID NO: 43393 - DNA, 201 bp, Homo sapiens
ttgtagtcttttatccctcgcccccttccaccctttcccctgagtccccaaagttcactgtataattcttatgcctttgcatcctcatagcttagctcccrcttataagtgagaacatacaatgtttggttttccattcctgagttacttcacttagaataatgatctccaattccatccacattgctgtgaacataatag

SEQ ID NO: 43394 - DNA, 201 bp, Homo sapiens
actaagacacaacttccacctcccccagtccagtctttctaataaccaaaagtgccttcacacatttccataaacctcccagtaaagtgatgttgccccasttaagaaccagtgggagggcatagtctgtggaaaggtaagttgtagcccttagtgccaagtgaaggggtttagatcagtttcatagatttggtttagtta

SEQ ID NO: 43395 - DNA, 201 bp, Homo sapiens
cttagctattaacagctttgcagcagtttacagataaaatggaaatgagagacttacgtgccagagttatgcttaaatttccgaggaaagaaggaagtagrgaagacacaaaaagaaggaagggagggagggaaggagggaataaagaaaaagcatgccactgggaaagtcacccatattggctgaagtttgctttgactt

SEQ ID NO: 43396 - DNA, 201 bp, Homo sapiens
taaagacctgaagctaagacctgaaaccataaaagatctagaagagtacctaggaaaaactcttctggacaccagcataggcaaataatttataactaagwcccctaaaagcaaatccaacaaaacaaaaataatgaataggactcaaactaaaaagcttcttcacagcaaaataaataatcattacagtaaacagacaac

SEQ ID NO: 43397 - DNA, 201 bp, Homo sapiens
ctacctttaacttctctgttaaaggcattagtatctgcataagtaccaaaatttaggaacccctatttctttgtcttatttgactagtcttcagtatttgrtcctattgaccatgatcttcttgttgagattattactactctgagcatttccttttggatgcatttctttatttgtctacattcatgaatactggaatta

SEQ ID NO: 43398 - DNA, 201 bp, Homo sapiens
tttctcatcatgttactttcaggctactgttgtaggttttctacctttaacttctctgttaaaggcattagtatctgcataagtaccaaaatttaggaacscctatttctttgtcttatttgactagtcttcagtatttgatcctattgaccatgatcttcttgttgagattattactactctgagcatttccttttggat

SEQ ID NO: 43399 - DNA, 201 bp, Homo sapiens
aatttatttataattattataaataaatttataatttaataaataaataattccctttccttgagtgacaagggaaatggttgaggtcatacaagtttgcyttgagtttatctcacataaacatcgataaactaagaaaagtctaatttcaatggaggattttccaaggttaatgaatgaagtcacctcatggactgggtt

SEQ ID NO: 43400 - DNA, 201 bp, Homo sapiens
tatcttccccagaaaaagcaagtctgcctttgctgagtccaagaaaaccaattacccgaaagactctgaaaccaccacctgaaaatgctagaatagaggcytctgttgatttttatgacaaaaatatttttttgatcactagccgaacatcacccttatctgctctcctgtgcacatcaattaaatgaagagggagggaaa

SEQ ID NO: 43401 - DNA, 201 bp, Homo sapiens
cttttctttaaatccacagcagttcctatcaacagactacttaaaatcagcagtttttctcatgctttcaatggttagtctatctaacagcatatgtaagwgaccttttgataattatttaaaaggttcgtcagtaaagtctcaaatgcctgattcaggagagtcacgtatctatctgctctggaagcactcaagctgaac

SEQ ID NO: 43402 - DNA, 201 bp, Homo sapiens
ctcatttttaaaatgttttgtagagacggaatctcacaaaaatcttgccccagctggtcttgaactcctggcctcaagcaatcctcccgccttggcctccyaaagtgcttggattacaggtgtgagccatggcatccagcctgtttggctcttaataagacataaaacttcctttaatttcaatcttttcataaataaaat

SEQ ID NO: 43403 - DNA, 201 bp, Homo sapiens
gtggctcctatttttccggatgtacactatagctggctaataaaccttgatgattgagactcatttccaatgtcgtattagtcagcagatgacactttgarcaacaaggttttaaacaactctatgagtaatataattatgacaataacagcaatgatgacaacaatagtcatttaacatacaccatattacttgaacgga

SEQ ID NO: 43404 - DNA, 201 bp, Homo sapiens
tgaatttgcctgatgattatttttgttttctgattttatgattccatatctctatctatagacaaagaaagagaaatactatattagatcactctagtacwtgaatttttttcaggatgtaaatctgatatttgttgtttgctgctttttgtgaggcattttttttttctaccgaagatttatattcacatctgcagatct

SEQ ID NO: 43405 - DNA, 201 bp, Homo sapiens
tcttggtgaataattcatgttgtcacttctagggtaatcactgaaaaaaaaaaaagatatgcttcatttccaaacttactgtggaaaacaatgtacaacawtaacaatgatcaaccaaaaggaagcaaaaaataaaataaacatatatttggtaggacaaatatagagtataaagtgtatgccaacatgttaaatttgaat

SEQ ID NO: 43406 - DNA, 201 bp, Homo sapiens
ctccccctcacaaaccatcgtcacgatgtatattgccaacctgactaaaggttattgacaatatagagcaattcaaatcatgtaggataatgtgaaatttragatcatgcaaacaacaaaaaaatgggtgtaaaaatccctattctcataaatcctatggtcactctcatgctaaagatttctcaaaagtttccattaggt

SEQ ID NO: 43407 - DNA, 201 bp, Homo sapiens
agcattgcttctccataatacatgctggcccactgttcccagtccaatttaaactataagtaatgatggtgtatttctacttcctttgggaaagcattacraagtttaatttactgtttcctaacaacttgtaatagtatcagtagttaatgttctagaattttgatagtgaaactttctgctagtctactttcttcctca

SEQ ID NO: 43408 - DNA, 201 bp, Homo sapiens
caatccaggaacctgacctagatttgatatatttgaggtagtgtgataaatgctcaaccgtgacaatctaggaaactgacctagatttaataaagttttcrtgagaaaataatgctttaggtgagccctgctggataaattggagttagctaacaagaggtaaatccctacagaaagaaaagcatagacaaatgcccctag

SEQ ID NO: 43409 - DNA, 201 bp, Homo sapiens
tattttttaggttcacagcagaattgaataaaagttacagagatagcctccacaacacacacacacacacaaactcacacagcctttcccgttatcaacawcctccaccagagtgggtacatttgtttcaattggtgaacctacattgacacataatttttgcccaaaatctgtaccttacatcagggtgtattcttggtt

SEQ ID NO: 43410 - DNA, 201 bp, Homo sapiens
aatgctcaaccgtgacaatctaggaaactgacctagatttaataaagttttcgtgagaaaataatgctttaggtgagccctgctggataaattggagttasctaacaagaggtaaatccctacagaaagaaaagcatagacaaatgcccctagacaaagaagagtggaaatcgaggggtgctgataggaaataatgctaga

SEQ ID NO: 43411 - DNA, 201 bp, Homo sapiens
atatattctttgataaagtgtcttttcaatcttttgttcattttttctgttgtgtttccttttccttactgattttttttgagttctttctttattctggraaacgctcctcacactgtggattcattgactctattaacaatgtcttttaaaaaacagaagttcttggcttttatatagttcaatgtatcaactttttat

SEQ ID NO: 43412 - DNA, 201 bp, Homo sapiens
tgagacataatattagtctggccatttttagaaaatgcaatatgctacaacatggaaatttctttttctacaaagaagtgtcacaagattggtggcttcaytggctatatgtagttatatctatgtgtgttggaatttatatctttaaatttaatatggcataaaaagcatttctcaacaacttcatttttcaaaggaatt

SEQ ID NO: 43413 - DNA, 201 bp, Homo sapiens
agctctacttccctcctcccttcagcttacacacaccctctcacctacatggtcatccacgtaaccttgagaactttattctttgaatttacacaaagacmaacatcacagtgattaaaaaccacacatggcttcttgcttctcctggttgctgaattccaatgcctggggattagtttagatgcctactgctttcaggtt

SEQ ID NO: 43414 - DNA, 201 bp, Homo sapiens
accatgttgcccaggctggtctggaactcctgggctcaagtgatctgcctccctcggcctcccacagtgctggaattacaggcatgagtcactgcgcccascttttaatcagattttggagtaggggagtgagaggagctggttggtggtggtttttttttctttaaaattattattactttttttttctttaaaattatt

SEQ ID NO: 43415 - DNA, 201 bp, Homo sapiens
aaggcctggggggaattagccagcagaggagggaggtgagcaggcagaaggtcagcacgtgcccacaaggtaattttctggtgttgatgtgtatttccagytattgtcattttcccttcgcccaaaggacttcttctacatttcttgtagggtagatctcttggtgatgaattatttccgcttcggatgtctgaaatatct

SEQ ID NO: 43416 - DNA, 201 bp, Homo sapiens
ttttcccatcctccccctggcgggcatttgtccagtgtttgacttttgctattgcaactaaagctgtgtggagcagtgtgcctttggtgaacgtgcctttrgtgaacgtgaggatgcatttctgctgtgtacatacttaggagtgggactgcagggttgcaagtggatatcaacacgcagttttccaatgtggcccgtacc

SEQ ID NO: 43417 - DNA, 201 bp, Homo sapiens
tgatgtgtatttccagctattgtcattttcccttcgcccaaaggacttcttctacatttcttgtagggtagatctcttggtgatgaattatttccgcttcrgatgtctgaaatatctttatttcatcttcattttggaaagatatttttgctgggtacagaattctagatgggcagttttttcttttactgcttaaaagac

SEQ ID NO: 43418 - DNA, 201 bp, Homo sapiens
ggatctgtggatttattatttttatcaagtttggaaaagtttcagtcactatttcttcaaatatatttatgtcttctctcatctcactttttttttttttwatctaatttagagacagggtcttgctctgtcgctcaggctggagtgcagtggcacaaacacagctcactgcagtctcaaactcccgggctcaagtgatcc

SEQ ID NO: 43419 - DNA, 201 bp, Homo sapiens
tggattcaacagcagaaactttttttctcactgttctggaggcttgaagcctgagatcagggtgccagcaagtccggtttctggtgagggctctcttcccrgcttgtagatggccgccttcttgcagtgtcctcccatggcctctcctctgtgcttgcatggagagggcactccagtgcctcttcctctggtaaggacagc

SEQ ID NO: 43420 - DNA, 201 bp, Homo sapiens
gcttgtagatggccgccttcttgcagtgtcctcccatggcctctcctctgtgcttgcatggagagggcactccagtgcctcttcctctggtaaggacagcrgtcccatcagatcagggccccctctgacctcattcgcccttaaagaattacctccttacaggccctgtctccaaatacagtcacgctgcgggctagtgaa

SEQ ID NO: 43421 - DNA, 201 bp, Homo sapiens
ctcacagtcacaggggagcccacactgccctcccctcccagggactgcccctgtggcccccgtccaggtccacagcctcagcagtccctgagggccaggargtagcctccaggccactgggctgagaacccttaaaagaaaaagcccccctgcccatgacagtcattttagggtcaagaaagccctttgcagaaaccaaac

SEQ ID NO: 43422 - DNA, 201 bp, Homo sapiens
gtcctgagagatctgcttaggcaggaccagagaagacagatcagagggcccgaccgtcgctctgaagtctctcctgcgggttgggagctgtggctgagtgygaggtgagtgaggaaggctcagcgcacctgggtccagggtcaggaagttggtcccttccagctacctcccagaccctcccaggcttcccccgacgtgtat

SEQ ID NO: 43423 - DNA, 201 bp, Homo sapiens
ttttctatcctcccagtcacctttgcagacaaagaccaggggcagctcccgagggcactgtgaaggctcccatgccacacagtgagaactgtagcctctgygtccaaggcacacagggtactttctggacccactgctggacagacttgaaggtgtcatgcccggtgtgtgcaggaggaaactaacagttcagtaaactct

SEQ ID NO: 43424 - DNA, 201 bp, Homo sapiens
tttttatatcggctgcatgttgaaatgctgatatttcgtgttaatttcacccatttatttaaatttttgttaacgtggctactagaaaaggttcgctggcytctgcaggagtgttggtggccccaggtggcagctgccctcctcctgcactgtccccttctccctccagatggtactcttggtacacagatacactgaaat

SEQ ID NO: 43425 - DNA, 201 bp, Homo sapiens
acctcttagaggcaacctggccctttctaggattcagtaataaggcaaagaataacataccttaaaggttacttctagaaatatctaattctcacggtttmagcttctgaatcagtggatggttttatagcttcatatgagcacccaagtgatgtgaaggttttggcagttctccatcatcataagaagttctgtgggatg

SEQ ID NO: 43426 - DNA, 201 bp, Homo sapiens
tgagttttcagtctgcactcagaatagatataactccccaaatccaattttcattttaacctttcctcagtggcctagaaatcacagattgctggtattaygctaatagattggaaattcaaacctcttagaggcaacctggccctttctaggattcagtaataaggcaaagaataacataccttaaaggttacttctaga

SEQ ID NO: 43427 - DNA, 201 bp, Homo sapiens
  misc_feature (1)...(201): n = A,T,C or G, or insertion/deletion polymorphism (see Tables 1-2)
acggctcaaaggggggtgtggtccggggcgcagaaggacagaacccaatgggagcggacttaccccagcatttcacatccgatttttcagggatagatttngtctctaaaactagcacttgatattataagagcatataggctgaatgaacttatattgctatttcagaggaggccagtggcttaagagtcccaaagtgag

SEQ ID NO: 43428 - DNA, 201 bp, Homo sapiens
  misc_feature (1)...(201): n = A,T,C or G, or insertion/deletion polymorphism (see Tables 1-2)
cagaaggacagaacccaatgggagcggacttaccccagcatttcacatccgatttttcagggatagatttcgtctctaaaactagcacttgatattataanagcatataggctgaatgaacttatattgctatttcagaggaggccagtggcttaagagtcccaaagtgagttctgtgacttactcatgtttcatccacat

SEQ ID NO: 43429 - DNA, 201 bp, Homo sapiens
  misc_feature (1)...(201): n = A,T,C or G, or insertion/deletion polymorphism (see Tables 1-2)
ttatacagcagaataacatgcagtgtaagaaggaatgagtaccttgtctatagacatattactagtggagacagcaagcacacagcaggatgcacggtgcnctgtttctggtatagaaaatgcagaaatgcaagaatgtatttctcctgctgtgtttgcataaagacactggaaggacgcaggctgcttcagagtctggga

SEQ ID NO: 43430 - DNA, 201 bp, Homo sapiens
gcacccggtcttcttgccctgccccgctcgcgggactacagttcccaggcgcccctgcgcggccgcggcgccggcgcaggcgtcggttgggacgcggagcygaggagcagggccgggcgccatggcaccgtggggcaagcggctggctggcgtgcgcggggtgctgcttgacatctcgggcgtgctgtacgacagcggcgc

SEQ ID NO: 43431 - DNA, 201 bp, Homo sapiens
cgtctcagggcacacctgtgacccgtgagcacaagtgacacctccctgcttgggagcacagcggtgtggctcggcaggaggtggaaagggagaaccgtacygtgttgtgtactgggcttcttccagttccttggaggagaaacatgtctgtcctgaatgccacctcagttggggtctttctggccagcccaggccaggtgc

SEQ ID NO: 43432 - DNA, 201 bp, Homo sapiens
gaccagggctcccccttctcatgggtgagtgaaagttgctgaaaataggcctcctggtgaggaacctcccagccagccctgtcagtggcactgaggctgcyctccgactgtggcatcccccatgtctgtcctcattactgagcaaaaatttgtgcagaggagtgctctacactttccaagggtttaatccaggagctgagg

SEQ ID NO: 43433 - DNA, 201 bp, Homo sapiens
  misc_feature (1)...(201): n = A,T,C or G, or insertion/deletion polymorphism (see Tables 1-2)
tgaaaataggcctcctggtgaggaacctcccagccagccctgtcagtggcactgaggctgctctccgactgtggcatcccccatgtctgtcctcattactnagcaaaaatttgtgcagaggagtgctctacactttccaagggtttaatccaggagctgagggccaggggctccatgactgtagactcaacatcctgggcc

SEQ ID NO: 43434 - DNA, 201 bp, Homo sapiens
atgactgtagactcaacatcctgggccacagccatccgtgagggggaggacgaggggccacgccctgcactctgtcccagcatcccctctccctggagccrtgcagagatggcctcatttcatcccacactcacatgcgggtcctagacaccagctcatgcacatacacacacacacacacgcacacacacacacacacac

SEQ ID NO: 43435 - DNA, 201 bp, Homo sapiens
cgctctctggagggctgttttgggactggaattgcctgcgtggtgctccctatggatgtgtggccagcctggggccagcacacagcctctggagtcagccrggcacctgccgctgggccggcatcccttccttccaggaaatacccccagccaggctctatggagcagcacctcgcccttccagggccacccccagccctc

SEQ ID NO: 43436 - DNA, 201 bp, Homo sapiens
ccacattttgcagcagtcacagggcctggcctcactccagggctccatgtttggatgcgaggcccagtgggtaagtgcactgctgcccacgcccccccccmagcactgtctgctcctccctgcttgcctgcctgtcaaggcagccctcatcttccttggaggatggggctgggctgggagcctgcgccctcccattctgac

SEQ ID NO: 43437 - DNA, 201 bp, Homo sapiens
ttttctggctcaatagactcagcctgacaaaggggaacttggagaaagagaacaagaaatccatatgctgagctgggacagaacccaagtggggttctcaygtggggagcatatggggctttcctcctgcccaccccctgcacctgcagccaggatgcacctgagctcggactgccctgaaaccccgggaaaatcccaaca

SEQ ID NO: 43438 - DNA, 201 bp, Homo sapiens
cccagacttcgcagtgacggatttcagagtgtttcctgttacgagaaggctgtggattcgctttggaacatgacagatttttcttctgtgctacgtggagygtgagggaaggaagtgaaactggtgttaatttttcagcagtcacatgtcaaagtgagtggctagcaagcaggggggtccaggctgtggtggccctggtca

SEQ ID NO: 43439 - DNA, 201 bp, Homo sapiens
aggggccacgccctgcactctgtcccagcatcccctctccctggagccatgcagagatggcctcatttcatcccacactcacatgcgggtcctagacaccrgctcatgcacatacacacacacacacacgcacacacacacacacacacatgcgcacatgcacccacgcactctctttgcctgtgggagggcaggatccca

SEQ ID NO: 43440 - DNA, 201 bp, Homo sapiens
tttttttttttttttgagacagagtctcactctgacagccaggctggagtgcagtagcatgatcttggctcactacaacctccgcctcccaggttcaagcrattctcctgcctcagcctcccaagtagctgggattatagccacgcaccaccatgcccaactaatttatgtatttttagtagagatggggtttcaccacgt

SEQ ID NO: 43441 - DNA, 201 bp, Homo sapiens
agcataatgaataacaaagcaaacactctaaggtcaagaattaggaggctatcagctccccagaagacctagtccctgattgacatgcccagtcctgcagrggcggccccgccttgccgtgggcacagtggccgcggtgactgggcctgctttcttctcccacatggctggcttccctccaacatggcgctggctcttcct

SEQ ID NO: 43442 - DNA, 201 bp, Homo sapiens
tcaagaattaggaggctatcagctccccagaagacctagtccctgattgacatgcccagtcctgcaggggcggccccgccttgccgtgggcacagtggccrcggtgactgggcctgctttcttctcccacatggctggcttccctccaacatggcgctggctcttccttctctgacctttatccaagtggaatcgcacact

SEQ ID NO: 43443 - DNA, 201 bp, Homo sapiens
gtaacaggagaaatacgtcgcatctctagtgtgtggagattaccgggcctttatattaaaaaaaaattttaagtgcttatatttgctctgtctctaaaaaytgtttccaggtaacagttggcctcaagatgcctttttgtttttctgaatgaataaggaataaagaaaaattctgggcactataaaatcaagcccagattc

SEQ ID NO: 43444 - DNA, 201 bp, Homo sapiens
ggctctgagctgaggaagggggtcccaggtggaggccgggaggtggctgcagagtgaggccacaaggcctgggggttggcccagaaggtaggacccctgtaggcagcctcccaaccccaggaatttgcctcttgggaacgtgcaggtccctcgagggtcctggaaggcgctggagtggtgggacagggattgagggagcgt

SEQ ID NO: 43445 - DNA, 201 bp, Homo sapiens
gggcccagcccaggcccggctcggcgtttttggagccggcggaaggaagaagacttggcccagggcagcctcataaagcaattcccacccaggaccgccccgatcgatcggcctggtgctgtggagccaggcccacagcccttccgtccagtagcacctctcaatcccctgtgtgtctgggtgccttcgggatcctgataa

SEQ ID NO: 43446 - DNA, 201 bp, Homo sapiens
cagcccacctcaccgccgaaagaagacccctcatgggggtctggtgaatctgggtttgtcgttttcggatgctggggcagtgcgtctgggagggagcgggsctgtggattcctggtgggtcaccgtggctgcttgaggctttggtccctgccgctgccatccaccctgagcatctgtggccctggagagcgaaagacttgt

SEQ ID NO: 43447 - DNA, 201 bp, Homo sapiens
cctcagtggggaggttttcttggaatgaagcagaaggaacaatattactggtgcctcctgaatatttaaaaagaagagacattagcaattccagacacttmtccattggtccactgcaccttcttccttcctctgcacttgatatttttagttttacaaactgctaggcagaggcaagcatggttttttcctttccagggc

SEQ ID NO: 43448 - DNA, 201 bp, Homo sapiens
  misc_feature (1)...(201): n = A,T,C or G, or insertion/deletion polymorphism (see Tables 1-2)
gacattagcaattccagacacttctccattggtccactgcaccttcttccttcctctgcacttgatatttttagttttacaaactgctaggcagaggcaancatggttttttcctttccagggcaaggtgggggctctcaagaagtggcgggtgctccctggaaagcctagatgtcgacttcatagccctggtgccagtta

SEQ ID NO: 43449 - DNA, 201 bp, Homo sapiens
gtgatcttggcttcctgtgacttccgcttccctggttcaagcgattcttctgcctcagccccccaagtagctggggttacaggtgtgtgccaccacgcccrcctaatttttgtatttttagtagagatggggtttcaccatgttggccaggctcgtcttaaactcctgacctcaggtgatccacccaccttggcctcccaa

SEQ ID NO: 43450 - DNA, 201 bp, Homo sapiens
tctgggctcactgcaacctctgcctcccaggttcaagtgattctcctgcctcagcctcccaagtatctgggattacaggcacccgccaccacgcccagctratttttgtatttttggtagacatggggtttcaccatactggctaggctggtctcgaactcctgacctcaactgatccacctgcctgggccttctaaagtg

SEQ ID NO: 43451 - DNA, 201 bp, Homo sapiens
gtatttcactgccgtgacaggccgtcatgattggggacgatatcgtgggcgacgtcggcggtgcccagcggtgtggaatgagagcgctgcaggtgcgcacygggaagttcaggtcagtgccagctggagtcatttattcaccttccttccaggggatgaccacattctcattctgttttgttcttcaaaataaaggggata

SEQ ID NO: 43452 - DNA, 201 bp, Homo sapiens
aaataatgtgttttatatatagagagaaaggctaatgctttaagtttaaaaatcagtatttaaaagtttataagtaggctgggcatggtggctcacacctrtaatcccagcactttaggagtccaaggagggcggatcacctgaggtcagaagttccagaccagcctggccaacatggcaaaaccccatctctactacaaa

SEQ ID NO: 43453 - DNA, 201 bp, Homo sapiens
  misc_feature (1)...(201): n = A,T,C or G, or insertion/deletion polymorphism (see Tables 1-2)
ggtgggtcaccgtggctgcttgaggctttggtccctgccgctgccatccaccctgagcatctgtggccctggagagcgaaagacttgtttcctctggtggntccgagcatatgtggcaaagctgtgtcttatttacctcccacatcatcatcctctcctaccctcatatgacatttctgcctgtccccttgacagtggagt

SEQ ID NO: 43454 - DNA, 201 bp, Homo sapiens
tacctatctgtaggtggcaattaactgagtctcttggtccttcttagagaccccattctaccaatctgcatgtctgatgtctgggagctgctgagataatrgggacccaaacggtcccgcatagtgaagccggaggtgtttgggaggctgggaactgggaacagggagacttggcttccaggagcaagcacaaagggcagc

SEQ ID NO: 43455 - DNA, 201 bp, Homo sapiens
agcaaggtgtctctgttctctcttctacatgttgatcgaggtataacacccaggaaaggacatcaagtgtacagtttgaatttttgcacacacgtacaccygtgtaacccccacacagatcaagatgtagaacattccagcacccagaagtttccccgtgccccttcccagtcagaccccccgaccccaggtcacccctgc

SEQ ID NO: 43456 - DNA, 201 bp, Homo sapiens
tgggaggcaggggttgcagtgagccaagatggtaccactgtactctaggctggacaagagagtaagaccttgtctcaaaaaaaacaacaaacccccccccmaccccgcggtttctcaacctcgacacttggtgtttttggactgggtcattttgtggtgaggggatgtcctatgcattgtagggtgctaaacagcatccca

SEQ ID NO: 43457 - DNA, 201 bp, Homo sapiens
  misc_feature (1)...(201): n = A,T,C or G, or insertion/deletion polymorphism (see Tables 1-2)
ggggtgaagtgggcctcatctggggagcaggaagccagagctcaatgctgtgactggggcaggcaaggcctcatgggagaccctgccactcattgcttgcngaagatacatttgacattatctaccagtggttccacttctgagaatttgtccttgtctcatgcgtgagaaatgacatgagtacaaggtcattcctggcag

SEQ ID NO: 43458 - DNA, 201 bp, Homo sapiens
ttttgcacacacgtacacccgtgtaacccccacacagatcaagatgtagaacattccagcacccagaagtttccccgtgccccttcccagtcagacccccygaccccaggtcacccctgccctgacttgcagtgtagagctcacccggccacttcctcttttgcccacagcaggtgaggagggccttctactgggaaaaac

SEQ ID NO: 43459 - DNA, 201 bp, Homo sapiens
gaggagggccttctactgggaaaaactgtgactattaatttaggtttaaaatgtattggtaacaggcagatctggccagtccctccctggcttcaatctcyttggtagcttccaggattactcttaggagggactggaggaaaagcccctctctgtccccacggcacccacagtgaccatcacagccctcctctgggccct

SEQ ID NO: 43460 - DNA, 201 bp, Homo sapiens
ccaccttggcctcccaaggtgctgggatcacaggcgtgagccactgcgcccagcctgagaaatgcaaattaaaactatatcaagctgccctgtttcatcartttgacaaaattggccaaaatccaaaagtttgagaacactttctctgtgagagtttgtggaaacagaccctgccacacattgcttgcagaagatacattt

SEQ ID NO: 43461 - DNA, 201 bp, Homo sapiens
  misc_feature (1)...(201): n = A,T,C or G, or insertion/deletion polymorphism (see Tables 1-2)
gactggaagcagctcagatatccatcagtaggggagttttagggtctgtctgtttatacagcagaataacatgcagtgtaagaaggaatgagtaccttgtntatagacatattactagtggagacagcaagcacacagcaggatgcacggtgcgctgtttctggtatagaaaatgcagaaatgcaagaatgtatttctcct

SEQ ID NO: 43462 - DNA, 201 bp, Homo sapiens
tccaggtctctgtgggagcctgggttcctttggggcctggattcagggctcatcctagagtgagctgtcatctcagggcatctccctgggggatatgtgcmccccggagctgcagttacagacactgagctcactccaccttcaccacccagccctgctgcttcccgccctaatcctcctggcagagcccctggataagga

SEQ ID NO: 43463 - DNA, 201 bp, Homo sapiens
tcctaggtgggagtgcagtggcaccatcatggcccactgcagcctggaactcctgggcacaagtgattctcccgcctcagcctcccaaatagctgggaaasaggtttatgccaccacgcccaactaatttttaaattttttataaagatggagtctccctgtgttgcccagcctcctgggctcaagtgatctccccgcctt

SEQ ID NO: 43464 - DNA, 201 bp, Homo sapiens
tgagtgctcagtaggcagacctggttttgagctgatagagaaggcccacgcgaacgggcagagctgggcctcgccagggcctggcactcagtagtgctcascaaatgcctgttgcacaagggatggtgcccaggtaacctgggtgagctacaaaccagagccgctggacgagttccaaagggaactcgggcgcactagccc

SEQ ID NO: 43465 - DNA, 201 bp, Homo sapiens
acagcccctttgaccctcagtggggaggttttcttggaatgaagcagaaggaacaatattactggtgcctcctgaatatttaaaaagaagagacattagcyattccagacacttctccattggtccactgcaccttcttccttcctctgcacttgatatttttagttttacaaactgctaggcagaggcaagcatggtttt

SEQ ID NO: 43466 - DNA, 201 bp, Homo sapiens
aagtgattctcccgcctcagcctcccaaatagctgggaaacaggtttatgccaccacgcccaactaatttttaaattttttataaagatggagtctccctrtgttgcccagcctcctgggctcaagtgatctccccgccttggcctcccaaagtgctgggattacccggcttgagcatgatctttttgccttgcttggctc

SEQ ID NO: 43467 - DNA, 201 bp, Homo sapiens
cacacgacctgctgctgagctggacataagcaggacctggctctgggggcttctgacctagggcaggccctgaagttggtcattagaccccacccacccasctgagagcctggcggagatgtgacaggtgacagccccagaagtcccatcgttgctgcctttgtggttaaagtccgctgaacccaagcgctctcttcccct

SEQ ID NO: 43468 - DNA, 201 bp, Homo sapiens
ttttacacaaaatatccagatttctggattcttttgaagaatcagaagatctgacaatacggagcctcacattcctgcacacacagcagccatcgctggarccactgcctccattagtttgaatttactgcagaccccactcctccctgtcgtccctgtctccagaccacagagttagttgtcattgatcgtgtgccattt

SEQ ID NO: 43469 - DNA, 201 bp, Homo sapiens
gaacctgggccacttgggctctgctggatgcccacagggctgccagagcctgcccgccacagagcccctctgagacctggagtctcacctgagccctctcrctgcccacagggctggcctctgcctttccgctgctgctctgcggctcggggacacggccagggctggtggcgcttacagcccaggggcaggggagggcac

SEQ ID NO: 43470 - DNA, 201 bp, Homo sapiens
  misc_feature (1)...(201): n = A,T,C or G, or insertion/deletion polymorphism (see Tables 1-2)
gctcctgcagccgtggcgtggcagaggagggaagcacttcctgggatttatgctgcctccctgacatttcaaggcccttcatttctctaaatattggaggngttgaattatttttagttgagcctcaagggatcagagaataagcttgcagcaacgttggcagatgggcttcttctagcagagagtggttattcggggcct

SEQ ID NO: 43471 - DNA, 201 bp, Homo sapiens
gatgtgaacccggtgtgctcctctagctccactgtcctcaggttggggacagccagggacaaggccccctactccagctccaaacgtagttccaggctggrgtgccctttgcccaggcccagcctggtagccccgggtgctctccctgacttttcatgagcccgggggctgaaaccagagcagcagggagacagaaaagcc

SEQ ID NO: 43472 - DNA, 201 bp, Homo sapiens
ttccttatctttaaaatggacagagttggccgggtgaggtggccctgcctgtaatcccagcactttgggaggccaaggctggcagattgcttgagcccagkagtttgaagccagcctgggcaacatggcgaaaccccatctctactacaagtacaaaaatttggccgggcatggtggctcatgcttgtaatcccagcactt

SEQ ID NO: 43473 - DNA, 201 bp, Homo sapiens
aacccggtgtgctcctctagctccactgtcctcaggttggggacagccagggacaaggccccctactccagctccaaacgtagttccaggctggagtgccytttgcccaggcccagcctggtagccccgggtgctctccctgacttttcatgagcccgggggctgaaaccagagcagcagggagacagaaaagcccagccc

SEQ ID NO: 43474 - DNA, 201 bp, Homo sapiens
ctccactgtcctcaggttggggacagccagggacaaggccccctactccagctccaaacgtagttccaggctggagtgccctttgcccaggcccagcctgrtagccccgggtgctctccctgacttttcatgagcccgggggctgaaaccagagcagcagggagacagaaaagcccagccccaccctccagagggggagtc

SEQ ID NO: 43475 - DNA, 201 bp, Homo sapiens
ccagagggggagtccagctgcccggagaccccaagagcactgccagaatctgggtatgagacccagtcccctgccgcgtgctaaccatgtaaccttggacrtgatctctttgtgcttttttttttttgtttttttctttttgagatgcggtcttgttctgtttcctaggtgggagtgcagtggcaccatcatggcccactg

SEQ ID NO: 43476 - DNA, 201 bp, Homo sapiens
ctcctgcaccagcttccctggacccactgccactgcgtcacgtggtcggatctgtgtcccctgcactctcaccacctccaacttgcatcccggtcccccakaccctgacccccaaaggcattgtgcatgtggatgagtgagtgaaggaaaggctggcgtgttgggtgtgcgaggtcgcaggggcatgaggtgcctggacgg

SEQ ID NO: 43477 - DNA, 201 bp, Homo sapiens
gtgactattaatttaggtttaaaatgtattggtaacaggcagatctggccagtccctccctggcttcaatctctttggtagcttccaggattactcttagragggactggaggaaaagcccctctctgtccccacggcacccacagtgaccatcacagccctcctctgggccctcactgccaccagtggactcactgtctc

SEQ ID NO: 43478 - DNA, 201 bp, Homo sapiens
tcacaggcagagagcctggctcgaggatgggcgggagctcagtctggctttgatctgcgggaggtgttgtgtgcagaagctgtgggcaccgggggctgcayagcttcagacctggagcctgctcccagggccgatctgaacccggcacctgtgctgacccaagggtcaaccaaagtcctgagtttggtggcgccgagggag

SEQ ID NO: 43479 - DNA, 201 bp, Homo sapiens
acaggcagatctggccagtccctccctggcttcaatctctttggtagcttccaggattactcttaggagggactggaggaaaagcccctctctgtccccayggcacccacagtgaccatcacagccctcctctgggccctcactgccaccagtggactcactgtctccctctgccctgtgcacagcttcttaatttgggtc

SEQ ID NO: 43480 - DNA, 201 bp, Homo sapiens
aatgttaaataaaatgaagtcgtgtctgtgaagcacctggcatggtaatcggtggccgtgaggatgacgctggcctcgcagggactgggtggcacaggtgrcctgaccttggcatgcagggtggatgggccaggcttccagccagtgctggatctcagaggcccaggggttagagaactaagggcctccgagccaggctcc

SEQ ID NO: 43481 - DNA, 201 bp, Homo sapiens
gtccctccctggcttcaatctctttggtagcttccaggattactcttaggagggactggaggaaaagcccctctctgtccccacggcacccacagtgaccrtcacagccctcctctgggccctcactgccaccagtggactcactgtctccctctgccctgtgcacagcttcttaatttgggtccctctggtttagctcag

SEQ ID NO: 43482 - DNA, 201 bp, Homo sapiens
  misc_feature (1)...(201): n = A,T,C or G, or insertion/deletion polymorphism (see Tables 1-2)
atatccatcagtaggggagttttagggtctgtctgtttatacagcagaataacatgcagtgtaagaaggaatgagtaccttgtctatagacatattactantggagacagcaagcacacagcaggatgcacggtgcgctgtttctggtatagaaaatgcagaaatgcaagaatgtatttctcctgctgtgtttgcataaag

SEQ ID NO: 43483 - DNA, 201 bp, Homo sapiens
cctccccagtcacgtggaactgtaagtgcattaaacctctttcttttgtaaactgcccagtctctctggtatgtctttatcagcagtgtgaaaacggactratacacttccactttttggctattgggaatagtggtgctgtgaacactaatgtataggtttttgtgtggacacgtttccagttgtcttggatatatacct

SEQ ID NO: 43484 - DNA, 201 bp, Homo sapiens
atgtataggtttttgtgtggacacgtttccagttgtcttggatatatacctagttgtggaattcctggctcatgtggtaattcatgtttaactttttgagkaacgagcggccatttttaaagactggataggaatatgtaaggaagaaagtaaatttattcacttccgttcaggaaatttacctaccaaacaacatgctga

SEQ ID NO: 43485 - DNA, 201 bp, Homo sapiens
ataggtttttgtgtggacacgtttccagttgtcttggatatatacctagttgtggaattcctggctcatgtggtaattcatgtttaactttttgagtaacragcggccatttttaaagactggataggaatatgtaaggaagaaagtaaatttattcacttccgttcaggaaatttacctaccaaacaacatgctgaatgg

SEQ ID NO: 43486 - DNA, 201 bp, Homo sapiens
tgcctgggaggaggaccagcaaagggcagagccccccgtgtttcagatggaaaggttaagtaatgtgactctggtaatgcagtccagttcatttatgagaycatggacctcttatactacagattttttgtgttttttttgctgagtcttttgctccctaaccgtgttccctggctggccaccctgccagcaccacgctgg

SEQ ID NO: 43487 - DNA, 201 bp, Homo sapiens
  misc_feature (1)...(201): n = A,T,C or G, or insertion/deletion polymorphism (see Tables 1-2)
cggtgatgtgctgactgggaacggcagaggtgccctgggaaggcggaggtctgggagccccacaagggctgagccttggggcctcaaaacagggagtcttntctgggctcagggcctttctggagatgggacttctaggttgccagggccactagccgtgaggagttcagctgcccatggtggcggcggctgggctgtatc

SEQ ID NO: 43488 - DNA, 201 bp, Homo sapiens
gggtttcaccatgttgaccaggctggtctcaaactcctgacctcaagtgatccactcgcctgggcctcccaaagtgctgggattacaggcatgagccaccrtgcccagcccccaagggacagtttgagccctggtctgcccaacccagacccctacttggaatccttcagggagaagggggtgttgggaaatgtcacaggc

SEQ ID NO: 43489 - DNA, 201 bp, Homo sapiens
gagggttttgtttggatttgctttggctcctgcagatttatctagctgggggtgtctctggtagcagctatactgtatacatctaacagcaatgtaataayaatcctgaaatacaccacagcctgttatgtagctgggagaggctaaaatctcccttcccaaaagcatatgggattatttttggtgaggggacatcacacc

SEQ ID NO: 43490 - DNA, 201 bp, Homo sapiens
gattttttgtgttttttttgctgagtcttttgctccctaaccgtgttccctggctggccaccctgccagcaccacgctggccctcaggaagcatcatcagycagagacacaggcctttgctgtggcctcacatgctagcagaggaagatagacaacatggcgatggatgaggaagttgggttgtctgtaagaggatgagaa

SEQ ID NO: 43491 - DNA, 201 bp, Homo sapiens
tttgtttggatttgctttggctcctgcagatttatctagctgggggtgtctctggtagcagctatactgtatacatctaacagcaatgtaataacaatccygaaatacaccacagcctgttatgtagctgggagaggctaaaatctcccttcccaaaagcatatgggattatttttggtgaggggacatcacacccgtgat

SEQ ID NO: 43492 - DNA, 201 bp, Homo sapiens
tctgtaagaggatgagaagggctgtcattaaacaggtgggttcaggtgggtctcattgaaccatgagatttgaaccaagacctaggggggtgagtgagggkttggggaagggagattaatgcgagttctggggaaggaacattccaggtgaggaaacagccactgcagagccccttgggtgttggagaaagacactcaggt

SEQ ID NO: 43493 - DNA, 201 bp, Homo sapiens
ctctgtggattcgcccgctctgggcatttcatgtaaatggaatcagacgatacatggtcttttgtgtctgactccattcactttgcttaatgtcttgaccrttcatctgtgttacggtgtgtatcagagtttcacttctttttgtggctgagtaatattccactatgtggataggccacattttgttgatctgttatcagc

SEQ ID NO: 43494 - DNA, 201 bp, Homo sapiens
tcctgcagatttatctagctgggggtgtctctggtagcagctatactgtatacatctaacagcaatgtaataacaatcctgaaatacaccacagcctgttwtgtagctgggagaggctaaaatctcccttcccaaaagcatatgggattatttttggtgaggggacatcacacccgtgatctgggaggttttgttattgtg

SEQ ID NO: 43495 - DNA, 201 bp, Homo sapiens
tgtgttgcccagcctcctgggctcaagtgatctccccgccttggcctcccaaagtgctgggattacccggcttgagcatgatctttttgccttgcttggctctgggtttcctcatgtgtcaagtggggctgagccccagctgtgtgggctgaacaggggagggttaagctcggcccctagagtgagggcccgccatggtgg

SEQ ID NO: 43496 - DNA, 201 bp, Homo sapiens
catcaccctcagggcccgggaagctccgtacaccctccctcgcatgcctgtggggctcgtggcagatgcccagagtggctgcgaaggtggtgcaggaaackccccctccaggaaagtgtgcctgcttttggaattttccctggggattttccagagatgcaggacacctgttttcctcgcctggtgattgagccgggaagc

SEQ ID NO: 43497 - DNA, 201 bp, Homo sapiens
ggtggcctggctgggcgtggccttgaggttctattgataaccccatggggaaagcccccctgaggtgcttgggcatcggacctgcccaccatctcctgagrtggggcctgctctccagacagtcaggtcagcatgagttcccatgaggccagggccagcacgaggacctgctgggagcggtccatccacccatccgtccgt

SEQ ID NO: 43498 - DNA, 201 bp, Homo sapiens
ccatggtggtggctcccgtatggcatatttccctaacggttcccatttggtctgtcctgctagaccaggctggtgggacgtacactgactctggggttctrtccaccccgtgggtgtggtccaccacatggtcatggtggctttctagggtagacttgaccttccccactgcctttatttatttatttattattttatttt

SEQ ID NO: 43499 - DNA, 201 bp, Homo sapiens
gcttgggcatcggacctgcccaccatctcctgaggtggggcctgctctccagacagtcaggtcagcatgagttcccatgaggccagggccagcacgaggamctgctgggagcggtccatccacccatccgtccgtccatccatccatccatccatccatccctatccacctgtccaccctgatgcagttcctgccatccac

SEQ ID NO: 43500 - DNA, 201 bp, Homo sapiens
gccgggtgaggtggccctgcctgtaatcccagcactttgggaggccaaggctggcagattgcttgagcccaggagtttgaagccagcctgggcaacatggygaaaccccatctctactacaagtacaaaaatttggccgggcatggtggctcatgcttgtaatcccagcactttgggaggccaaggagagcggatcacttg

SEQ ID NO: 43501 - DNA, 201 bp, Homo sapiens
ccaccaccatgcccagctaatttttttgtatttttagtagagacggggtttcactgtgttagccaggatggtctcaatctcctgacctcgtgatctgcccrcctcggcctcccaaagtgctgggattacaggtgttgggggattcttaaggaaaaccacctgaaagtgcggggttattaaaaacagaaaccaacccatgca

SEQ ID NO: 43502 - DNA, 201 bp, Homo sapiens
gctggtttggcgcagccccggcttctgtgagcttttgtttctgttactggcacctgcagctcttcctaggcccctgccctggggcactggtgcctgcttcrccaaaggcacagagggctgcaggcgactggggcagggtggggggcttgcctcttagggctcagcttcactggccagaaacagggctggctcgagctgggt

SEQ ID NO: 43503 - DNA, 201 bp, Homo sapiens
ctgtgagcttttgtttctgttactggcacctgcagctcttcctaggcccctgccctggggcactggtgcctgcttcgccaaaggcacagagggctgcaggygactggggcagggtggggggcttgcctcttagggctcagcttcactggccagaaacagggctggctcgagctgggtgttggcctgggtggggtggccagc

SEQ ID NO: 43504 - DNA, 201 bp, Homo sapiens
tcatcccacactcacatgcgggtcctagacaccagctcatgcacatacacacacacacacacgcacacacacacacacacacatgcgcacatgcacccacrcactctctttgcctgtgggagggcaggatcccagctgccccagcggggaaggggtgtggggaatcagccctgcagatgcggtgtgaggggcagacatggc

SEQ ID NO: 43505 - DNA, 201 bp, Homo sapiens
gccctgcctgtaatcccagcactttgggaggccaaggctggcagattgcttgagcccaggagtttgaagccagcctgggcaacatggcgaaaccccatctytactacaagtacaaaaatttggccgggcatggtggctcatgcttgtaatcccagcactttgggaggccaaggagagcggatcacttgaggccagaagctc

SEQ ID NO: 43506 - DNA, 201 bp, Homo sapiens
gacatggcatgctggtctttggcagtgtggtcccaagtgggggcggctggagaggtgccttgccacagggcccaggccacccgcatgcatcccatgaggcygtccaagcccgtctgccctgcatcagagaggacaccccaatgcggggagggaggaacctggtgaagccaggagcggtgggcaggggccagcaaggatccc

SEQ ID NO: 43507 - DNA, 201 bp, Homo sapiens
cttgggggacacagccgacacgaccagcctgcagtaccaggatagacaatttgggctggagccaaacttgatcagagggaggctgactttatcgagggctsctttgtggcgggcgttcattgtggaaagagcccaggaaggagctctctgccttgcaagaacattgcctgtggctcaaaatggccacatgggatgcagttc

SEQ ID NO: 43508 - DNA, 201 bp, Homo sapiens
agccaggcttccacaagcctgcccattcctcaggacactgaccctctcctctgccacccttcacgggtgcagacgatgagcatggagaacaccacagcgcrcagggccgagggccaccatcagagtctcctgcagccctggattccctgggcctgaagcaggcagagcggccaaggtagcctcatcagcctcaccagcccg

SEQ ID NO: 43509 - DNA, 201 bp, Homo sapiens
acggttcccatttggtctgtcctgctagaccaggctggtgggacgtacactgactctggggttctgtccaccccgtgggtgtggtccaccacatggtcatkgtggctttctagggtagacttgaccttccccactgcctttatttatttatttattattttatttttttttgaaacggagtcttgctctgttgcccaggct

SEQ ID NO: 43510 - DNA, 201 bp, Homo sapiens
gagactgaggaaaatctgatggctgcttgaaagctttcccgtggctctgctggcaggagtaaggtctgcttctcagtttctgatctcagccttggtgggcrggggtcaccctgtgaaaatcaagggcagccagggtgggtctggcacaggattattggtttaccctgcaggtgctgcctctggttggaagcccttggccaa

SEQ ID NO: 43511 - DNA, 201 bp, Homo sapiens
ttatttatttatttattattttatttttttttgaaacggagtcttgctctgttgcccaggctggagtgcaatggtgcgatcttggctcattgcaacctccrcctcccgggttcaagggattctcctgcctcagccttccaagtagctgggaatacagatgtctgccaccacacccggctaatttttgtatttccactagag

SEQ ID NO: 43512 - DNA, 201 bp, Homo sapiens
ttaggtgacaagccacagtcatacagggaggaggtgtgtctgcttcccgagctgagctcccaccttacttacaggggcctggcctttgtcccctgcagccrccatggccctcagggacgtcgggctgctgctgaggctcctaggctgaggagtggaagaaaggagccaggatccccacccctcacccccacatgccacgag

SEQ ID NO: 43513 - DNA, 201 bp, Homo sapiens
agtgtggcacaagttacaaagctcatgaatggagtcctgcccctacccccagtgccccacaacgtgcaagaagccatattggcaaagcagtgccacacctscccactgtggtgtgcagggtgatttcccaggcccccggcaacaggcacgttgctgtccagcttgtagaggaggaacttaaggttcacagaagtgatagga

SEQ ID NO: 43514 - DNA, 201 bp, Homo sapiens
cagggcaggcaccacctcttacctgttgcaaagcttaatcctgtcacagaaagtgccaggtgtcagctctagtgtgagagcgtgggtttccaatcccagcwctgccccatagttgccatgtggcctcaaggaagtcccttagcgttccgtcaccccattatggctgcagctcaagggccccagtttcctatgtgtaattcc

SEQ ID NO: 43515 - DNA, 201 bp, Homo sapiens
attgtccaactgggaaaaagaaaaagcagtacttttttaggccatgtaaatgcaaaatatacatttgaagtctgcgtttaagacatgaacttagagatttrtaagcctgtttttgggggtcactctaaaagggagggcattttcaggtcccccctctgtgagcattcacagcatcccagccagcctgtatccctgtgccgt

SEQ ID NO: 43516 - DNA, 201 bp, Homo sapiens
cctccgcctcccgggttcaagggattctcctgcctcagccttccaagtagctgggaatacagatgtctgccaccacacccggctaatttttgtatttccastagagacggggtttcgccatgttggccaggctggtcttgaactcctgacctcaggtgatctgcccacctcagcctcctaaagtgctgggattagaggcgt

SEQ ID NO: 43517 - DNA, 201 bp, Homo sapiens
gggtgagtgagggtttggggaagggagattaatgcgagttctggggaaggaacattccaggtgaggaaacagccactgcagagccccttgggtgttggagraagacactcaggtggctggaggggtgggggaagcattggcagggagaggccagggctggcaggcctgccgaaggctttgcttctcttctgccaggctggc

SEQ ID NO: 43518 - DNA, 201 bp, Homo sapiens
gattaatgcgagttctggggaaggaacattccaggtgaggaaacagccactgcagagccccttgggtgttggagaaagacactcaggtggctggaggggtrggggaagcattggcagggagaggccagggctggcaggcctgccgaaggctttgcttctcttctgccaggctggccatcacgggccttgcacagaagagag

SEQ ID NO: 43519 - DNA, 201 bp, Homo sapiens
  misc_feature (1)...(201): n = A,T,C or G, or insertion/deletion polymorphism (see Tables 1-2)
ccataggggacagggccccactgtcccccatcactgaacagtgtgcccaggtgagatcatggacttgggccccctaggccagcccagtctctttgcagccnaggaaagtgaggcttagctgtcgggggctgtggggggatgcagcttgccacacttgacacccaaacgctgattttgtttacatgagactcaggtccgagt

SEQ ID NO: 43520 - DNA, 201 bp, Homo sapiens
ctgcaggagctcaaaggaagttcctggggtgagaccagccgccgcagagggaaaagtgtgattggagtggggtggggggtcttagggttggcagggggaayacatgcctccgtggcagctcccggcaccatgggctccctggcagcatcgtccgttctctgagcctgcgaggggcgacacactgtcaccattcttcttctt

SEQ ID NO: 43521 - DNA, 201 bp, Homo sapiens
agactcaggtccgagtttatgtctgagacctgggaatcaaaaagccacccccacagcctccagggacctggctcccctggagccaccgtgctgccccacasgtgtcacccatggaggctgcaggagcacctggcgtggtccaggggacacgaagccctggtgctggctcctcccaacgcccctgtgagttctgcctcccat

SEQ ID NO: 43522 - DNA, 201 bp, Homo sapiens
aaagtgtgattggagtggggtggggggtcttagggttggcagggggaacacatgcctccgtggcagctcccggcaccatgggctccctggcagcatcgtcygttctctgagcctgcgaggggcgacacactgtcaccattcttcttcttggattttctgtgatgatgggtcctccgattttattgagggccacggagcacg

SEQ ID NO: 43523 - DNA, 201 bp, Homo sapiens
  misc_feature (1)...(201): n = A,T,C or G, or insertion/deletion polymorphism (see Tables 1-2)
atggatctcagcgcgcagccacagcaaacaggcagcgtggcgctgaggggcacaggtttgctggggggcgtgagccgggagcatcgccagcagcaggctcncccccctgcgagggcgcgcacggattcgctcgccaccaagagcagggccccaagaggggccctcggcatagtcccctcgagtccccagaacttcacaggc

SEQ ID NO: 43524 - DNA, 201 bp, Homo sapiens
ggcagctcccggcaccatgggctccctggcagcatcgtccgttctctgagcctgcgaggggcgacacactgtcaccattcttcttcttggattttctgtgrtgatgggtcctccgattttattgagggccacggagcacgggggaagtagaagctcaactttttaaaataatatccacagcaacagcagtcaccccgcatc

SEQ ID NO: 43525 - DNA, 201 bp, Homo sapiens
  misc_feature (1)...(201): n = A,T,C or G, or insertion/deletion polymorphism (see Tables 1-2)
ccaccaagagcagggccccaagaggggccctcggcatagtcccctcgagtccccagaacttcacaggcagagagcctggctcgaggatgggcgggagctcngtctggctttgatctgcgggaggtgttgtgtgcagaagctgtgggcaccgggggctgcagagcttcagacctggagcctgctcccagggccgatctgaac

SEQ ID NO: 43526 - DNA, 201 bp, Homo sapiens
gagcagggccccaagaggggccctcggcatagtcccctcgagtccccagaacttcacaggcagagagcctggctcgaggatgggcgggagctcagtctggytttgatctgcgggaggtgttgtgtgcagaagctgtgggcaccgggggctgcagagcttcagacctggagcctgctcccagggccgatctgaacccggcac

SEQ ID NO: 43527 - DNA, 201 bp, Homo sapiens
gcaaacattgagtgcctctgctgtactaaagacaccatcctaggccctggggatgtgcagcagtgaacaggtggagccgatgctgcagtcatgggggaccrgcaggcgacagcgtgcactcgggaaggctagagcatctgagacacgcagtgaggtggggagccctgggctgggtacctggcctcgcagatcccatggcga

SEQ ID NO: 43528 - DNA, 201 bp, Homo sapiens
tgggcggtgtttgctggaagaatttttgttccgcttcgggcaacaaggaacccaaacctctcactgttgtggggagaaaagttggaaatcagatgggaackggctgcggtaccagagaggacgtcagacccgggccgcggcctcagcccccgactccttgtaagcgtgggctgggtgcacacgtggcggctgcgagcagtg

SEQ ID NO: 43529 - DNA, 201 bp, Homo sapiens
cctggggatgtgcagcagtgaacaggtggagccgatgctgcagtcatgggggaccagcaggcgacagcgtgcactcgggaaggctagagcatctgagacaygcagtgaggtggggagccctgggctgggtacctggcctcgcagatcccatggcgagggagctgggattggaggatgctgagcgagccagccaggcaggca

SEQ ID NO: 43530 - DNA, 201 bp, Homo sapiens
ggatgtgcagcagtgaacaggtggagccgatgctgcagtcatgggggaccagcaggcgacagcgtgcactcgggaaggctagagcatctgagacacgcagygaggtggggagccctgggctgggtacctggcctcgcagatcccatggcgagggagctgggattggaggatgctgagcgagccagccaggcaggcatctgg

SEQ ID NO: 43531 - DNA, 201 bp, Homo sapiens
tcctgcaggtgcccttgccccaacgcaccactcagcctaaccatggggagcatccgacaaaaccaagctgtccgcatctccaaggacaggcacactggggsttagggcttcagtgggggcggaggtacagttcactccctaatacgccatttacttggagaagccctctccagctgcctgaggcagaagcacccggttctc

SEQ ID NO: 43532 - DNA, 201 bp, Homo sapiens
ttccgcttcgggcaacaaggaacccaaacctctcactgttgtggggagaaaagttggaaatcagatgggaactggctgcggtaccagagaggacgtcagamccgggccgcggcctcagcccccgactccttgtaagcgtgggctgggtgcacacgtggcggctgcgagcagtgctttggagctcatctccccagaccctag

SEQ ID NO: 43533 - DNA, 201 bp, Homo sapiens
  misc_feature (1)...(201): n = A,T,C or G, or insertion/deletion polymorphism (see Tables 1-2)
tgtgggtgggcgtggtcacaggccggaggacatctgtaaccggccgtgtccccccaacaggccctttattgaagccctttcatgggcggattgggttcccngaggggagccattcagaggcagggcccagcacagcgaggggtgcagaggccggcctcggggccctggccctatggctgggaggcatctgcatgtgaaagg

SEQ ID NO: 43534 - DNA, 201 bp, Homo sapiens
ttgaagccctttcatgggcggattgggttccccgaggggagccattcagaggcagggcccagcacagcgaggggtgcagaggccggcctcggggccctggscctatggctgggaggcatctgcatgtgaaagggggtgggcatttactgcatcctgtcttgggccactaaagcacatctgctgggcccagcccaggcccgg

SEQ ID NO: 43535 - DNA, 201 bp, Homo sapiens
ctgatatttggagccaggaatcttttctttcttttaacagatacttaagtgattcctgtggtccaggaagttttgcaagctctgatgcagaagagctcgcyggagcaaacatgtatgttctgttttactaattagatatacgctgttgatgactccaaagtggacgtgccatttctgtcccctccagcagtaggaaagaat

SEQ ID NO: 43536 - DNA, 201 bp, Homo sapiens
actcagaggctcgtcctggcctgctgagatgaggtaaaggtcagttcaaagatccagtttgggccaggcgcggtggctcaggccgggtgccatggctcacrcctgtaattccagcactttgggaggccgaggcaggtggatcactggagattgggagttcaagaccagcctgggcaacatggtgagaccccgtctctacta

SEQ ID NO: 43537 - DNA, 201 bp, Homo sapiens
ttatacttagaaagaaggatattctacattctccttcaggagttctaaagatttgctttgcacattcaggttccaaatctacttgaatttgacttgtgtatatggtgtgaggtagggatttgattttattttctatgtggataacagttgttccattatcacttttgagtagtccaccttttctctcactgacttataatg

SEQ ID NO: 43538 - DNA, 201 bp, Homo sapiens
aggcagcgtgctgaggtgggggccatggtctcagaggggctatctggcagccaggaccctgcagaaggcccctttccccaaggttcttgggtggtggggtsggaacagcccatcccagagctgggcttgtccttctttgcaggggctctttgtacagctctctgcaagccttgctggggtcctggagccgcacctgactag

SEQ ID NO: 43539 - DNA, 201 bp, Homo sapiens
ctgttgtcacccaggctagagtgcaatggcacaatcttggctcactgcaacctctgcctcctgggtttaagcacttctcctgcctcagcctcctgagtagmtgggattacaggcacccgccaccacacccagctaatttttgtatttttagtagagacggggtttcgccatgttggccaggctggttttgaactcctgatc

SEQ ID NO: 43540 - DNA, 201 bp, Homo sapiens
aggaattctggctgcctggtggaggtcggggctggccctgcaccgccaggagaagcagtctgagggagggctgctcaggctggacccagccctgaccagcsgggccatcgggcgtcctgggccctggcaggatgtcgttccagtgatacagcacttccttgcttctaaactgctgagtggtcagtgtcggttatcagctgt

SEQ ID NO: 43541 - DNA, 201 bp, Homo sapiens
atgaggacacgcccacccgccaagctcccctcctgccagtcccacctggagccttcatgcatgctgtctgcgcccttcacctgtcccaccacctcttcttyggcctgcctggatcctgccatatcctcaaggccttccctggtgatggaattccagagtcctcccaattgcaagggcctgagggatccgctgccctccaac

SEQ ID NO: 43542 - DNA, 201 bp, Homo sapiens
ggaattctggctgcctggtggaggtcggggctggccctgcaccgccaggagaagcagtctgagggagggctgctcaggctggacccagccctgaccagcgkggccatcgggcgtcctgggccctggcaggatgtcgttccagtgatacagcacttccttgcttctaaactgctgagtggtcagtgtcggttatcagctgtc

SEQ ID NO: 43543 - DNA, 201 bp, Homo sapiens
actgattgatgtatgccagtgtgggctcgtggcttcctatgtaattcagtgggttatcgtctgttaaccgtcatcactgggatattcagatggtccccgaygcaggcactggcagccccttcaggctggccctgtgacctttcggcacatcctcaccgttctttgagcccttccttgcattttggcccaaaaagatgtttc

SEQ ID NO: 43544 - DNA, 201 bp, Homo sapiens
cgtggccaggctagggccaggggggctgcgcaggatggggccttttcaccactgcctggagccgctcgcccaccaaccccactgacggctctcagtttccmtttccccgagcgcccttcaccctgaggcacagcacagcctcgtgctcctggccccactggcctgctcccttaagctgagttttgcctttgcagtttgagt

SEQ ID NO: 43545 - DNA, 201 bp, Homo sapiens
  misc_feature (1)...(201): n = A,T,C or G, or insertion/deletion polymorphism (see Tables 1-2)
atttattttaaaattagaaggaaaatatctctggaacatttagggccaaagaaaatgttttaatgttttttctcactttagaaataataattcaaaaatcnattaaattatttaacagcttttttaatggaggaaggggccccccaaatcacaaagtggccctgggccctgggatggccgggtgagagcctgccataccca

SEQ ID NO: 43546 - DNA, 201 bp, Homo sapiens
ccagtgccaggcacgtagtaggcgctcagtgacagtttgcagaagggtggatgttacttcatttggtgcgttctgagaacttgcccaggtgcagcctggawtcgcgggtctcctatgaagtcaggagggaagaagctcggtgccgccggccagtggcagcatcctgaagttcatgagacctccaggctgggtttgggcagg

SEQ ID NO: 43547 - DNA, 201 bp, Homo sapiens
  misc_feature (1)...(201): n = A,T,C or G, or insertion/deletion polymorphism (see Tables 1-2)
caaaaagatgtttcaggttcatttgttcagtctttgcttcagccctggaatcggccatttctccaaggagccccagttccttccagtggagggcactgttnagaatctcagcccagggccccaggtgtgcttgtgttgtctctgggcattgctgctcaggccctggcggtggacagaggtaggaaagatgcgcatggtatg

SEQ ID NO: 43548 - DNA, 201 bp, Homo sapiens
ggtgtgcttgtgttgtctctgggcattgctgctcaggccctggcggtggacagaggtaggaaagatgcgcatggtatgcaggtgtgacacacacatgcgtycgtgcttaccctacccacctggacctgcccaaaagcccgagctcacagcagtgcctccgattccagtccagcagcacagggttccttctcacctcatgcc

SEQ ID NO: 43549 - DNA, 201 bp, Homo sapiens
  misc_feature (1)...(201): n = A,T,C or G, or insertion/deletion polymorphism (see Tables 1-2)
cttcccaggccatttctgcatttgtggttctcttccaagcctcttgggtaggcatagaaagtcttctctgttttccagggaagctgcagactcacccagcntcacccagctggtaagggtgtagcaggacagtgccagcatgtctgtcccaactgtccctatggcccctatggaagattagctatgtggtggcaaagtgtc

SEQ ID NO: 43550 - DNA, 201 bp, Homo sapiens
gaaatacaccacagcctgttatgtagctgggagaggctaaaatctcccttcccaaaagcatatgggattatttttggtgaggggacatcacacccgtgatktgggaggttttgttattgtgctgtctgtgggcctgcagaaccgatggcctggtctctcaaccccatgggcttcccatgccataggaccaagtccccatat

SEQ ID NO: 43551 - DNA, 201 bp, Homo sapiens
tcagagcacttatccaaccaaatgaaattttgagtagaactccaaaattatatatatataatatatatatttatatattatatatatatttatatattatrtatatatttatatattatatatatttatatatattttatatatatttatatatatataaattttttttatatttatatattttttatatatttatatata

SEQ ID NO: 43552 - DNA, 201 bp, Homo sapiens
ctgcaggactggctggcccttgtgtctgtctttcccctcgtcctggccccctttgtccactcctgcaccagcttccctggacccactgccactgcgtcacstggtcggatctgtgtcccctgcactctcaccacctccaacttgcatcccggtcccccacaccctgacccccaaaggcattgtgcatgtggatgagtgagt

SEQ ID NO: 43553 - DNA, 201 bp, Homo sapiens
ggcattgtgcatgtggatgagtgagtgaaggaaaggctggcgtgttgggtgtgcgaggtcgcaggggcatgaggtgcctggacggcagagagccagggctkggtgaggacctgggtgccaggtcgggggtctgggcagcctggtggccccctgaaaacgttcacatcccttggggcctgctgtgatacatactaatcagtg

SEQ ID NO: 43554 - DNA, 201 bp, Homo sapiens
gccactaaagcacatctgctgggcccagcccaggcccggctcggcgtttttggagccggcggaaggaagaagacttggcccagggcagcctcataaagcarttcccacccaggaccgccccgatcgatcggcctggtgctgtggagccaggcccacagcccttccgtccagtagcacctctcaatcccctgtgtgtctggg

SEQ ID NO: 43555 - DNA, 201 bp, Homo sapiens
  misc_feature (1)...(201): n = A,T,C or G, or insertion/deletion polymorphism (see Tables 1-2)
cccggcagaacataaagtactagtgtggggtatgaggcagcatgtgggggcgctggggtggcagcagggccagaccccacttcaggggttgcccccaggancccccttgcggtacccgtatatcccacccccagactcctttccatgagctgctcccagaccccctcatatccatcctgcctccagaacccctatatcttg

SEQ ID NO: 43556 - DNA, 201 bp, Homo sapiens
tgcatttccgagtaaaatgcagacacgggtatactcccctatacacttcagcatatcattggagtttggtatttgtttacggtttttcctgtttgatgtamaatttacatacaatgaaatgtacacacgtcaagtgtacttttgctgagttttgacatatgcatgcacccatggaacccaaccccgtgaagagctagacca

SEQ ID NO: 43557 - DNA, 201 bp, Homo sapiens
ggggcgctggggtggcagcagggccagaccccacttcaggggttgcccccaggaccccccttgcggtacccgtatatcccacccccagactcctttccatragctgctcccagaccccctcatatccatcctgcctccagaacccctatatcttgctcccactccctaccatatgctgttcccagacccccctccatggcc

SEQ ID NO: 43558 - DNA, 201 bp, Homo sapiens
gggggtactggggggctgaggggggttctttagggcaggagttacctgccctgtagacggggagaccacattagtgtttgtgcaaagccctgccctcgtgmacctgtccttccgtagcccacgatacctcatccagcccgggcccgtgggtgggctgctgagcacccgaccacagccaggcctccatgtgccactgtcaag

SEQ ID NO: 43559 - DNA, 201 bp, Homo sapiens
gagaggagacacatggggcaaagtctaggagaagacaggcatgaacttccagttgtcccttcgaaatggagtcctactgggcacacttgattctcccagcratgatgtgtgacaacacgtgggaagcattggccaccagggaagctcactggagcctcagtgtccagggtttttgtgtagacattagcacctgtgtgactg

SEQ ID NO: 43560 - DNA, 201 bp, Homo sapiens
ggaagctcactggagcctcagtgtccagggtttttgtgtagacattagcacctgtgtgactgactttagcgactcagtctccagccccacagagtccaaastgatacagctgggccagggccgcagggatacagaaacaggtgttcactgtaagccaagctgttagcgtaaatgatctggtcagactgagagagcagggcc

SEQ ID NO: 43561 - DNA, 201 bp, Homo sapiens
tttagggcaggagttacctgccctgtagacggggagaccacattagtgtttgtgcaaagccctgccctcgtgcacctgtccttccgtagcccacgataccycatccagcccgggcccgtgggtgggctgctgagcacccgaccacagccaggcctccatgtgccactgtcaaggggacttggcccgccatgatcctgagtg

SEQ ID NO: 43562 - DNA, 201 bp, Homo sapiens
tgagcaacctagtcctgctgagttaaccctttccgtcacagtagtcttttgtgtaaggcttcttttacccaacgtaatgtttttgagactcatccatattrttgcatgtatcagcagtgttgttcatttttattgcagaatagtattccattgagtgaacagaccacagtttatccattcacatgttgttgatacctggat

SEQ ID NO: 43563 - DNA, 201 bp, Homo sapiens
agaagggccaggtaggctgatgggtcctgagcttgtgctcccgaccgccaggctgtgtgtctgatggccgaggccagggtggctcagccaagcccagccarcccaagactagaccatccccagcgtccaccccagcctcctgggcacaggggtcacctcccacccctggcccacccatacagccttttcccatctaacctt

SEQ ID NO: 43564 - DNA, 201 bp, Homo sapiens
tgcacatgcatatgtgtgcacacatatgcacataccttcaccttcctatccctccccaggggaaggccttccttggggctgcccctcctccactctggcarcattgggacttgaatcttgtggccccgtcacaactgtactcagctactccagctccttgtgtgacctctcagcccccaggctctgagctacctgaggtga

SEQ ID NO: 43565 - DNA, 201 bp, Homo sapiens
  misc_feature (1)...(201): n = A,T,C or G, or insertion/deletion polymorphism (see Tables 1-2)
gcacacacctgagtcgctcttcctcccatagacacatttggagttcccactgccttcctaggccccaccacatgctgtcacctccaggaagccttcacagnttgctccctgctgatagccttgacctgcttcccggggcatttgcaagggagtagaacgaagaccaagtccgtgcaggggctgctggctctgtgctcagca

SEQ ID NO: 43566 - DNA, 201 bp, Homo sapiens
tgccagcccccgcccctgtagtcatttctaaatcgggtctagatggactggacgcgtggctgccagagaccatttgaaccccctacctccaaattccccarggtccccgcctgcaaaggaccagccccagcatgaggccctgaaagtggcaacatttcaatagcctatcctggacaatcaggacgatccctttactaattt

SEQ ID NO: 43567 - DNA, 201 bp, Homo sapiens
  misc_feature (1)...(201): n = A,T,C or G, or insertion/deletion polymorphism (see Tables 1-2)
caagggtgctgcctccccagctcctacctggggagatgctgacatctggtcattcgcagagtgccctgtgcccacatgctgtccctgtccagacatgaaanggacagcaggagggggctttgaggggtctctcctgagacacctctccagctgaggctcctggagttggaagcccctgcagactcggtggctgcctcacca

SEQ ID NO: 43568 - DNA, 201 bp, Homo sapiens
ttccccaaggtccccgcctgcaaaggaccagccccagcatgaggccctgaaagtggcaacatttcaatagcctatcctggacaatcaggacgatccctttrctaatttatatgctatacgtttggggtttaattggagcgtaattgtaatccatatgctgttaaggtaattacacttataaacctaatataatccatagat

SEQ ID NO: 43569 - DNA, 201 bp, Homo sapiens
gttctggagctgggaattccaatatcaaggcactggtaggttggtgtctggtgagtgctactctgtgctttcaagatggtgcctcttggtttgtcctcacrtggcgaaggagggaaaggagaaacagggacgaacagtgttcatagcagctcttttatttataaattgctaatcctgttcatgagagcagagccctcatga

SEQ ID NO: 43570 - DNA, 201 bp, Homo sapiens
  misc_feature (1)...(201): n = A,T,C or G, or insertion/deletion polymorphism (see Tables 1-2)
agacagcccctttgaccctcagtggggaggttttcttggaatgaagcagaaggaacaatattactggtgcctcctgaatatttaaaaagaagagacattancaattccagacacttctccattggtccactgcaccttcttccttcctctgcacttgatatttttagttttacaaactgctaggcagaggcaagcatggtt

SEQ ID NO: 43571 - DNA, 201 bp, Homo sapiens
ttcttggttcagaacaatgacaactctgggacaagcatgccgctgggagaaagagaccaggagctgcacagccagacagatgcttttgcagtgggatggcrgtggggggttggaatggttcatcatttactttttatatttaacacttttttttttaagagatggaatgctctgtcacccaggctggagtgcagtggtatg

SEQ ID NO: 43572 - DNA, 201 bp, Homo sapiens
ggtcattcgcagagtgccctgtgcccacatgctgtccctgtccagacatgaaacggacagcaggagggggctttgaggggtctctcctgagacacctctcsagctgaggctcctggagttggaagcccctgcagactcggtggctgcctcaccaaaggctccatctgcatttgcccccatgaccttcccactgtgcctggg

SEQ ID NO: 43573 - DNA, 201 bp, Homo sapiens
ctgcttttagcacccagggactctgatcagggacccagctgatgagtggcagcaccatgggaagccaggtccctgtgacttggccatccccagaacacggctgattttctggctcaatagactcagcctgacaaaggggaacttggagaaagagaacaagaaatccatatgctgagctgggacagaacccaagtggggttc

SEQ ID NO: 43574 - DNA, 201 bp, Homo sapiens
  misc_feature (1)...(201): n = A,T,C or G, or insertion/deletion polymorphism (see Tables 1-2)
ggctctggtgggcacggggcttgcacagatcggactgtgaccccaggctgtgggactcagccaccaagcgccttcacttatttactgaccttgaagttatncagcacttatgtgtttacagatacctgcacaacagccagagaggtacgaatacatctccacctacaggtgagggcacagagaggttaggacccacctgag

SEQ ID NO: 43575 - DNA, 201 bp, Homo sapiens
ctctaaaccacaggtcccatctccaaaccacaggtcccatctgtaaatggaaacatgaacccacctctcagactgtcaagaggattcgatgtgaacatgcsgttggggctcggtggaggaggagccagtcaccgggcgctgctgtagccactgctggggctcagttcaccctgggctccctgctggtgtaaactttcccct

SEQ ID NO: 43576 - DNA, 201 bp, Homo sapiens
aaaggattctcatcccagttctgtccctagacaagtcactgaacccctccaaaccacaggtcccatctccaaacagcaggtcccatctctaaaccacaggwcccatctccaaaccacaggtcccatctgtaaatggaaacatgaacccacctctcagactgtcaagaggattcgatgtgaacatgccgttggggctcggtg

SEQ ID NO: 43577 - DNA, 201 bp, Homo sapiens
cactgattgccaacagcagctttatgcggctggcattttagtctcactttagggtgaggaaactgaggctcagagaggctgaatcactggtttgagtacgwccagcgagagggcagctgggccaggatttgaagccagccattctcaacaccactgtgctctctgcctcccgagtggaggccctgacccctttgctctctt

SEQ ID NO: 43578 - DNA, 201 bp, Homo sapiens
cagtgccagcatgtctgtcccaactgtccctatggcccctatggaagattagctatgtggtggcaaagtgtcccgaggaaggggcattctgggatgttcasgtgctcgactgggctgggacttgtactttggaaatgagaagaagcccaggctcaaatctttgccccactgcttgctggcaggaagaccactgagcctcag

SEQ ID NO: 43579 - DNA, 201 bp, Homo sapiens
tctccacctacaggtgagggcacagagaggttaggacccacctgaggggatgcagccagcaggtgggacttgggccctggcagtctgtttccagcctgtgygctcaggtccagggtctccctgggactggagagggcgctgggggaatggagccgcctcctgcatcagagcttctcctgctccagttcagcctgcagctct

SEQ ID NO: 43580 - DNA, 201 bp, Homo sapiens
cctgaagggtcccacgctgcagagggccccagcccagggccagaccccaagtgtgtgcctggagtgactcaggggtgcgcgaggaggactcagtgggatayggaatgcaggggctgaggcatagggagtgacacaggggctcagggctttcccatgagtcgaggctcattgggttggcagggaccacatctgccctggtcg

SEQ ID NO: 43581 - DNA, 201 bp, Homo sapiens
  misc_feature (1)...(201): n = A,T,C or G, or insertion/deletion polymorphism (see Tables 1-2)
attgtgctggggcctccagtgctacccccaggctgaatgattcattagcaggactcacagaacttagaaaaggtattacactcccagttagacttattacngtgaaagaataaagattaaattcagcgaagagaggagacacatggggcaaagtctaggagaagacaggcatgaacttccagttgtcccttcgaaatggag

SEQ ID NO: 43582 - DNA, 201 bp, Homo sapiens
cacagagaggttaggacccacctgaggggatgcagccagcaggtgggacttgggccctggcagtctgtttccagcctgtgtgctcaggtccagggtctccstgggactggagagggcgctgggggaatggagccgcctcctgcatcagagcttctcctgctccagttcagcctgcagctctcctgcatccccaggtgggga

SEQ ID NO: 43583 - DNA, 201 bp, Homo sapiens
cgcagcagggcaggtagcttgtcttttagtttgttttgttagtctcctgtatctgtgactctgcagagagccaacggcaggaagagggcagcaccggcacrtcggaggccgaggacggcttagacgggaggtccggaggctctcagcctgaccagccctggcctagggccggggaaaggcctgggctttggggtcaagggc

SEQ ID NO: 43584 - DNA, 201 bp, Homo sapiens
  misc_feature (1)...(201): n = A,T,C or G, or insertion/deletion polymorphism (see Tables 1-2)
ccgtcacggtcgttctccccggtccctgcctgcccatggctcttgccacagtggggatgcagcagctctgggttgagtgtctgtcgttgcccctgcactgngtgtgccctgtgagtgggggctgctgtgccacacctcactgccacccatgcccatctcagggtgtgggcccagcgggtcctcaggctgtacctgtcaggg

SEQ ID NO: 43585 - DNA, 201 bp, Homo sapiens
ttctgctcaaggagctgtattttccacatctgtttgtattttcatgaagccaacataaaaggattctcatcccagttctgtccctagacaagtcactgaayccctccaaaccacaggtcccatctccaaacagcaggtcccatctctaaaccacaggtcccatctccaaaccacaggtcccatctgtaaatggaaacatga

SEQ ID NO: 43586 - DNA, 201 bp, Homo sapiens
aacggatctgcccacctcagtctcccaaagtgttgggattacaagtatgaaccaccgtgcccggccatatgaagtcttgtagttgttgaactcggtgtacrtgctaaaccaaagcacacagttctgctcaaggagctgtattttccacatctgtttgtattttcatgaagccaacataaaaggattctcatcccagttctg

SEQ ID NO: 43587 - DNA, 201 bp, Homo sapiens
agcagtgaggccttacaagtagttctaggcctggaaaggaaagggaaagaaagagcaatggaatctggtattttctcaggtgtcctggactccatctgaamgatttcgccatgggaaacattccttcctgggtcctcggcgcctattgttacagcacgcaggcacccgggctgtggcctaggggtgaaacctctctcgatt

SEQ ID NO: 43588 - DNA, 201 bp, Homo sapiens
caggtcagcatgagttcccatgaggccagggccagcacgaggacctgctgggagcggtccatccacccatccgtccgtccatccatccatccatccatccatccctatccacctgtccaccctgatgcagttcctgccatccacgtgtccatctgtctacccgtacacctgttcatccccatccatccatccccctgtcca

SEQ ID NO: 43589 - DNA, 201 bp, Homo sapiens
catttggagttcccactgccttcctaggccccaccacatgctgtcacctccaggaagccttcacaggttgctccctgctgatagccttgacctgcttcccrgggcatttgcaagggagtagaacgaagaccaagtccgtgcaggggctgctggctctgtgctcagcacacgccccgtgaccacctcaggggcggctctgcg

SEQ ID NO: 43590 - DNA, 201 bp, Homo sapiens
tgatagccttgacctgcttcccggggcatttgcaagggagtagaacgaagaccaagtccgtgcaggggctgctggctctgtgctcagcacacgccccgtgrccacctcaggggcggctctgcgagtccccacttgacaggtgagccacagggccacaggcatggcttggggtcctctgcggagcccgatgtgtcactggcc

SEQ ID NO: 43591 - DNA, 201 bp, Homo sapiens
cctgagtgctgctttagctttggccccacccatcttaggctgctcagaggcctcaggcctccctggagggccagaagggattcccaggggcaggatagcayggacggggggtccgctgtgtaagcctgggaaattctggctgcttgaagctggcacactcccctgaggctgttccaggcacagtcactgggtctccccgtc

SEQ ID NO: 43592 - DNA, 201 bp, Homo sapiens
ctgctttagctttggccccacccatcttaggctgctcagaggcctcaggcctccctggagggccagaagggattcccaggggcaggatagcacggacgggkggtccgctgtgtaagcctgggaaattctggctgcttgaagctggcacactcccctgaggctgttccaggcacagtcactgggtctccccgtcgaagtggc

SEQ ID NO: 43593 - DNA, 201 bp, Homo sapiens
actcccctgaggctgttccaggcacagtcactgggtctccccgtcgaagtggctctaaggcaggtcttcccggttaccagcaagcagatacatgttgtaaygggctgagagtgggtgtgtatctcatattccccagaggagcttacggacagcccctctttaaggaacatctcccgggccgagcgttctgagcgccctctg

SEQ ID NO: 43594 - DNA, 201 bp, Homo sapiens
  misc_feature (1)...(201): n = A,T,C or G, or insertion/deletion polymorphism (see Tables 1-2)
gaactgtgctgtagcatttcaatgtatggctgtcccacaatttatattccagtcccctgatgatggacatgtaggcggtttccagtttttttcatgatcanagatcacacttctgtgaacagctctggatgtgtctccttgtgcaaatatggtgctaggtgttcttcagagcatttttctccaaacttgccgggtaatatg

SEQ ID NO: 43595 - DNA, 201 bp, Homo sapiens
  misc_feature (1)...(201): n = A,T,C or G, or insertion/deletion polymorphism (see Tables 1-2)
tgaacagctctggatgtgtctccttgtgcaaatatggtgctaggtgttcttcagagcatttttctccaaacttgccgggtaatatggtcaccttggggagnttgttaaatatacatatttccaggtctgctctggtgggtctgatatttggagccaggaatcttttctttcttttaacagatacttaagtgattcctgtgg

SEQ ID NO: 43596 - DNA, 201 bp, Homo sapiens
  misc_feature (1)...(201): n = A,T,C or G, or insertion/deletion polymorphism (see Tables 1-2)
aaatatggtgctaggtgttcttcagagcatttttctccaaacttgccgggtaatatggtcaccttggggagtttgttaaatatacatatttccaggtctgntctggtgggtctgatatttggagccaggaatcttttctttcttttaacagatacttaagtgattcctgtggtccaggaagttttgcaagctctgatgcag

SEQ ID NO: 43597 - DNA, 201 bp, Homo sapiens
gtctgatatttggagccaggaatcttttctttcttttaacagatacttaagtgattcctgtggtccaggaagttttgcaagctctgatgcagaagagctcrctggagcaaacatgtatgttctgttttactaattagatatacgctgttgatgactccaaagtggacgtgccatttctgtcccctccagcagtaggaaaga

SEQ ID NO: 43598 - DNA, 201 bp, Homo sapiens
gtctaagcatatatgaaacacaaattttatgtttagatttgggtcccatccccaagatatctcatgtatatgcaaatattccagaatcaaaaaatatatakagagagaaatttgaaacacttttggtcccatgcattttggataagggattctttacttgtattttgtagtgttcacaatataaactataatataatacaa

SEQ ID NO: 43599 - DNA, 201 bp, Homo sapiens
gctttaaggtactttgtctatcttgactgttaggctctttatttttcaaaaaaaaattcaatataatagtttgcattttttcttattgataataaaaccaytgacattattgagctcttgttctgggctcagctctgccccgagctgtttgtacatgttaccttgctgaacctgcacccaagtcctcaggccatattcccc

SEQ ID NO: 43600 - DNA, 201 bp, Homo sapiens
  misc_feature (1)...(201): n = A,T,C or G, or insertion/deletion polymorphism (see Tables 1-2)
ggctctttatttttcaaaaaaaaattcaatataatagtttgcattttttcttattgataataaaaccactgacattattgagctcttgttctgggctcagntctgccccgagctgtttgtacatgttaccttgctgaacctgcacccaagtcctcaggccatattcccccttacagatgaatgaagtcactggcccgaggt

SEQ ID NO: 43601 - DNA, 201 bp, Homo sapiens
tactaaaatacaaaaaattagccaggcatggtggctggcgcctgtagtcccagctactcgggaggctgaggcaggagaattgcttgaacccaggagatggrggttgcagtgagctgagatcgcgccatcacactccagtctgggcgacagaacgagactctatctctaaaaaaaaaaaagaaaaagaaaaaaaagaaaaca

SEQ ID NO: 43602 - DNA, 201 bp, Homo sapiens
gaggtgaggctggtgaggcccagagtgtacctgttggggatgctgcaacacttggaaatccggctgcccgaggctggaagccgtcttgctgcgtatgtcargtaggataatgagtggactcttttctcagtcctggaggacttcctcggccagtctggagtaagccatggctggggagatcagttcttggaagtgctgggt

SEQ ID NO: 43603 - DNA, 201 bp, Homo sapiens
atagatttgggtcccaggttccccaccaggggcctggctggcttccccaggtccacacccttccagcgaagtcacatcacaagttgtgtggaaatggaggrcaccaccctggccacagaggtgaggctggtgaggcccagagtgtacctgttggggatgctgcaacacttggaaatccggctgcccgaggctggaagccgt

SEQ ID NO: 43604 - DNA, 201 bp, Homo sapiens
cggtggagatgctgtgggtgggtgggcaggtgtgccttgtgctgtggcctcccgagacaaggagggctcccacctaagcagggtcctgcagcccaggcacytagccctgccctggccctccaggtccacacggctgtgggttcccaccagggggcggcagggacttgcggccggggacccagcctggtttctcccgctttg

SEQ ID NO: 43605 - DNA, 201 bp, Homo sapiens
  misc_feature (1)...(201): n = A,T,C or G, or insertion/deletion polymorphism (see Tables 1-2)
tgggccctagctggttgaccccagtgcccactatttatttggtgcttacatgcactggctcattttgtctctacagccttgcaaaggccacagttatgagntggcagaggtggtattcaaattcaggcccctaaacttgtgtctgtgttccctcttgaaaacttcagtaaactgaagaagtgaaaggcagagggtaaacca

SEQ ID NO: 43606 - DNA, 201 bp, Homo sapiens
  misc_feature (1)...(201): n = A,T,C or G, or insertion/deletion polymorphism (see Tables 1-2)
ctagtccacaggtgaggtcaggagcacaggctgttttgggacatctcttcccagtgcccagttccagaacacccttccaaaccaccgtgcattctccgggnccatcgttttaatggctgcaccctgctcccgcgtgtggacgcatcctaaacagtcccttagtattatggttagatgctccatgtgtttccaattcttcat

SEQ ID NO: 43607 - DNA, 201 bp, Homo sapiens
  misc_feature (1)...(201): n = A,T,C or G, or insertion/deletion polymorphism (see Tables 1-2)
gcccatggctcttgccacagtggggatgcagcagctctgggttgagtgtctgtcgttgcccctgcactgcgtgtgccctgtgagtgggggctgctgtgccncacctcactgccacccatgcccatctcagggtgtgggcccagcgggtcctcaggctgtacctgtcagggggctggatacctggacagggccttgtccgag

SEQ ID NO: 43608 - DNA, 201 bp, Homo sapiens
aggggcagacctaggcagaagccctgagtgggcatcctggtcagccctgtgggggttgggggccagtgggcaggggcactcaccatgctacccaacccccyatggcacccccaatgtggaacgcacgggctcaggactcacttttattttggtagagcttggagtccccatttccatgttttgtttttctttacagtccca

SEQ ID NO: 43609 - DNA, 201 bp, Homo sapiens
atctcttcccagtgcccagttccagaacacccttccaaaccaccgtgcattctccggggccatcgttttaatggctgcaccctgctcccgcgtgtggacgyatcctaaacagtcccttagtattatggttagatgctccatgtgtttccaattcttcattattgtaaacccaactgcattgctcatccttgtagcatagct

SEQ ID NO: 43610 - DNA, 201 bp, Homo sapiens
ccgttccagctcgggcagtacaagccttcatcctcccagactccacctccctggctgctccttcctgtatggcccccacaggggttggcagggcgcactcmccagagggacaggagtttgtggccaacctgagggtagacactgcctgtcctccagacccctagacacccccggtcggcccaggtgcggggtctgcccgca

SEQ ID NO: 43611 - DNA, 201 bp, Homo sapiens
ggaaaggcttgagaaccagtgatcttctgccctgttacagacgcggaagccggggtggagcaggcctgtaaggtgggggctggggccggcactgggtcccygggcttttccacccctgccgcgtgtgcgtgcagactggccctgcggtccatgggcttgggcctgccttttggcttgctcccgagtattttgcccagaggc

SEQ ID NO: 43612 - DNA, 201 bp, Homo sapiens
tctaagctacattctagagcagactttttgcccacacaagccttaaatgtgggctggggacagtggctcacgccggtaatcccagcactttgggaggacawggtgggcagatcacctgaggccaggggttcaagaccaggctggccaacatggtgaaaccctgtctctactaaaaataaaaaattagccaggtgtggtggt

SEQ ID NO: 43613 - DNA, 201 bp, Homo sapiens
tctcccatctgcactgtggataattctgcaactctcgacaccctcaccaacaaataacaccgaggactagcagtgtcatttttaaaacgcgcctccatcartgggaaaagaatgggatcttctttgattgataatgagactaaaggctttttctgtcttcctcagtcgctgatatttgtttcttctataaattgcatattc

SEQ ID NO: 43614 - DNA, 201 bp, Homo sapiens
agctctctgcaagccttgctggggtcctggagccgcacctgactagggctttcctgatattttggaattcttgtacttcatgcctcccaaggcttagtctktgacatctggtggcaggccccacggagggatgacaagggtttgcttccttagctgtcctagtcggcctgggctgccataacaagtgccattgactgggga

SEQ ID NO: 43615 - DNA, 201 bp, Homo sapiens
tagcagtgtcatttttaaaacgcgcctccatcaatgggaaaagaatgggatcttctttgattgataatgagactaaaggctttttctgtcttcctcagtcrctgatatttgtttcttctataaattgcatattcatatcctttctcagtcttttttgtatgttttttaaacgaaggctcttctttaatgggaaatctgcat

SEQ ID NO: 43616 - DNA, 201 bp, Homo sapiens
  misc_feature (1)...(201): n = A,T,C or G, or insertion/deletion polymorphism (see Tables 1-2)
tgactagggctttcctgatattttggaattcttgtacttcatgcctcccaaggcttagtctgtgacatctggtggcaggccccacggagggatgacaaggntttgcttccttagctgtcctagtcggcctgggctgccataacaagtgccattgactggggacttcaacagcagacgtttattttttcacagttctggagg

SEQ ID NO: 43617 - DNA, 201 bp, Homo sapiens
acttcaacagcagacgtttattttttcacagttctggaggctggaaggctgatatcagggggtcggcatggccagtttctggtgaggccccttttctgggyttgtaagcaggtgccggcttgctgtgtgctcacatggcctctttgtgcattcatgagggtgctctctggtgtctcttcctcctaggacactgatcctgtc

SEQ ID NO: 43618 - DNA, 201 bp, Homo sapiens
tggccatgttggccaggctggtctcgaactcctggcctcaagtgatccacccgcctcagcctcccaaagtgctgggattgcaagcataagccaccgcgccyggcctccactttctgtggtgtaaatattcctaccatggctgatttcctctggggaagccatgtcccctccacttctaccttcatggtctttgcttgttta

SEQ ID NO: 43619 - DNA, 201 bp, Homo sapiens
tcttctgccctgttacagacgcggaagccggggtggagcaggcctgtaaggtgggggctggggccggcactgggtccccgggcttttccacccctgccgcrtgtgcgtgcagactggccctgcggtccatgggcttgggcctgccttttggcttgctcccgagtattttgcccagaggccttgtggctttcagggatgctg

SEQ ID NO: 43620 - DNA, 201 bp, Homo sapiens
  misc_feature (1)...(201): n = A,T,C or G, or insertion/deletion polymorphism (see Tables 1-2)
tctggtgacggctcaaaggggggtgtggtccggggcgcagaaggacagaacccaatgggagcggacttaccccagcatttcacatccgatttttcaggganagatttcgtctctaaaactagcacttgatattataagagcatataggctgaatgaacttatattgctatttcagaggaggccagtggcttaagagtccca

SEQ ID NO: 43621 - DNA, 201 bp, Homo sapiens
tggcaccttcaatttttttcttttaaaaattaatgtatttttttttctgataatataagaaatgcatgccttctttggaaaatacagaaaatcacaaagamaataatccacaatcccaccttccaaaaggaaccacagttagcattttgttcagcctgttttttaaaaaacaaacaaacaaaaaatgcatactaaaagcaa

SEQ ID NO: 43622 - DNA, 201 bp, Homo sapiens
ggctggtctcgaactcctggcctcaagtgatccacccgcctcagcctcccaaagtgctgggattgcaagcataagccaccgcgcccggcctccactttctrtggtgtaaatattcctaccatggctgatttcctctggggaagccatgtcccctccacttctaccttcatggtctttgcttgtttattttcaaatgtggcc

SEQ ID NO: 43623 - DNA, 201 bp, Homo sapiens
  misc_feature (1)...(201): n = A,T,C or G, or insertion/deletion polymorphism (see Tables 1-2)
cagattttaagtaaagaatttgagaatcagagacattcacagcaacctggtgcacccggagcctggctgaccccagcaccgctgctggcggccccacctcnctcgcccagtctccctgcttccccagccaccgtccagctacctcgagagatcctgggagcatggtgattgtggggtgcatgggggcccgtgagctgttgg

SEQ ID NO: 43624 - DNA, 201 bp, Homo sapiens
gggacgagggtcatggcctttgagggcctgcagagggccttgcctgtggtggcgtggccaccctggtcctcagcagggtgctcagtggattccaaggtgcwccctggacccggacctccccttcacttccttttagctcaggtctcagctttccatgcctctgctgcctccctgaacccagcctgtcccccgccctgttca

SEQ ID NO: 43625 - DNA, 201 bp, Homo sapiens
  misc_feature (1)...(201): n = A,T,C or G, or insertion/deletion polymorphism (see Tables 1-2)
gggcaattaaccactaagtgtaattgataattcataaacctctgattaggaaagacaaataataagaaaggaatgaatcacccatcctattgaagaagacnttgccagcctctggtctgcattcactatgtggtcagcagatctacagatttcttcctaaattgcacctgtcagctccagggctgggggtctggaggctca

SEQ ID NO: 43626 - DNA, 201 bp, Homo sapiens
  misc_feature (1)...(201): n = A,T,C or G, or insertion/deletion polymorphism (see Tables 1-2)
acctggtgcacccggagcctggctgaccccagcaccgctgctggcggccccacctcgctcgcccagtctccctgcttccccagccaccgtccagctacctngagagatcctgggagcatggtgattgtggggtgcatgggggcccgtgagctgttgggggtgtcagggttctgcccgtgagatcctccttgttgccagaca

SEQ ID NO: 43627 - DNA, 201 bp, Homo sapiens
agcccaccaggtaggttggcgccttgtgaagtgggtcaggggaggcagccccgtcagggaggccgccccgtcagggaggccctggagcttggaatggattrcaggactcaggcagcctgtggggttggccaggcagccaagcgtgggctccctgtgaaagctgacctggctgggaaggagggggaagacagcaaacgaaat

SEQ ID NO: 43628 - DNA, 201 bp, Homo sapiens
  misc_feature (1)...(201): n = A,T,C or G, or insertion/deletion polymorphism (see Tables 1-2)
ggtattaagagaacggttacggagaactctagtactgaacccaagattactttgccaatgaggagtgaagccaggcaccaaaccatcgtcttccagccccntccagtgctctttgccatagcccaactctcagggaggaccagcggtgcagcagaatttcttagggaggtggggagggtagggaggatttcaggttggggg

SEQ ID NO: 43629 - DNA, 201 bp, Homo sapiens
tgcagaagagctcgctggagcaaacatgtatgttctgttttactaattagatatacgctgttgatgactccaaagtggacgtgccatttctgtcccctccagcagtaggaaagaatcccattatcccacatcctggccagttcttggtattgtgagatttttttaaacttcttctcttaagactatgatggtattttgttg

SEQ ID NO: 43630 - DNA, 201 bp, Homo sapiens
acggggtttcgccatgttggccaggctggttttgaactcctgatcttgggtcttgggatccacccgccttggcctcccaaagtgctgggattacagacgtragccaccatgcccggctattttcattacccccaaataaaccttgtaccctttagttacctcctcatctctgtaaccctaagcaaatactcatctgctttc

SEQ ID NO: 43631 - DNA, 201 bp, Homo sapiens
ggttttgccacattggccaggctggtttcgaactcctgacctcatgtgatctgcccaccttggactcccaaagtgctgggattacaggtgtgagccaccgygcccagcctgcatatcatttttaagatttttaaactatgtgaatgtgttttctattcaaaatattacaattcaaatattaaattgaatattaaaattcaa

SEQ ID NO: 43632 - DNA, 201 bp, Homo sapiens
tgtggccttttctgtcttcttttactctgcgtgttttcaaggttcatccatgttgtagcatgtatcaggacttcatttctttttatggctgaataatgctycactgtatggatagaccacagttatttattcattcctgtgttagtgtatatttgggttgtttctgcctttggctattgtgagtaatgctgctataaggat

SEQ ID NO: 43633 - DNA, 201 bp, Homo sapiens
ttcttttactctgcgtgttttcaaggttcatccatgttgtagcatgtatcaggacttcatttctttttatggctgaataatgctccactgtatggatagamcacagttatttattcattcctgtgttagtgtatatttgggttgtttctgcctttggctattgtgagtaatgctgctataaggattcatgggcaagttttt

SEQ ID NO: 43634 - DNA, 201 bp, Homo sapiens
  misc_feature (1)...(201): n = A,T,C or G, or insertion/deletion polymorphism (see Tables 1-2)
gatagaccacagttatttattcattcctgtgttagtgtatatttgggttgtttctgcctttggctattgtgagtaatgctgctataaggattcatgggcangtttttgtgtggacataggtcttcatttctcttgaatatatgcctaaggagtggaattgctgggtcacgtggtatctatttttaatcacttgaggaattg

SEQ ID NO: 43635 - DNA, 201 bp, Homo sapiens
ctcccgagtagctgagattacaggcacctgccaccatgcctggctaatttttgtatttttagtagagatggggttttgccacattggccaggctggtttcraactcctgacctcatgtgatctgcccaccttggactcccaaagtgctgggattacaggtgtgagccaccgtgcccagcctgcatatcatttttaagattt

SEQ ID NO: 43636 - DNA, 201 bp, Homo sapiens
cagttatttattcattcctgtgttagtgtatatttgggttgtttctgcctttggctattgtgagtaatgctgctataaggattcatgggcaagtttttgtrtggacataggtcttcatttctcttgaatatatgcctaaggagtggaattgctgggtcacgtggtatctatttttaatcacttgaggaattgccagactat

SEQ ID NO: 43637 - DNA, 201 bp, Homo sapiens
gaagaggagggttggtcttgctgtctcaaggtggcagaggtagaagaaaaactgcatataagtgggcccatgcagttcaaacccagttgttaagggtcaastgtattttctcatattttgtgggttgtcttttcattttcttgatgttgttttttaaagcataaaagtttttaaagttttgatgaagtccatttgatcttt

SEQ ID NO: 43638 - DNA, 201 bp, Homo sapiens
gaagcctcaggaagcttccaatcacagtggaaggcaaagcaggagtaggcatctcacatggcgagaatgggagcaagagtggtaggggtgccgtatacttytaaatgaccagatctcatgagaacttactcactatcgcaaatatggcaccaagccctgagagatctgccccatgacccaaacacctcccaccatgcccca

SEQ ID NO: 43639 - DNA, 201 bp, Homo sapiens
tgaacacatgagcccgtggacatctagtgagcttagggcatggcaggggtggggtgcgttgcctgcagcctggggcggcctcggctccttcatgtcagcgygtcctgacaccgtgacactgcgcatggtcacatggagcctgtcctcttgtatctgcttcatctctggctttcctgtccatctgcctggtgctttggaggg

SEQ ID NO: 43640 - DNA, 201 bp, Homo sapiens
ctggctttcctgtccatctgcctggtgctttggagggtgtaccaggctgtgagggagaagcagccacgtggctccgttttcttgtgctgcagctgggccarcagatctaggggaaaggccacttcctagtggcctttctggtgggagggagtcatagtgatgagtctggaagctgagccctggcttgggagcagctggaaa

SEQ ID NO: 43641 - DNA, 201 bp, Homo sapiens
ctaggagccatccgagcaggcccctgcggccatatgcattcccatgcgtagcgaaaccaggccctcttgccaagcactctttgggaggatatttggaaaaratgtcaaggcattcatttttctctcgaccttttctgttggaatcgtggggccttaacactggaagtaaaaggagttataagacacagctggcttcctgca

SEQ ID NO: 43642 - DNA, 201 bp, Homo sapiens
ggccgcgccccagttccgggtttgcacccggtcttcttgccctgccccgctcgcgggactacagttcccaggcgcccctgcgcggccgcggcgccggcgcmggcgtcggttgggacgcggagctgaggagcagggccgggcgccatggcaccgtggggcaagcggctggctggcgtgcgcggggtgctgcttgacatctcg

SEQ ID NO: 43643 - DNA, 201 bp, Homo sapiens
tgtggaaatggaggccaccaccctggccacagaggtgaggctggtgaggcccagagtgtacctgttggggatgctgcaacacttggaaatccggctgcccraggctggaagccgtcttgctgcgtatgtcatgtaggataatgagtggactcttttctcagtcctggaggacttcctcggccagtctggagtaagccatgg

SEQ ID NO: 43644 - DNA, 201 bp, Homo sapiens
cccagcagagctggagggggtaggggcagcctccccaggactgatctgacagacgggtatgtgcctcacccggcatcacccaccggggaggcctccgtccrcccccatgcagtcatgctgggtccccccatctcgtgtcttctggggaatggagcggaagacctcccctctctggaaccaggggtgggagggactgtgctc

SEQ ID NO: 43645 - DNA, 201 bp, Homo sapiens
  misc_feature (1)...(201): n = A,T,C or G, or insertion/deletion polymorphism (see Tables 1-2)
gtcagtacagcagaattagccatgactcagagtgggtctccgtggtgattctgcctctagagaacatgccgtgctcccgacgtcaggctcacaggtgagcnggggcactagccggggacgaggggctggagcctggccggcccaactacagaggggcctggggtttggctcctgccggaggagcccctctagggctctccg

SEQ ID NO: 43646 - DNA, 201 bp, Homo sapiens
atctcagacgtggagctgaagaagccagcaagagcctctgcagaagcctgctctccctggctgaaggaccaagccaggggcacctggcgagacagaaaacrtttaggcaataactgtggtactccagccaaacaccacagaaaaccctgtggccccctcagctactcgtgccagcaagggctcagcagggagcctggacca

SEQ ID NO: 43647 - DNA, 201 bp, Homo sapiens
caaagtgctgggattgcaagcataagccaccgcgcccggcctccactttctgtggtgtaaatattcctaccatggctgatttcctctggggaagccatgtyccctccacttctaccttcatggtctttgcttgtttattttcaaatgtggcccaaatccaccctgaggcaggcgcagtggctcacgtctgtaatcccagca

SEQ ID NO: 43648 - DNA, 201 bp, Homo sapiens
acagaaaacatttaggcaataactgtggtactccagccaaacaccacagaaaaccctgtggccccctcagctactcgtgccagcaagggctcagcagggakcctggaccaaaacactgaccaggctgaaatgagcccctaccactgggggtgtcagagaaggccaaggagggagccaggagcagggtgggaatgaggtccc

SEQ ID NO: 43649 - DNA, 201 bp, Homo sapiens
ttccttggttatctgaaggcctgtttgggagacggttcccaggacagttgcttcaggcttatatgtgtgtgctttctggaattcacagcatggcgtgcccyggtgagtggtggggagatgggtagtgaacacgtgtggtagcccctgctgggcgtgtcccacctgtcctccatgtcctacaacctggttggccccttttgc

SEQ ID NO: 43650 - DNA, 201 bp, Homo sapiens
gtgaggttcttgtctggccgcccggctcatagcaatgtttaatagatagtaactggtgttatgactgaagacgtcctttgtgggctattggagttcttaayatccccgagtaaccacagggcaacgctctggcttgacaaggggcggcactgctggtcagcagcccagccagccgcagcggccacttgtgttcccagctgt

SEQ ID NO: 43651 - DNA, 201 bp, Homo sapiens
accacatggtaagcctgtgcttcccctagtcagtggtgacaagacatcccttcccctcccactggacgggcagcatcatactgaagagtcaggacttcatygccactcagaggttacaaggctatccgccccccccacaacagtgacaatggagcccgcatgggacacagtaatgagggattcctgcacctcccaaccagg

SEQ ID NO: 43652 - DNA, 201 bp, Homo sapiens
cctgtccactgctcagcactaggcctgcagcagacaccatgagccccaaacttcccaaagcccttccccagtcccacaagatggtgtctgcggaccgtgcwcgtgagagatggcagccaggcagtccccacagggcacccattttcagctgcccccgcttctcagacaaggaaactgaggccagaaagccaggtggcccag

SEQ ID NO: 43653 - DNA, 201 bp, Homo sapiens
ggttatctgaaggcctgtttgggagacggttcccaggacagttgcttcaggcttatatgtgtgtgctttctggaattcacagcatggcgtgccctggtgartggtggggagatgggtagtgaacacgtgtggtagcccctgctgggcgtgtcccacctgtcctccatgtcctacaacctggttggccccttttgcttgtca

SEQ ID NO: 43654 - DNA, 201 bp, Homo sapiens
ctgtccactgctcagcactaggcctgcagcagacaccatgagccccaaacttcccaaagcccttccccagtcccacaagatggtgtctgcggaccgtgctsgtgagagatggcagccaggcagtccccacagggcacccattttcagctgcccccgcttctcagacaaggaaactgaggccagaaagccaggtggcccagg

SEQ ID NO: 43655 - DNA, 201 bp, Homo sapiens
  misc_feature (1)...(201): n = A,T,C or G, or insertion/deletion polymorphism (see Tables 1-2)
gcggaagacctcccctctctggaaccaggggtgggagggactgtgctccccagaatgaatattccttggctgtgggtgagcctgccagcccagagtccccnggggtcaggagcagactggcaggggccatggcaacgactgggacacctggggagccaggtgtccaggcaggctccagtgtccactcccaacaagtatggg

SEQ ID NO: 43656 - DNA, 201 bp, Homo sapiens
gaagagacggaggatgaaattgtgttgccagatagtccatttgttgttctgagactcgcatgcctgggagaatcctgggaattaactagctccttctctcycatcccattttacagaaaagtgagacccaaggtggtttctgacttgcccagaggtcataactgcttggacagtcatggtcctcagagcccacgtttgctg

SEQ ID NO: 43657 - DNA, 201 bp, Homo sapiens
atattaaaaaaaaaaaaagagcatgagtccatttaagcaataacacatgttaatgtggcaaaaggagacccacaaatgactgacgtttcagccacactggygaggactgtatgactccctccactctatgtaggtgaccaatgggaagtcttgtttgcgcctcataagtgtgtccagacacagccagccgtgccgtaatgc

SEQ ID NO: 43658 - DNA, 201 bp, Homo sapiens
ctcccctctctggaaccaggggtgggagggactgtgctccccagaatgaatattccttggctgtgggtgagcctgccagcccagagtccccaggggtcagsagcagactggcaggggccatggcaacgactgggacacctggggagccaggtgtccaggcaggctccagtgtccactcccaacaagtatggggcattgaga

SEQ ID NO: 43659 - DNA, 201 bp, Homo sapiens
cttgtgagatccctccgcggtggcgtggagaggtgtggctacttcccgcttcgtggcaagtcgtgttctgccatttctccgaataccgatggaggcttacmgtgctggaccatggaatggggtctggaatgttctcatacaggtcctgtggtgcaatgggcgtgtgctggcactgggattctgtgtctaatgctcttcatc

SEQ ID NO: 43660 - DNA, 201 bp, Homo sapiens
gctatagaagtgagagcaggtgcctggggacacttggaggcccccctaggtttgtctgtaatgagcttgtgctggcgactggcatgttctgtcccccccayggctcccagcgtgctcccagcgccctcccacagctttaggcaattaagacacgggcttggagtggccattgcaggacctgctggtaatgggggtgagggg

SEQ ID NO: 43661 - DNA, 201 bp, Homo sapiens
aaaaaattaggcatggtggcgtgcacctgtagtctcagctactcaggaggctgaggtgggagaatcacttgagcccaggaggtcaaggcagcagtgaaccrtgatccactattgcattccagcctgggcaacagagcgagactctgtctcaaaaaaaaaaaaaaaaagaaaaagaacagcaatttatttcctcacggttct

SEQ ID NO: 43662 - DNA, 201 bp, Homo sapiens
gtctcagctactcaggaggctgaggtgggagaatcacttgagcccaggaggtcaaggcagcagtgaaccatgatccactattgcattccagcctgggcaayagagcgagactctgtctcaaaaaaaaaaaaaaaaagaaaaagaacagcaatttatttcctcacggttctggagctgggaattccaatatcaaggcactgg

SEQ ID NO: 43663 - DNA, 201 bp, Homo sapiens
tctcagctactcaggaggctgaggtgggagaatcacttgagcccaggaggtcaaggcagcagtgaaccatgatccactattgcattccagcctgggcaacrgagcgagactctgtctcaaaaaaaaaaaaaaaaagaaaaagaacagcaatttatttcctcacggttctggagctgggaattccaatatcaaggcactggt

SEQ ID NO: 43664 - DNA, 201 bp, Homo sapiens
  misc_feature (1)...(201): n = A,T,C or G, or insertion/deletion polymorphism (see Tables 1-2)
ctggagttgggagggggaaatagccctgccccaacatgtgatccagcatggactatggtcagttacaaatatgagtgagccaggcccctgccctgaagganctcccagatttgtggggaagacacaaactcagcacagaatggaaaggggcctggggacacagtgctgtgccgagcttggaatttgtttcatgaagggaca

SEQ ID NO: 43665 - DNA, 201 bp, Homo sapiens
agcaaaagatgcaaacaggtcatggaagaggaagtgagagaggctccgccttactcaaataagaggtgtgtgatctcggctcactgcagcctctgcctccygggttcaagccactcttgtgcctcagcctcctgagcagctgggactacaggcatatgccaccgtgcccagctaatttttggtatttttagtagaggcagg

SEQ ID NO: 43666 - DNA, 201 bp, Homo sapiens
ggtttcctgcctgcgatagtgacctcagggagctcctggggctgatgtggtattgggatggagggtcctgggtgtgtccacctttctcctcataagccctytctgaggagccgaattccctcctctgtcaaataggaataacccttctgtgtctacctcccatggcagctgtgatgatcagaaagaaatgcatctgagaaa

SEQ ID NO: 43667 - DNA, 201 bp, Homo sapiens
attctgctttttcttcaggacatatgtgtggggttgcctgaaatgtgtcaacggttcttacagtttgggaccagtagtgccaaccctccaaggcttgtgcrgccccatttcctcctgctgcaggctctcagtgtcttctgagcagatttcccttctcagtagcaaagctgtgggtttcctgcctgcgatagtgacctcagg

SEQ ID NO: 43668 - DNA, 201 bp, Homo sapiens
tttaaaggtaacaaacaaccccttctggctggtgtgggggaagccctaatttgtagtgcttgctacttttttttttttttttttttgagacagtgttttgytctcgtcacccaggctagagtgcaacggcacaatcttcactcattgtaaaacctccgtctcccgggttccagcgattctcctgcctcagcctcccgagta

SEQ ID NO: 43669 - DNA, 201 bp, Homo sapiens
gagcctcccaccccaggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctc

SEQ ID NO: 43670 - DNA, 201 bp, Homo sapiens
ctatcccaaaaggttatgtactttctgattccatgtatagaacatcctcaaaatgacaaaattctatcatgcaaaacagatactgttggatggggtggggyggggcaggagggcagtgggcgtggctataaagagcagcctgaggggtcctggtggtgatggaaagcttctttatttcactgtatcaatgtcaattgttga

SEQ ID NO: 43671 - DNA, 201 bp, Homo sapiens
gagggccaccatcagagtctcctgcagccctggattccctgggcctgaagcaggcagagcggccaaggtagcctcatcagcctcaccagcccgtccttcttgtctccctggcaccttgtcagagagaggcctaagaacacgctctgggcattgggggcctcccagtgttccctgcgagtttggagaggccaggtccctggg

SEQ ID NO: 43672 - DNA, 201 bp, Homo sapiens
gccctccccgctcccctctcagttcctcagcctggctatgggaggcccaagtcccacgtgtcactggaattcgggaggcctggctctcaaagctttctgtrcaaaacaaggagaaaaagagaagccacttttgctgtctggacatgctgtgggtgtcctggggaatgtgctggcccactgcttggggcctgacttggagtg

SEQ ID NO: 43673 - DNA, 201 bp, Homo sapiens
ttcagaacaatgacaactctgggacaagcatgccgctgggagaaagagaccaggagctgcacagccagacagatgcttttgcagtgggatggcggtggggrgttggaatggttcatcatttactttttatatttaacacttttttttttaagagatggaatgctctgtcacccaggctggagtgcagtggtatgatcgtgg

SEQ ID NO: 43674 - DNA, 201 bp, Homo sapiens
cgagggccaccatcagagtctcctgcagccctggattccctgggcctgaagcaggcagagcggccaaggtagcctcatcagcctcaccagcccgtccttcttgtctccctggcaccttgtcagagagaggcctaagaacacgctctgggcattgggggcctcccagtgttccctgcgagtttggagaggccaggtccctgg

SEQ ID NO: 43675 - DNA, 201 bp, Homo sapiens
  misc_feature (1)...(201): n = A,T,C or G, or insertion/deletion polymorphism (see Tables 1-2)
gcttggggcctgacttggagtgcccaggagctgcgtctgcactgtggcttgaaccgagtgtcgtgctctgtggacagagccatccactctgggggtgctcntcccatggcactgtcagcccccattctggaaggtcccaactgggtcccccaggcctgtgtcccagagaccttccaggtcttcattcactgatcatgcatt

SEQ ID NO: 43676 - DNA, 201 bp, Homo sapiens
ctccagtgtccactcccaacaagtatggggcattgagatcctgggtggatcacaggggagcaggcgtgctcaagctgacacagcccaagctgtctttattcaccaccagacccgaatccacctctgggccaacagtctcaccctgcaggaggcctggcacctgtgtttgtattttatcaccatgaggttgtgtgggctgct

SEQ ID NO: 43677 - DNA, 201 bp, Homo sapiens
acgcgcccctggctgcctctctcagcctcggccccctccactcatgagtgggaataaataagagagtagaaaacgtaagtgaggttcttgtctggccgccyggctcatagcaatgtttaatagatagtaactggtgttatgactgaagacgtcctttgtgggctattggagttcttaatatccccgagtaaccacagggca

SEQ ID NO: 43678 - DNA, 201 bp, Homo sapiens
ccgagggccaccatcagagtctcctgcagccctggattccctgggcctgaagcaggcagagcggccaaggtagcctcatcagcctcaccagcccgtccttcttgtctccctggcaccttgtcagagagaggcctaagaacacgctctgggcattgggggcctcccagtgttccctgcgagtttggagaggccaggtccctg

SEQ ID NO: 43679 - DNA, 201 bp, Homo sapiens
agagggggcagctggtgggtaagcagaggccagctccaaggcccccctgtgggccacattagggagacagggtctggccttgttggtagcgcggcccctcscagtgatgggtcccctgtcagacctccaggatcctgggttgctggtttggcgcagccccggcttctgtgagcttttgtttctgttactggcacctgcagc

SEQ ID NO: 43680 - DNA, 201 bp, Homo sapiens
ctgtggccggctgagtggccgggcctcggtgttctcgtctctgaagtggggagaaggctgcccccgtcacgggacctcacagtgttagatgagattgcagmtgcgatgaggtgggggcccagcaggcctgctcagggcgtggctgtccctcctggtgcagacaccatcacgtggaaggcgatcacatcgagtgttctggcc

SEQ ID NO: 43681 - DNA, 201 bp, Homo sapiens
gtagaaaacgtaagtgaggttcttgtctggccgcccggctcatagcaatgtttaatagatagtaactggtgttatgactgaagacgtcctttgtgggctaytggagttcttaatatccccgagtaaccacagggcaacgctctggcttgacaaggggcggcactgctggtcagcagcccagccagccgcagcggccacttg

SEQ ID NO: 43682 - DNA, 201 bp, Homo sapiens
gtgcgcacgccaggccccacaggttctcaggcccaggccacacatccacaggtgcccactctcatgctggcctcatagtgcatgcacacacacacacacamatatacatacactcacgcccagacccccccacgccccaggccacacatgtgggcctgctcacaccccactcattccctcccagatgccgcgccaccccca

SEQ ID NO: 43683 - DNA, 201 bp, Homo sapiens
atgtgggtgctttgagctgagtgaaggaggaacttctctaggagagagctctgcctgccacctccctggtgcccccgcccccagagcagagctgtccttayagggccacagcctctgctggccccgaagcccctttgcagtgaaggggggctcctgtgtgcggctccctccagatggacaaaaaccaggtttggatgccgg

SEQ ID NO: 43684 - DNA, 201 bp, Homo sapiens
tgcagagatggcctcatttcatcccacactcacatgcgggtcctagacaccagctcatgcacatacacacacacacacacgcacacacacacacacacacmtgcgcacatgcacccacgcactctctttgcctgtgggagggcaggatcccagctgccccagcggggaaggggtgtggggaatcagccctgcagatgcggt

SEQ ID NO: 43685 - DNA, 201 bp, Homo sapiens
  misc_feature (1)...(201): n = A,T,C or G, or insertion/deletion polymorphism (see Tables 1-2)
tcgtgctggatggagctggactctagggaggaccaggagggtgagctcaggccagggcgccaaggccctgagccccaggggcctgcctgtctgcccatcantcctccactcatggggagggactgccccccagcccagatttctaggagggccgaggctcacaggaagccaatgccaggcgataacccacagtccccagtg

SEQ ID NO: 43686 - DNA, 201 bp, Homo sapiens
gtctctgtgggagcctgggttcctttggggcctggattcagggctcatcctagagtgagctgtcatctcagggcatctccctgggggatatgtgcaccccrgagctgcagttacagacactgagctcactccaccttcaccacccagccctgctgcttcccgccctaatcctcctggcagagcccctggataaggaaaata

SEQ ID NO: 43687 - DNA, 201 bp, Homo sapiens
catcccctctccctggagccatgcagagatggcctcatttcatcccacactcacatgcgggtcctagacaccagctcatgcacatacacacacacacacacgcacacacacacacacacacatgcgcacatgcacccacgcactctctttgcctgtgggagggcaggatcccagctgccccagcggggaaggggtgtgggg

SEQ ID NO: 43688 - DNA, 201 bp, Homo sapiens
gcatcccctctccctggagccatgcagagatggcctcatttcatcccacactcacatgcgggtcctagacaccagctcatgcacatacacacacacacacacgcacacacacacacacacacatgcgcacatgcacccacgcactctctttgcctgtgggagggcaggatcccagctgccccagcggggaaggggtgtggg

SEQ ID NO: 43689 - DNA, 201 bp, Homo sapiens
  misc_feature (1)...(201): n = A,T,C or G, or insertion/deletion polymorphism (see Tables 1-2)
gccatgaggccactaacggaatgtccctgatctcagggatctcagtgtggaggtggcagcacacaggtaaccaaacaattgtggcagattgatgggtgctntgatggggtccacacagttaccgtggagtgcagagtgggcacctaactgaggaggcaagggttggagggaggaaggtttcagggaagacttcctggagga

SEQ ID NO: 43690 - DNA, 201 bp, Homo sapiens
gatagtaactggtgttatgactgaagacgtcctttgtgggctattggagttcttaatatccccgagtaaccacagggcaacgctctggcttgacaaggggyggcactgctggtcagcagcccagccagccgcagcggccacttgtgttcccagctgtggcttgtgatctatggtcgactgagctgttactctcctcggtta

SEQ ID NO: 43691 - DNA, 201 bp, Homo sapiens
ctgcactctgtcccagcatcccctctccctggagccatgcagagatggcctcatttcatcccacactcacatgcgggtcctagacaccagctcatgcacayacacacacacacacacgcacacacacacacacacacatgcgcacatgcacccacgcactctctttgcctgtgggagggcaggatcccagctgccccagcg

SEQ ID NO: 43692 - DNA, 201 bp, Homo sapiens
  misc_feature (1)...(201): n = A,T,C or G, or insertion/deletion polymorphism (see Tables 1-2)
tgccgcgtcacacgctgcagcgcagtgctgcccatggtttgtcggcccatattgtgggatctttcagattttctcaagaagccaggtttccagctcctagntttgaaaagttctatgtgcgcttgaccggggggccttacgtacgtgaattgggtgagggcctgagacaggcgggtgagcacttgccccacactccagcca

SEQ ID NO: 43693 - DNA, 201 bp, Homo sapiens
tgggtgctttgagctgagtgaaggaggaacttctctaggagagagctctgcctgccacctccctggtgcccccgcccccagagcagagctgtccttacagrgccacagcctctgctggccccgaagcccctttgcagtgaaggggggctcctgtgtgcggctccctccagatggacaaaaaccaggtttggatgccggggc

SEQ ID NO: 43694 - DNA, 201 bp, Homo sapiens
tttcactgtgttagccaggatggtctcaatctcctgacctcgtgatctgcccacctcggcctcccaaagtgctgggattacaggtgttgggggattcttarggaaaaccacctgaaagtgcggggttattaaaaacagaaaccaacccatgcacccaccactcacgagcagcccacacagctcccacctgaccagggctcc

SEQ ID NO: 43695 - DNA, 201 bp, Homo sapiens
tcaatacaaacaaaccacaggcataatttgggtctgtaaaggccgacgctgtcattctgctgcaagagggagggaagttcagttggggggaaaatgcagcrcttttgctgtcattaagtccaatggtggctggcgacagtcacggcgctggtggagctcagagcagaggtgggaggggtggtattgaccaggcgtgtgtgt

SEQ ID NO: 43696 - DNA, 201 bp, Homo sapiens
ggacggacccgcctttcccgcatctctgggggtgaggtcggctctcgttcaggcctgcagggtccctggtgccgcagcccctctggttggaaggccccctrcgtgcagccccgtcctccagccccgctcggctctgaatgagttcattatgtctcagcgcgccctggccgccaggctggcagttcttcgggctggcggggc

SEQ ID NO: 43697 - DNA, 201 bp, Homo sapiens
agggtccctggtgccgcagcccctctggttggaaggccccctgcgtgcagccccgtcctccagccccgctcggctctgaatgagttcattatgtctcagckcgccctggccgccaggctggcagttcttcgggctggcggggctcgggagctgtcagcctgccaaatccagttgtttgacttcatgtttcaaggccaaatc

SEQ ID NO: 43698 - DNA, 201 bp, Homo sapiens
aaggccaaatcctttcaggaaagttctctccatcccaccactccaccgccccccgcccttagaaaaataaatgcgtgattgactggctttgcaggtttttyatccatcgttctttccaaagaatagtgtgaacagctcattcgattcgttcatgtgacgtcctccctctcccaatccctgtctctctctctccttccacag

SEQ ID NO: 43699 - DNA, 201 bp, Homo sapiens
ccttagaaaaataaatgcgtgattgactggctttgcaggttttttatccatcgttctttccaaagaatagtgtgaacagctcattcgattcgttcatgtgrcgtcctccctctcccaatccctgtctctctctctccttccacagccacatgaaattgaagtgggagaacatggtgtgtgagcattattgggggtggggtg

SEQ ID NO: 43700 - DNA, 201 bp, Homo sapiens
gcactggctttggttgaggtctgcaaaggaaagcacccccactgccaggctgctcaggagtggctcccaccctcgactgcggggaagtgctggaaccctcygcacgagggcaacctttcttgggctctgaaggcgcctctcatcctctgagccaagaagacttctgacccagaattctgagttgagttccgacgcaggcgt

SEQ ID NO: 43701 - DNA, 201 bp, Homo sapiens
ccgcacgagggcaacctttcttgggctctgaaggcgcctctcatcctctgagccaagaagacttctgacccagaattctgagttgagttccgacgcaggcrtgggcgatggtgagcaactccaggctaccccgagaaagccgctgtgtgaccccattaggggacttggctctcctgccaagcccccacccagcacctgtcc

SEQ ID NO: 43702 - DNA, 201 bp, Homo sapiens
cgagggcaacctttcttgggctctgaaggcgcctctcatcctctgagccaagaagacttctgacccagaattctgagttgagttccgacgcaggcgtgggygatggtgagcaactccaggctaccccgagaaagccgctgtgtgaccccattaggggacttggctctcctgccaagcccccacccagcacctgtcccttgt

SEQ ID NO: 43703 - DNA, 201 bp, Homo sapiens
gtggcccctcgggacagcctacagagcagctgtctcttccaggcattgctgcagggcctgctgtctctgctgtcctgggccaggcgctgagttctgtcgcrgaaagtctgagggcagagctgggagggcagcgtttccaaagcaaatggaaaaggcaaacgggaacgtggcgggcagggtgggcagggcagcctggaaaca

SEQ ID NO: 43704 - DNA, 201 bp, Homo sapiens
  misc_feature (1)...(201): n = A,T,C or G, or insertion/deletion polymorphism (see Tables 1-2)
tctcctgccaagcccccacccagcacctgtcccttgtgtcatgactggacttgttacttctagcccaggagctccaggtgaaggggactgtgttggtcctntctgcccaggactctccccacccgcacagtgtacctgtcccacagtggcaccaacaaggctcagctgagcccttgccagaggagacacggtgggcaccag

SEQ ID NO: 43705 - DNA, 201 bp, Homo sapiens
aggaggaagagaacatcgtgccagccaagacttgaccatgaggacacttttttttttttgagacagttttgctcttgttgcccaggccggagtgcagtggygccatctgggctcactgcaacctctgcctcccaggttcaagtgattctcctgcctcagcctcccaagtatctgggattacaggcacccgccaccacgccc

SEQ ID NO: 43706 - DNA, 201 bp, Homo sapiens
tgtgttaacctacagggattccctctttgctttggctgccagggaactcaaagctaagttttttcgctcacattcccaggcttctggtgtagatatctccrttcttccttactgtggtttctgagccatctggtgtagatatctcccttcttccttactgtggtttctgagccaccctgcaaacttcctctgcatctgtcc

SEQ ID NO: 43707 - DNA, 201 bp, Homo sapiens
cctgctgtctctgctgtcctgggccaggcgctgagttctgtcgcggaaagtctgagggcagagctgggagggcagcgtttccaaagcaaatggaaaaggcwaacgggaacgtggcgggcagggtgggcagggcagcctggaaacaccctttgtcccatgcagctcattcactcggccaggatttgccgagtggcttactgc

SEQ ID NO: 43708 - DNA, 201 bp, Homo sapiens
tgcattggtttaggtgagaggaggaggaagagaacatcgtgccagccaagacttgaccatgaggacacttttttttttttgagacagttttgctcttgttkcccaggccggagtgcagtggcgccatctgggctcactgcaacctctgcctcccaggttcaagtgattctcctgcctcagcctcccaagtatctgggatta

SEQ ID NO: 43709 - DNA, 201 bp, Homo sapiens
  misc_feature (1)...(201): n = A,T,C or G, or insertion/deletion polymorphism (see Tables 1-2)
ggtgaagaactttgtttaggaacaatttaagatgccaacaggttcatctgctctcctgcctccttctccccaccttgtaacacaccctagacaagtcagcnctcaagtttatatggacaaataagcaagtaaaattagttaggaaatcaaatattggggttggggaacaataagagaaggcaagccctatgggatggtaaa

SEQ ID NO: 43710 - DNA, 201 bp, Homo sapiens
cagcgtttccaaagcaaatggaaaaggcaaacgggaacgtggcgggcagggtgggcagggcagcctggaaacaccctttgtcccatgcagctcattcactyggccaggatttgccgagtggcttactgcactctgtggccctgaaccagggctgggggatctcagggacatgtgtgtccacagagatggtcacctgccacc

SEQ ID NO: 43711 - DNA, 201 bp, Homo sapiens
  misc_feature (1)...(201): n = A,T,C or G, or insertion/deletion polymorphism (see Tables 1-2)
ggcatgtgccaccacacccggctaattttttgtatttttagtagagacggggtttcaccatgttgggcaggctggtctctaactcctgacctcaggtgatncacctgcctcggcctcccaaagtgctgggattataggcgtgagccacatgcccagttgataatatttttaatatactgttttaggttaaaatatttgaaa

SEQ ID NO: 43712 - DNA, 201 bp, Homo sapiens
ataggtcttcatttctcttgaatatatgcctaaggagtggaattgctgggtcacgtggtatctatttttaatcacttgaggaattgccagactattcaaaygcagctgcaccattttatgccattttacattcccaccagtagtgtatgagggctgatttatctatgtccttaccaacgcttcttatctgactgtttaatt

SEQ ID NO: 43713 - DNA, 201 bp, Homo sapiens
tgtgcagaagctgtgggcaccgggggctgcagagcttcagacctggagcctgctcccagggccgatctgaacccggcacctgtgctgacccaagggtcaarcaaagtcctgagtttggtggcgccgagggaggggagtggtcgcatcccaccgggtgcctggaatggtgctggaggaggcagcatctgatttgggccccgt

SEQ ID NO: 43714 - DNA, 201 bp, Homo sapiens
agccacagcaaacaggcagcgtggcgctgaggggcacaggtttgctggggggcgtgagccgggagcatcgccagcagcaggctcgcccccctgcgagggcycgcacggattcgctcgccaccaagagcagggccccaagaggggccctcggcatagtcccctcgagtccccagaacttcacaggcagagagcctggctcga

SEQ ID NO: 43715 - DNA, 201 bp, Homo sapiens
aacttgggtccccagataaccgtggggaggggagggtttacctgcaggtgccctggcccagccgttcatgcagcgccgtgctgtttctgtgtctgtgcgcrtcggtggagatgctgtgggtgggtgggcaggtgtgccttgtgctgtggcctcccgagacaaggagggctcccacctaagcagggtcctgcagcccaggca

SEQ ID NO: 43716 - DNA, 201 bp, Homo sapiens
tagtaactggtgttatgactgaagacgtcctttgtgggctattggagttcttaatatccccgagtaaccacagggcaacgctctggcttgacaaggggcgscactgctggtcagcagcccagccagccgcagcggccacttgtgttcccagctgtggcttgtgatctatggtcgactgagctgttactctcctcggttaga

SEQ ID NO: 43717 - DNA, 201 bp, Homo sapiens
  misc_feature (1)...(201): n = A,T,C or G, or insertion/deletion polymorphism (see Tables 1-2)
tgaaaagttctatgtgcgcttgaccggggggccttacgtacgtgaattgggtgagggcctgagacaggcgggtgagcacttgccccacactccagccaggnttgggggttcaagggaccgcatttgccacgtgagggagtctctggagaccaccaacccgctggtgggcggccaagcgtcaccaccagtccctctcagtgc

SEQ ID NO: 43718 - DNA, 201 bp, Homo sapiens
ccagccccaactctgagcctccgttgggtcagcggtaagatggggcagtggcacctacctccccggctgctgtgaaaaccaagtgagcggaagcatggcascccctcaccaggtccccagtgggaggactctcaatgattggcactgccaggagtaatgttatgagaggagcgtcccatcagcctggaggggacacaggct

SEQ ID NO: 43719 - DNA, 201 bp, Homo sapiens
tggaggtgaaaccgcgcgatgaggcccctttcgagtctggctgcttttgcttagccctgcgcttgtgagatccctccgcggtggcgtggagaggtgtggcyacttcccgcttcgtggcaagtcgtgttctgccatttctccgaataccgatggaggcttacagtgctggaccatggaatggggtctggaatgttctcatac

SEQ ID NO: 43720 - DNA, 201 bp, Homo sapiens
ccacataacacttttgtaagaataagagttattttttatggcacaatcgcccctgccctgggtttgtgaatttgggggattcttttttttttttttttttytttgagacagagtcttgctctgtcgcccaggctggagtgcagtggtgtgatctcggctcactgtaagctccgcctcccgggttcatgccattctcctgcc

SEQ ID NO: 43721 - DNA, 201 bp, Homo sapiens
cctgtgttgcccagcctcctgggctcaagtgatctccccgccttggcctcccaaagtgctgggattacccggcttgagcatgatctttttgccttgcttggctctgggtttcctcatgtgtcaagtggggctgagccccagctgtgtgggctgaacaggggagggttaagctcggcccctagagtgagggcccgccatggt

SEQ ID NO: 43722 - DNA, 201 bp, Homo sapiens
  misc_feature (1)...(201): n = A,T,C or G, or insertion/deletion polymorphism (see Tables 1-2)
gcgcttgaccggggggccttacgtacgtgaattgggtgagggcctgagacaggcgggtgagcacttgccccacactccagccagggttgggggttcaaggnaccgcatttgccacgtgagggagtctctggagaccaccaacccgctggtgggcggccaagcgtcaccaccagtccctctcagtgcgtcccacctctgttc

SEQ ID NO: 43723 - DNA, 201 bp, Homo sapiens
gatggagtctccctgtgttgcccagcctcctgggctcaagtgatctccccgccttggcctcccaaagtgctgggattacccggcttgagcatgatctttttgccttgcttggctctgggtttcctcatgtgtcaagtggggctgagccccagctgtgtgggctgaacaggggagggttaagctcggcccctagagtgaggg

SEQ ID NO: 43724 - DNA, 201 bp, Homo sapiens
  misc_feature (1)...(201): n = A,T,C or G, or insertion/deletion polymorphism (see Tables 1-2)
acgtacgtgaattgggtgagggcctgagacaggcgggtgagcacttgccccacactccagccagggttgggggttcaagggaccgcatttgccacgtgagngagtctctggagaccaccaacccgctggtgggcggccaagcgtcaccaccagtccctctcagtgcgtcccacctctgttctcagcccctgcggtgcccgc

SEQ ID NO: 43725 - DNA, 201 bp, Homo sapiens
agatggagtctccctgtgttgcccagcctcctgggctcaagtgatctccccgccttggcctcccaaagtgctgggattacccggcttgagcatgatctttttgccttgcttggctctgggtttcctcatgtgtcaagtggggctgagccccagctgtgtgggctgaacaggggagggttaagctcggcccctagagtgagg

SEQ ID NO: 43726 - DNA, 201 bp, Homo sapiens
ggtcctgttgaccaccaggctgcagatcccaaggaacgcaggcatctgggtggccccacgtggagcaccagccatggggaggccgtgggctaccaggcccygcgtgcactcgcagcatgcaccactccttctccaggtcccgttgacctccatgtgtgctgtgccccgtcctccgctgcactgcctcttcgtagtgcccca

SEQ ID NO: 43727 - DNA, 201 bp, Homo sapiens
gcctggaactcctgggcacaagtgattctcccgcctcagcctcccaaatagctgggaaacaggtttatgccaccacgcccaactaatttttaaattttttrtaaagatggagtctccctgtgttgcccagcctcctgggctcaagtgatctccccgccttggcctcccaaagtgctgggattacccggcttgagcatgatc

SEQ ID NO: 43728 - DNA, 201 bp, Homo sapiens
ccttggggccacattttgcagcagtcacagggcctggcctcactccagggctccatgtttggatgcgaggcccagtgggtaagtgcactgctgcccacgcmccccccccagcactgtctgctcctccctgcttgcctgcctgtcaaggcagccctcatcttccttggaggatggggctgggctgggagcctgcgccctccc

SEQ ID NO: 43729 - DNA, 201 bp, Homo sapiens
gggcgtcctgggccctggcaggatgtcgttccagtgatacagcacttccttgcttctaaactgctgagtggtcagtgtcggttatcagctgtccacatatrttgcataatctcagatgctggcttgtaacagtgagtggaggtgggtggccacactgtccctttagaataatccacatggccctgtccaggcagggcagcc

SEQ ID NO: 43730 - DNA, 201 bp, Homo sapiens
ggtgacttgtagctcgcccacagtgagacgtgcaggaagtgtaaaatacacactggatttcagagactgggtggggagaaaggattgtgaaagagctcatkagtatttttttatatcggctgcatgttgaaatgctgatatttcgtgttaatttcacccatttatttaaatttttgttaacgtggctactagaaaaggttc

SEQ ID NO: 43731 - DNA, 201 bp, Homo sapiens
tggcttgtaacagtgagtggaggtgggtggccacactgtccctttagaataatccacatggccctgtccaggcagggcagcctctgggctcccgcccaccrcctgatgcccctgtgcctggtgagcctgggccggggtgtgttcgctgtggatgggtgtgttccgagttctccggtcagcaagctccctttgtctctaggg

SEQ ID NO: 43732 - DNA, 201 bp, Homo sapiens
cgcagtctcggctcactgcaagctccgcctcccgggttcacgccattctcctgcctcagcctcccaagtagctgggactacaggcgcccaccaccacgccyggctaattttttggtatttttagtagagacggcgtttcaccatgttagccaggatggtctcgatctcctgaccccgtgatctgcccacctcggcctccca

SEQ ID NO: 43733 - DNA, 201 bp, Homo sapiens
ggagggaggaaggaagggagggagggagaaaggaggaagggagggagggaggaagaggggaggtggggagggctctgttcacataataaagaaatccagasgtttgaccatgggcgtcatttcatcactgcacttggcagaggtcatcgctgctgctcccatccagctcagtcctgtggtccctgtcgtgtgtagaaacac

SEQ ID NO: 43734 - DNA, 201 bp, Homo sapiens
caactccatctaggtttgctgttaatgccattatttcgttcctttttatggctaagtagtattccatggtgtatatgtaccacattttttttctttgtttstttctttttttttctttgagatagagtcttgctctgtcacccaggctggagtgcagtggcgcagtctcggctcactgcaagctccgcctcccgggttcac

SEQ ID NO: 43735 - DNA, 201 bp, Homo sapiens
ttgggcatgcttcatagtcatcgtttcattttgtcttgattttggtttgtgtatttatcggttagcccctcttagcatctgaattccagtgagaagacatrtagtttgtttgtttgtttgtttgtttgtttgttttaagacagagttttgctcttctcgcccaggctggagtgcaatggttgcaatcttggctcattctcc

SEQ ID NO: 43736 - DNA, 201 bp, Homo sapiens
acactgtccctttagaataatccacatggccctgtccaggcagggcagcctctgggctcccgcccaccacctgatgcccctgtgcctggtgagcctgggcyggggtgtgttcgctgtggatgggtgtgttccgagttctccggtcagcaagctccctttgtctctaggggagttcctgggaggtaaaggggagccttttca

SEQ ID NO: 43737 - DNA, 201 bp, Homo sapiens
  misc_feature (1)...(201): n = A,T,C or G, or insertion/deletion polymorphism (see Tables 1-2)
gtgactaggtgagggacagtgcggggtggcctgcctgcatatgccaggttctgtgtatcacatctctcaccaggaaggcaaaacctggcagatggcacccnggcctgatggctcctcaaccctctcagcaccccaaagagggaagtcccatcaccctcactcacccagccccgggctggccctgtcagctctcgaactgca

SEQ ID NO: 43738 - DNA, 201 bp, Homo sapiens
atctggtgtagatatctcccttcttccttactgtggtttctgagccaccctgcaaacttcctctgcatctgtcccagtacaaatatcactgtgtgcccttytaggctatctgggacacttaaaaataaataaataaagacatctgtctgaggcttaacttgcatatagcaaagtgcatgaatctgaagtgtgtggctgatg

SEQ ID NO: 43739 - DNA, 201 bp, Homo sapiens
caaatatcactgtgtgcccttctaggctatctgggacacttaaaaataaataaataaagacatctgtctgaggcttaacttgcatatagcaaagtgcatgmatctgaagtgtgtggctgatgaatctgtacacaccgctctccctgcacagccacccagatgaagacgaggagcacctccaatacccaagcctccctccac

SEQ ID NO: 43740 - DNA, 201 bp, Homo sapiens
atagcaaagtgcatgaatctgaagtgtgtggctgatgaatctgtacacaccgctctccctgcacagccacccagatgaagacgaggagcacctccaatacscaagcctccctccacccagtcaacactcttctccagagggagctagcccgtgccttcacccccgtcttctgcctgacggtaaacttgaggtgaatgggct

SEQ ID NO: 43741 - DNA, 201 bp, Homo sapiens
atacccaagcctccctccacccagtcaacactcttctccagagggagctagcccgtgccttcacccccgtcttctgcctgacggtaaacttgaggtgaatsggctcctacccatgaacacccaccgttcatttcatccgtgttgttctgtgcagccagactccatcctacggcatccgtgggtgatgtttcatcacgaggc

SEQ ID NO: 43742 - DNA, 201 bp, Homo sapiens
attgaaggatgcctagatggctggtaaagttttgtttctggctggttaagtgtgtctgtgagggtgttgccagaggagactgacttttgagtcggtggacygggtgacggagacccaccctccgtgtgggtgggcaccatctcatcggctgtccttgtggctggaacaaagcagatggaggaaggtgggaagactttgttt

SEQ ID NO: 43743 - DNA, 201 bp, Homo sapiens
gcttgaagttgtgccatagctcactgatgctctgttcatttttgaaaataatttttctgcctctgtttcattttgggcagtttctattgccatgtctccaygttcattcatcttttcctctgcggtatctcttctggcattaatcccacccagtgtattttgatccctgacattgtagttttcatctctagaagcttggtt

SEQ ID NO: 43744 - DNA, 201 bp, Homo sapiens
gtgtgggtgggcaccatctcatcggctgtccttgtggctggaacaaagcagatggaggaaggtgggaagactttgtttgctgggtcttctggctttcatcygtctcccgtgctggatgcttcctgctctgggacatcagactccaggttctttgacctttggactctggtttagctggagctctcgggaggtgtcggcttc

SEQ ID NO: 43745 - DNA, 201 bp, Homo sapiens
accagggctgggggatctcagggacatgtgtgtccacagagatggtcacctgccacctccaccatcacagatgccatgaaggctgtgaagggaaacagacytgtaaggcagcggagccgagatggggttgatgagtgtcaccagtcacaagcaaggtgtctctgttctctcttctacatgttgatcgaggtataacaccca

SEQ ID NO: 43746 - DNA, 201 bp, Homo sapiens
atgacactaggctctaagtagtggggctgcgtgactccagcgcccctaggaccagcaagggcacccagagcactgtgggaggactggtgccgcctccctgmccccctgctttctcctgggccactgggctagacatggggcctccctgcccccatgtggtttggcctgaaaaagagaggaggtggggtggcacttctgggg

SEQ ID NO: 43747 - DNA, 201 bp, Homo sapiens
gcccaggggacagatgccgatctgttgctgctcctacctgcaggtggtcccccagcccaagctggtgtgcttcatggtgcagggcacggggtgggctcatscgcacatcagtgtgggcgtccccggggcatatgtgaataactgtatttttctattgaaaaaacaactctgctctgcttacggggctcctgcttgaccttc

SEQ ID NO: 43748 - DNA, 201 bp, Homo sapiens
ggccctacgcccaggcccgtccctctgccaaagcgagccttttaggtgagccctgccggccacctgctagcccaggccccggctcctggtgggccctggaycaggctgcaagcatatccaagtgcatggcagtgagacgtccaggcctcccagccccaactctgagcctccgttgggtcagcggtaagatggggcagtggc

SEQ ID NO: 43749 - DNA, 201 bp, Homo sapiens
tgaaaaccaagtgagcggaagcatggcagcccctcaccaggtccccagtgggaggactctcaatgattggcactgccaggagtaatgttatgagaggagcrtcccatcagcctggaggggacacaggctgggtcagcacccacaggggcttccgcttctctgtctcagggggtccagggtggccccttgccactggtcccc

SEQ ID NO: 43750 - DNA, 201 bp, Homo sapiens
tgcacacacgtacacccgtgtaacccccacacagatcaagatgtagaacattccagcacccagaagtttccccgtgccccttcccagtcagaccccccgaycccaggtcacccctgccctgacttgcagtgtagagctcacccggccacttcctcttttgcccacagcaggtgaggagggccttctactgggaaaaactgt

SEQ ID NO: 43751 - DNA, 201 bp, Homo sapiens
cctgggaggcggagcttgcagtgagccgagatcgcgccactgcactccagcctgggtgacagagcgggactccgtctcaaaaaaaaaaaaaaaaaaaaaaagtttaggtaatgtattatgtcctggccctgtgctgggtgcttcactaagatgatttcctttaaacgccacacctgttatacccattttacagatggaggt

SEQ ID NO: 43752 - DNA, 201 bp, Homo sapiens
tggatgcacaggctccatgggaaggagctcctgctcgggtttctttgtaagcagcacgacatggcaccttcccagaggtacatgggtctgggcatgtcatyccccgacctgcttccagaacccaggggacggaggtcggagcagcctgcctgagatctgtggccatctccactccgccacccagctaccccgtaaggaggc

SEQ ID NO: 43753 - DNA, 201 bp, Homo sapiens
aggacacctgttttcctcgcctggtgattgagccgggaagccttcatggagcaggccctacttgcccaggtgaagtctgtgtggcctgcagccacgggggygagtggccctgcgcctttcatgctgtggcctccttgatatgtacagcctgctttgaagtcctgcaggagctcaaaggaagttcctggggtgagaccagcc

SEQ ID NO: 43754 - DNA, 201 bp, Homo sapiens
gtagcacccgacccaggacacctgcctctgggactgtggcgcctccatccggctctctggatcctgggttctggggggtccgacctttcatttttttctccgcctcacaccccaccatgtcgtgtctgaaaggaagcgaagcccagccctggcaggtggagtatttttatttcccctgacagcgcacctcctgacctctat

SEQ ID NO: 43755 - DNA, 201 bp, Homo sapiens
gctgcctctgcctcctgtgaacgccatcctctggttcttcaccttcaggctcccgcatgagctgggtggttggtgttaactcctctcttctctctttctasccggaaccccctgcccagagctccagggagctccaccatagccagtagagggagggctctgtttacctccttccaagttcccaattttgctctactgatt

SEQ ID NO: 43756 - DNA, 201 bp, Homo sapiens
ctttgtctttgtgatgtgtcctagtcataaggtgctctgagacctcatggcttagttttccttcagagttttttctcccttggaggcttttttttttttttaagtagattttattttcttctcaaaacacaagtatttaaaatatctgattatgaagcaactcatgctcattaaaggagctaagaaaaattcaggaaagta

SEQ ID NO: 43757 - DNA, 201 bp, Homo sapiens
aggctcccgcatgagctgggtggttggtgttaactcctctcttctctctttctacccggaaccccctgcccagagctccagggagctccaccatagccagkagagggagggctctgtttacctccttccaagttcccaattttgctctactgatttttgtctgcggtgcataatcaatcagcctggaccccagagaggcct

SEQ ID NO: 43758 - DNA, 201 bp, Homo sapiens
gccgaggtgggcaggtcattagagcccaaaagtttgagaccagcctgggcaacacggaaaaaccccgtctctacagaaaaaatgcaaaaaaaaaaaaaaaaggcagatgtggttgcatgtgcctatggttccagctacttggggggctgaggtgggcagattgcttgggcccaggaggttgaggttgcagcaagctgagat

SEQ ID NO: 43759 - DNA, 201 bp, Homo sapiens
accatgggggcagccccagcccttccctgcctgttacaggcccctgcccctgttcctgtgtcccatgcctgtcccctccctccatgtgtctgtctctactygcctgccctctctctgccctcttttctctgcttcatcctctttttctgtttctgcctgtctcatggttcttcctgtccctgccctccctccctccgtgtg

SEQ ID NO: 43760 - DNA, 201 bp, Homo sapiens
tgggcatggtggctcacacctgtaatcccagcactttaggagtccaaggagggcggatcacctgaggtcagaagttccagaccagcctggccaacatggcraaaccccatctctactacaaatacaaaaattagccgggcctggcagcaggtgcctgtaatcccagctactcaggaggctgaggtgggagaatcacttgaa

SEQ ID NO: 43761 - DNA, 201 bp, Homo sapiens
agaaccatgggggcagccccagcccttccctgcctgttacaggcccctgcccctgttcctgtgtcccatgcctgtcccctccctccatgtgtctgtctctrctcgcctgccctctctctgccctcttttctctgcttcatcctctttttctgtttctgcctgtctcatggttcttcctgtccctgccctccctccctccgt

SEQ ID NO: 43762 - DNA, 201 bp, Homo sapiens
gagctcagtctggctttgatctgcgggaggtgttgtgtgcagaagctgtgggcaccgggggctgcagagcttcagacctggagcctgctcccagggccgayctgaacccggcacctgtgctgacccaagggtcaaccaaagtcctgagtttggtggcgccgagggaggggagtggtcgcatcccaccgggtgcctggaatg

SEQ ID NO: 43763 - DNA, 201 bp, Homo sapiens
gccatgtttataaatattaaagctataaatattttataaatattatagctttttttatttaaaaaataagcaactatgtatatatttgtattcccctcatrggatgaatttaagagacaaattctcaaaataatgtgttttatatatagagagaaaggctaatgctttaagtttaaaaatcagtatttaaaagtttataag

SEQ ID NO: 43764 - DNA, 201 bp, Homo sapiens
ctgctcccacctcccagccaggccccgagggccaggcactctggcttagtgaagaagccacccagcaaaggcctggtgtctccacaccattctcgggggggacagcagcaaggacgatggacgggagcagtgctcggccttaacgtccctgtttccggaagcgtccctgccccgctcagtcctgccccactccctctccca

SEQ ID NO: 43765 - DNA, 201 bp, Homo sapiens
atcccttcctgatcttccaggtcatgggctccaggcttgggcccactgctgtccttctccactctctccccagggaacccacctgggttgtggccttaaamccagccagatgatgcttctccagcctctgcctcctgccgggccctcccctgagctcagaagctgccatcagtagccatgcaacctcccccttgccatcat

SEQ ID NO: 43766 - DNA, 201 bp, Homo sapiens
tgagtagctgggattacaggcatgtgccaccacgcccatctaattttgtgtttttagtagagacggggtttctccatgttggtcaggctggtctcaaactytcaatctcaggtgatccgcccgcctcggcctcccaaagtgctgggattacaggcatgagccaccacatccggccttcattggtgtattttatgtgtggcc

SEQ ID NO: 43767 - DNA, 201 bp, Homo sapiens
gtcagcatgagttcccatgaggccagggccagcacgaggacctgctgggagcggtccatccacccatccgtccgtccatccatccatccatccatccatccctatccacctgtccaccctgatgcagttcctgccatccacgtgtccatctgtctacccgtacacctgttcatccccatccatccatccccctgtccatcc

SEQ ID NO: 43768 - DNA, 201 bp, Homo sapiens
tagccttgaagtctccctaacctggcaagacagtggagaagggggacagccagcgggacattccactgtagaataaatacatgcatggcaaaacacttgayatctattaacttctaagtggcaagagtgattcttgtggttagacctgaatgggaacttgtaagtctaaagtgaaaatctaattagatttttcccacaaaa

SEQ ID NO: 43769 - DNA, 201 bp, Homo sapiens
ttctctattgctgctgggaaggtgaaatgacaatgctgccacggaaagccacttggtggttcctcaaagttaaacatagaatttgccgtatgactcagcawcccatttccaggtctatacccagaagaactgaaacacgtgttcaaacaaaaacttgtacacagatattcatagcagctccatacacaatagccaaaaggt

SEQ ID NO: 43770 - DNA, 201 bp, Homo sapiens
ggtcagcatgagttcccatgaggccagggccagcacgaggacctgctgggagcggtccatccacccatccgtccgtccatccatccatccatccatccatccctatccacctgtccaccctgatgcagttcctgccatccacgtgtccatctgtctacccgtacacctgttcatccccatccatccatccccctgtccatc

SEQ ID NO: 43771 - DNA, 201 bp, Homo sapiens
ttgcgtgctgtgaactgggcgtgaacacctcctgtgatggggagctcactccttgccgagggagcctggtaagctgccggcacagtcatcctcataccctstctcctgacctgtgtcttatggcctctgcccccaggcagctgcggggcagggggctggggtgacccccgtcttggttgttgagcccttccactagctgga

SEQ ID NO: 43772 - DNA, 201 bp, Homo sapiens
gctggagtgcagcggcgtgatctcggctcgctgcaacctctccctcccgggttcaagcgattctcctgcctcagcctcctgagtagctgggactacaggcrcccgccaccatcccagctaatttttatatttttggtagaggcggggtttcaccatgttggccaggatggtctcaatctcctgaccttgtgatccgcctgc

SEQ ID NO: 43773 - DNA, 201 bp, Homo sapiens
aggtcagcatgagttcccatgaggccagggccagcacgaggacctgctgggagcggtccatccacccatccgtccgtccatccatccatccatccatccatccctatccacctgtccaccctgatgcagttcctgccatccacgtgtccatctgtctacccgtacacctgttcatccccatccatccatccccctgtccat

SEQ ID NO: 43774 - DNA, 201 bp, Homo sapiens
ggcactgcattcaaagtgagtgcgcctgcttttgtttcttcctaggacttctgaaaacgtgtgggtgggggagggtgtggagggttcgtgcaccgggtggygtggctgcagtggcgtgggaggcggccccagaggggcagaggcgcagtgtgtttatgtgcacagggccgttcccttcctgtccctcatgtgaacaccagt

SEQ ID NO: 43775 - DNA, 201 bp, Homo sapiens
tggttatctatggtgtggctatcttgtatatatatatattttttaagactgagtctcgctctgtcacccaggctggagtgcagcggcgtgatctcggctcrctgcaacctctccctcccgggttcaagcgattctcctgcctcagcctcctgagtagctgggactacaggcgcccgccaccatcccagctaatttttatat

SEQ ID NO: 43776 - DNA, 201 bp, Homo sapiens
tgggattacaggcatgagccaccgcacccagcccctttgctcttcctttgtcttctgccatgattgtgaggcctccccagccatgtggagttgtgagtccrttaaacttctttcctttaaacattacccagtctcaggtatgtcttcattagcagcatgaaaacagactaatacaccatgtcatttaatgaggctgggcct

SEQ ID NO: 43777 - DNA, 201 bp, Homo sapiens
cctctgctgccctccaaggtgccctgggtccagctggccagaagcactgctttctggagcagccacttatgcttttacttttttctcttctttttttttttaagactgagtcttgctctgttgcccaggctggagtgcagtggcacaatcttggctcactgcattctccagttcaagtgattctcctgcctcagcctcctg

SEQ ID NO: 43778 - DNA, 201 bp, Homo sapiens
atgaacttgggggattttaaaggtaacaaacaaccccttctggctggtgtgggggaagccctaatttgtagtgcttgctacttttttttttttttttttttgagacagtgttttgctctcgtcacccaggctagagtgcaacggcacaatcttcactcattgtaaaacctccgtctcccgggttccagcgattctcctgcc

SEQ ID NO: 43779 - DNA, 201 bp, Homo sapiens
ctggaggggacacaggctgggtcagcacccacaggggcttccgcttctctgtctcagggggtccagggtggccccttgccactggtccccaggcacagccrctacacaggtgcctctgcagggtctgggagtcagctgtccagggcctgcttggccaccgcagggcaggagtgtggcactgtgagcctggtggcctggctg

SEQ ID NO: 43780 - DNA, 201 bp, Homo sapiens
cagggcaggaagtggcctgcacagaggccccgaggcgagaaggaccacaactctcctgtggacctcctctttgtacgatcagttttaattacgcaaaaaaattatgcagttaaagctttgctcatttaaacagaccttccctggattaagagtaattaggttttattgtcattgtcttgaaaattgccttgccatggacct

SEQ ID NO: 43781 - DNA, 201 bp, Homo sapiens
gcagccaggggttccgtactccctgccaggcagctgccagccctccccgctcccctctcagttcctcagcctggctatgggaggcccaagtcccacgtgtmactggaattcgggaggcctggctctcaaagctttctgtacaaaacaaggagaaaaagagaagccacttttgctgtctggacatgctgtgggtgtcctggg

SEQ ID NO: 43782 - DNA, 201 bp, Homo sapiens
tggcacctgcagctcttcctaggcccctgccctggggcactggtgcctgcttcgccaaaggcacagagggctgcaggcgactggggcagggtggggggctygcctcttagggctcagcttcactggccagaaacagggctggctcgagctgggtgttggcctgggtggggtggccagcatgcccacacctctcagtctgga

SEQ ID NO: 43783 - DNA, 201 bp, Homo sapiens
tgcttcgccaaaggcacagagggctgcaggcgactggggcagggtggggggcttgcctcttagggctcagcttcactggccagaaacagggctggctcgakctgggtgttggcctgggtggggtggccagcatgcccacacctctcagtctggatgtggggagaggttgttccatccagggcagttggtctccagaaggaa

SEQ ID NO: 43784 - DNA, 201 bp, Homo sapiens
  misc_feature (1)...(201): n = A,T,C or G, or insertion/deletion polymorphism (see Tables 1-2)
tgacttgttcttagggaatgaggcccagggagctaaagctttagggcagggcagcagattcagagacacccccaggggtagggggaagtgcactagagtgncgtgtgcctggcgtgggaacagggagacattagagaatagtgggagtgtggcaggctgggcccgccttgcccctttcaaggaagcagctgccgcgtcaca

SEQ ID NO: 43785 - DNA, 201 bp, Homo sapiens
ccacgtgagggagtctctggagaccaccaacccgctggtgggcggccaagcgtcaccaccagtccctctcagtgcgtcccacctctgttctcagcccctgyggtgcccgcagtcagtggggcagtgagaaccgcgcaggaaatagctggcgccatggtgtcggttctggttgacagagtgccacctggctaaacccagccg

SEQ ID NO: 43786 - DNA, 201 bp, Homo sapiens
gcctgtgggcagagctggcctgggaggacacgggcctgagggctgagcaatccctgagtgagaacaggtagctgaggctggagcctgtgtcccccaggcasctgctaaggcccgggcctggggctggagtgctgggctcaggtgccatgtgagctctttgcaggcagggaccaggtcagagtcctttgtgtgcctcttgac

SEQ ID NO: 43787 - DNA, 201 bp, Homo sapiens
cagtcattggtggattttctgtctaacattttatgaaaattttcaagcatccaacaaagttcaaataatttttacttggaatagttttggtttttttttttggagacagagtcttgctctgtcacccaggctggagtacaacagtggtgtgatcttggcttcctgtgacttccgcttccctggttcaagcgattcttctgc

SEQ ID NO: 43788 - DNA, 201 bp, Homo sapiens
gagtcctgccacctttttgtagtagctgtcactaccactcatggctgtatttggggccctctctcactggtggggaatcgtgcctggcttatctgcccccyttttttttttttttttttttttgcgacagagtctcactgtgtgacccaggctggagggcagtggcttgatcttggctcactgtgacctccacctcctggg

SEQ ID NO: 43789 - DNA, 201 bp, Homo sapiens
tgaaggagcgaggcctgcgaccatacctgctcatccatgacggtaggcctgtcggacaccaggacctcacgggggtgaaagctcccctttcccagggtggrggctgtgcagagagcctctttcactgggccaaaccactgactgagctaggccaccaacactcatgggttgggggtaaaaacctcatgggacttcctgctg

SEQ ID NO: 43790 - DNA, 201 bp, Homo sapiens
agcaccagtgtctccatgaagttggggttcctggggagatggctccccccagcctcgcctcctccctgcctcagagactgcgcagaaggagggcagctggrctgatgagcaactcgcctggggccccagagaggcccgatcccatcccgctggggcacgccccaggtccaagcctgtctgggcacccccagggctctggac

SEQ ID NO: 43791 - DNA, 201 bp, Homo sapiens
ccccgactctactaaaatacaaaaaattagccaggcatggtggctggcgcctgtagtcccagctactcgggaggctgaggcaggagaattgcttgaacccrggagatggaggttgcagtgagctgagatcgcgccatcacactccagtctgggcgacagaacgagactctatctctaaaaaaaaaaaagaaaaagaaaaaa

SEQ ID NO: 43792 - DNA, 201 bp, Homo sapiens
ctccatgaagttggggttcctggggagatggctccccccagcctcgcctcctccctgcctcagagactgcgcagaaggagggcagctgggctgatgagcarctcgcctggggccccagagaggcccgatcccatcccgctggggcacgccccaggtccaagcctgtctgggcacccccagggctctggactcacctccacc

SEQ ID NO: 43793 - DNA, 201 bp, Homo sapiens
taacaagtatcattaatccaaaaatctgaaatctggtatgctccaaaacctgaaactttctgagcactaacatgacagcaacagtggaaaattccacccctgtcctcacgcgatgggtcgcagtcaaaacccaatcaaaaccttgtttcatgcacaaaattatttaaaattttgtataattaccctcaggctatgtgtcta

SEQ ID NO: 43794 - DNA, 201 bp, Homo sapiens
ctgcatccttggtggtgacaccatcggcaagtttggcacccccggccctcacactgaccccagcaccccttccccaggctctggtggactccttgctcacrctgcctgctctgcagggtgggggcgggggggcagagcctgccagcccctcccacacttccctcaccagatcacaggaccctcggggtggaggctggtgcg

SEQ ID NO: 43795 - DNA, 201 bp, Homo sapiens
taaccctaagcaaatactcatctgctttctgcctttgtgggtttccctattctaaatattttttatgaatggaatcatatagtatgtggccttttctgtcbtcttttactctgcgtgttttcaaggttcatccatgttgtagcatgtatcaggacttcatttctttttatggctgaataatgctccactgtatggatagac

SEQ ID NO: 43796 - DNA, 201 bp, Homo sapiens
attactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgtggtttgt

SEQ ID NO: 43797 - DNA, 201 bp, Homo sapiens
tattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgtggt

SEQ ID NO: 43798 - DNA, 201 bp, Homo sapiens
atattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgtgg

SEQ ID NO: 43799 - DNA, 201 bp, Homo sapiens
tggtgcaccaggcactctgctaagcactttatgtacattcttaaattaccggatccccattacggaaacggagtcttaggttgaaaaactacttgaccaargtcatcccagctgtaagtggcagagcaggccctgaatccaggcaacccaggctgatcaccaccctgccaccacccacccctctctcacatacaggctcta

SEQ ID NO: 43800 - DNA, 201 bp, Homo sapiens
tatattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgtg

SEQ ID NO: 43801 - DNA, 201 bp, Homo sapiens
ctatattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctgt

SEQ ID NO: 43802 - DNA, 201 bp, Homo sapiens
cctggagggagagcagtgaggggcatcattaatgggctgttgggtgtcctgatttctttgagagaagacgagctgagcaggcacagctcttaatcctccarccactgccccccaggctggggcctgccagcccccgcccctgtagtcatttctaaatcgggtctagatggactggacgcgtggctgccagagaccatttga

SEQ ID NO: 43803 - DNA, 201 bp, Homo sapiens
tctatattattactgtgcttgagcacttcttcaaatgtttgatgaccttgaccattgaaacttcctttttgtgaattacctattcatatcctttgtagcttcactgtggaatgcttgttactgatttgtagccattctttatacatttcactcccactcgtttgtcagttatatgtggtgcacacatctgctcccagtctg

SEQ ID NO: 43804 - DNA, 201 bp, Homo sapiens
cccgccaggccccactgctctctgcctggctggcacacgcccttgcctcaggcctggctccccgggtcctgttgaccaccaggctgcagatcccaaggaargcaggcatctgggtggccccacgtggagcaccagccatggggaggccgtgggctaccaggccccgcgtgcactcgcagcatgcaccactccttctccagg

SEQ ID NO: 43805 - DNA, 201 bp, Homo sapiens
caggcacagctcttaatcctccagccactgccccccaggctggggcctgccagcccccgcccctgtagtcatttctaaatcgggtctagatggactggacrcgtggctgccagagaccatttgaaccccctacctccaaattccccaaggtccccgcctgcaaaggaccagccccagcatgaggccctgaaagtggcaaca

SEQ ID NO: 43806 - DNA, 201 bp, Homo sapiens
gctttagctttggccccacccatcttaggctgctcagaggcctcaggcctccctggagggccagaagggattcccaggggcaggatagcacggacggggggtccgctgtgtaagcctgggaaattctggctgcttgaagctggcacactcccctgaggctgttccaggcacagtcactgggtctccccgtcgaagtggctc

SEQ ID NO: 43807 - DNA, 201 bp, Homo sapiens
atctgggtggccccacgtggagcaccagccatggggaggccgtgggctaccaggccccgcgtgcactcgcagcatgcaccactccttctccaggtcccgtrgacctccatgtgtgctgtgccccgtcctccgctgcactgcctcttcgtagtgccccagctccatccgggggtgggtgggagtggagacccctgcctacag

SEQ ID NO: 43808 - DNA, 201 bp, Homo sapiens
gcctccgggtctagccagagtcaaccagcccaccagagacacccagatgcaggctatgccccacgtgcccagggaggatctgctgacgtgagcccagattmcgattcttgtgcgagggagacgaaccaggtttaaaccccagctctgccacttctggctgtgactttgagcatggctgttcatctctgggggtctctctcc

SEQ ID NO: 43809 - DNA, 201 bp, Homo sapiens
cggggcaggctctgggccctgggcaccacccactggaaggaaagggggttcagttagcccagccctgccccccaatggaagaaaattggggttcagttagmccagccctgccccaccccagctcttcacacatccagatccagatgggggccagaccaccaggagactgtaaggatccaaggccgaggggcaggagacgca

SEQ ID NO: 43810 - DNA, 201 bp, Homo sapiens
agcccagccctgccccccaatggaagaaaattggggttcagttagaccagccctgccccaccccagctcttcacacatccagatccagatgggggccagaycaccaggagactgtaaggatccaaggccgaggggcaggagacgcagtgcgcccctctcctatttctgggttgcaaccgcccacacatgtgcacacaggga

SEQ ID NO: 43811 - DNA, 201 bp, Homo sapiens
gatcatgcatttattttgggggtaggataggtcctgaagaccacagggcagggatctctgagttggggcttttgcggagtgagggagtgagagggtgttcyaggcagaggaggtggcagagaaaggcaccaagtgaggcaggggcagttggggacatgagtgctcgggagcggggagagggggcagctggtgggtaagcag

SEQ ID NO: 43812 - DNA, 201 bp, Homo sapiens
cttgggcatcggacctgcccaccatctcctgaggtggggcctgctctccagacagtcaggtcagcatgagttcccatgaggccagggccagcacgaggacytgctgggagcggtccatccacccatccgtccgtccatccatccatccatccatccatccctatccacctgtccaccctgatgcagttcctgccatccacg

SEQ ID NO: 43813 - DNA, 201 bp, Homo sapiens
ctccctttcatgtatagacatggatcctatgagtcttttccctctggggagccctgcctaacacagtggcatagagctccaggcaggcccctcacctggcyttcagcttcagtttctttgcctactgggctgaatattggtgtcaccacccaggatagcaagtccccatcagtgtcactgccacctgtcgaagagatcccc

SEQ ID NO: 43814 - DNA, 201 bp, Homo sapiens
  misc_feature (1)...(201): n = A,T,C or G, or insertion/deletion polymorphism (see Tables 1-2)
aggctggcagattgcttgagcccaggagtttgaagccagcctgggcaacatggcgaaaccccatctctactacaagtacaaaaatttggccgggcatggtngctcatgcttgtaatcccagcactttgggaggccaaggagagcggatcacttgaggccagaagctcgagaccgcctctactaaaaatacaaaaattagcc

SEQ ID NO: 43815 - DNA, 201 bp, Homo sapiens
catgatcctgagtgcacaggtacattgctccgccctctcaacagccacgacccagaaataaagtaggcactgtaatttgcattttgaggataaggaaaccraataatagagtctactgagcgcatactcagtctttccagaccctagaaagtaggtaccattgtcatcctcatttcagagctaggagagcagaggccagac

SEQ ID NO: 43816 - DNA, 201 bp, Homo sapiens
cctgccctgtagacggggagaccacattagtgtttgtgcaaagccctgccctcgtgcacctgtccttccgtagcccacgatacctcatccagcccgggcccgtgggtgggctgctgagcacccgaccacagccaggcctccatgtgccactgtcaaggggacttggcccgccatgatcctgagtgcacaggtacattgctc

SEQ ID NO: 43817 - DNA, 201 bp, Homo sapiens
gtacccgtatatcccacccccagactcctttccatgagctgctcccagaccccctcatatccatcctgcctccagaacccctatatcttgctcccactccytaccatatgctgttcccagacccccctccatggcctgcccccagatccccctttgctgccacccctatatcttaccccagactcccccatatctcgcccc

SEQ ID NO: 43818 - DNA, 201 bp, Homo sapiens
tctgggaatctcccaaatcccagaactcaccactcaccatgggcctttaaatgcagtaaactccacctaaccagattcaggggcactatgcccactgcctmctcttcagactctttgcatttcagtgaagagcctggaagaaacccaggggcctcctatgcacagatcttgcagcccagaaccaagtcagcctccctgcga

SEQ ID NO: 43819 - DNA, 201 bp, Homo sapiens
gggcagagccccccgtgtttcagatggaaaggttaagtaatgtgactctggtaatgcagtccagttcatttatgagatcatggacctcttatactacagaytttttgtgttttttttgctgagtcttttgctccctaaccgtgttccctggctggccaccctgccagcaccacgctggccctcaggaagcatcatcagcca

SEQ ID NO: 43820 - DNA, 201 bp, Homo sapiens
  misc_feature (1)...(201): n = A,T,C or G, or insertion/deletion polymorphism (see Tables 1-2)
tagtctcacaagatcagatggttttaaaaagcggagttgccctgcacacgctctcttctcttgtctgccgccatgtgagacatgcctttcaccttctgccntgacggtgaggcctccccagtcacgtggaactgtaagtgcattaaacctctttcttttgtaaactgcccagtctctctggtatgtctttatcagcagtgt

SEQ ID NO: 43821 - DNA, 201 bp, Homo sapiens
gtgctatagaagtgagagcaggtgcctggggacacttggaggcccccctaggtttgtctgtaatgagcttgtgctggcgactggcatgttctgtcccccccacggctcccagcgtgctcccagcgccctcccacagctttaggcaattaagacacgggcttggagtggccattgcaggacctgctggtaatgggggtgagg

SEQ ID NO: 43822 - DNA, 201 bp, Homo sapiens
tcaatctcctgatctcgtgatctgcccaccttggcctcccaaagtgctgggattgcaggcgtgagccaccgcgcctggccaatttttttttttatagagaygagtctcactgtggtgcccaggctggtcttgaactcctgggctcaagtgatcctcccacttcagcctctcaaagtgctgggattacaggtgtgccccact

SEQ ID NO: 43823 - DNA, 201 bp, Homo sapiens
tttcaccatgttacccaagatggtctcaatctcctgatctcgtgatctgcccaccttggcctcccaaagtgctgggattgcaggcgtgagccaccgcgccyggccaatttttttttttatagagatgagtctcactgtggtgcccaggctggtcttgaactcctgggctcaagtgatcctcccacttcagcctctcaaagt

SEQ ID NO: 43824 - DNA, 201 bp, Homo sapiens
aaaggtcaaggttgtagtgagctgagatcacgccactgcactccagtctgggcaacagggtgagaccctgtctcaaacaaacaaacaaacaaacaaacaaataaatagaagatacaatgaagagccaaatgaaaattttagaactgaaaaatacagtagccaaaatagaaaactccatggatgggtttgacagcagaatca

SEQ ID NO: 43825 - DNA, 201 bp, Homo sapiens
ccaatggaagaaaattggggttcagttagaccagccctgccccaccccagctcttcacacatccagatccagatgggggccagaccaccaggagactgtarggatccaaggccgaggggcaggagacgcagtgcgcccctctcctatttctgggttgcaaccgcccacacatgtgcacacagggaagatgtctcttttggt

SEQ ID NO: 43826 - DNA, 201 bp, Homo sapiens
gggaggtcccagccaggggaagtgtgtccccatccctgctctggtccccaggccagagaggtgagggacccagagaggcccaggatgaggactccttcagkcctgggtttttgtttggattttttttttctgccaagtgactttaaagccgcccgagaaggtcctgtatgtgtgagcaggttgggcaaggggagggcgggt

SEQ ID NO: 43827 - DNA, 201 bp, Homo sapiens
gaaaggtcaaggttgtagtgagctgagatcacgccactgcactccagtctgggcaacagggtgagaccctgtctcaaacaaacaaacaaacaaacaaacaaataaatagaagatacaatgaagagccaaatgaaaattttagaactgaaaaatacagtagccaaaatagaaaactccatggatgggtttgacagcagaatc

SEQ ID NO: 43828 - DNA, 201 bp, Homo sapiens
gactttaaagccgcccgagaaggtcctgtatgtgtgagcaggttgggcaaggggagggcgggtctccaagctgggagcctcctcgcggccctcgcctcggsactgatgtggccctggaccctccggtccctccaggccacccttcgtgccaggacccagctggcttcaatggcaggaggtgccctgggctggagggtcccc

SEQ ID NO: 43829 - DNA, 201 bp, Homo sapiens
  misc_feature (1)...(201): n = A,T,C or G, or insertion/deletion polymorphism (see Tables 1-2)
actttaaagccgcccgagaaggtcctgtatgtgtgagcaggttgggcaaggggagggcgggtctccaagctgggagcctcctcgcggccctcgcctcggcnctgatgtggccctggaccctccggtccctccaggccacccttcgtgccaggacccagctggcttcaatggcaggaggtgccctgggctggagggtcccca

SEQ ID NO: 43830 - DNA, 201 bp, Homo sapiens
ctgatgtggccctggaccctccggtccctccaggccacccttcgtgccaggacccagctggcttcaatggcaggaggtgccctgggctggagggtccccasgctgggctccggggctccaggttgactcagcagtccccaggcctgtgggcagagctggcctgggaggacacgggcctgagggctgagcaatccctgagtg

SEQ ID NO: 43831 - DNA, 201 bp, Homo sapiens
tgcaggcagggaccaggtcagagtcctttgtgtgcctcttgacccccaggtcctgggagaagaggggcttgggaggccttggctggatgcacaggctccaygggaaggagctcctgctcgggtttctttgtaagcagcacgacatggcaccttcccagaggtacatgggtctgggcatgtcattccccgacctgcttccag

SEQ ID NO: 43832 - DNA, 201 bp, Homo sapiens
gcccggcctcactacctccacctcatgaatcaccctctgtccttgtcctgcaagtctgtcggcacagccgagctggcgtcaccctctgatgccagtgcccrgatccctgaattcactgggcagccgccccctgcacctggctcccagccactgcctttccaaagcaaatggggacagggatacctgcccctccctgggtag

SEQ ID NO: 43833 - DNA, 201 bp, Homo sapiens
caagtctgtcggcacagccgagctggcgtcaccctctgatgccagtgcccagatccctgaattcactgggcagccgccccctgcacctggctcccagccaytgcctttccaaagcaaatggggacagggatacctgcccctccctgggtaggcagctgttgcggcctccagttgtgagagtctctgccccaccctgcccct

SEQ ID NO: 43834 - DNA, 201 bp, Homo sapiens
tcactgggcagccgccccctgcacctggctcccagccactgcctttccaaagcaaatggggacagggatacctgcccctccctgggtaggcagctgttgckgcctccagttgtgagagtctctgccccaccctgccccttcccctgcccctgcagggtagagaggaggcgggtgggccaccgactgggagtcccgggcagc

SEQ ID NO: 43835 - DNA, 201 bp, Homo sapiens
  misc_feature (1)...(201): n = A,T,C or G, or insertion/deletion polymorphism (see Tables 1-2)
cgggcagagctggtggggcagcttcagaggctgggatttgacatctctgagcaggaggtgaccgccccggcaccagctgcctgccagatcctgaaggagcnaggcctgcgaccatacctgctcatccatgacggtaggcctgtcggacaccaggacctcacgggggtgaaagctcccctttcccagggtgggggctgtgca

SEQ ID NO: 43836 - DNA, 201 bp, Homo sapiens
tgtgttttatatatagagagaaaggctaatgctttaagtttaaaaatcagtatttaaaagtttataagtaggctgggcatggtggctcacacctgtaatcycagcactttaggagtccaaggagggcggatcacctgaggtcagaagttccagaccagcctggccaacatggcaaaaccccatctctactacaaatacaaa

SEQ ID NO: 43837 - DNA, 201 bp, Homo sapiens
accttgtgggatctaggcaggtcattgctgttttgcaagtggggttgttgaagccacaggagatgaaataagctgctgtcccccagccattgagtgctgayaggatcaggagtgccagttggtgtggctgaccccagaccctgtgcgtgttacctctaagctacattctagagcagactttttgcccacacaagccttaaa

SEQ ID NO: 43838 - DNA, 201 bp, Homo sapiens
tttttaattctcaccattctggtgggtatgaaatcgtatctcattgtgtatttcagtttctttctttctttctttctttttttttttgagacagagtctcrctctgttgcccaggctggaatacagtggtgcaatctcagcccactgcaacctctgcctctcgggttcaagtgattctactgcctcagactcctgagtagc

SEQ ID NO: 43839 - DNA, 201 bp, Homo sapiens
ttcagagggattgcaatattttacacgtcctccatctgctgcagctgttcagtatcctcaccagaccttggtgttatcagtctttttaattctcaccattstggtgggtatgaaatcgtatctcattgtgtatttcagtttctttctttctttctttctttttttttttgagacagagtctcgctctgttgcccaggctgg

SEQ ID NO: 43840 - DNA, 201 bp, Homo sapiens
caaagtctaggagaagacaggcatgaacttccagttgtcccttcgaaatggagtcctactgggcacacttgattctcccagcgatgatgtgtgacaacacytgggaagcattggccaccagggaagctcactggagcctcagtgtccagggtttttgtgtagacattagcacctgtgtgactgactttagcgactcagtct

SEQ ID NO: 43841 - DNA, 201 bp, Homo sapiens
gcgaagagaggagacacatggggcaaagtctaggagaagacaggcatgaacttccagttgtcccttcgaaatggagtcctactgggcacacttgattctcscagcgatgatgtgtgacaacacgtgggaagcattggccaccagggaagctcactggagcctcagtgtccagggtttttgtgtagacattagcacctgtgt

SEQ ID NO: 43842 - DNA, 201 bp, Homo sapiens
  misc_feature (1)...(201): n = A,T,C or G, or insertion/deletion polymorphism (see Tables 1-2)
ttatgtaaatagaatcatacagtatataattgtgctggggcctccagtgctacccccaggctgaatgattcattagcaggactcacagaacttagaaaagntattacactcccagttagacttattaccgtgaaagaataaagattaaattcagcgaagagaggagacacatggggcaaagtctaggagaagacaggcatg

SEQ ID NO: 43843 - DNA, 201 bp, Homo sapiens
tgaaaggtcaaggttgtagtgagctgagatcacgccactgcactccagtctgggcaacagggtgagaccctgtctcaaacaaacaaacaaacaaacaaacaaataaatagaagatacaatgaagagccaaatgaaaattttagaactgaaaaatacagtagccaaaatagaaaactccatggatgggtttgacagcagaat

SEQ ID NO: 43844 - DNA, 201 bp, Homo sapiens
  misc_feature (1)...(201): n = A,T,C or G, or insertion/deletion polymorphism (see Tables 1-2)
tgctcacacgtgctcttctcccaagacactccctgaagcgcgttccccaggagctggaagggggataacgcaggtatgcctcatggcggggccagtgctcntgcttacacacactcggcctcagctcgtctacaccctgcaacagcccagagaagccacccgccttcttacccctaccatttagatttgcaaatggaagct

SEQ ID NO: 43845 - DNA, 201 bp, Homo sapiens
ctgaaaggtcaaggttgtagtgagctgagatcacgccactgcactccagtctgggcaacagggtgagaccctgtctcaaacaaacaaacaaacaaacaaacaaataaatagaagatacaatgaagagccaaatgaaaattttagaactgaaaaatacagtagccaaaatagaaaactccatggatgggtttgacagcagaa

SEQ ID NO: 43846 - DNA, 201 bp, Homo sapiens
  misc_feature (1)...(201): n = A,T,C or G, or insertion/deletion polymorphism (see Tables 1-2)
tctcccaagacactccctgaagcgcgttccccaggagctggaagggggataacgcaggtatgcctcatggcggggccagtgctcatgcttacacacactcngcctcagctcgtctacaccctgcaacagcccagagaagccacccgccttcttacccctaccatttagatttgcaaatggaagctcagagaggtgaagtaa

SEQ ID NO: 43847 - DNA, 201 bp, Homo sapiens
cctttcataatccaccggcaacatcagttaacatgtggcatatttccttcccgtctcctccactcccattttttttggacttcttaaacataattgagattgtgttttatgtacaattttatagcatgtacttgttagctttgaaacagacccatctgcgtttgcaatttggcctgcagggaaaagaccagattgctgagt

SEQ ID NO: 43848 - DNA, 201 bp, Homo sapiens
gcaggagctgtggccaccgtcctagccaggccggccacctgcccaaaatgttctctaaccttaacatgaacctgggccacttgggctctgctggatgcccmcagggctgccagagcctgcccgccacagagcccctctgagacctggagtctcacctgagccctctcgctgcccacagggctggcctctgcctttccgctg

SEQ ID NO: 43849 - DNA, 201 bp, Homo sapiens
  misc_feature (1)...(201): n = A,T,C or G, or insertion/deletion polymorphism (see Tables 1-2)
gaggtgggactactggcatgcaccaccacaccggctagtttttaaaattcttgcagagacagggtctccctgtgtggcccaggctggtcttgaactgggcncaagtgatcctcctgccttggccttccaaaatactgggattacaggcatgagccactacacccggcctggactcagtttctataatgggatatggcagtt

SEQ ID NO: 43850 - DNA, 201 bp, Homo sapiens
  misc_feature (1)...(201): n = A,T,C or G, or insertion/deletion polymorphism (see Tables 1-2)
ccatacagcttgtctggcagagcctcagcaggagcccgggtccccggacaccgaggctagctctttctgctgtggccttctcacagaccaaggtgggatcncagccttggtagccttgaagtctccctaacctggcaagacagtggagaagggggacagccagcgggacattccactgtagaataaatacatgcatggcaa

SEQ ID NO: 43851 - DNA, 201 bp, Homo sapiens
gccacccgcatgcatcccatgaggccgtccaagcccgtctgccctgcatcagagaggacaccccaatgcggggagggaggaacctggtgaagccaggagcrgtgggcaggggccagcaaggatccccaggcccccagggcagtgtgcatccggccttcttgcatgcccacctggcatcctgcctgccgcctcctgcctccc

SEQ ID NO: 43852 - DNA, 201 bp, Homo sapiens
tgcagctgaggcatgttttctggggttcctggctttggcctgcacggctgggtgggaggagggcatgggaggtgatgctgctcactgagcagggcctgctytgaccacctcgggatcaagagtcctgttagatgcccaggtagagacccttgctgggcgggcaggtggatcttcgagaatggagctccgagggacaggttg

SEQ ID NO: 43853 - DNA, 201 bp, Homo sapiens
cacccgcatgcatcccatgaggccgtccaagcccgtctgccctgcatcagagaggacaccccaatgcggggagggaggaacctggtgaagccaggagcggygggcaggggccagcaaggatccccaggcccccagggcagtgtgcatccggccttcttgcatgcccacctggcatcctgcctgccgcctcctgcctcccgc

SEQ ID NO: 43854 - DNA, 201 bp, Homo sapiens
tggagggggtaggggcagcctccccaggactgatctgacagacgggtatgtgcctcacccggcatcacccaccggggaggcctccgtccgcccccatgcartcatgctgggtccccccatctcgtgtcttctggggaatggagcggaagacctcccctctctggaaccaggggtgggagggactgtgctccccagaatgaa

SEQ ID NO: 43855 - DNA, 201 bp, Homo sapiens
acacacacaaatatacatacactcacgcccagacccccccacgccccaggccacacatgtgggcctgctcacaccccactcattccctcccagatgccgcrccacccccatgccctgtgtgccctctgcctctcggggccctggggccccagctccaagaaccacgggcttgctttagccaggcttccacaagcctgccca

SEQ ID NO: 43856 - DNA, 201 bp, Homo sapiens
aagccactttatatatttgggattctattaatccttctagtttgtacattttttatggcaccttcaatttttttcttttaaaaattaatgtatttttttttctgataatataagaaatgcatgccttctttggaaaatacagaaaatcacaaagaaaataatccacaatcccaccttccaaaaggaaccacagttagcatt

SEQ ID NO: 43857 - DNA, 201 bp, Homo sapiens
agcgcacagaaaagccactttatatatttgggattctattaatccttctagtttgtacattttttatggcaccttcaatttttttcttttaaaaattaatrtatttttttttctgataatataagaaatgcatgccttctttggaaaatacagaaaatcacaaagaaaataatccacaatcccaccttccaaaaggaacca

SEQ ID NO: 43858 - DNA, 201 bp, Homo sapiens
agtgggagatggggacaggtgagtggggtcttgaaacgtgaacaggagtttgcaggtggagcaggtttcaagagcattccagggcacagcatgggcaatgrcagggagagctgggatgtctgaagagcagcggcccagacactgagtggctggcgaggcgagggaggtccgcgggtggggcccagtcaggatggactcatc

SEQ ID NO: 43859 - DNA, 201 bp, Homo sapiens
cagcgcacagaaaagccactttatatatttgggattctattaatccttctagtttgtacattttttatggcaccttcaatttttttcttttaaaaattaawgtatttttttttctgataatataagaaatgcatgccttctttggaaaatacagaaaatcacaaagaaaataatccacaatcccaccttccaaaaggaacc

SEQ ID NO: 43860 - DNA, 201 bp, Homo sapiens
gagcaggtttcaagagcattccagggcacagcatgggcaatggcagggagagctgggatgtctgaagagcagcggcccagacactgagtggctggcgaggsgagggaggtccgcgggtggggcccagtcaggatggactcatctgccatgctgaggagctgggctatgatgtgggcaatagggagccacagcagtttacac

SEQ ID NO: 43861 - DNA, 201 bp, Homo sapiens
gaggggtccgtggggcctgtctgggcccagcacagcagcgcacagaaaagccactttatatatttgggattctattaatccttctagtttgtacattttttatggcaccttcaatttttttcttttaaaaattaatgtatttttttttctgataatataagaaatgcatgccttctttggaaaatacagaaaatcacaaag

SEQ ID NO: 43862 - DNA, 201 bp, Homo sapiens
gtctgaagagcagcggcccagacactgagtggctggcgaggcgagggaggtccgcgggtggggcccagtcaggatggactcatctgccatgctgaggagcygggctatgatgtgggcaatagggagccacagcagtttacacaggggaggcgggagcagctgagcatttagggaaaccactctggctgcaaaagaggagag

SEQ ID NO: 43863 - DNA, 201 bp, Homo sapiens
  misc_feature (1)...(201): n = A,T,C or G, or insertion/deletion polymorphism (see Tables 1-2)
gccccgagggccaggcactctggcttagtgaagaagccacccagcaaaggcctggtgtctccacaccattctcgggggggacagcagcaaggacgatggangggagcagtgctcggccttaacgtccctgtttccggaagcgtccctgccccgctcagtcctgccccactccctctcccatcagtgccctcagactccagg

SEQ ID NO: 43864 - DNA, 201 bp, Homo sapiens
acgatggacgggagcagtgctcggccttaacgtccctgtttccggaagcgtccctgccccgctcagtcctgccccactccctctcccatcagtgccctcaractccaggcccttttctttctttcccagcagtgctgacaactgtgagtgtggaactggactgtgaaccctggagggcagatggtggaggtgggagggggc

SEQ ID NO: 43865 - DNA, 201 bp, Homo sapiens
gagcagcgctgtgacccccacggggagccgtcagccaggcccgtagccagggaagggcggaggggcttaacgcaggcccacatggccaggacacagaaccrtgggggcagccccagcccttccctgcctgttacaggcccctgcccctgttcctgtgtcccatgcctgtcccctccctccatgtgtctgtctctactcgcc

SEQ ID NO: 43866 - DNA, 201 bp, Homo sapiens
gggatttgacatctctgagcaggaggtgaccgccccggcaccagctgcctgccagatcctgaaggagcgaggcctgcgaccatacctgctcatccatgacrgtaggcctgtcggacaccaggacctcacgggggtgaaagctcccctttcccagggtgggggctgtgcagagagcctctttcactgggccaaaccactgac

SEQ ID NO: 43867 - DNA, 201 bp, Homo sapiens
ccctgttcctgtgtcccatgcctgtcccctccctccatgtgtctgtctctactcgcctgccctctctctgccctcttttctctgcttcatcctctttttcygtttctgcctgtctcatggttcttcctgtccctgccctccctccctccgtgtgtggccgtgtctctctgtctgtctcttcctcctcctccagctctgtcc

SEQ ID NO: 43868 - DNA, 201 bp, Homo sapiens
tgcgctcgccccactgggtgtggcggcctgccgcccggctctgtggtgctggtcccctgcggtcattctcagcgtagcgcctggactgcccctcagccgcrgcttggctctgcagccagcgggacaggcccggcgctcagctcccgatacttagcatcctgcggtcagctccccgtgctcagcatcccgtgctccgttctg

SEQ ID NO: 43869 - DNA, 201 bp, Homo sapiens
aagccagccctgggctcaaagagcagtgaggccattttgagagaggaatgctccctcgtgcagagcctgtctccacctccatgagacgggaaggaacagtkgtcttctcataaaagcatctggcgcccatgaaacctggcacctcgcttgacctccggctaacgggatgcggcagggtgctgtggaactaatggagttctc

SEQ ID NO: 43870 - DNA, 201 bp, Homo sapiens
gtggatgttacttcatttggtgcgttctgagaacttgcccaggtgcagcctggattcgcgggtctcctatgaagtcaggagggaagaagctcggtgccgcyggccagtggcagcatcctgaagttcatgagacctccaggctgggtttgggcagggtccacgtcctgtctgtccatcccggaatgttggtgtccctgatga

SEQ ID NO: 43871 - DNA, 201 bp, Homo sapiens
  misc_feature (1)...(201): n = A,T,C or G, or insertion/deletion polymorphism (see Tables 1-2)
tggcacagctcatggtctagaggaataacctcaggtccaggtgagacactcagcctgtgatggcttcatatggtcactacgttgttgtatatggagagagnactctttcttggttttaaattttgtttttaattttataaatgtaatatattcacatggaaaatttggaaattataaacaatcaaaaagaagcagctaaaa

SEQ ID NO: 43872 - DNA, 201 bp, Homo sapiens
acagccgacacgaccagcctgcagtaccaggatagacaatttgggctggagccaaacttgatcagagggaggctgactttatcgagggctgctttgtggcrggcgttcattgtggaaagagcccaggaaggagctctctgccttgcaagaacattgcctgtggctcaaaatggccacatgggatgcagttcctgaggtggc

SEQ ID NO: 43873 - DNA, 201 bp, Homo sapiens
gttgtgatgtcttttgccagctctcttctgtagcttgaaattggccacggtggaagtatttacaccatggaagttggcaaatgcacggacccagcaccccyaccccatcccggagagccagttaccagcacacgtctgccttttggggtcttttgtgcaggactgatggatggagtcgcagcagacacttggcctggccac

SEQ ID NO: 43874 - DNA, 201 bp, Homo sapiens
cttgaacctgggaagtagaggttgcagtgagctgagatcgtgccactgcactctagcctgggcgacagagcaaaaccctgtctcaaaaaaaaaaaaaaaaattagtcaggcatggtggcacacacctgtagtcccagctactcaggaggctgaggtgggaggattgtttgagcccagaaggttgaggctgcattgagctga

SEQ ID NO: 43875 - DNA, 201 bp, Homo sapiens
  misc_feature (1)...(201): n = A,T,C or G, or insertion/deletion polymorphism (see Tables 1-2)
tcttgaccgttcatctgtgttacggtgtgtatcagagtttcacttctttttgtggctgagtaatattccactatgtggataggccacattttgttgatctnttatcagctgatggacatttggattgcttcctgatatggtttggctgcatcccaacccaaatctcgtctcgaattcccatgtgttgtgggaggtaattga

SEQ ID NO: 43876 - DNA, 201 bp, Homo sapiens
cctcctattccaacctggatggtggcctggagatcagggaacttttccatgctcacgactacagctctgtgcaccaggccagtgccaggcacgtagtaggygctcagtgacagtttgcagaagggtggatgttacttcatttggtgcgttctgagaacttgcccaggtgcagcctggattcgcgggtctcctatgaagtca

SEQ ID NO: 43877 - DNA, 201 bp, Homo sapiens
tcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggcttcaggagcttgctgagcaccc

SEQ ID NO: 43878 - DNA, 201 bp, Homo sapiens
cggtgcagcgcggttatttatagccctggtggagcgcccataaatcaaggctttccccagcagcgcggctgtgagggctccgagatgatctcatggtgccyctcccttgaaccatcccagagaaaggaggcctgtcaccttcaaggaccaatgcttctgccgggactcaagcagaacctgttcctgctgctgcaaggttta

SEQ ID NO: 43879 - DNA, 201 bp, Homo sapiens
aaattgcccttcctttgcagggtctcttgttcctattccaacctcctcctattccaacctggatggtggcctggagatcagggaacttttccatgctcackactacagctctgtgcaccaggccagtgccaggcacgtagtaggcgctcagtgacagtttgcagaagggtggatgttacttcatttggtgcgttctgagaa

SEQ ID NO: 43880 - DNA, 201 bp, Homo sapiens
gtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggcttcaggagcttgctgagcacc

SEQ ID NO: 43881 - DNA, 201 bp, Homo sapiens
cgtgtgcaggaaataagccggggggaagggggcaccgcgggtgggtgttaactgctgcttcggggtccagtcctgttaatgaaagcaggggtgaggcaagsggggaagactctctgtacctgatcagtggcatgtgtgtggctccagccggcatggcctgagctgccggtgagggagaggcctcagggagaaaagacaaaa

SEQ ID NO: 43882 - DNA, 201 bp, Homo sapiens
ggcccttgggcttgcagcttgatgtcttttccacgagtccacactgcagctccatgcagatgtcaaatatgaccgctgccttgttggggccggtttgtccrggaagggatcttgtgatcttggcgagggagccaggtcctgcctgtcaccctccccccaggtctgagtgacccaccccgcctgcctctgtaggttcctcta

SEQ ID NO: 43883 - DNA, 201 bp, Homo sapiens
ccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggcttcagg

SEQ ID NO: 43884 - DNA, 201 bp, Homo sapiens
caagggcacccagagcactgtgggaggactggtgccgcctccctgcccccctgctttctcctgggccactgggctagacatggggcctccctgcccccatrtggtttggcctgaaaaagagaggaggtggggtggcacttctggggcagcccagagtgagtgccctgccctgagcccagcgtgtgccccgcctgtgcccct

SEQ ID NO: 43885 - DNA, 201 bp, Homo sapiens
actagggtttcttaaaagtgcctcccggcccttgggcttgcagcttgatgtcttttccacgagtccacactgcagctccatgcagatgtcaaatatgaccrctgccttgttggggccggtttgtccaggaagggatcttgtgatcttggcgagggagccaggtcctgcctgtcaccctccccccaggtctgagtgacccac

SEQ ID NO: 43886 - DNA, 201 bp, Homo sapiens
cccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggcttcag

SEQ ID NO: 43887 - DNA, 201 bp, Homo sapiens
ccctgcccccatgtggtttggcctgaaaaagagaggaggtggggtggcacttctggggcagcccagagtgagtgccctgccctgagcccagcgtgtgcccygcctgtgcccctgggtggggggtgcatacagacctcggggggatctggccgttggagtgcgcactgggagggacggagtcagctctttttaatctaaaca

SEQ ID NO: 43888 - DNA, 201 bp, Homo sapiens
ctcaaactcctgccctcaagtgatccacccacctcgacctcccaaagtgctggggttacaggactgagccaccatgctctgccttatctgccctctcagtkgtcctccactccagcctcatttcctggctccaccttccacataccccacgctgctcgagttctttctatccgagagggtggggccagtgcacacctgcct

SEQ ID NO: 43889 - DNA, 201 bp, Homo sapiens
aggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcaccatgtggggctt

SEQ ID NO: 43890 - DNA, 201 bp, Homo sapiens
cacctggctaattttttttggtatttttagtacagacaggatttctccatgttgaccaggctgatctcaaactcctgccctcaagtgatccacccacctcracctcccaaagtgctggggttacaggactgagccaccatgctctgccttatctgccctctcagtggtcctccactccagcctcatttcctggctccacct

SEQ ID NO: 43891 - DNA, 201 bp, Homo sapiens
gctgagccccacctcccagccgtgggcattttctttggattgtcagtgtggggatgaccctgctcaactcctgactgggagcaggctggcctgctgggccrtgcccacttccagcactgaaagaatgggcccaggacgggggtcagccctcctgcagccctggtttgaattggaaactctgtccaccgatgcctggcacct

SEQ ID NO: 43892 - DNA, 201 bp, Homo sapiens
tgtcactaccactcatggctgtatttggggccctctctcactggtggggaatcgtgcctggcttatctgccccccttttttttttttttttttttttgcgrcagagtctcactgtgtgacccaggctggagggcagtggcttgatcttggctcactgtgacctccacctcctgggttcaagagattcttctacctcagcct

SEQ ID NO: 43893 - DNA, 201 bp, Homo sapiens
ctcccaccccaggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcacca

SEQ ID NO: 43894 - DNA, 201 bp, Homo sapiens
cccgtccctctgccaaagcgagccttttaggtgagccctgccggccacctgctagcccaggccccggctcctggtgggccctggaccaggctgcaagcatwtccaagtgcatggcagtgagacgtccaggcctcccagccccaactctgagcctccgttgggtcagcggtaagatggggcagtggcacctacctccccggc

SEQ ID NO: 43895 - DNA, 201 bp, Homo sapiens
ctctttttctgtttctgcctgtctcatggttcttcctgtccctgccctccctccctccgtgtgtggccgtgtctctctgtctgtctcttcctcctcctccrgctctgtcccagtagggccactccaggcaggatggtctgcggcccctcctgcttcaccctctccactctgtccccactgccgaggacacacctttgctgg

SEQ ID NO: 43896 - DNA, 201 bp, Homo sapiens
cctcccaccccaggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcacc

SEQ ID NO: 43897 - DNA, 201 bp, Homo sapiens
gggacagctgtctttgtgcttattgaagcactttaacgaagcagttttcacagctgcatactattccactgttcagactcccgtcatattcttgaccattycctattgatggagatgaggctgcttccagtttcgctcttgtgcgtaaccctgatgaacacatcttgtatgtacatcctcttgtacatttctaattatttg

SEQ ID NO: 43898 - DNA, 201 bp, Homo sapiens
gtctgcggcccctcctgcttcaccctctccactctgtccccactgccgaggacacacctttgctgggtttcttggttcagcttttgtaccgtgacatctcygaggtccacaggtcacagggcactggccagtgtggggcagggactcctcctgcccaggccattggacaaagcagagctgcttcaggggctttggggccac

SEQ ID NO: 43899 - DNA, 201 bp, Homo sapiens
gcctcccaccccaggcccacccacctgctgggtcctcccacctgcggggcccgccatgcggggtcaccatgcgagtctcaccatgcagggtcaccacacgagtctcaccatgcagggtcaccacgcgagtctcaccatgcagggtcaccatgcggggtcaccatgcagggtcaccatgtggggtcaccatgcggggctcac

SEQ ID NO: 43900 - DNA, 201 bp, Homo sapiens
  misc_feature (1)...(201): n = A,T,C or G, or insertion/deletion polymorphism (see Tables 1-2)
tgcccaggccattggacaaagcagagctgcttcaggggctttggggccaccaggccaggaacaggtcccctcctgcctaccccagctccctgggagacacngcccacagcagcgtcacgtaattaagacataaaagtccacgatttccgctgcgtgtgggcaaacaccggccgggtgctaatgcaatcctttcttttagtg

SEQ ID NO: 43901 - DNA, 201 bp, Homo sapiens
cttaccaacaccatgatttctggctttttttttttaaagtggtctttgagttttgctgttagtcttgttccttatgaaggtgtccgaccacagtggcaatyactcagcattgcactgtctccaggtctctgtgggagcctgggttcctttggggcctggattcagggctcatcctagagtgagctgtcatctcagggcatc

SEQ ID NO: 43902 - DNA, 201 bp, Homo sapiens
ggcaaacaccggccgggtgctaatgcaatcctttcttttagtggattcttgaatttaaatgatatgtaattaaacataattagccacggacgccattcggytaggtacacgtgcggagtggggctggccggattctcattacaaagcgtcatcttctatggggagacctcttgttccctctcggggctggttgcttttgcc

SEQ ID NO: 43903 - DNA, 201 bp, Homo sapiens
gtctcgcggtggcttgcggctaccagtaactggcagaattctcaacattgtggccctcagccacctcctccgagctctctctcagcaccaccatccgccgwggcttctctgagggaggcccctctggcctctgcttgactatgatacatgtcgagtccatgccgagtggcagaaaagctccgttttcagctgaaactacct

SEQ ID NO: 43904 - DNA, 201 bp, Homo sapiens
cagcctggcagggctgatgcaggcccatgcacacaggccaggcagaggtgagaccagggaatagaagcgttgcaggggcagagggcaggagggggcagagyctcggcgtaggagtgagcctactggtccttcccgcaggcaccctccctagtgccaggtctgctgggactccaggctgttggtatgccccctagggtcctg

SEQ ID NO: 43905 - DNA, 201 bp, Homo sapiens
gatgattccttggttatctgaaggcctgtttgggagacggttcccaggacagttgcttcaggcttatatgtgtgtgctttctggaattcacagcatggcgygccctggtgagtggtggggagatgggtagtgaacacgtgtggtagcccctgctgggcgtgtcccacctgtcctccatgtcctacaacctggttggcccct

SEQ ID NO: 43906 - DNA, 201 bp, Homo sapiens
acatcagtgtgtccgtccgcctgcctgtctgccccccaccagcctgtgtgcccaggggaaggctcaaggccggtcatgctctacctccctggccagcccasccccagcccacggtgcattccctggacaggattgctgagttttccattttagccacaacagcgcccacacccgcgccaaccaacctgtccttgccacgaa

SEQ ID NO: 43907 - DNA, 201 bp, Homo sapiens
aagttgcctgaggtcacgtggctggtagggggcggagccagctttatcctcatggcacagatgaggaaactgaggcagagaggtgttttgccagggggctratttactgagctagccagccgttctggttttgtctctgtctcgctcagagggtcccccaccccacccacctgcctacccagcttgccgtgtcctcggcca

SEQ ID NO: 43908 - DNA, 201 bp, Homo sapiens
gagacgggtttcaccatgttgcccaggctggtctggaactcctgggctcaagtgatctgcctccctcggcctcccacagtgctggaattacaggcatgagycactgcgcccagcttttaatcagattttggagtaggggagtgagaggagctggttggtggtggtttttttttctttaaaattattattactttttttttc

SEQ ID NO: 43909 - DNA, 201 bp, Homo sapiens
  misc_feature (1)...(201): n = A,T,C or G, or insertion/deletion polymorphism (see Tables 1-2)
tcatggcacagatgaggaaactgaggcagagaggtgttttgccagggggctgatttactgagctagccagccgttctggttttgtctctgtctcgctcagngggtcccccaccccacccacctgcctacccagcttgccgtgtcctcggccagggccagcagtctcagaggtagagctgctgagagaagcctgtcatctgt

SEQ ID NO: 43910 - DNA, 201 bp, Homo sapiens
ggcacagatgaggaaactgaggcagagaggtgttttgccagggggctgatttactgagctagccagccgttctggttttgtctctgtctcgctcagagggbcccccaccccacccacctgcctacccagcttgccgtgtcctcggccagggccagcagtctcagaggtagagctgctgagagaagcctgtcatctgtcctc

SEQ ID NO: 43911 - DNA, 201 bp, Homo sapiens
gaagcctgtcatctgtcctccaagagggatctgagtaagccggagagcatcagcagcctcaaggggaccttggacccctgcccacctttcattctgtaccrgggcagggtgtgtctgcacagcctggagccaggtgtggctggcagccccaggaagacagggccaaccctgcccagcccagagcagccgcatctctgcagc

SEQ ID NO: 43912 - DNA, 201 bp, Homo sapiens
caatctccattgctttccaaaaggggagcgactgaagatctgaaaattagacagtggctagcactgcccagaggccccgttattaaaaacatttcaaggcygggtgccggtggcttacgcctgtaatcccagcactttgggaggctgagactggcggatcacgaggtcaggagttcaagaccagcctagccaacatagcga

SEQ ID NO: 43913 - DNA, 201 bp, Homo sapiens
cctctctgaggaaactgaggcattgagcttgtatttctctgcactggttcccatttcagtagtaatagggaccctccagcacaccaggtgatgtctgcaaygtggccccagaggcaggagcaggctgggagttaggaggctgaagcctgatgtgggggagcgctgccccccaaccccactccctgggaaccaaccctccac

SEQ ID NO: 43914 - DNA, 201 bp, Homo sapiens
tgtactaaagacaccatcctaggccctggggatgtgcagcagtgaacaggtggagccgatgctgcagtcatgggggaccagcaggcgacagcgtgcactcrggaaggctagagcatctgagacacgcagtgaggtggggagccctgggctgggtacctggcctcgcagatcccatggcgagggagctgggattggaggatg

SEQ ID NO: 43915 - DNA, 201 bp, Homo sapiens
gtccccaggccagagaggtgagggacccagagaggcccaggatgaggactccttcagtcctgggtttttgtttggattttttttttctgccaagtgacttraaagccgcccgagaaggtcctgtatgtgtgagcaggttgggcaaggggagggcgggtctccaagctgggagcctcctcgcggccctcgcctcggcactga

SEQ ID NO: 43916 - DNA, 201 bp, Homo sapiens
tagtgcctactttctttattttcagtaatttaaaataaggaagaggcaacctggggctggtccctggtggtcagaatgggtctctggtgacggctcaaagsggggtgtggtccggggcgcagaaggacagaacccaatgggagcggacttaccccagcatttcacatccgatttttcagggatagatttcgtctctaaaac

SEQ ID NO: 43917 - DNA, 201 bp, Homo sapiens
gtcaggtgcagctgggcagggggcaggtcctcaaaaggactttgggtttttgtttttttttttagacagagtctcactctatcaccttggttggagtgcartggcacgatctcagctcactgcaacctccacctcccaggttcaagctattctcctgactcagcctcctgagtagctgagattataggcacctgccaccat

SEQ ID NO: 43918 - DNA, 201 bp, Homo sapiens
ctgccaccatgcccggctaatttttatatttttagtagagacagggttttaccatgttggccaggctgatctcaaactcctgacctcgtgatccacctgcytcagtctcccaaagtgctgggattacaggcatgagccactgcgcccggcccccaggactttggtttctactgttgctgatgctgggagctgtagcagctg

SEQ ID NO: 43919 - DNA, 201 bp, Homo sapiens
catggctctgaccccccgcttttccccatgcatcagtggcggggcagacgctgaaggggccctggaacaacctggagcgtctggcagagaacaccggggasttccaggaggtggtgcgggccttctacgacaccctggacgctgcccgcagcagcatccgcgtcgttcgtgtgagtccatgccctgtctctctggcctcat

SEQ ID NO: 43920 - DNA, 201 bp, Homo sapiens
cctgggagacgtcgctctcttgccacttgaaggaccggatatgactggctttcgggtgagtgacccctcaggactcctcaccttcagccccctcctcctamtggggactcaaagtacctttcctgtgctctaaacctgcaaactccatctctgcaatggccctgcagctctgtggagcccaggcttcctgccaggcggctg

SEQ ID NO: 43921 - DNA, 201 bp, Homo sapiens
tggagggcctagacctagacggggaggactggctgcctcgggagctggaggaggaagggcctcaggagcagccagaggaggaggtgaccccagggcatgargaggaggagcctgtggcccccagcactgtggcacccaggtggctggaggaggaggccgctctgcagctggccctccaccggtcactggagcctcaaggtc

SEQ ID NO: 43922 - DNA, 201 bp, Homo sapiens
cagcccctgacccaatggcctctccctgcccccagaggaggtccgagaactgctggccaccctggagggcctagacctagacggggaggactggctgcctygggagctggaggaggaagggcctcaggagcagccagaggaggaggtgaccccagggcatgaggaggaggagcctgtggcccccagcactgtggcacccag

SEQ ID NO: 43923 - DNA, 201 bp, Homo sapiens
ggcatgccatggataataatcacatcaaggtaaatggggtatccatcagctcaggcattttgtccttcgtgttacaaacaatccagttatactcttggagwtgttttaaaatgtacaattattcttgaccacagtcaccctttgtactaacaaatacgatgtcttgttttcacactagagaccctgaacgctcgcttgtct

SEQ ID NO: 43924 - DNA, 201 bp, Homo sapiens
ctcacttgacctcaccccctgccctgctctgtgctcccatctgtctactgacccatcttaggcccaccctgtaccctaaaaacttgctccccatctttcayccattccaactcctcctgggtccagcccctgacccaatggcctctccctgcccccagaggaggtccgagaactgctggccaccctggagggcctagacct

SEQ ID NO: 43925 - DNA, 201 bp, Homo sapiens
tggggctgggcagacccagccgaccgtccctctcctgcagaaatctgacaggctttctgtcctttcccttcctccaagtggcagaacgagtgttgcagcargagcaccggttgcagggctcagagctgagccttgtcccccactacgacgtcctggagcccgaggagctggctgagaacaccagtggaggggaccacccgt

SEQ ID NO: 43926 - DNA, 201 bp, Homo sapiens
ttttccccatgcatcagtggcggggcagacgctgaaggggccctggaacaacctggagcgtctggcagagaacaccggggagttccaggaggtggtgcggrccttctacgacaccctggacgctgcccgcagcagcatccgcgtcgttcgtgtgagtccatgccctgtctctctggcctcatggcgtcctgggctcttgca

SEQ ID NO: 43927 - DNA, 201 bp, Homo sapiens
tggctgaagggacagcctgggtgccctgatattctaatgcctgacatcctgccccgcccctgcccacagacgccgagagggtcttggcccaggcagatcaygaactacatggtgcccagctgagcctgcggccagctccaccacgagcccctgcacgcctgctgctccaaggactgccccctggcaccacgccccagcgct

SEQ ID NO: 43928 - DNA, 201 bp, Homo sapiens
tgtcattttacaaggctcaccctgacacctctgttgaggacccaccatgggagtggcagacagagactagttaagaggttagcctagctacctagcgagaratgctggaggctgggaccagggtcggggcagcagaggtgtggcatgtgcagggctaggagtgcaggctggccagggtcctcagctccctggagggaggaa

SEQ ID NO: 43929 - DNA, 201 bp, Homo sapiens
aacccgggaggcggagcttgcagtgagccgagatcgtgccactgcactccagcctgggcgacacagccagactccctctcaaagaaaaaaaaaaaaaaaaacttgcagggttttctttcactctgaaggttgaggtttcctggcacgtgggtgccaggggcgttgtctttcctcattgtccttcttggcatttcacggatc

SEQ ID NO: 43930 - DNA, 201 bp, Homo sapiens
gaacccgggaggcggagcttgcagtgagccgagatcgtgccactgcactccagcctgggcgacacagccagactccctctcaaagaaaaaaaaaaaaaaaaacttgcagggttttctttcactctgaaggttgaggtttcctggcacgtgggtgccaggggcgttgtctttcctcattgtccttcttggcatttcacggat

SEQ ID NO: 43931 - DNA, 201 bp, Homo sapiens
aggctttctgtcctttcccttcctccaagtggcagaacgagtgttgcagcaggagcaccggttgcagggctcagagctgagccttgtcccccactacgacrtcctggagcccgaggagctggctgagaacaccagtggaggggaccacccgtccacccaggggcctagggctaccaagcatgctctcctgaggaccggagg

SEQ ID NO: 43932 - DNA, 201 bp, Homo sapiens
gggaaccgcccatgctcagcacctggcaggtgtgagggaccaggagcagggttgagaaggttgctgggggcgttgaaggccagccttggccgggggcgggcctggagacccagcactttgtgtgcagagggtgtcatggacacagaggcttggagatcctgagtgaggggcagtgactcaggccccttggtgggtttagtg

SEQ ID NO: 43933 - DNA, 201 bp, Homo sapiens
ttggccagcccccggccagaccgggctctggtccagttgcccaagcccctttctgaggcaggtgagaggcagggttggggttgaggtgctggctagggggkattccctgagctgacctgcacataccccacagatgtccgtgtcctggaggagcaggcccagaatctgggcctggaggggaccttggtgtccctggcccgg

SEQ ID NO: 43934 - DNA, 201 bp, Homo sapiens
ctggtaagcctgaggcctgtggggttgcaggaacaggaggggcccatgagcctggggcctgtggggtctgcaggcccagtggagacctctaaggggttgcyggggcaggagggcctggtggaaattgccatggactcaccagagcaagaggggctggtgggtcccatggagatcaccatggggtctctggagaaggcaggg

SEQ ID NO: 43935 - DNA, 201 bp, Homo sapiens
gaactgctggccaccctggagggcctagacctagacggggaggactggctgcctcgggagctggaggaggaagggcctcaggagcagccagaggaggaggygaccccagggcatgaggaggaggagcctgtggcccccagcactgtggcacccaggtggctggaggaggaggccgctctgcagctggccctccaccggtca

SEQ ID NO: 43936 - DNA, 201 bp, Homo sapiens
ctctaaacctgcaaactccatctctgcaatggccctgcagctctgtggagcccaggcttcctgccaggcggctgaggagtttctgcggagcctgctgggcrgcattagctgccatgtgttgtgcctggagcacccgggcagcgccaggtttctcctgggcccagaagggcagcaccttctccaggggctggaggctcagtt

SEQ ID NO: 43937 - DNA, 201 bp, Homo sapiens
tcccgggttcacgccattctcctgcctcagcctcccaagtagctgggactacaggcgcctgccaccacgcccggctaattttttaaaaaatatttttagtrgagacggggtttcaccatgttagccaggatggtctcgatctactgacctcgtgatccgcccgcctcggcctcccaaagtgctgggattacaggcgtgagc

SEQ ID NO: 43938 - DNA, 201 bp, Homo sapiens
gcctaacgtcctcacaagctgcgaggggctgaggcttggggatgcagcaggactggaggccaggccacctccctgcttagctcccaagtcctcttgggggrgcagtgactgacacaggcagggtacatcctgctgccagccttcccacccggggcccagaccccacctgccctcccgcccttggagggccggcctctccca

SEQ ID NO: 43939 - DNA, 201 bp, Homo sapiens; identical to SEQ ID NO: 13642

SEQ ID NO: 43940 - DNA, 201 bp, Homo sapiens; identical to SEQ ID NO: 13696

SEQ ID NO: 43941 - DNA, 201 bp, Homo sapiens; identical to SEQ ID NO: 13649

SEQ ID NO: 43942 - DNA, 201 bp, Homo sapiens
tgcctccagtctcggacttggttgttgcgcgctccggctccggctgagctgggagagttggaggaggtggcggcgggcagaggtgatgtctgggagccctyccttgacagcccgggccgagaaggtgagcgtcgacgctggtcgtgggggcggaggtaaggggcccggggcggggacgtagaggaggcgcgagggcggact

SEQ ID NO: 43943 - DNA, 201 bp, Homo sapiens; identical to SEQ ID NO: 13693

SEQ ID NO: 43944 - DNA, 201 bp, Homo sapiens; identical to SEQ ID NO: 13677

SEQ ID NO: 43945 - DNA, 201 bp, Homo sapiens; identical to SEQ ID NO: 13678

SEQ ID NO: 43946 - DNA, 201 bp, Homo sapiens
aagaacataaagtacattgatttctttattacggctagcagatatttaagaatgttagcacaggtctttgaataaattttgcttctgagagaagttactakttattcttaattcgatggggaggaaagcctttgaagaggaaactctactttttgcattgctctatcacccaggcttgagtgcagtggcacaatctcagcc

SEQ ID NO: 43947 - DNA, 201 bp, Homo sapiens
tgtcattatcccctaagaaagggaaccgctatttgtactgcagttgctgtatattagttttgctcatttttggattttatataaatgaaaccatagagtargctgtcttttatatctggcttccttcattcaacaatgtgcgtgcaagactcctccctgtagccgtgtatagtagtcatgtgctctttcttcttgctgccc

SEQ ID NO: 43948 - DNA, 201 bp, Homo sapiens
gtgtaaaaagctgaaaaacttctatccatttattctactactctgaggactggagataatcttttggcccgtttctaatagtctatttctttttctttatkagtttattagtaggttatgcagacaattttgtgttctgtttttatcatttaaaacgatctcacatattacccatttctttaaaatagtttgtaaatctct

SEQ ID NO: 43949 - DNA, 201 bp, Homo sapiens
gtccaccttactgctgtgtccagtttccattggctggaaccgggcttcacattctgtatttgtcctgattgttttgtgcaatgttgagaaaggtaaaaaccttcaaatgaggaagaggaacatgctatgacctaatgcttgcttggaccagtataagcatgccagggcaaatatttaggctaaattgtgggagccaagaac

SEQ ID NO: 43950 - DNA, 201 bp, Homo sapiens
tttttacaaaaaggggccctgagctcagctcctgggggggcttgtttgcttttaggccatggctttgtctgttgggaaaggaatcttcacaagtcctgacrcctctccaggcctcagtctccccactgttaaaatcaaaagagcaggaaaatagtatcagaattgtggacagagactagacttggtcagacagaatggggg

SEQ ID NO: 43951 - DNA, 201 bp, Homo sapiens
gtggtattttgtcactgccctgaagatttgtggaactttggacttgagagagatgatttaggtatctggtggaagaaatttctaagcagcaaagcattcawgatgtgacttgggtgctgttaaaggcattcagttttataagggaagcagagcataaaactttagaaaatttgcagcctgactatgcaatagaaaagaaaa

SEQ ID NO: 43952 - DNA, 201 bp, Homo sapiens
taaagacagggataatcagagatggggtggaggtgggctgaggtgaacgcgaatgcagaacttagcaatttgccaggtatttgggagcttaaaaaaaaaaagtagaagggaaagaggaaggaaagtgctactttttgagtatctctgaaggattaggcaagatgtgattttattcctattattcataagaaaatcagggct

SEQ ID NO: 43953 - DNA, 201 bp, Homo sapiens
taagtctcatgagatctaatgggtttatcaggggtttccacttttgcttcttcctcattttctcttgctgctgccatgtaagaagtccttttcacctcccrccatgattctgaggcctccccagccatgtggaactgtaagtccaattaaacctctttttcttcccagtcttgggtatgtctttatcaacagcatgaaaac

SEQ ID NO: 43954 - DNA, 201 bp, Homo sapiens
gcagagtgcctggcccatcaaggcatacaataaatgtttgttgaatgaatgaacaatgaatgaatataactgtgtcttaaccttggtctgggctcacatcracctggcctggaatgacccagctgtcaggttagttcccctgggcccatcccacacatctgagtttggattctcccagaagcagaacctgggacagacttg

SEQ ID NO: 43955 - DNA, 201 bp, Homo sapiens
ttgctaatatttttcctgatagcataactgaagcccagagagagatgtgacttcatctcacatttattctattcattcactcattcatccttttacgcacwtttttgcccctacaaatatttcttgtgcacctactatgtcctcagccctggtttaggagcctgagatgcaaagacgaatggaaaggcatccctttcccct

SEQ ID NO: 43956 - DNA, 201 bp, Homo sapiens
gctcttttgccttcaccctttaacctgagccagtgggacgcagtgacctggctgaggactgtgttctgcagactcatacattacctcagagggaagctaaraaccagaacgctgccagaactgtctctttcttcctctctcttcctcatcgtcattatcatctcctcaagtcagttttctctgcttctctgttcctacggc

SEQ ID NO: 43957 - DNA, 201 bp, Homo sapiens
ggtcagacacaatctctattttgttctcaccagaaaccttgtgcctagcagagtgcctggcccatcaaggcatacaataaatgtttgttgaatgaatgaayaatgaatgaatataactgtgtcttaaccttggtctgggctcacatcaacctggcctggaatgacccagctgtcaggttagttcccctgggcccatcccac

SEQ ID NO: 43958 - DNA, 201 bp, Homo sapiens
cactcaaaagcattattgctaaggtttgaatatttgtcccctccaaaactcatgtcgaagcttaatccccactgcagcagcattgagaggtagggtctttaggaagtgattgggttcattcatggacccaatgggattagtccatttatgaattaatggattaatgcattaatggattaatgggttatcatgggactggga

SEQ ID NO: 43959 - DNA, 201 bp, Homo sapiens
tttatagtggggttctctgggcctctttctgtgattacacaggatttctcttggggagaaatcatatacagactgtaggactcacttctctgtggttcccygtcatctggtatctagtcccttatgtcatggccactttttactccaaactctaatttttccagtctgcagcacaaaagagggtcctcatcagaaccacac

SEQ ID NO: 43960 - DNA, 201 bp, Homo sapiens
aaggaagacgtgtccttttgttgattttcacatgggaagacaagggtgtgtgtgtgtgtgtgtgtgtgtgtgtgtgtgtgtgtgtgtgtgtgtgtgtgtggtgagacacaagggttgaaaactaactggttctcagtttgtggtgtttcctgccatcagcaatggccttggggatgactcccactcctcccttctagcccc

SEQ ID NO: 43961 - DNA, 201 bp, Homo sapiens
ttaaggaagacgtgtccttttgttgattttcacatgggaagacaagggtgtgtgtgtgtgtgtgtgtgtgtgtgtgtgtgtgtgtgtgtgtgtgtgtgtgtggtgagacacaagggttgaaaactaactggttctcagtttgtggtgtttcctgccatcagcaatggccttggggatgactcccactcctcccttctagcc

SEQ ID NO: 43962 - DNA, 201 bp, Homo sapiens
aaccccatcaaaaagtgggcaaaggatatgaacagacacttctcaaaagaagacatttatgagccagcaaacacatgaaaagaagttcaacatcactgatmgttagagaactgcaaactaaaacgacagtgagataccatctcatgccagttggaatggcaattattaaaaagtcaggaaacaatagatgctggtgaggct

SEQ ID NO: 43963 - DNA, 201 bp, Homo sapiens
tcttcttaattaattcaagacaagtaaatgatacgaggcctcataggcttcgcggggcagcttcctggtgactaatatttgaagcaataaaaggagccagrgcattcctgcttcttaatggtctccagtcatccccaccctcgacccagccccacacagccccagcctcctccggcttgggtcagaaaatagcatggacca

SEQ ID NO: 43964 - DNA, 201 bp, Homo sapiens
ttgggagatgtgcagcagccccaacctgggtgggcgctggtgctcttttccgctcatgaatcatctgagctcaacattggctaacgtgccctactggaacytgagctcccacctcaatccccaccccacccccagaaccagcggcaggctggcagcccctcttcctgtgatccatctttcagagatgtgtgcggcttggcc

SEQ ID NO: 43965 - DNA, 201 bp, Homo sapiens
cttgacttaggaaattaaggaagacgtgtccttttgttgattttcacatgggaagacaagggtgtgtgtgtgtgtgtgtgtgtgtgtgtgtgtgtgtgtgtgtgtgtgtgtgtgtggtgagacacaagggttgaaaactaactggttctcagtttgtggtgtttcctgccatcagcaatggccttggggatgactcccact

SEQ ID NO: 43966 - DNA, 201 bp, Homo sapiens
caggcagcagtttaatctgaagcaaatcctaaaatagtcctcaagaagatgagcacatcccagctctaattcgccctccaagtgcctcgaaagatcttttytaacaaaaacacagaaatgatttttacaatccaaccaaccatcagctccatgaaccttgagagagacgggaaggcagccgcaacctctgcgaactgaaat

SEQ ID NO: 43967 - DNA, 201 bp, Homo sapiens
cccttaggactcctgcagctctgctgaaccctgagtgcaagggtgacccccggccccagggcgtcatggagacagccaggggagggttgactccctccttrccaaccttgccgctgttcctgctacagggccgggggtgggggtgcccctttggcatggtggcatgcctttctcttgtcaccacaaattctttacgaagat

SEQ ID NO: 43968 - DNA, 201 bp, Homo sapiens
caaatcctcaaaccacccgaggaagtgggtcctgatgccctattatatatggggaagctgaggcacagagaacttcagtaacacattcatggtcaccaacmccacaagcatccatcagaacctggaaaggagatgattttctgcaccgaagctaacctggaaatgtatgaattctgtggatactttcttaggaaccatggg

SEQ ID NO: 43969 - DNA, 201 bp, Homo sapiens
gtctatgaatgcaacctcatctggaaatagggtctttgcagacataaccaagttaaaaggtggtcatactggagtagggtggtgtcttagtccatgttgcrttggcataaaggaatacctgaggctgggtaatttattaagaggtttatttggctgaggattctgcagactgtacaagaaggatggcattggcacttgctt

SEQ ID NO: 43970 - DNA, 201 bp, Homo sapiens
ttatgggaaagctctttatatttgggacaccccagtttgttcattcagcacattttcttttcaacttttttagagacaaggtctcactctgtcacccagaytggaatgcagtagcgtgatcatagctcactgtaacctcgaactcctgggctcaagtgatcctcctgcctcggcctcccaggagctaagggctacaggcgt

SEQ ID NO: 43971 - DNA, 201 bp, Homo sapiens
gggacccagtctactgtcaggaaagatggaggtcacctgattatgatctgcaggtagagaaagcatcaaaggctgaaggagaacttgtgtgacagtcaggwgagtcagactgaagtctcaatatagggatagagggttcttcagagacacagcaccaataggatgtgtgcgtgtgtgtgtgtgtgtgtgtgtgcgtgtgtg

SEQ ID NO: 43972 - DNA, 201 bp, Homo sapiens
tccgttctgctggcatccgggctcttctctgccataacgtttcgctcacagcattatctcttaatttatctctctcacctggaagaaagaacctctttatrtttctctgttcagaaccaggtctgccacagataaggcattcaggaagtatcagttggttgaatcaaatgactaattaatgttttggccctgtggaatgga

SEQ ID NO: 43973 - DNA, 201 bp, Homo sapiens
ttgtttggaaatgacattttaacaacaggctccaagtacaggatcagaagtttttggtattcaagagttaatccagccacaaaaagaaggaaattctgtgyggaggaatcaggcgctgcgcttgcctggaaacacaggattgggccagatgggttgtctgaggtctcctttagtttgattgtttattatggttctaaggga

SEQ ID NO: 43974 - DNA, 201 bp, Homo sapiens
tgcagtagcgtgatcatagctcactgtaacctcgaactcctgggctcaagtgatcctcctgcctcggcctcccaggagctaagggctacaggcgtgtgccrccactcccagctagttttttaatttttaaaaattttttgcagaggtggcgtcttgctatgttgaccaagtttgtctcaaattcctggcttcaagccatcc

SEQ ID NO: 43975 - DNA, 201 bp, Homo sapiens
tctgcgtgcaggctaattcctgtaagaaattccctcttcccttaggactcctgcagctctgctgaaccctgagtgcaagggtgacccccggccccagggcrtcatggagacagccaggggagggttgactccctccttaccaaccttgccgctgttcctgctacagggccgggggtgggggtgcccctttggcatggtggc

SEQ ID NO: 43976 - DNA, 201 bp, Homo sapiens
ctggatcacactggagttagcccctgggtccctgatatatcttggctttcattgcctatgtgcaaaatctatgggctatacaataacaactctcattggtmatcagtccatagaacagtagggacaattggtgcagactaatgtttttcagttttgcaaatctgcctttgtaaacatccatgtttagtatagacttccttg

SEQ ID NO: 43977 - DNA, 201 bp, Homo sapiens
ttctattctaattcaattagaagtattttcttctactaataataaagccatttccttcttttataattatattataattattgatgaaaagagcaaagtcrttttttttttttgagatggagtctatttttgtcatccaggctggagtacagtggcatgatctcggctcaccgtaacctccgcctcccaggttcaagtgac

SEQ ID NO: 43978 - DNA, 201 bp, Homo sapiens
aatttgcagcctgactatgcaatagaaaagaaaacccattttctggggagaaattcaagctggctgcagaaatttgcataagtagtgagaagcctaatgtkaatccccaagaccatggggaaaatgtctccaggccatgtcagagaccttcatggcagcccctcccatcacaggcctagaggcccaagaggaaaaagtggt

SEQ ID NO: 43979 - DNA, 201 bp, Homo sapiens
gccctgctggcaaacatcagcccaagcctgccactaggagcttggttgcgggcagcttggaagggggcagctcccagaggagccaggttctccaggcctcmgcccctcaggtgcccttctccagacgcatgccgcttcttggattttcctgcaaaccttcgcctgtctggccctgctggtgccggacctgtgtggcaaggc

SEQ ID NO: 43980 - DNA, 201 bp, Homo sapiens
cagtctgcagaagaaatccgctctgctgccacccggcctccagaatggggaggaagagaatctgtgatgtctgaaggtgtccggtgtggccctgtgatgcrgcagccccgggaaccgagcacagccccccattgcctcctgaagcaggcccgctggaccatctcttcccactgcaggccacccccactcttctcccaggcc

SEQ ID NO: 43981 - DNA, 201 bp, Homo sapiens
cacagaagtcaagaactgaggtttgggaacctccacctagatttcagaagatgtatggaaatttctgaatgcccaggcaaaagttttctgcaggatggcarccctcatggagaacctctgctatggcagtgcagaagggaaatgtggagttggcgtccccacacagagtccctattggggcactgcctagtggagctgtga

SEQ ID NO: 43982 - DNA, 201 bp, Homo sapiens
aagatgtatggaaatttctgaatgcccaggcaaaagttttctgcaggatggcagccctcatggagaacctctgctatggcagtgcagaagggaaatgtggrgttggcgtccccacacagagtccctattggggcactgcctagtggagctgtgagaatagggccactgttctccagctcccagaatgattgatccaccaac

SEQ ID NO: 43983 - DNA, 201 bp, Homo sapiens
atccttttcgtcatcaccaccaccatcgtcacgaccaccgttattaccatcagatgggctgttggtgtttccatgggacagatctgtcatagtaagtctgwgtgatggtttaggacttgaagctgattttttctggcttgtggtagttaaaaatactatcctgacgttctctccactgtttattgttttagaaaatctatt

SEQ ID NO: 43984 - DNA, 201 bp, Homo sapiens
aataaggaagttcaaccaatccctgttgggtatattaggtatattagtttggggatagtgggtataatagtttgcaggggtttacaaaacaaaatatcacmaactgggtggcttaaacaacagaaattaattttctcataattctggaggctagaaatccaagatcaaggtgtcagcagcttaggtttcttctgtggcctc

SEQ ID NO: 43985 - DNA, 201 bp, Homo sapiens
aagaactcccatgcctatcagcagcccctcctgatttcctcctcctccagcccctgacaaccacgaatctgcttttgtgtctctagatttgcctattttgsacatttcatataaatggaatcatacaatgtgggatattttgtgtctggcctctttcaattaacataacgtttccaaggtttaccctcactgtagcatggg

SEQ ID NO: 43986 - DNA, 201 bp, Homo sapiens
ggggcaagagagagatgctgggttcctttaaataaccagctttcacatgagctaatagaatgcaaattcactcatcaccaagggaatggcactgagccatwggtgagggatccacccccatgagccagtcacctcccaccaggccccacctccaatactggggatcacatttcagcataaggcttggaggggacacacatg

SEQ ID NO: 43987 - DNA, 201 bp, Homo sapiens
aggctggagtgcagtggcatgatctcagctcactgcaacctccacctccctggttcaagccattcttccacctcagcctcccgagtagctgggattgcagrtgcccgccaccgcgcccggctagttttttgtatttttggtaaagacaggatttcaccatgttggccagacttgtctcaaactcctgacctcaggtgatct

SEQ ID NO: 43988 - DNA, 201 bp, Homo sapiens
attctgtaaattaagcatacttgcttctgatttcacagtttccatgggatcagaggattgaaatgtcaaggaacctcccttgatgtccccctaagactctraattgaactgatgaggacccttttgagaatctttcagtgatccccttctctaggaaggaagggtgaagtatgctttgtaagagagattgtctatttgtct

SEQ ID NO: 43989 - DNA, 201 bp, Homo sapiens
aagttcaaatcaaggggttggcagggctgcactctcatgaaggctacagggagagctggttccttgtctctcccagtttctgatggcggctggcagtcctrgggtcccttgttttgtagctcaatcactctaatctctcccttcatcttcacaagtccttctccattgtttgtgtgtgtgtgttgtgtgtacattgtgtgt

SEQ ID NO: 43990 - DNA, 201 bp, Homo sapiens
tgaagcctcatgacaatgctatgaggtcataactatccccttggaaacagaggagtcagcggagactagtcagagactagtgggccatggttaccaagctrtagtgagtgtaggagctgagatctgaatccatgaattagatacctgaaccccaagtgattagtgataaaggtgtataatgcaattcaataagtactcacc

SEQ ID NO: 43991 - DNA, 201 bp, Homo sapiens
cttgaactcctggcctccagtaatctgcccacctcagcctcccaaaatttataggcttaagtcacaacccctggctggagcaaagagattttgagcttctrttaagcagtgggccacttcttgaggaactttccctgaacttcactgaagcctcatgacaatgctatgaggtcataactatccccttggaaacagaggagt

SEQ ID NO: 43992 - DNA, 201 bp, Homo sapiens
tcaattagaagtattttcttctactaataataaagccatttccttcttttataattatattataattattgatgaaaagagcaaagtcgttttttttttttgagatggagtctatttttgtcatccaggctggagtacagtggcatgatctcggctcaccgtaacctccgcctcccaggttcaagtgactctcgtgcctca

SEQ ID NO: 43993 - DNA, 201 bp, Homo sapiens
gcgtggcaccaacccagctgtgtgtgctttggagctggatactcctaaacacgtttgggtttgaactccagctctgatcctgccagcgaggagccttagarcaagtgacttaaccttctgggcctcagtttccctcatctgaaaatgggcgtgatcaagtcacctcccagggatattttcgaggatgagaggtaaggacgg

SEQ ID NO: 43994 - DNA, 201 bp, Homo sapiens
gagatgtttgcacacagactggggcatgaggtccatagataggtgcgggtcaggcccgtggctgttttgagaactgtgttatgtggcctcaatggcagcaygtaacagcatcaattcatctattaatagttttcctttgtcgtaaaagcaagttgggaagggcgtgatgaggcgagctctctgggatgctgtcatgtggat

SEQ ID NO: 43995 - DNA, 201 bp, Homo sapiens
cgccctgctaccgcggcgggaggaaaaaggttccggcctcagccggcgcacctggcggaggaggaacctcgcgacgcgctctcgggcatcggtttctcccwgcaaagcttggagggtttagctgcgcggagagctcagcgagctcttctgtgtctgtttggggcgtgtgggctccgggagcgtgaggaccgggaagctagg

SEQ ID NO: 43996 - DNA, 201 bp, Homo sapiens
agccacagacactcaatgccagcgaagagaaagcagctgcaaagccacaggggcagagctgcctaagactgtgggaacccacctcttgcattggtgtgacytggatgtgagacctggagtcaaaggacatcattttagagctttaaaatttgactgtccgctggatttccgacttgtatgggccctgtaacccctttgttt

SEQ ID NO: 43997 - DNA, 201 bp, Homo sapiens
gggaacccacctcttgcattggtgtgacctggatgtgagacctggagtcaaaggacatcattttagagctttaaaatttgactgtccgctggatttccgayttgtatgggccctgtaacccctttgttttggccaatttctcccatttggaatggctgtatttaccaaatacttgtatccccattgtattcaggaagtaac

SEQ ID NO: 43998 - DNA, 201 bp, Homo sapiens
tggtgtttttggatatagtacttaattttaatatatcccactttattagtttttaatcttgtagttagcaccctttttgtcctatttaagaaatctaaggycaggcgcagtggctcgcgcctgtaatcccagcactttgggaggtcgaggtgggtggatcacgaggtcaggagatggagaccattctggctaacacggtga

SEQ ID NO: 43999 - DNA, 201 bp, Homo sapiens
ggaaaccctgtctctacaaaagaggaaatgtgttctgtatcctcctgctggctcccaaacctacctctagcttacaaaacccaagcactttgtgctacccyggacatggttaaagctaattcttgaagcagaagttggcggaatgtaaaaaagcctttgctaaggacttgaccaggggaaaactccaagcttggaggcctc

SEQ ID NO: 44000 - DNA, 201 bp, Homo sapiens
caaaacccaagcactttgtgctaccctggacatggttaaagctaattcttgaagcagaagttggcggaatgtaaaaaagcctttgctaaggacttgaccargggaaaactccaagcttggaggcctcctaactgctgcattctcagagcagtctcccgcccagggcgagagctcctgccattcaggagggacctttctctc

SEQ ID NO: 44001 - DNA, 201 bp, Homo sapiens
ggttatgcagacaattttgtgttctgtttttatcatttaaaacgatctcacatattacccatttctttaaaatagtttgtaaatctctttctctctctctyttttttcttttgagacggagttttgctcttgttgcccaggctggagtgcaatggcgcgatctcggctcaccgcaacctccgcctcacgggttcaagcgat

SEQ ID NO: 44002 - DNA, 201 bp, Homo sapiens
atgtcctcgagctctacccatgttgtggcatgtatcagtattcccttcctttttgaggctgaataatattccattgcatgtgtatgtattacttttttttwaatttttttttgagaccgagtctctgtcgcccaggctggagtgcagtggcgcgatctcatatgtattatgttttatttatccattcatctgtcgtggaca

SEQ ID NO: 44003 - DNA, 201 bp, Homo sapiens
aactagcaatatgtgccagatactgtgttaaatgctgcacatataggaactcattcaattcccacacagtcctattctttaggaacgattattatccagcwtactaactgaaagacagggaggttaagtaacttggccaaggtcacttagttactgagtgatgacacttggttttggactccaaatctatgccacctgact

SEQ ID NO: 44004 - DNA, 201 bp, Homo sapiens
catatggtgttttagtgccttgtccttcccctaatcaaaagcacaagaagcaaaagcacactgagcagatagcaatgaactaattgacaaaaataaataarcaggccaaccagacattcatgttatcatgttattaattcattcattcaaaaaatatttttgggcacctgctgtgtgccaggccctgtggtaggcactggg

SEQ ID NO: 44005 - DNA, 201 bp, Homo sapiens
agagacaaaagggaacatcaactgggaaggggaaaagggggctgaagacagaacccatctttctgctaaaaccacacattcagcaattccagagatgtccsttgtctgaggatgaaaaaaagaactggggaatgactttgccttcttataatgatggtttgtgccagtgacggctcatggcagtggtcccagtatcttggg

SEQ ID NO: 44006 - DNA, 201 bp, Homo sapiens
cttctacagaggtcatggttgaattatcacaaaacttcctttactcaaagcagatgcttattaagattaatttagtgtgaaaagtgaaccagactgagtayaaaggacattgtctcctcaattatgtaataagacacctcctcattgtcctgtactcactgaagatgattgtgcatttcctcagggacatttcagcgcggt

SEQ ID NO: 44007 - DNA, 201 bp, Homo sapiens
gcccaccaggcctctcagccagcagttgtgggtgtggccagcggcctttgcaaagcttctagcaagaaggaaccttcctgggcatcttccctgcttccctkcaaaaggaaacaacacaaggaaagagctctccatatccacgtgtccaaacacaacagcttatttcagtgtattgtgaagtcattgtatttcactttgtgc

SEQ ID NO: 44008 - DNA, 201 bp, Homo sapiens
accagcactgtggtagatggagggagtgtagatgctataggtaccaaatagaggcacacttattttaaaacctcgctgtttttgtcatacatgttctcaatataaacatggaaataatttatatcaggtgaataattgtgaaatactttaggttaaaggtcttcataatgaaaaatatctaggctgggagctgtggctgac

SEQ ID NO: 44009 - DNA, 201 bp, Homo sapiens
tatcactgcatcatccgttcatccattcatgtgttctataagccctggcagagcagccaccatggcctggccctgggaatgggcagagtggtttagagatrgtgaagatttatcctgtgccccctagaaatttgcagatgtgcctccactgactacagaggagagagagggagggatgctgttgactttgaaatcagagag

SEQ ID NO: 44010 - DNA, 201 bp, Homo sapiens
ttgtatgggccctgtaacccctttgttttggccaatttctcccatttggaatggctgtatttaccaaatacttgtatccccattgtattcaggaagtaacyagcttgtttttgattttacaggctcataggtggaagggacttgccttgtcttagatgagactttggactgtggacttttgtgttaatgctgaaatgagtt

SEQ ID NO: 44011 - DNA, 201 bp, Homo sapiens
cgagtagctgggactacaggcatccgccaccacgcccggctaattttttgtgtttttagcagagacggggtttcaccgtgttagccaggatggtctcgatytcctgacttcgtgatccgcctgcctcggcctcccaagctggttttctttcaaacagaggccagctagagccagggacggcaactcggaacgtgtctaacg

SEQ ID NO: 44012 - DNA, 201 bp, Homo sapiens
tttaaaagagtgtggtgcctcccacctcctctttcttgctcccactttcaccatgagatgctagctctccctttgccttctgccatgatcgtaagcttccygaggcttcaccaaaagccaagtacatgctggtgccgtgcctgtacagcctgcagaactgtgagccaatgaaacctcttttctttacaaattacccagcct

SEQ ID NO: 44013 - DNA, 201 bp, Homo sapiens
cttgtgcacctactatgtcctcagccctggtttaggagcctgagatgcaaagacgaatggaaaggcatccctttcccctctggacctctcagtggtcacargttaatgatcctaaatgagagacagcccttcagcatttctgggcctcagtggccttgcatgggacacacacagattacattagttgctgagaatcctaga

SEQ ID NO: 44014 - DNA, 201 bp, Homo sapiens
tgtgcagagctaggaatgaagtgagagggtgagcccagaggttatctggcggaagaacattccaggcagggactcagcaagtgcgaagaccctgaggtggkcgtgtacctggaatattggaggaagagcagggaggcagatgtgctggagtgcagggagtgagatgaagccaaagggagctgggaccagcatttccaagag

SEQ ID NO: 44015 - DNA, 201 bp, Homo sapiens
gggtctggacttgggctgtatggagaagttctaatctttactgtaacctcagctagagctacataatttcagcgcctcccactgtgcatctttcaaatggktgcaaaggtcttatctgatatgttgctgagcagctgtgtgtggaggtgaaatataaatggtgacatgggcacagatgtgagggccccgttgatgtcaacg

SEQ ID NO: 44016 - DNA, 201 bp, Homo sapiens
aagccaaggactgacagagggacccagacccttggctgggaggcccagggaacaacttggcactatagagctgctagaatctgggacctaatctctccccmagaagcctgattttttaaaaaggtctatttgctaagaagacaaagtacaaacccattagcagctcttgaagttttgtttttgtggttgttcctgtcattc

SEQ ID NO: 44017 - DNA, 201 bp, Homo sapiens
tcaactccatttaacagatgagcaaactaagcagctaggcaacttgaccaaggtcactctcttggtgagtgccagagccagggctacaacccagcaacccrttagaatgacgcccaaaactgaagccaaggactgacagagggacccagacccttggctgggaggcccagggaacaacttggcactatagagctgctagaa

SEQ ID NO: 44018 - DNA, 201 bp, Homo sapiens
catttctaagctgaggtggttcagctggaaactggaggagggtctgatttcaatggctcatttgcatccctggcaagctggtgctggctcttggctgggayctcagttggggctgtgggccaaggtcttggttcctgtccatgtgtacttctccacaggctgcctgggcttcctcacagtatggtggctgtgttccaagaa

SEQ ID NO: 44019 - DNA, 201 bp, Homo sapiens
gcatatagtaggtgctcatggaacagtgggtgcaaaatggtggggtttgaagaagacctagttttaaatcttgacctctataagtctcttataaagacttracctcccccacaggtggatctggatattcccttattcacaccccactgacctgtgcctccatttgtttgtgtgtctgtgtcccatgtctgcttaatcatt

SEQ ID NO: 44020 - DNA, 201 bp, Homo sapiens
agtaggttctttaatgctatgtttagcccaccctggatgtgacactcttgtctcttggtgttccttctcttgaattcctgtggacatgcctggctcctgcrcatcattctgagagctggaccttgtctgactcaccagtttctcctgaaacccctggcatagtttcctgcatatagtaggtgctcatggaacagtgggtgc

SEQ ID NO: 44021 - DNA, 201 bp, Homo sapiens
gccttgcacactttctggaggctcctccattaaaatctactttgcccatgaaacatcagcctcctctctcttggtgctcacctctggtcatggggaccttycagagtgttgctgagcaaacgaatgcatgaatgtcattgttacacaccatataaccagaagtagaattggaccaagtaggttctttaatgctatgtttag

SEQ ID NO: 44022 - DNA, 201 bp, Homo sapiens
catagctattaaaattgacaactcaatcaatgagtttcttctgcattttaggttcatgttctgttttgtgttgttttttgagacgggggtctactatgttkcccaggctggattgcagtggctagtcagaggcgccatcctagctcactacagctggaacgccagggctcaaacgatcctcccggactcagcctcctgagt

SEQ ID NO: 44023 - DNA, 201 bp, Homo sapiens
ctggctaattcttttgtatttttagtagagatggggtttcaccgtgttagccaggatggtctcgatctcctgacctcgtgatccgcctgcctcagcctccsaaaatgctgggattacaggcgtgagccaccgcgcccggccaggaaaagattatttaaacccaaactgtagccacttcttgcagtttaaggaaaataaatt

SEQ ID NO: 44024 - DNA, 201 bp, Homo sapiens
tttacctcgaatacatctactaagatgttgtttccaaataaggccacattctgaggtctgagtggacatagattttggggggacacttgcttaaccccctrgtaacattctttaggaggagatgtaatttggggaattagttaatacacagaaaacacttaaaacagcaactggcccaatgacatcctcaaaaatattggt

SEQ ID NO: 44025 - DNA, 201 bp, Homo sapiens
cagggaaactcccccttatagagccgtcagatctcctgagacttcctatcacgagaacagtacaggaaagacctgccctcatattcagtcacctcccaccrggtccctcccacaacacgtggggattcaggatgagatatcagttgtcattccttgcggcagccctagaaaattagcacagcctccttcttgcataagcat

SEQ ID NO: 44026 - DNA, 201 bp, Homo sapiens
actgtactccagcctgggagacagagcgagactctgtctcacaaaaataataataataataataataataataatttggagaatcctcaacattctttctrctcatcccagtaacccacttgacagcatggagctcagaaatgtggggaccccagaagctcaagatcttcagccccaactcacaactttctcccttgccat

SEQ ID NO: 44027 - DNA, 201 bp, Homo sapiens
tgactaagtctgagaatagccactggactccagcctgggcaacataatgagacattgataatggtttggctgtgttcccacctaaatctcaccttgaattrtaataatctccacgagtcaagggcggggccaggtggagataattgaatcatgggagcagtttcccccatgctgttctcatggtagtgaataagtctcatg

SEQ ID NO: 44028 - DNA, 201 bp, Homo sapiens
gtccaaaattagtagcatatttctaacagacctcacttaaagccacatcaaattaaatagggccttttaagatgggtcctcctgtatgtgtgtgtgtgtgkatatatatgtgtgtgtgtgtgtatgtatatatgtgcatacatgtatggtgcagcatggattggaaaagtttaggaagtgaggtatgtttgtaaatactgg

SEQ ID NO: 44029 - DNA, 201 bp, Homo sapiens
ccaattgttaataatagttactgctagggggaagttttcagggatgatttttctttcttcttttgctcactattttctaagctgttagtagtagtagtagdaataataataataataataataataataatagctaagcactcctgagggcccacaaagctcggtgccagcctcattctctgtgttaattcatgtatttaa

SEQ ID NO: 44030 - DNA, 201 bp, Homo sapiens
catgaacctgggaggcggagcttgcagtgagccaagatagcgccactgcagtccagcctgggcaaaagagcgagactccgtctcaaaaaaataaataaatraaaaataagttttcataggagtctccttttagagagaggattttatgacagaacagatcatgagatagaacaataaaaattggccaggtgtggtggctca

SEQ ID NO: 44031 - DNA, 201 bp, Homo sapiens
gttccattctggagactctgggggagaatccatttatttgccttccccagctcctagatgctgcccacgttctttggttcacggccccaccctctttctcygaagccaggtatgatgggtggagatcttctcacatcgcatcactctgacactgactgtcctgcctccctcttccacatttaaggacccctgtcatgacat

SEQ ID NO: 44032 - DNA, 201 bp, Homo sapiens
cagtggctgacacctataatctcagcactttgggaggctgaggcgggtggatcatgaggtcaggagatcgagaccatcttggctaacacggtgaaaccccrtttctactaaaaatacaaaaattagccaggcgcggtggtgggcgcctgtaatcgcagctactcaggaggctgaggcaggagaatggcatgaacctgggag

SEQ ID NO: 44033 - DNA, 201 bp, Homo sapiens
agaaccggcagcagcaaactgattctgtctggaatttggaagccagggaggaacagcctcgaatggacagggtaggcccccaggttgtctggaacactgcrccctacttcaatctggcctccccaagtggacctttgtgagcccaggttcttctcccaggcacacagatgcctggacaaggcaggtcctggggctcatgaa

SEQ ID NO: 44034 - DNA, 201 bp, Homo sapiens
ggtacttatcccactctgctcaccccattttagaggcgtcaactcacaacaatgtgatcaacagtcaccaaagttcaagtcctctctctcccctccttctsctggcctccaggttgagaagtttggtgcaacttcttcccagggctgacttcgtccaccccaggagtttcatagagcacctcataaaaacccatttactgg

SEQ ID NO: 44035 - DNA, 201 bp, Homo sapiens
tctgtacaacaaacccgtgtgacgtgagtttacctatgtaacaaacctgcacatgtgtctccgaacctaaaataaaagttaaaaaataaaaaaaattaaaraataaaaaggctacagagcattagaaaaaaaaaagatctatttatgcccatttcatcatttagcccccaaagtctgaggttcttatgttttttgttgagt

SEQ ID NO: 44036 - DNA, 201 bp, Homo sapiens
tagccgtgggcaagttacttaacctgtttgtgcttcagatcgcagtctgtaaattggggctaataacagtattttctgcaaagtgttgttgtgaggattgsgtttatacatataaagcagttggtaatgcctggcacataggaagtattcagtttgcattagtgattattattagaaagtcacaaacttgaaatgaaaatg

SEQ ID NO: 44037 - DNA, 201 bp, Homo sapiens
tgggttttatttaaccctatatatggtgacttactttccatcctgactggtgtatcattacaagacaaggaatcaaaatattttactccaaaacatgtttmtttgccatattttgaaatggccctgcaaagctgttctttatgggggaaaatttgcatctgtaaagaatctctgttaacacagctagaactttttcttcca

SEQ ID NO: 44038 - DNA, 201 bp, Homo sapiens
aaggaaactaggctcagagaggttgggtgacctgcccaagatccacagctcatttgtaagaacaggatggacatggatcagctgcccaggtctctccccarcccctttccatggtggcctgcatctggcagatcaaggtaggggtgtcccggctctgccagcatggcccaaagcaggacaatgctgaagagctgtcccagc

SEQ ID NO: 44039 - DNA, 201 bp, Homo sapiens
ttgtgcttcagatcgcagtctgtaaattggggctaataacagtattttctgcaaagtgttgttgtgaggattgcgtttatacatataaagcagttggtaaygcctggcacataggaagtattcagtttgcattagtgattattattagaaagtcacaaacttgaaatgaaaatggttctcgagtgtgaatatgaatatgta

SEQ ID NO: 44040 - DNA, 201 bp, Homo sapiens
gtgtggttataaatcaactcttactttggatttatctttgaggcttcctctgatccctagtgttgaagtttaaatgtcacttctcaaagaaacatcactgrcctctcccaagggaaccctttctactgtcctctagtgatgccttgcacactttctggaggctcctccattaaaatctactttgcccatgaaacatcagcc

SEQ ID NO: 44041 - DNA, 201 bp, Homo sapiens
cttcctcttctgccatgattgtaagtttcctgaggcctccctagccatgcaaaactgtgagtcaattaaacctctttcctttataaattacccagtctcasgtatgtctttcttagcagtatgagaatggactaatacacacagggaaggcatttcatgagagatccacctccatgactggaacacctcccaccaggccct

SEQ ID NO: 44042 - DNA, 201 bp, Homo sapiens
cattggatgctgcctggatggctgccatcaactcctactttgtgtccttgcttccattcttgcctccctgtcttctcatccacacagtggcccaggagagytcaaatgccactcccgagagagacttccccaaccatgccagcatcgcgataatgggcgctgaggcttcctgagcaacagaccctgtcccaggtgcttcac

SEQ ID NO: 44043 - DNA, 201 bp, Homo sapiens
tccttcagtcttcttggtcagtgctcagggcctgaacttggctgtcctgttagccaggtctgcacatgttaaggtgccctaggggcccacccaggtgaccmtcttttcatctctcttctctctacattctcctgcccatctatatctccagttcatccccctctcttgagctgcagattcatatcctcaaccacttccttg

SEQ ID NO: 44044 - DNA, 201 bp, Homo sapiens
gaagggttttaagcaagggagagatatgatcggctttatctggggggagggatctcttgtagcaatgtgcaggccaaagagtgagaggctgggggcaaagmgatcaggaaggaggcagttgcaatggcttaaatgggacttcattcctacactccgtgaatactttttgaacacctactgtaagccaagcactgcgcaggc

SEQ ID NO: 44045 - DNA, 201 bp, Homo sapiens
aaattgaggatgggaatatagtggaaaatccattccccacaggaaaatattctgaaatttctggcttgggtgacaggctgtcattgatagagctagataaygatgaaggtgatgataatgatagccaatcctatgtagcactcattaagtaccaagcactattaagtgcttgagggagaataaatcatacaatcctatgtg

SEQ ID NO: 44046 - DNA, 201 bp, Homo sapiens
tccactggggcagcctgcattgaatgaacagtcaatcccaggggacagagtctggccttgatttggatagtttcaggctcatcccagcttcagagctccaygtggtgctcagtggtggctgcatcacgttttagcttctcccctgtctaaggtgctcctctctctccctcctgggcattgctgcccagagcactctccagg

SEQ ID NO: 44047 - DNA, 201 bp, Homo sapiens
caggcatggtggcatgcatgtgtagtcccagctacttgggaggctgaggcaggggaatcgcttgaacccgggagacggaggttgcagtgagctgagatctsatcactgtactccagcctgggtgacagagtgagactctgtctaaaaaaagaaaaaaaacaagagagtaagataaaacaatactaataacaagccgaatgg

SEQ ID NO: 44048 - DNA, 201 bp, Homo sapiens
gcatatccagtttggtatgacttggctcctgggcccctgtgtggagtcccgtgagaggcagctgagtccaactggccttttggggtatcatcagggcactyttgcaaatagtcttggccatttgctcctgccctcaaagtccctgaattccatggctctgtccttctgacttggactctgctggtcccctggttctccctc

SEQ ID NO: 44049 - DNA, 201 bp, Homo sapiens
cccacctcagcctctcaaagtgctaggattacaggcatgatccactgcacccggccagaggtcagttttaaacagagactgatctactgattttggagaayttgccccagtggggtaggggagcagtccaccaaagagaatgacctgtgtggtgctggaagtgacagagcgtaggtgtgatgcagtgcagtggggcagagg

SEQ ID NO: 44050 - DNA, 201 bp, Homo sapiens
tcctgagtccatgtgactaaatttcaagagggcaggttagaaaaagcaaagttgatggggcattacctgtggtttgaacttctacctgtcatatttcaggmaatcaccatgaggagcttgacttaggaaattaaggaagacgtgtccttttgttgattttcacatgggaagacaagggtgtgtgtgtgtgtgtgtgtgtgt

SEQ ID NO: 44051 - DNA, 201 bp, Homo sapiens
ggcagacaccccttttgtgtcttcctggaagacagagagatccacctactcttttccatttctcaaacaatgtttgtaggcctgctctggtaatactccargggtctacagaaattaagaaaacagaaccttttccctttgaggatttaacctagtaggagacacaccaatatccaaacacaaagcaatgttcttctgaaa

SEQ ID NO: 44052 - DNA, 201 bp, Homo sapiens
gctgagaagtgtgtttgggtttatttcacacacagggaaattgtcaatgaagtgtttaatagagaaagtgaatcagcactttggtctcccaagctcagccrtcaactccttaagcacagcctttagggctgggaaagacataatattactttagtttgagcttctgtctatttgttgatgaggaaacagacccagggcagt

SEQ ID NO: 44053 - DNA, 201 bp, Homo sapiens
tcctccaggaagccagatgaactgtggcccacacagggatgacagttcacccttacaggtgcatttgcaggatataccctcacatggcacccgacatctcyagaaaatgactgccattgccgtgctctgagaaggcatttcctcctgctcccaactgcatgtttcaatcccttacctctctgctggaggtctgacctgttt

SEQ ID NO: 44054 - DNA, 201 bp, Homo sapiens
cctaaggccgggcagaggtgagggaaatgaccccatttgtgaggtcctattatactctaatcacttccgttatattttttagatttctcctccccacatcyctttgaggtagataaaatggtgttcatttaaggaaactaggctcagagaggttgggtgacctgcccaagatccacagctcatttgtaagaacaggatgga

SEQ ID NO: 44055 - DNA, 201 bp, Homo sapiens
caatgcaaggtcgccataaatgttagttattgttattgttatcattataataaactaggacaatcatgatcatggacagcttcactttaggtcctaaggcygggcagaggtgagggaaatgaccccatttgtgaggtcctattatactctaatcacttccgttatattttttagatttctcctccccacatccctttgagg

SEQ ID NO: 44056 - DNA, 201 bp, Homo sapiens
gtgattccactattagatatatactgaaaagaaatgaaaacagatgttcacacaaaaacttgtatatgaatgtccatagtagcattattctttttttttttctcacttcatgggacccatgttctgttcacccattggggtgctgctcaagttgaaagcaactttgaaaactgccttccacatgtataaaaccctggcata

SEQ ID NO: 44057 - DNA, 201 bp, Homo sapiens
caaatcctatttcctctgggtattgtctgtgtgtccttgggtgaatcacttcacttctctgagtctcaacttcctcatcttcaaaatgagaacgtaggtasgcccaccttgctgcaaggtgatgagggaaggccctcgccaggggcctgtcactccttactcaggaataatcactgacccatccccacagtgctggaactc

SEQ ID NO: 44058 - DNA, 201 bp, Homo sapiens
gtaatcctagcacccaaaacaggtggataacttgagctcaagtgttcaagaccagcctgagcaatgtggcaagaccctgtctctacaaaaaaaaaaaaaaattagctggacatggtggtgcgtgcctgtagttccagctatttgagaggctgaagtaggaggattgcttgagcccaggaggttgaggctacagtgatagac

SEQ ID NO: 44059 - DNA, 201 bp, Homo sapiens
taacaaaatgaccacacatcagggacttcaaacaacacaaatactttctctcttacagttctggaggtcagaagtctgaaatgagtttccttggaccaaartcaaagtgtcagcaggcccgtgttccttctggaggctcgaggggagaatctattccttgccttttccagcttctagtctctgccttggctcttggctcat

SEQ ID NO: 44060 - DNA, 201 bp, Homo sapiens
aagtggaagtatatgcttctgggattggctttttgactcagtctaattctcttgagagtcactgagttatggcatgcatcagtagtgttttttttttttttaattttaactgagtggtgttccatggcatagaagtaccacagtttctttaaccatttacccactgaagaatatctgtgtccagtttctggccattatgag

SEQ ID NO: 44061 - DNA, 201 bp, Homo sapiens
cctcagcctcccaggttcaagccattctcctgcctcagcctcctgagtagccagaattacaggcgtccacctggctaatttttgtatctttagtagagatsgagtttcaccatgttggccagattggtctcaaactcctgacctcaagtgatccacttgtctcagcctcccaaagtgctgggatcactggagtaagccaca

SEQ ID NO: 44062 - DNA, 201 bp, Homo sapiens
actagaaggagggaacgtgtcagtgctggttgaattgtgactttctcatggggtagggggtgggttataggaacatgagatataaaacgtaccagaaaagktatccaacctctaggcgtccccctccttggacaccttcaggttccatggcgatatgatttggctctgtgtccccacccaaatctcatctcaaatcgtaat

SEQ ID NO: 44063 - DNA, 201 bp, Homo sapiens
ctggagtgcaatgcaacaatcaaggctcactgcagcctcaacctcctgggctcaagcgatcctcccacctcagcctctcaaatagctgggactaccggcaygcaccaccatgttcagctaatttttgtattttttttttttttttttttttgtagagacagggtctcgccatgttgctcaggctggtcttgaactcttggg

SEQ ID NO: 44064 - DNA, 201 bp, Homo sapiens
actactgttgccagaaatatggtgtagttggctgggcacagtggctcatgcttgtaatcccagcactttgggaggcaggtggatcacctgaagtcaggagwtggagaccagcctggccaacatggtgaaaccccgtctctaataaaaatacacaaattagcttggcatggcggtgtgcacctgtaattccagctactcatg

SEQ ID NO: 44065 - DNA, 201 bp, Homo sapiens
aagtgcaaaggcccagaggcaggagagcactggacctgttccagaaacctccagcaggccaatgtagctgaaacacagccaggcacaggggctgagacagsaggtgggccaggccatctagggctcagggaccatggtcaggactctatattcatcccaaaggtgatagggaagcactaaggttacagtgtaaccatatcc

SEQ ID NO: 44066 - DNA, 201 bp, Homo sapiens
ttttttttttttttgagatggggtcttgctctgttgcccacgctggagtgcaatgcaacaatcaaggctcactgcagcctcaacctcctgggctcaagcgrtcctcccacctcagcctctcaaatagctgggactaccggcacgcaccaccatgttcagctaatttttgtattttttttttttttttttttttgtagagac

SEQ ID NO: 44067 - DNA, 201 bp, Homo sapiens
ataaagacatacctgagactgggcagtttacaaaaggaagaaaggtttaatggacttacaggttcacatggctggagaggcttcacaatcatggtggaagrcaaggaggagcaagtcacgtcttacatggatggcagcaggcaaagagagagcttgtgcagggaaactcccatttttaaaaccatcagatctcacgagacg

SEQ ID NO: 44068 - DNA, 201 bp, Homo sapiens
tccttgtgcttcgggatgctggagccggaggatcacttgaggccaggagtttgagaccagcatgggcagcatagtgagactgtgtctttaatttttttttwaattagttggacatgatgatcagcgcctgtagtctgagctacttcagaggctgaggtgggagattcacttaagctcaggagttagaggctgcagtgcact

SEQ ID NO: 44069 - DNA, 201 bp, Homo sapiens
taactgcatgagttatgcattccagacataacattcttccaaggaagatgaaaatggttcaaaagaaagtgagtttctaagaagagagccaataagattaracatgtaaatgcttttcctatggcaagctttgctcttagtagtattcctgagctcactcattgcaagttctcaacaatctcctgggggagggactgtact

SEQ ID NO: 44070 - DNA, 201 bp, Homo sapiens
acagtacttagagcatactaggtgctcattaaaatgttcattgaatgaacagtacacaacagtgctcagcaaatacttgttgaatgaataattgaatagayataatcatataagtatgtctttctagcctcacagcatttcctggagatttttgtttgtttgtgggtttttgtttttgtttgttttttattttggtagctg

SEQ ID NO: 44071 - DNA, 201 bp, Homo sapiens
ctgagcccggtccctcatgcccagctgtctagggcctggggcctctccccaccacctgaaaggctgggcctgtgctctggtgtcagatgcacctcgatttraactccctgctgccattttctagttgtggtcctctgggcaagtcacatcacctctctgacctcagtttccccttctgtaaaatgggagtaaaacgatgca

SEQ ID NO: 44072 - DNA, 201 bp, Homo sapiens
cagccatgtggaactgtgagtccgttaaacctctttttttaaataaattacccagtctcaggtgtgcctttagtagcagtgtaaaaatggacgaatacagrcatcatctctagacaatttgattaatttaaaaataataacaatagccaggcgcaggactcacgcttgtaatgccagcacattgggatgccaaggcaagaa

SEQ ID NO: 44073 - DNA, 201 bp, Homo sapiens
ccatgctaccgcttgaaggccagtgtggctgagcccggtccctcatgcccagctgtctagggcctggggcctctccccaccacctgaaaggctgggcctgkgctctggtgtcagatgcacctcgatttaaactccctgctgccattttctagttgtggtcctctgggcaagtcacatcacctctctgacctcagtttcccc

SEQ ID NO: 44074 - DNA, 201 bp, Homo sapiens
gctccctccaccccatcacccctcaagggcctctgcaggcagcagtttaatctgaagcaaatcctaaaatagtcctcaagaagatgagcacatcccagctytaattcgccctccaagtgcctcgaaagatcttttctaacaaaaacacagaaatgatttttacaatccaaccaaccatcagctccatgaaccttgagagag

SEQ ID NO: 44075 - DNA, 201 bp, Homo sapiens
gcctgggatggccatttgaacactgaaagtcctgtgtgctggaaaacccctcagtcccattcatactgggcccgagggtcatgctagcaggcagcataacwttagtggctaacagaatgggctgtggaattagagacctgggttaggatctccctccagccactaactgggtgtggtacctggtgcaagttgctttagtct

SEQ ID NO: 44076 - DNA, 201 bp, Homo sapiens
caggtaaagtcataaagaagagccagaaccccacgaccagtcatctgatgctccctccaccccatcacccctcaagggcctctgcaggcagcagtttaatytgaagcaaatcctaaaatagtcctcaagaagatgagcacatcccagctctaattcgccctccaagtgcctcgaaagatcttttctaacaaaaacacagaa

SEQ ID NO: 44077 - DNA, 201 bp, Homo sapiens
tgagcagtccagagatggctccctgcattagagtcccttgccttgtcaggcctttgaaatgagggtttgccttgatggaacagacagctttcatgatgcastgtctgatatattcagacttgtaatgtagggtgcctagggctgtggggtataatgggggagcctgggagagcataagctcctaaggctccctcttggcct

SEQ ID NO: 44078 - DNA, 201 bp, Homo sapiens
aagttagctgctgggccaggatggtgaacagacagacccagcagccaccctcctagagctgacagtctagcaggcagaccccctgattgcagagttacacraataattgaataaaaatcacaagtgtggaaaagcacagagcaagagaataggcctggggctggatgatgtatctctggtctcagcagggtgacagtcccc

SEQ ID NO: 44079 - DNA, 201 bp, Homo sapiens
aactctgtactttttaaataataactccctgttctccatcctccacccctggcaaccaccattctactttctgtttctgtgaatttgactactctagataycacatattgattattatagtttcatagtgagttttgaaattaggaagtctaagttctctgactttgtgtttttaaagtttgttttggcttttctgggtct

SEQ ID NO: 44080 - DNA, 201 bp, Homo sapiens
cccttaatgttccaatgttccatcagcctgagtccttaagtaaagatgacatggagcatagccaaccaaggacattgtattagtcagagttctctagaggracagaactaataggataggtgtatatataaaggggagcttattaaggagtattgactcacatgatcacaaggtgaggtcccacaataggccatctgcaag

SEQ ID NO: 44081 - DNA, 201 bp, Homo sapiens
agcagtgtgaaaatggactcatacacagagagtacctaaaggaggggctgccaccacctcattcctacctgattcttgttctagatcctgagcccgttgcyctagcctactggcttgtttcatcctactttgtgtctcctcccaccctgtaatgagccaaatgttggccccccaaaagatatgtccacatcctgatcccta

SEQ ID NO: 44082 - DNA, 201 bp, Homo sapiens
agtgctcacctgcatttttttaagcagaaagtagtatttattttggcctaatttccacctgtcagaaaatcaaaacagtgatgaattgcatattgctataytacattttattatcagcatcaaaattcaagtgtgctctgcttaaaattcagaagacaaactttctcatttagaaaagttcattctgttagtgactgatca

SEQ ID NO: 44083 - DNA, 201 bp, Homo sapiens
agcttgcagtgagccgagatcgtgccactgtactccagcctgggagacagagcgagactctgtctcacaaaaataataataataataataataataataatttggagaatcctcaacattctttctgctcatcccagtaacccacttgacagcatggagctcagaaatgtggggaccccagaagctcaagatcttcagccc

SEQ ID NO: 44084 - DNA, 201 bp, Homo sapiens
aagcttgcagtgagccgagatcgtgccactgtactccagcctgggagacagagcgagactctgtctcacaaaaataataataataataataataataataatttggagaatcctcaacattctttctgctcatcccagtaacccacttgacagcatggagctcagaaatgtggggaccccagaagctcaagatcttcagcc

SEQ ID NO: 44085 - DNA, 201 bp, Homo sapiens
gaagcttgcagtgagccgagatcgtgccactgtactccagcctgggagacagagcgagactctgtctcacaaaaataataataataataataataataataatttggagaatcctcaacattctttctgctcatcccagtaacccacttgacagcatggagctcagaaatgtggggaccccagaagctcaagatcttcagc

SEQ ID NO: 44086 - DNA, 201 bp, Homo sapiens
cttgttttaacttctcaaacattttgagtcttgctcctgttaaccaagaagacctagaaagctccacatctcctcttaaaatgtgtgtgtgtgtgtgtgtgcgtgtattcgtacgcacacccctgggtacagctctgaggaggccacctataggtttctgaacaatcttccatgaatacagctcattcatacacacattta

SEQ ID NO: 44087 - DNA, 201 bp, Homo sapiens
ccttgttttaacttctcaaacattttgagtcttgctcctgttaaccaagaagacctagaaagctccacatctcctcttaaaatgtgtgtgtgtgtgtgtgtgcgtgtattcgtacgcacacccctgggtacagctctgaggaggccacctataggtttctgaacaatcttccatgaatacagctcattcatacacacattt

SEQ ID NO: 44088 - DNA, 201 bp, Homo sapiens
aatatgacctgatgtttcagcttcaggcataatagcccagacatttttgaaacccacaagggtagtttttacttcttcagaatgtctttttttttttttttctccccacagtctggcttccttttcccttcaatggaataacatatacaaactctacctaagagtgctgtgtgaagtacatgccagcctacaagacatgtc

SEQ ID NO: 44089 - DNA, 201 bp, Homo sapiens
cttccagcagaacaagggtgtccttcaagcagctgctcgtgagcagaggggcagctgtcctttttctgccatgtttcagttggggctgtctcttctgcatkctctggctggaagggacctctgaggtcaggtcaggtggtctaggtgacaagtgagggtggtgatcagttgacctctgtgacagctgccactctccttccc

SEQ ID NO: 44090 - DNA, 201 bp, Homo sapiens
ctatgagctgtctgtagaaaagaaaaagtaaatatgacctgatgtttcagcttcaggcataatagcccagacatttttgaaacccacaagggtagtttttrcttcttcagaatgtctttttttttttttttctccccacagtctggcttccttttcccttcaatggaataacatatacaaactctacctaagagtgctgtg

SEQ ID NO: 44091 - DNA, 201 bp, Homo sapiens
attgcagtgagccgagatcgcgccactgcagtccagcttaggcatcagagcaagactttgtctcaaaaaagaaaaaaaatggaacccaaaatgctgggcayggtggctcacacctgtaatctcagcactttgggaggctgaggcgggtggattgctttagggcaggagttcaagaccagcctgaccaacatggtgaaaccc

SEQ ID NO: 44092 - DNA, 201 bp, Homo sapiens
atcaagcagagtgaccttgaagcctaaagcccagtaacagccttatcactttcactcctccagctcatccaacagttttctagcacctatttatttcctcrtattgaatacctcgctgccaaaaatacctagacacatttctggttccttgactgaactctgctgatagagccattcactatgcaaagccctggggctaca

SEQ ID NO: 44093 - DNA, 201 bp, Homo sapiens
taaattctctcattccacagtattcctatgaaatcaggatgcctttgatggacatgccttaaattctctcattccacagtattcctatgaaatcaggatgyctttgatggacttgccttaaattctctcattccacagtattcctatgaaatcaggatgtctttgatggacttgccttaaattctctcattccacagtatt

SEQ ID NO: 44094 - DNA, 201 bp, Homo sapiens
ttctctgactttgtgtttttaaagtttgttttggcttttctgggtctcttacattttcatataaattttaatagcttgtcggtttctgcaaaaagggcagwtggaattttgataggcatcatatcagatgcagattaattgaaaaatattgccatcttaataatattaagtcttctaatccatgaacataggatgcctttt

SEQ ID NO: 44095 - DNA, 201 bp, Homo sapiens
cactcaggctaggcaccatacctcttgcctcagaatgtggatactcttgtgtgttcagaattggagattaggaaataatactattaaaagtaatagcaatygatgataaagccttcatatgctttattcacagacattactgacttctcctgttagctctgtcgtgcttacatcatgatgcccatttttcaggtaaagaaa

SEQ ID NO: 44096 - DNA, 201 bp, Homo sapiens
gctggagggcgggaggcggcgagggcgggcagctgactgttggctgtggacaggctccaggcgtgccaggccagagtggggataattccaccccaggttgyttagctgagggttctctgcgcattaagcaccttaactcgctgtcctgctgcaccccagccacagaggccttggtgaaggtgaaatcttagagaatagctg

SEQ ID NO: 44097 - DNA, 201 bp, Homo sapiens
ttcacagaaagccttcgttggattcaaatcctgactccattgtttattagctgtgtgaccctgggtgtgtcactcaacctctctgctttctttccctacawctgcccatgggtacaagacctcccttcctctcggaactgatgtgttattgaagcagtgatgcccaagaaagggctttgcaaatgagagaatgtgatgtaa

SEQ ID NO: 44098 - DNA, 201 bp, Homo sapiens
ctaatttaggagtgcagaggagccccatgcattagagaagggggagcatgaaaggaaaagacaacgcaccagtgaatcactccttgacaaatgtgactgtytaccacacccttggatgagaggcattcgtttttcacgacagccctggcaggagaaactagtcagataggccagcctcattttcctcttctgtagaatggg

SEQ ID NO: 44099 - DNA, 201 bp, Homo sapiens
gcccgccccctgctgcctggccagcccggtggctgaggaagactcggacatggagccaggatgcctttcccctcaaagtgttggctctgttttgtcgggartcaggaagtctgtgtcctgtggcacctaatttaggagtgcagaggagccccatgcattagagaagggggagcatgaaaggaaaagacaacgcaccagtga

SEQ ID NO: 44100 - DNA, 201 bp, Homo sapiens
ctactaataataaagccatttccttcttttataattatattataattattgatgaaaagagcaaagtcgttttttttttttgagatggagtctatttttgycatccaggctggagtacagtggcatgatctcggctcaccgtaacctccgcctcccaggttcaagtgactctcgtgcctcagcctcccgagtagctggaat

SEQ ID NO: 44101 - DNA, 201 bp, Homo sapiens
ccagattggccaaaaggtttttcctctttgggaagggatcagctgtcatgctgtatggagcaagtccccggaatcccaccctggggctagacatattctcytgttactttttattatgggaggcaggggagaaagatgcacgctgtcaaggataagactggggatttgctgaaagggtagatcctgtgttaagtgttcaca

SEQ ID NO: 44102 - DNA, 201 bp, Homo sapiens
gcctcaaaatgagcaccttagctctgatgctggatggtgtcttctagtgggatgaaaaaagcagcacatatgttactgtttcacaaatgtatttttaaatrttttgataacggtatcttactataattgctttccttgataatcctctttattttattttaattaattaattttttttgagacagaatctcactctgtcgc

SEQ ID NO: 44103 - DNA, 201 bp, Homo sapiens
gagctgttagcccatctcacagtctgctccaccacttgctagctgtagcggtgtcaccatgcacctgttactcaatgactttgagccccaggctctaatayacagcaatagactgggtgcttgaggttgttaatttgtgaatgcaagatatacctagagtgtgctcataaagtaatcttctgagaaagaaatgccatgaag

SEQ ID NO: 44104 - DNA, 201 bp, Homo sapiens
tgatgtggtttggctatgtccccattcaaatctcaacttgtatctcccaaaattcccacgtgttgtgtgagggacctaagaggacgtgattgaatcatggrgccggtctttcccatgctattctcatgatagtgaataagtctcacgagatctgatgggtttatcaggggtttccacttttgcttcttcctcattttctct

SEQ ID NO: 44105 - DNA, 201 bp, Homo sapiens
agagctcagcgagctcttctgtgtctgtttggggcgtgtgggctccgggagcgtgaggaccgggaagctaggaggctccttcccttctggcggctccctcmctgagaccgggcggtttggttgcgggggaagtggagacgagccacccttgacctttgactgcaagaactcaccttgagcaggatagaggcacgtggacgg

SEQ ID NO: 44106 - DNA, 201 bp, Homo sapiens
cattcgtggaggcccccgtctgaccacctccttgcagagctgttagcccatctcacagtctgctccaccacttgctagctgtagcggtgtcaccatgcacytgttactcaatgactttgagccccaggctctaatatacagcaatagactgggtgcttgaggttgttaatttgtgaatgcaagatatacctagagtgtgct

SEQ ID NO: 44107 - DNA, 201 bp, Homo sapiens
ttttgtatttttggtaaagacaggatttcaccatgttggccagacttgtctcaaactcctgacctcaggtgatctgcctgccttggcctcccaaagttttrggattacaggcgtgagccaccatgcccagcccattttatgttatatgttacctttccccacccccagaagaatccctaggcttacacaggctgctaaaga

SEQ ID NO: 44108 - DNA, 201 bp, Homo sapiens
gctacaggaaatttgctgcgtccccctaggtactgttgtcagagtggactctgggtcaaagagtcagacctttcattggtgtgcttcaagtctaagctttkcaagctctttctctatgttacgtctgcctccttcctctttagtttgtcttttatttgtcctagccttgaggagtgaaggttccaggaaattgaggatggg

SEQ ID NO: 44109 - DNA, 201 bp, Homo sapiens
tcagggcagctgggtgttgaacaaatgaagggcttgccaggattcaggtctccagaaatggcagctcagaaaaaggtctctcctccaggtggaatccagcrgagaatgttacctggggcctggggccatcacccccaggcattcgtggaggcccccgtctgaccacctccttgcagagctgttagcccatctcacagtctg

SEQ ID NO: 44110 - DNA, 201 bp, Homo sapiens
cagacttgtctcaaactcctgacctcaggtgatctgcctgccttggcctcccaaagttttaggattacaggcgtgagccaccatgcccagcccattttatkttatatgttacctttccccacccccagaagaatccctaggcttacacaggctgctaaagaactcatgacatccaggaaattaagaacccctgggtcatac

SEQ ID NO: 44111 - DNA, 201 bp, Homo sapiens
aaggccacagaaagggaagcaagatcccccagactcaggccaggcccgtttggttccacatggagcaaccttctactcggccacttgtcttcttaatgtakcaggtgagatcgggaaaaatactaaatatcacatcactaacgtgttcaaagccaactggtattcccaatagggttggaattgatgtcctcgtccttccag

SEQ ID NO: 44112 - DNA, 201 bp, Homo sapiens
gtcttcctcccatgatccctgggccagtgctccttctccagggctccgcatctgagatgtgacaccatctacccagttgttcaagccagaaactggatcayactggagttagcccctgggtccctgatatatcttggctttcattgcctatgtgcaaaatctatgggctatacaataacaactctcattggtcatcagtcc

SEQ ID NO: 44113 - DNA, 201 bp, Homo sapiens
ggaaacctggtccagacactgcgttcgcaatacctggccctgctaatgtgtagctcacagggcaggtgtgtgctccagccgggaatccagccagctaagtrtctgatatagtttggctgtgtccccacccaaatctcatcctgaattgtagttcccataatccccagtgtcgtgggagggacccagtgagaggtaatttag

SEQ ID NO: 44114 - DNA, 201 bp, Homo sapiens
ttatttcgagaatgttctgtaagtggaagtatatgcttctgggattggctttttgactcagtctaattctcttgagagtcactgagttatggcatgcatcrgtagtgttttttttttttttaattttaactgagtggtgttccatggcatagaagtaccacagtttctttaaccatttacccactgaagaatatctgtgtc

SEQ ID NO: 44115 - DNA, 201 bp, Homo sapiens
agagccaagattcctacccccagaaaggccgagattcaaacccattctgtcttatgtcagaactcctgcttgtatcagttggaattctgtttggaaaagtrggtttatttttctcatgtaacaggaaacccgaaggcaggtgattgctggtgttgatttagcagttcaagggagtaggactgacatgtctgtttttctctt

SEQ ID NO: 44116 - DNA, 201 bp, Homo sapiens
acacaaaaagtaaaattagccgggcatggtggcacacgcctgtagtcccagatactcaggagcctgaggcaggagaatcacttgaacctgggaggcggacrttgcagtgagccgagatcgcgccactgcagtccagcttaggcatcagagcaagactttgtctcaaaaaagaaaaaaaatggaacccaaaatgctgggcat

SEQ ID NO: 44117 - DNA, 201 bp, Homo sapiens
ggcgaaaacaatctgtgcccaaattctggatggggccttaactgcaaacgaagagcccatcggtttggtgtgtcccaggaggcaatgccagggagagaacmggtggctggagttgtcttgggtctgtccatgtttcccaaataaaaaagttgtgcaccaagcaattccccatttaaaaaaaaaaaaaaaaacttgatttcc

SEQ ID NO: 44118 - DNA, 201 bp, Homo sapiens
tttctacagaccaaggaagactggtttcgggataaaactgttccacctcagatcatcaggcattagattctcaaaaggagcttggaccctaggtccctcamgtgcacagttcacaatggggtttgtgcacctatgagaatctaatactgctactgatctgacagggggcatagctcaggcagtaatgctcactggcccgct

SEQ ID NO: 44119 - DNA, 201 bp, Homo sapiens
tgtttttctgtgttggtgaggccagcagtcacagctcttctggtgagaaatgttattatatttgtggggagcggcattcaggacagctcatgcaaacccargctaaccaggcctacaggtgagggaggggcaggaggcagagatcacgggcgaaaacaatctgtgcccaaattctggatggggccttaactgcaaacgaag

SEQ ID NO: 44120 - DNA, 201 bp, Homo sapiens
gcttcctcacttgtgaatcttttctccactttcagagcctctgcaggggctatgccctccccagagaatgctcttgctctcgcaagcctggatccttcccrttctttagggaagaaatgtcccctcctccaatattctctagcatagttccctcctcttatttctgcaaggcacttgtgctgttctttcacaatttctcat

SEQ ID NO: 44121 - DNA, 201 bp, Homo sapiens
acagctattcatagggtttgccacaggtctggttccttgggaaacagattctgtgattcacgtgcccaagattttagtggtgcatctgaaggaacaagtgmagcagggctcaacagcatggcagaggtgacaagaatcaggagaggccgctctgcaaatggagcagatccagccccttggggtggatttggggccactcct

SEQ ID NO: 44122 - DNA, 201 bp, Homo sapiens
tttggggcacaggaccctgaatagacttccctttggatcccagcagaagacttcgcctgggggacttttcccattgccaggaaggataaaattgccatgamtcgacccagagctcaagcccttgacagttctcaaaaccctttttcgtccagcttctcttttgatttttgaaatcagccctactgtgagcaggccagagtg

SEQ ID NO: 44123 - DNA, 201 bp, Homo sapiens
gcagggaagcagaatgaggagcaggacctcagggggtccatgtggccagtgctgctgcccagggctgtattctacatgctccaggctttcctgtgcgtggyccaggtatggggtttcaggagggccagggctgggctggcatcggcttggccactcagtgggtgctcactgacagtgagtgtttagctttatgttcctggg

SEQ ID NO: 44124 - DNA, 201 bp, Homo sapiens
cttctgtcaagtggcttttggcttggtcaccactttgctggtgtttctctccagaagtgagtcccagacttcaggtgtggtctgactcacgtcctatcggrtctctccctctgaaaaccgtgcttgtattaaagcagcttgggagctcattaatgttcttggcagccaggtcctacccctgacagtgcaggagctgcctgt

SEQ ID NO: 44125 - DNA, 201 bp, Homo sapiens
agccatgtggcccaggcagggggcagcctctgttacccagagccataggcactgcagggaagcagaatgaggagcaggacctcagggggtccatgtggccrgtgctgctgcccagggctgtattctacatgctccaggctttcctgtgcgtggtccaggtatggggtttcaggagggccagggctgggctggcatcggctt

SEQ ID NO: 44126 - DNA, 201 bp, Homo sapiens
ctatttacaaagtattttccccctttaaaccagaaacttggcagggccccgtgattacgtagtggttccccagatgattacgatgcggtgtctggacttcktggaaagttttggcattagtggctgccttttgttttttcttttcttaaggtttgtgaaagtaaactggcgcttgccctgaggggcctgggcaagtggggg

SEQ ID NO: 44127 - DNA, 201 bp, Homo sapiens
actcagtacttccttagtcctccataagctgaaggtagaaagtggtggcagaatgcgttcatctcaagacgtaaactaaaaacagctgaattggctttgtkcagtgtttccagttttggaaacaaggacatgcacaatacgccacacgaatgtgtgatttctgcgatttcaccttcaagttaattactcttatatgtgcat

SEQ ID NO: 44128 - DNA, 201 bp, Homo sapiens
gaggaaactggttatggtggaaagaaagatgctatccaacaagaagtacatcagccagctattaagtaacaaatcacccccaaagctcagtgacttaaaayaccaatcatgcatcttcagggtggaggttggctgagctaggttgggtgcagctggatattctaggatagaattggcatttactgggaggggaagacacta

SEQ ID NO: 44129 - DNA, 201 bp, Homo sapiens
agaagaaaggttccggcctgcgccctgctaccgcggcgggaggaaaaaggttccggcctcagccggcgcacctggcggaggaggaacctcgcgacgcgctstcgggcatcggtttctcccagcaaagcttggagggtttagctgcgcggagagctcagcgagctcttctgtgtctgtttggggcgtgtgggctccgggagc

SEQ ID NO: 44130 - DNA, 201 bp, Homo sapiens
ttcagtttgagagagtgagtagacttccagataaaggtgttaagcaggaagttggagaattgagcctgggcctcaggggagagaacaggccttgagattcmagtttggggagcatctgctgatatttaaagccatcagatagggtcaagttagcaagggcatgaatatggacaagaagagaagatacccaagcgtatccag

SEQ ID NO: 44131 - DNA, 201 bp, Homo sapiens
ttgaatgactacagcgtgaaaatggcaaagcagacatttttcccaagctccgtcctcaaggcacagaggaattttaaatggctctgggttggggtacttgrcataatttgcagcactaaatccaaaacagatttgagcagccacagccacagagccacagtgctgggtcccaggtctggaatgtcattggaacaggagttg

SEQ ID NO: 44132 - DNA, 201 bp, Homo sapiens
tcagaccacgttcccttaccccctgactttgctcaaagagacagatctccatacttcttccctccatttgctatcttaactccacccaccatcatcacacrcatattgtaggaaatttagaacataaaggtgtaaaaagctgaaaaacttctatccatttattctactactctgaggactggagataatcttttggcccgt

SEQ ID NO: 44133 - DNA, 201 bp, Homo sapiens
ttacaggtgcgggccaacacatccagcttattttttgtatttttagtagaaacggggtttagtcatgttggtcaggctggtctcgaactcctggcctcagktgatccacccgccttggcctcccaaagtgctagtattgcaggtgtgagccaccgcgcctggcttttttttttttctgataaagacattagtcattggctt

SEQ ID NO: 44134 - DNA, 201 bp, Homo sapiens
aattctctcattccacagtattcctatgaaatcaggatgcctttgatggacatgccttaaattctctcattccacagtattcctatgaaatcaggatgtcwttgatggacttgccttaaattctctcattccacagtattcctatgaaatcaggatgtctttgatggacttgccttaaattctctcattccacagtattcc

SEQ ID NO: 44135 - DNA, 201 bp, Homo sapiens
tattatagtttcatagtgagttttgaaattaggaagtctaagttctctgactttgtgtttttaaagtttgttttggcttttctgggtctcttacattttcrtataaattttaatagcttgtcggtttctgcaaaaagggcagatggaattttgataggcatcatatcagatgcagattaattgaaaaatattgccatctta

SEQ ID NO: 44136 - DNA, 201 bp, Homo sapiens
tccacgacagccctttaaaggtggtctggacacacattgttggtctggcgcccattgtccctgaccctgaccaaaagcctcacagagctgcaaaaatgtcygtgggcaggactggctctaactcgggcctgggaggcaggactgagaagaaaacccacgtagtgagcctgcaccaggtcctaggaactttctacactttct

SEQ ID NO: 44137 - DNA, 201 bp, Homo sapiens
aagctggccattgtactgggttgaacagtgtccccccagaattcatgttcacctggagcctcagaatgggatcttatttggaagtagggtctttgcagatktaattagttaagacaaagtcatactggattagagtagaccctaaatccaatgactactctgcctagaagaatctgtaggaagacagaggcagagattggt

SEQ ID NO: 44138 - DNA, 201 bp, Homo sapiens
tcctctttagccttcccaagaggtttgcaagcacctcatcccctgttaagtctctgagaaaacagaaggggccttgggagttggtgttgccagatgcagcrcacagaggtttgggatgatgcctcctaatatgctgtgcggttctgggtaggcaggaggtagagagaggggatggcggcatttggtggtacacagaacaga

SEQ ID NO: 44139 - DNA, 201 bp, Homo sapiens
taatcagagatggggtggaggtgggctgaggtgaacgcgaatgcagaacttagcaatttgccaggtatttgggagcttaaaaaaaaaaagtagaagggaargaggaaggaaagtgctactttttgagtatctctgaaggattaggcaagatgtgattttattcctattattcataagaaaatcagggctcaggtagatgga

SEQ ID NO: 44140 - DNA, 201 bp, Homo sapiens
aaggactaaccaagattatggttagtgacagcactgaggctgaagacggacagcccctagtgcctccttgacccccaagaaggaggccctcagcggaaggrtgtgttttctcaagtccacagcttctgtgcctacatagtaggtgctcaataaatatcttatggatcccaggggttctaactgcaatctcctctcagtgca

SEQ ID NO: 44141 - DNA, 201 bp, Homo sapiens
tgattagtttgttacatgtacacatacatccatgtaaccaccccatcgtctagctataaagcatttccatctgcccagtgccgtgggccccctaagctccrcagtcgaagcggtgaccttctggtttcccatcttaccatggtggaaaccttagtagccaccctggccagtcactccgaggcggttcagcctccagctcct

SEQ ID NO: 44142 - DNA, 201 bp, Homo sapiens
ccgatttttattccaacttcagtcttatgattatgactcctgggaaacaggaaggggattttcttcccaaatataactgtgcccccaaagttgtggtcacrctggctgcggcccctcagatctccctgtgtagagaaccagccatgaggagtgaaattgggtgcagcccctgactgctgcacctttgggatctgctgcagt

SEQ ID NO: 44143 - DNA, 201 bp, Homo sapiens
aatgtcataaatacgtcttgaatcctaagtcctacctaccctggacaaattactgttctttgaactcaccctggttattgatccatccatccattcattcmgcattgcctgtgtgcccattttgtgctaggcatgggttctggggttgcagaggtgaccaagacaccgtcactggcctctatgagctgactgtctggagag

SEQ ID NO: 44144 - DNA, 201 bp, Homo sapiens
attcttaaagagcaatttaaaatcactggctgagattttatgaggatccttcccagctcagacatgctgtggtaagggggctctgttatttattaccacartaaagctgcataataacacaaccctcagtggcttaaaagaagaaagcatttctttctctcatgagtggctgttgttttaggctgggctcagctgggcggt

SEQ ID NO: 44145 - DNA, 201 bp, Homo sapiens
cacccccaaatcatgacatagaataaaatgttttgtgtcactaagtttggggctgtttgttacgcagcagtggaaacatggaacagtcatttggactgacytttggacagtcatttggagaggtgacatcatattaaatgagtagcaagtaccactgcaggaattagtgggggtggagggagcacctccagatcggaaggg

SEQ ID NO: 44146 - DNA, 201 bp, Homo sapiens
catggtaatccctctatgtgtgtttgtgtatcagtcttctcttcttataaggacttcagtcatattggattagggcccacctaatgaccttattttcgctkaatcacctcttcaaaggctctatctccaaatatggcaatattctgaggtactgggggttaggacttcgaaatatgaattttggattggacacaagtcagc

SEQ ID NO: 44147 - DNA, 201 bp, Homo sapiens
atactccatgtaagacagcaaacatttagattgtgttgcttgcagtcaagggagtcagatggcctcgggctggtctgcctggagcagagacaaggtttgtrgttttaacaagatgattgatggaggtgagcagagaaggccgtttgctggggatgacagtatatgtagtccattcacttgtgaggctcttcctcttacaaa

SEQ ID NO: 44148 - DNA, 201 bp, Homo sapiens
aacttctacctcacatcaaaaaggatttgaggccaggcatgatggctcatgcctctaatcccagcactttgggaggctgaggcagcaggattgcctgaggytaagggttcaagaccagcctggcaacatagtaagaccccatctctaaaaaattaaaaacataagattagccaggcatggtggcatccacctgtagtccca

SEQ ID NO: 44149 - DNA, 201 bp, Homo sapiens
gcatgcaaatcagctctcagacatgtttcttggtatactccatgtaagacagcaaacatttagattgtgttgcttgcagtcaagggagtcagatggcctcrggctggtctgcctggagcagagacaaggtttgtggttttaacaagatgattgatggaggtgagcagagaaggccgtttgctggggatgacagtatatgta

SEQ ID NO: 44150 - DNA, 201 bp, Homo sapiens
ttgagtcaaaggcggaggtgggcggccaagcctaccttggccccgctggggaggaaggggcagaccgggggggtctctgggtctctggagccttctaggtkggaaattcccatgaaccccctgacaccaggcaggcagaagcagtgaggtctgggagtttggggttttgtttcttgggggaagaggtgagttcgttctaag

SEQ ID NO: 44151 - DNA, 201 bp, Homo sapiens
ctgcattgaatgaacagtcaatcccaggggacagagtctggccttgatttggatagtttcaggctcatcccagcttcagagctccacgtggtgctcagtgrtggctgcatcacgttttagcttctcccctgtctaaggtgctcctctctctccctcctgggcattgctgcccagagcactctccaggaattttctgcatgc

SEQ ID NO: 44152 - DNA, 201 bp, Homo sapiens
aaaaaggcaggctgtggagtcacttcctctccttggtgagcacagtacaggagtctctccctgcttatctcggggggatatatcagatgaccccagtggaygcctgaaactgcaggtagtacagaaccctacgtatactatacacaaatttcttttttttcttcctaatttcacagatagaagattcattctttaaaatat

SEQ ID NO: 44153 - DNA, 201 bp, Homo sapiens
tcgagatgggggaactctcctggacagtctgggtgggcccaaagtcatctcaagggtcctcgtaagagggaagcaagagggtcagagtcacaaaaagtagwtgtgatgaaggaaccacaagttggagtgatgtactttgaggatggcagaaagggccatgacccatggaacacaggaggcccctagaagaaggaaagggga

SEQ ID NO: 44154 - DNA, 201 bp, Homo sapiens
gtctcaggccactcctaagggcttgttctgtgtgcaccaactgaacagcagcctctcattcagtatgcgggttagggagaggagaaaaacaaccaaagtcrcttgggcggaaaaaaccaggacacgattgattcccaaaggccatattttttttgcactgtttccttcaagtctgtggcccaggcaggcaaggagtaatat

SEQ ID NO: 44155 - DNA, 201 bp, Homo sapiens
tgagtggatctgctcttcgtcaaatgttctcggagttaatcccaccagatcctcctgtgtctccagttttgcttgtggcagaagaaattcttgaaaaacaytgtggcaggtagaataatggtctcaaagatgtcgacgtcctaatccctggagtctatgaatatgccaccttacaggataaaggggactttgaatatgatg

SEQ ID NO: 44156 - DNA, 201 bp, Homo sapiens
gatgcgtcaagccaagagcatcattttttacagcattcgaggagctcatcaatgctcccaggagcctctctcaagtttggatatgcacatccctcctctgsaagtgcctgtgctgtcctgattgagtggatctgctcttcgtcaaatgttctcggagttaatcccaccagatcctcctgtgtctccagttttgcttgtggc

SEQ ID NO: 44157 - DNA, 201 bp, Homo sapiens
gggaggagggagaggagcagaaaatattactattgggtactgcactgaattcctgggtgaggaaataatctgtacaacaaacccgtgtgacgtgagtttamctatgtaacaaacctgcacatgtgtctccgaacctaaaataaaagttaaaaaataaaaaaaattaaagaataaaaaggctacagagcattagaaaaaaaa

SEQ ID NO: 44158 - DNA, 201 bp, Homo sapiens
gaaggcctggggtggggcttgagaatataaattctttaaaaaaatttttttcttttccttagataaatcttagaaaccaaagggaattgaattcttaagargacttgaaaatgattctaatatagtcgggttaggggaaatctggtcttgagctttttcttgggagatgtggtgagtccaaggcaagccaggcttcaattc

SEQ ID NO: 44159 - DNA, 201 bp, Homo sapiens
gcctcgtagagactctgaacctggccgcagttcaagggcaggagagcctggctgtggaggatgcagggttctggaaaggcaccaaaaagtcatagcaaatratgtgggacaggggaggctgatcagggcttagcttgcaaataaaatttaaaattgtgaaacagattgggcatggtggcttacacctgtaatccccacaat

SEQ ID NO: 44160 - DNA, 201 bp, Homo sapiens
gcatataggtaaagtgtacaatttgataagtacactttttgagcaaatccaccctttgttctggaagaagacactctatagtctcaggctgtttctttacyaacatcaacaagctagtcttaaacagaggaacctcagtgcctcactttcaagacaatcaagattatttcccaacattccactagtagagggtcagaaaca

SEQ ID NO: 44161 - DNA, 201 bp, Homo sapiens
ggtgagggctctcttcctggcttatagatggctgtcatctcactgtgtcctttcctctgtgctttcgtagtgttgtggggggtgggacagtgggcagggckgggggagagaaagggagagagagagaaacctggtgtctctttctcttctcataaggacaccagttctatcggattaaggtcccacccttgtgacctcacc

SEQ ID NO: 44162 - DNA, 201 bp, Homo sapiens
cgccaccacgcccggctaattttttgtacttttagtagagacggggtttctccgtgttgatcaggcttgtctggaactcccgacctcaggtggatccaccygccttggcctctcaaagtgctgggattacaggcgatagcctccgcgtccggccaaatctcatttttaaatggctgcttaataattcatggtgtgaatgag

SEQ ID NO: 44163 - DNA, 201 bp, Homo sapiens
gcaggttacatgtgtggctatggaggtcgtggggtggggtgcagtaagaagaagctgcactttctgttccaaccaggacgtgcttcaagtgcagaaagaasacaatgacattctaagcaatgggaatgacccattctgtccttgccttttcctgctacttccttggtataagacaaccacctatgctgacaatgatgacag

SEQ ID NO: 44164 - DNA, 201 bp, Homo sapiens
gacaatgacattctaagcaatgggaatgacccattctgtccttgccttttcctgctacttccttggtataagacaaccacctatgctgacaatgatgacaragaaagaaaaagaaggatagggaaatcacaggctttttttcgactcagtacttccttagtcctccataagctgaaggtagaaagtggtggcagaatgcgt

SEQ ID NO: 44165 - DNA, 201 bp, Homo sapiens
ttttaactctgtgaaactttctttgatccctaaatttgaccccaagttaatcatttttctccctctgctacaattttcacatttagcttttaaaagatatytaatatattgtgcacctcttatactaggctgtgaactccaactccctgagacaagttgttcattcattcgtcaaatatttattgagctcctaccattgta

SEQ ID NO: 44166 - DNA, 201 bp, Homo sapiens
cattaatttcctttgagctaggattacaggccatctaaaacttcttaatgaatggccacactgcctttttgaagcatttgtgtatttgccaacacagactygaaggttgcattagatattgggagttgtcttttctggaagttagggtcttctagaagctgacgggcgatggaggcctgatgctctgccatttctttggtg

SEQ ID NO: 44167 - DNA, 201 bp, Homo sapiens
atctggagttggtaccattagcatagcttccttcctcttgcaaaggaggcaagcctaggctcagagaggctgggcggccggccctgctgcctccaaggccrgggctcacaccctcgcctcttcccaggatcgtggcagccactcacccagggctctcccaacagcacagcttctttctggcccaacatccatcacagaggc

SEQ ID NO: 44168 - DNA, 201 bp, Homo sapiens
gtttttggtaactgaaacattttaagactcaattccgccactttgttgaagataaaatcaagttcaaaccctgctttattttatttttcttttttttggayggaactagtgaggaaactgtgtgtgcaaaccccagaaaacccacttgagacctgatgctaattggctggatgatgttcaataggacacggctccactgag

SEQ ID NO: 44169 - DNA, 201 bp, Homo sapiens
ttaaggacattaagtccaggtgacaggtgggtgtggtaaccatcatgaaggcagtaagaaatggtgagcctctgcattactccaggatctggagttggtaycattagcatagcttccttcctcttgcaaaggaggcaagcctaggctcagagaggctgggcggccggccctgctgcctccaaggccagggctcacaccctc

SEQ ID NO: 44170 - DNA, 201 bp, Homo sapiens
atttcattgatattattgcttgggatgagattagagtatttaaaagttgaggccattgaaaaaaatgattaaggacattaagtccaggtgacaggtgggtrtggtaaccatcatgaaggcagtaagaaatggtgagcctctgcattactccaggatctggagttggtaccattagcatagcttccttcctcttgcaaagga

SEQ ID NO: 44171 - DNA, 201 bp, Homo sapiens
tgtatcaattccatacagcagccactccctgcagtggaagccacagacttataaagtggccgttgataacagaacagtttacccccaacccacctcccttstttaaaactccccaagacagactaatcagggcacattcataattcctcctgaaacaggaatgccacatcaaaacacacaagacccaaactggtctctagg

SEQ ID NO: 44172 - DNA, 201 bp, Homo sapiens
gatgtcatcaagatcacccagggacctgagaatgtgcagcgatttgagcaaatcagacacaaggagcatttctgctcctggagccgttgctgtcttgggascctgaggaggcccatgtggcatcatcactccctggggaaacgggatttgtttcatccttattattcttcaaggagcttggattcttcccctgctaactcc

SEQ ID NO: 44173 - DNA, 201 bp, Homo sapiens
gagatgatgacttttacgttaactaacttcattgtgatgattgattgatttgtgttcatatgcatctgctaacattttatcaaattttatgcttaaaatayatgcagtatgtcaattatatctcaacaaagctgggatttttttaaagctcgaaagagaaactgaaatactagacaagaaggaggtaactgcatgagttat

SEQ ID NO: 44174 - DNA, 201 bp, Homo sapiens
attatcaaggttcatcataattaaattgctttaaaacagtgataaggagaaaatctcaaaaggaccctgtaacaaaaaagacattacatatagaaaaacartgataataatagctgcagatctctcattggaatcaatgtaagccagaaagaagtggagcaaaatatttaaagaactgaaagaaaaaaaaaaaggttggat

SEQ ID NO: 44175 - DNA, 201 bp, Homo sapiens
agagctaaaaaatttccaaatttgatgaaatctttaacacacagagccagtgaacccactgcaaaaaaaaaaaagaagaaaaagaaaacattatcaaggtwcatcataattaaattgctttaaaacagtgataaggagaaaatctcaaaaggaccctgtaacaaaaaagacattacatatagaaaaacaatgataataata

SEQ ID NO: 44176 - DNA, 201 bp, Homo sapiens
tgcccttgtaggccagcagaagttctgagattcaaggtggatgaagggattgaaccatgacctggagtggaaaatgcatccttggggctaagtatgtcctstgtgccccgggcctgggctccacgtggccctcactgccttctaacaatcattgctggctatgtgtgaagcgccttgtgctaggtactgtcctgtgtgaaa

SEQ ID NO: 44177 - DNA, 201 bp, Homo sapiens
ctggcaggcggggagaataagaggctgcccctctgtgccttcgcccatgggaaatcttagactctattcatttgtcaagatcaactcaaagatcatgttcytaagaagtccttttatcctttctcctttgtgcaccttgggcattgtgcactgaattagggactatggttgactgcatgcaacagaaatattactggagga

SEQ ID NO: 44178 - DNA, 201 bp, Homo sapiens
ggccagacactgttctgaaaaatacgcagtcgacttttgaacagcacaggcttgaactgcatgcggccactaatactcggacttccttctgcctctgccayccctaagacagcaagacccacccctcctgctcctcagcctactcgatgtgatgatggtgagtatgaagacctttactttatgatgatccacttccattta

SEQ ID NO: 44179 - DNA, 201 bp, Homo sapiens
cagacagccagaggcctccccctggagcaccagactccattgcctcttgctctcgggctttcctcactcaggtgttcaccaagtattgcagagagcttccraagatgacctcaatgatttcctcctcctggtagtcacaccgttgtgtaagcccctgcccttgactgtgggctggacctagtgaatcatttctaaccatag

SEQ ID NO: 44180 - DNA, 201 bp, Homo sapiens
aaacaatattggaagaattaagagctaaaaaatttccaaatttgatgaaatctttaacacacagagccagtgaacccactgcaaaaaaaaaaaagaagaaraagaaaacattatcaaggttcatcataattaaattgctttaaaacagtgataaggagaaaatctcaaaaggaccctgtaacaaaaaagacattacatata

SEQ ID NO: 44181 - DNA, 201 bp, Homo sapiens
atgaataagggggtgtggggtcagtagaaggtcagtcctagacaaagctgcaaagagagaagattcgggtttctgtgtcgctcccctattcactgccatgyccctcatctaagccccatttttaccacgttgtcctcagggttagttgatctctaggctgctggtagttaggaagggcttagcaagactccaggtgggact

SEQ ID NO: 44182 - DNA, 201 bp, Homo sapiens
gaggcctgaactgccacgtcctccggtattgtccccttcccctctactttctatttgcccatcttcctaattagagggaaaaaatctacactcacttcctstattcaacctttcacttaaaaaaaaaatgcaactcccacccccctggttcccagcctcgaagggaagccaccctggccaggggcaagcatcgcagcaaac

SEQ ID NO: 44183 - DNA, 201 bp, Homo sapiens
cagaaagggctgcacagggtccctcctgagtcttcatctgatcctgtaagtacttatcagcacttgcatgagaggaagctaccctcctccaaagaattagrgaaaacatccctagcgtgcaaacagaccaggaatatagcgttttcaccagccacagtggataagcctcagagttagaaggatgtcagagtactacagaag

SEQ ID NO: 44184 - DNA, 201 bp, Homo sapiens
tcaaatctctttgctgggccaaagcaagccatatttatgcctttggttcagacatggaagaaacagaaaattgattatgttcctgttggtttcatcaaacmcatcatattcctggtatcctctgacagtctgcaataaagcagtgagatctcaacccttcccaggccatggggatgatggaatctgggaagctggcatctt

SEQ ID NO: 44185 - DNA, 201 bp, Homo sapiens
gatggctaaaattcacgcagagtaccagaggtggaaataacacagaaagggctgcacagggtccctcctgagtcttcatctgatcctgtaagtacttatcrgcacttgcatgagaggaagctaccctcctccaaagaattagagaaaacatccctagcgtgcaaacagaccaggaatatagcgttttcaccagccacagtg

SEQ ID NO: 44186 - DNA, 201 bp, Homo sapiens
ttaacatgccatgagggttagttaagaattccatggaagctgggggtctattccaagtaagaattccacactgtttctgtgagaattcattaaggatcacmtggcaactctgagagattttcacgaaaattcattgagaactccataggtcttctatgaacattccatcagacttgtggaaaaattctatgagaaggagac

SEQ ID NO: 44187 - DNA, 201 bp, Homo sapiens
ctcccactgagtggtgggggtgcctgtattccctccctttgaacctgggcaggcttgcgactatggcagaagtgacactatggaacttccaagaaaagctyattagattataaaatgctatgcatatctaccttactctcttgagtctctcttggaacccagctgccatgctgtcaggaagcccaatctagcccacatgga

SEQ ID NO: 44188 - DNA, 201 bp, Homo sapiens
aagtagaggcttgtgaagagctcaccagaatatctcattctgggttctgtgttcctagggaatgatggtggtcaaagaagccaggtaacccacagatcccrgtacccacagatcccggaaacagcccctccaaaccacggagcggagtgaaggaggcagtgtccagatggcagagggctttcatgcccactttctcccaac

SEQ ID NO: 44189 - DNA, 201 bp, Homo sapiens
gtttctaatcaacaacagtagaggaggctgacctacaggtcaaatttaaatgccccttgttatggaggggaaggaaatttccacgtagttttacagggagsgggtaagtcaacagcaaggcctttggaatcatcattgcaaagctaaggagaaagtcaaggttgataaagagcctagacctttgattctgatggaaaaatg

SEQ ID NO: 44190 - DNA, 201 bp, Homo sapiens
gccatgagggttagttaagaattccatggaagctgggggtctattccaagtaagaattccacactgtttctgtgagaattcattaaggatcacatggcaaytctgagagattttcacgaaaattcattgagaactccataggtcttctatgaacattccatcagacttgtggaaaaattctatgagaaggagacacagctg

SEQ ID NO: 44191 - DNA, 201 bp, Homo sapiens
aatcatattccattgtgtggatgtattgcatgttatttacccatttgtccattgatggatgttagattgtttccactttttggctgttataaataatattmctatgaatattcacattgaggttttcgcatagatatatgtgtcatggtttggatgtttgtcacctccaaacttcatgctgaaatgtaatttctaatgttg

SEQ ID NO: 44192 - DNA, 201 bp, Homo sapiens
tggtcaaagaagccaggtaacccacagatcccggtacccacagatcccggaaacagcccctccaaaccacggagcggagtgaaggaggcagtgtccagatsgcagagggctttcatgcccactttctcccaacggccttacaaatgaccctggcaaggcatgcattcacccaggtcagagctcaataaatacttgtggtgt

SEQ ID NO: 44193 - DNA, 201 bp, Homo sapiens
acatgtcaccccaagacatagcacctcggaaatggagaaaacatcagaagcaggaaggccactgtctgcctttcccaggccttgctgtatgaccactggcrtgaaaggattctctgacccactcccctgaaagtagagaccctcatgtgacaggtgtcctgacctgtacccagaggaaaggaatgaagacacagaactgcc

SEQ ID NO: 44194 - DNA, 201 bp, Homo sapiens
agaagttgtaaagacaatcaggaatgtcaggcacagagcacactgcctggattggaaaaggtgtttgggaatgtgacttgattgccctctcctacacatcytcaagcacactgcagggcacatggtgctgtaataatcatttagagcccctgtgctccaggcattgtgccaaatcttggcatcaagagtgcttttaatcct

SEQ ID NO: 44195 - DNA, 201 bp, Homo sapiens
gggcgtgatcaagtcacctcccagggatattttcgaggatgagaggtaaggacggcaggagaagctcaatgtgctggctacttttaccttagcgtaaacayataagagagcgaaaaggcatccctgaaactgaagccatgttttcacaagctgtcttcacggcttattgattatttgagatgtttgcacacagactggggc

SEQ ID NO: 44196 - DNA, 201 bp, Homo sapiens
tgtaaccatgtctcaatcaccagcctaactctaatagaaggagggtacttgtcagtgctgaattgaattgtgagtttctcatgagaggttggggtagaagracatgagatattaagtgtaccagaaaaaggatgggtagttctggtgtgtttcagtcagctctggctgctataacaaaataccatagccatagggtggctc

SEQ ID NO: 44197 - DNA, 201 bp, Homo sapiens
atggagcccagaggagccgctcccagccacagtccctaacccctcaggcctgagtctcctttctcctccaactccagcccagccgagcatggccctggctmccctgttacctcttttcccatggtccatgctagggcctgtgctcagtgagggctggacactctgtgagcatggccaggttctggtggccccagaagacct

SEQ ID NO: 44198 - DNA, 201 bp, Homo sapiens
ggtattgtcttgtaacagcaggctctggggtgggttcaatgaaaatccagccctgcatgtctctgtattctaacctgaaaagaattatgttacatcaataratgatacccattatgtgccagcatccagggctcttaattgactcgggcttagttaatgattgggagaacatccacggagagcctgaggctccaaagggag

SEQ ID NO: 44199 - DNA, 201 bp, Homo sapiens
ggaaggagaacaggaaaggagaaagacacattcctctcttttaactcacacttacatcccactggtgagtacaagttataaaaccacacttaatgagatgkgtatggtggctcatgactgtaatcccaacactttgggaggccaaggctggaggatcacttgaggccaggagtttgagaccagcctgggcaacatagcaag

SEQ ID NO: 44200 - DNA, 201 bp, Homo sapiens
ccttagctgcctttttgactgagtctgagctgcctttgacctcctggggtagtgcttctgagacaagagaatagggtctggaggcaggaaacctaaggtartttcaggccgacttcctagaactaaattgaaagaaaaacccgggccaggcgtggtggctcacgcctgtaatcccagcactttgggaggccgaagagggtg

SEQ ID NO: 44201 - DNA, 201 bp, Homo sapiens
ctccatttgtttgtgtgtctgtgtcccatgtctgcttaatcattgtgtctctaggtctcagcacaggctggacatatgagtgggccttgggtagtctttcraagatctaaaggacagagagaaaagcccaggagttggtgttccattcgatacacccctaggtcaaacagtttcattaaaaagtagtgacacctcaccgac

SEQ ID NO: 44202 - DNA, 201 bp, Homo sapiens
tatactgcaatttagtatcgatgccttattgacagacatggttgtttctaatatttagggcattaccttaaaactctcctgcctcaatttcctcatctatraagaatgcagaacagagcctggcacaagacattcaataaatattgaagagtaatatataaagagtagctcttttggtcattattctccctcttttttcca

SEQ ID NO: 44203 - DNA, 201 bp, Homo sapiens
ttattctggttgtcgctgcgcctttatcagatgccagtgtgggctatactgcaatttagtatcgatgccttattgacagacatggttgtttctaatatttrgggcattaccttaaaactctcctgcctcaatttcctcatctataaagaatgcagaacagagcctggcacaagacattcaataaatattgaagagtaatat

SEQ ID NO: 44204 - DNA, 201 bp, Homo sapiens
cccatctgagatcccgaagcactgagcacattgtgatgtcactgtcttcatcacccggactcccttggagccaggcactggcttaatcctatctccatttsccccgtgcccagcacatagttagtgctccagatgatgggagactcaatggagagacacgtgagtggatggatgttttgctgaaggcatccaatgtggcag

SEQ ID NO: 44205 - DNA, 201 bp, Homo sapiens
cccttctccccttctgctgtgcactttgattttcctgcctaactctctatcctggaggtggcgggagaccagctcatgaacttcctttattctggttgtcrctgcgcctttatcagatgccagtgtgggctatactgcaatttagtatcgatgccttattgacagacatggttgtttctaatatttagggcattaccttaa

SEQ ID NO: 44206 - DNA, 201 bp, Homo sapiens
tgagagatgggttctgtgcacacaagccaatatacggctatagtcttttcttccccttctccccttctgctgtgcactttgattttcctgcctaactctcyatcctggaggtggcgggagaccagctcatgaacttcctttattctggttgtcgctgcgcctttatcagatgccagtgtgggctatactgcaatttagtat

SEQ ID NO: 44207 - DNA, 201 bp, Homo sapiens
gcctcccaagtagctgggattaaaggtgtgagttactgagcctggctaaacttaaacatttttgtgaaaatagctaatatagtcacataaagcaaaatcaraaaagtctaagcaaatgtacagtgaaaactttctctgtaactctctccccagcctccgcattcctttcccagaaggcttccagtgttccaagtttctcat

SEQ ID NO: 44208 - DNA, 201 bp, Homo sapiens
tgtttgcctaggctggtctcaaactcctggcctcaagcgatcctcccgcctcagcctcccaagtagctgggattaaaggtgtgagttactgagcctggctwaacttaaacatttttgtgaaaatagctaatatagtcacataaagcaaaatcaaaaaagtctaagcaaatgtacagtgaaaactttctctgtaactctctc

SEQ ID NO: 44209 - DNA, 201 bp, Homo sapiens
gctgcagacttaactcccagccattcatttccagagacaggacaaagacctttatattttttatttccttcttttaacttaaatgtcattattattattayttttgttttgttttgctaagagatgagttttcactatgtttgcctaggctggtctcaaactcctggcctcaagcgatcctcccgcctcagcctcccaagt

SEQ ID NO: 44210 - DNA, 201 bp, Homo sapiens
acacttgcaccattcataggaaacacatgttggctggtaattgttttgaactcattttgagctgggctgcaccacgttgggctgcccttgcgttttcgcastggtttgagatggccgtggaatttgcaaggaattttcttcccaattccagaggctccacgagggggccgttccttggccaagctggcagaagagcactgt

SEQ ID NO: 44211 - DNA, 201 bp, Homo sapiens
acccctctcctctgaatctgcctgagctctaaatccactgaagtcaggtggacagcaccaaagtatccactgtgctctgtctagaagctggtgactgtgtsggataagtgctgcaccagtgcacctcctctggccaccccagaatcaggcaggttcacccacgcagtccaagccaccctgcaaggcaggagggatgagaac

SEQ ID NO: 44212 - DNA, 201 bp, Homo sapiens
atatgtcttttcttataggggtgtctgctatgaagcttgccatgggggaggaaagggaatagttttctccccctgcaatgctcagagtgcacttgggaaaycataagcaggtgattatcattgaggctttaggaggtacgttagtttcctgtggctgctgtacaaagtgccacaaactgggtggcttaaaacaacagaaat

SEQ ID NO: 44213 - DNA, 201 bp, Homo sapiens
atctgttttgaacttacaatataacagagaaaacagacaacaagcaagatgaataaacaaaaatggaataagtaaaacaaatagtagagtcctggagtgaytggggaacacaggatgcccttgagtctagagtgagagaaagagtgggactataaaaaatgaggactgaaagacagtgaggggttgggggatgcaaagtct

SEQ ID NO: 44214 - DNA, 201 bp, Homo sapiens
ttccacgtccagaaccgtatcttgtactcagtaaacactgaacaatgaactcagtaaacattgaacacctttctcttaggaattggcctggatagttagastttagaagtcccaaactgaactcacgtcttcctcccatgatccctgggccagtgctccttctccagggctccgcatctgagatgtgacaccatctaccca

SEQ ID NO: 44215 - DNA, 201 bp, Homo sapiens
actgggggcaaccagtgtaacatggttggtgatatgtgaatgaaccttttaaaatgttaatacttttgcatttattttaatatgtgttaaaaatatttctrgtgtattatatcagaaatagttttcactgcaaacaacaagacaaaaagtaaagaaaacaacaacaaaaaccagtggcttcaacagaagtttattttgccc

SEQ ID NO: 44216 - DNA, 201 bp, Homo sapiens
gcctctcagctgggaagggactgaaatggcggtcagggcagagacagcccgagtgtgggtgactagttaggaccaggtggtggggtgaggtgtgcaagggrctgaggcctcccagctcccacactgaccttactgcgacctcgctagagctacaagcctatgccctgggatataaacatgaataggatacagtcccctctc

SEQ ID NO: 44217 - DNA, 201 bp, Homo sapiens
taaattttcttttgatctcagatctgcaaagccgctcagaaaaaataaatcgcaacagtgggcccacggtggttggtcagagccagagaagccagaaaagkttccttctccagctcagggttccctgattccccctggtacattacatatcaaaaggaggcgggtgcgctggggagggatccctggctcagaacagggcaa

SEQ ID NO: 44218 - DNA, 201 bp, Homo sapiens
caattccactaggtctgagaagctgaaagcaaaggttattagctgaaaatgcaccactgagcctgttcgttctccagataatccagtttatgtatctgatraaatgggatcaaaatgagaaacacatttccaaaaggagttggaaacagcattgtccttcctccagagcattttacaactgcaaaatcacggtgattcatg

SEQ ID NO: 44219 - DNA, 201 bp, Homo sapiens
tgaaaatcatttaaatggttttcacagcatcgtttgatttaaagcatttatcaccacctaacgcataattaacagcaggacaagcgattgaacaaaggctstcttctactcagagggattatgttaattttcattaatcttatatattaccatctctttccaaatgaatgttatcttaaaggcccaaatgccttctttgat

SEQ ID NO: 44220 - DNA, 201 bp, Homo sapiens
atcacctaaggtcaggagttcgagaacagcctggccaacatggtgaaaccctctctctactaaaaatacaaaaattagctgggcgtggtggcaggcgcctrtaatcccagctactcgggaggctgcggcaggagaattgcttaaacccaggaggaggaagttgcagtgagccgagatcacgccattgcactccagcctggg

SEQ ID NO: 44221 - DNA, 201 bp, Homo sapiens
ccctaacgccacagccggggtctctcggaagctctgtggttttggccccctatgagagctgtagtacacgttccttcgttctcttccccagcctcctcccwttaccactgtaccccttaggaacatcttaagagttccagaacttcccaggaccttcaaagcggttttatgccaccatgcctgcttatgaccctcctccaa

SEQ ID NO: 44222 - DNA, 201 bp, Homo sapiens
gagaatgacagccaagtaaaaggggtttccccttataaaaccatcagatctcaggaggcttattcactaccacgagaacagtatgggggaaatcactcccrtgattcaattctcccccactgggtccctcccacaaatgagggaattatgggaggtacaattcaagatgagatttgggtggagacacagcaaaaccgtatc

SEQ ID NO: 44223 - DNA, 201 bp, Homo sapiens
tgttcattccttgtgccccaccgtccatcctgcttccttagctgcctttttgactgagtctgagctgcctttgacctcctggggtagtgcttctgagacargagaatagggtctggaggcaggaaacctaaggtaatttcaggccgacttcctagaactaaattgaaagaaaaacccgggccaggcgtggtggctcacgcc

SEQ ID NO: 44224 - DNA, 201 bp, Homo sapiens
tccatccttacatcttcctgttaagagacttgtgattacatttggtctttgtagttaagccagaacaatccctcagctcaagatccttagtataatcacawctgcaaaatcccccttgccatggaatttcatgtatttgcaggttcctgggactgggacagggacatgtttgggagccaccattctgctgactgcagtggc

SEQ ID NO: 44225 - DNA, 201 bp, Homo sapiens
ttaaaacttatgaattgaattatttgtttctggaatttttcgtttaatattttcaaacccctgttgaccatgggtaactgaaaccacagaaagggaaaggmagttaagagaggactaatgtactcgaagcccacactttccagtcctcccctcccctgcggctgacccccgtgctcccccaccttgtcccgtggagtcaca

SEQ ID NO: 44226 - DNA, 201 bp, Homo sapiens
tttaaataaagaaataaaaagaggttattgacccctaccttttggccgaatcttagtcttgaacggcttgcctgaactgtccggaatttcgcagcccaacytgacactgatttcaaccaattctgttcattccttgtgccccaccgtccatcctgcttccttagctgcctttttgactgagtctgagctgcctttgacctc

SEQ ID NO: 44227 - DNA, 201 bp, Homo sapiens
acaacaagacaaaaagtaaagaaaacaacaacaaaaaccagtggcttcaacagaagtttattttgccctctgctgtaagtcaggggctggcatggcatgtsatatggtttggctctgtgtccgcaccaaaatttcatctcaaattgtaatcctcagtgttgcatgaggagcctggtggaaggcgattggatcatggggatg

SEQ ID NO: 44228 - DNA, 201 bp, Homo sapiens
ccgggtactctttcttaagacattgatataacagccccaaagagctgacttgatcatcagggccagacccctcacctcggagtagatgagaaactccagakgaaggggaatctatctgaatgactcatcttttcctcccctgggactccagaaaggatctgcactattccatttcagtggcaagatatctccgtcctcttc

SEQ ID NO: 44229 - DNA, 201 bp, Homo sapiens
tagtgtttaatgggaacagagtttcagtctgggaagatgaaaaagccctggagatggatggtggtgacggttccgagaccatgtgaatgtgtttaatgcckctgagtggcacatttgaaaatggggaaaatcggccaagcttgtggctcatgcctgtaatctcagcactttgggaggctaagctgggaggatcatttgagc

SEQ ID NO: 44230 - DNA, 201 bp, Homo sapiens
aaaaaaattttaaataaagaaataaaaagaggttattgacccctaccttttggccgaatcttagtcttgaacggcttgcctgaactgtccggaatttcgcrgcccaacttgacactgatttcaaccaattctgttcattccttgtgccccaccgtccatcctgcttccttagctgcctttttgactgagtctgagctgcct

SEQ ID NO: 44231 - DNA, 201 bp, Homo sapiens
ccccagcttcgtgtgcaaacttgggccagtgtctgtgcctctggggcctcagtttcttcattaccaacttccagaatatcggtctccacgctgggctaacmgcttgcatttatggaatgctttgttgaatgctggtgctgttgtttccccatttcacagatgaggaaactgagatcttagaggccctgccaggttcgcacg

SEQ ID NO: 44232 - DNA, 201 bp, Homo sapiens
tttgaggaaactgagattcagaaagcaggagcctatgtctaggggagagcaccagtggaaagagaggtgacaatgaggatccgagagaggggacgtcctakctggatggaggagttagggagtgaggagggaaaggccttctcagaaatcccaggggatgcacgcatcggcctttacagtttataaagtacaccctgtact

SEQ ID NO: 44233 - DNA, 201 bp, Homo sapiens
tagaaaaaaaaaagatctatttatgcccatttcatcatttagcccccaaagtctgaggttcttatgttttttgttgagtgcgggatgttcctgctgacatmataataataataataataataataataataataataataataatactatcagccaggcgtggtagctctcacctgtaattccagcactttgggaggccga

SEQ ID NO: 44234 - DNA, 201 bp, Homo sapiens
tcttgcagcaaggtgaccaagtgaacactttctggctaatgagatgtacatagaagtcttgtgtaatacttctgggaagctttctgaaagagagcgaatayactcttctcccattttcctcaaaaaccttctagcaggaatgtggatatgatgtctggagctctagcaaccatatcagaccacaaggatgaatgtacaccc

SEQ ID NO: 44235 - DNA, 201 bp, Homo sapiens
aggagcaggaatggagtgcaatggatgggaaggcaggagagctaggggccgaggacccagctgcagacttaactcccagccattcatttccagagacaggrcaaagacctttatattttttatttccttcttttaacttaaatgtcattattattattacttttgttttgttttgctaagagatgagttttcactatgttt

SEQ ID NO: 44236 - DNA, 201 bp, Homo sapiens
ctgtgacagctgccactctccttcccagccagactctcccagctatgcctgtttcaggagcaggaatggagtgcaatggatgggaaggcaggagagctagrggccgaggacccagctgcagacttaactcccagccattcatttccagagacaggacaaagacctttatattttttatttccttcttttaacttaaatgtc

SEQ ID NO: 44237 - DNA, 201 bp, Homo sapiens
caagttagtcttcaggaatacaaagcccagcaagtgcaggggggctcagtgtgatgtgcacacagtgtggcacagcccaagagtccggctttggaggcagygatctctcagaactaagaccaccctgaattaagaccaccctgtcagcatccccttactctgaccatgcagcatggtctttgggctccacaaatatccttg

SEQ ID NO: 44238 - DNA, 201 bp, Homo sapiens
cctcatctgggaggtgggattgatcctaggggccgtcagtggaggaggctcaaggaagtcctgtagcttccagcagaacaagggtgtccttcaagcagctsctcgtgagcagaggggcagctgtcctttttctgccatgtttcagttggggctgtctcttctgcatgctctggctggaagggacctctgaggtcaggtcag

SEQ ID NO: 44239 - DNA, 201 bp, Homo sapiens
tcagtttcctcatctgggaggtgggattgatcctaggggccgtcagtggaggaggctcaaggaagtcctgtagcttccagcagaacaagggtgtccttcargcagctgctcgtgagcagaggggcagctgtcctttttctgccatgtttcagttggggctgtctcttctgcatgctctggctggaagggacctctgaggtc

SEQ ID NO: 44240 - DNA, 201 bp, Homo sapiens
attctctcctgcttctacagtaattgagttcttagctggcatgtgggtgcctagctgatgcctactttcccagaccctcttgcagccaggtgtggccatgrgatcaggttccagccaatgagctgtgaaccaaagtgatatgtgcaacttgcagggcatgtccttcctctgccccttttcttctcactggctggagtgcag

SEQ ID NO: 44241 - DNA, 201 bp, Homo sapiens
agttacctctgtaaaggctctatttccaaatacacccacattctgaagccctgggggttaggacttcaacatatagattttttggggaacacaagtcatcycctcacagcaggtgatgtgaagtcatgagctccaccctggccccttagtagccacatccttgatcaagtcccttccactactgggtctcagtttcctcat

SEQ ID NO: 44242 - DNA, 201 bp, Homo sapiens
tgtttggggcgtgtgggctccgggagcgtgaggaccgggaagctaggaggctccttcccttctggcggctccctcactgagaccgggcggtttggttgcgrgggaagtggagacgagccacccttgacctttgactgcaagaactcaccttgagcaggatagaggcacgtggacggtgaccctcgggatgcaataaatgct

SEQ ID NO: 44243 - DNA, 201 bp, Homo sapiens
tgttttcaaaccaaacatggcctttccttcgaggactgggaaatttgggaagaaagatattgcatggctctcctgtggatctttccggccctatcaccaaygaaatatctcactggactcttaggggaaagttgaaatgcactcccaaagagattcaggccactgcgggtaacttcaaaggacggtcctccagaaagctga

SEQ ID NO: 44244 - DNA, 201 bp, Homo sapiens
atggtgttttagtgccttgtccttcccctaatcaaaagcacaagaagcaaaagcacactgagcagatagcaatgaactaattgacaaaaataaataaacargccaaccagacattcatgttatcatgttattaattcattcattcaaaaaatatttttgggcacctgctgtgtgccaggccctgtggtaggcactgggggt

SEQ ID NO: 44245 - DNA, 201 bp, Homo sapiens
ccccacgggcttcttgtgaagataaaataagacaatgtttgcccagggcaggatggggatagtagtctgctgggcctcccatgacaaagtactacagactygggggcttaaaccatagaagtgtattttcttacaattctggaagctaaaagtctgagatcaaggtgtccacagggttggtttctaatgaagcctgtctcc

SEQ ID NO: 44246 - DNA, 201 bp, Homo sapiens
atttattgagtgtgtggcaatagaatttatggagacttgtgttgtctctctgtcccaaacattgtagagcagagatggctaactgctctccagtacacatkctccttccttttattaagagaaacagcctccctgattttaatagccagaaaacatgtttcctggcttgccttgcaggaagatatggccatgagactatgt

SEQ ID NO: 44247 - DNA, 201 bp, Homo sapiens
ccctaatcaaaagcacaagaagcaaaagcacactgagcagatagcaatgaactaattgacaaaaataaataaacaggccaaccagacattcatgttatcakgttattaattcattcattcaaaaaatatttttgggcacctgctgtgtgccaggccctgtggtaggcactgggggtgaaatgtgacccagtggtcacatgt

SEQ ID NO: 44248 - DNA, 201 bp, Homo sapiens
cctttttgaagcatttgtgtatttgccaacacagactcgaaggttgcattagatattgggagttgtcttttctggaagttagggtcttctagaagctgacrggcgatggaggcctgatgctctgccatttctttggtgagacctctggactgcttcgttcatagtcctctttcccacatatgctcccctgatgtcttactc

SEQ ID NO: 44249 - DNA, 201 bp, Homo sapiens
tggtcccctggttctccctcacctcaccagggcacgtgggaacctgcatcctcattgatcatggagaatgagcagcacctcctcagggccagtgtctagayattctctttgctgatgccgcactattgctttcggccatatattggaagttgaaccaaatgcaatgtgcagcttctcctagaggcttggagtctcctctgg

SEQ ID NO: 44250 - DNA, 201 bp, Homo sapiens
ggcactgggggtgaaatgtgacccagtggtcacatgtcctagctgaggtgccaagacagagtttattagacagtgatagaatttgcaagataggccaggcrtggtggctcatgcctgcaatcccagcactttgggaggccaaggtgggtgggtcacctgaggtcaggagtttgagaccagcctggtcaacatggcaaaacc

SEQ ID NO: 44251 - DNA, 201 bp, Homo sapiens
aggtgcatcctttctccagcttctcctcttggtgaacttccactcctccttcaggatccagctggacttctttctttttggaaatcttccctaactcttcrcccctgtccccatgtccccatgtccccatgcaacattattggcagggacttctcctccgttctgctggcatccgggctcttctctgccataacgtttcgc

SEQ ID NO: 44252 - DNA, 201 bp, Homo sapiens
tgggaggccaaggtgggtgggtcacctgaggtcaggagtttgagaccagcctggtcaacatggcaaaaccccgtctctactaaaactacaaaaattagccrggcgtggtggcaggcacctgtaatcccagctacttgggagcctgaggtaggagaatcacttgaacctaagaggcggaggttgcagtgagccaagatcgcg

SEQ ID NO: 44253 - DNA, 201 bp, Homo sapiens
ccactcctccttcaggatccagctggacttctttctttttggaaatcttccctaactcttcgcccctgtccccatgtccccatgtccccatgcaacattaktggcagggacttctcctccgttctgctggcatccgggctcttctctgccataacgtttcgctcacagcattatctcttaatttatctctctcacctggaa

SEQ ID NO: 44254 - DNA, 201 bp, Homo sapiens
gtgggtgggtcacctgaggtcaggagtttgagaccagcctggtcaacatggcaaaaccccgtctctactaaaactacaaaaattagccaggcgtggtggcrggcacctgtaatcccagctacttgggagcctgaggtaggagaatcacttgaacctaagaggcggaggttgcagtgagccaagatcgcgctactgcactcc

SEQ ID NO: 44255 - DNA, 201 bp, Homo sapiens
atctcgcacccccgccccgccattttttctgtctacatttctaaacatttttctgatttcaaagcatagcatgcccttcccaaaaaaattggcaaatttgaaaaaaaaaaatcacatgtaaaataaaaatctgtgattccactacctggatgtttttcctttacacaaagttccatccaatcattttcccctgtatgtatg

SEQ ID NO: 44256 - DNA, 201 bp, Homo sapiens
ttgctaggtcacatggttactcttatatttaactttttgaggaactgccaagtattttccaaagcagctgcaccattttgaattcctagcaggagtgtatyaggggttcattttctccaaattgtcctcaacacttgtcattatctgtctttgtgataaaagtcatcatcttactggaggtgtcgtgttatctcattgtgg

SEQ ID NO: 44257 - DNA, 201 bp, Homo sapiens
ggcggataagagagccaacccagagggcaccaatctgatggggcctgtcctgtgggaggtcagatctatctatctatctatctatctatctatctatctawatatctatctatctgtctatctgtctgtctgtctgtctgtctatctgtctgtctgtctgtcatctatctatctaatctatctatcatctacctatctgtc

SEQ ID NO: 44258 - DNA, 201 bp, Homo sapiens
gcggataagagagccaacccagagggcaccaatctgatggggcctgtcctgtgggaggtcagatctatctatctatctatctatctatctatctatctaamtatctatctatctgtctatctgtctgtctgtctgtctgtctatctgtctgtctgtctgtcatctatctatctaatctatctatcatctacctatctgtct

SEQ ID NO: 44259 - DNA, 201 bp, Homo sapiens
acattttagggagacataatacatcaatcaatacatgtaagatttacattggtttgatctggaaggagggtacaatttcaactgggatggggggcacttcytggtcataggtagatttaaaatgtttctacctggcaattggttgaaagagttactatcaatagaaaggaatgtgtgggttatactaaggggttgtgaagg

SEQ ID NO: 44260 - DNA, 201 bp, Homo sapiens
  misc_feature (1)...(201): n = A,T,C or G, or insertion/deletion polymorphism (see Tables 1-2)
attaggagccctggctgagcaccacaccatgatccctccagttcttgccactgccagagccagggaagtgcaatgttggcagaaaccatgggaaatactgngatggagccatttttggtagtagatgtgatctttttctcttaatacagctgtaacataatggaatggcaggaggaaaactagatcgtggctggaattctt

SEQ ID NO: 44261 - DNA, 201 bp, Homo sapiens
ggtaaaacaaagaatacaggttgctacataaaaattaataagggatgacttcctcccctcactttccagcatgcataaaaatagcagaagctttagcagaktcccccatgctgtaggtgacagagcttcagcagtgacttcttcttgtttcccttctggcttttcccaggaggcagcttaggtttgaagcagcatttcact

SEQ ID NO: 44262 - DNA, 201 bp, Homo sapiens
cctataaaatcacagatgaggatcctgagcttctccatttggggcagaactcactgggacatcttgatacctcgaaatgttagcacgacgtgcaccatgcrggcactgagaagcagcgcaaggcagcagtgcaggtgtttgcaggattgaatctcagcagccgcttgttactctgaggccttgagcgagttccttgacctc

SEQ ID NO: 44263 - DNA, 201 bp, Homo sapiens
aaaaaaaaaagatctatttatgcccatttcatcatttagcccccaaagtctgaggttcttatgttttttgttgagtgcgggatgttcctgctgacataatmataataataataataataataataataataataataataatactatcagccaggcgtggtagctctcacctgtaattccagcactttgggaggccgaggt

SEQ ID NO: 44264 - DNA, 201 bp, Homo sapiens
tggctcacacctgtaatcccagcactttgggtggccaaggtgcgtggatcacctgaggttgggagttcgagaccatcctgaccaacatgtagaaaacttgyctctactaaaaatacaaaattagccgggcatggtggcacatgcctataatcctagctgctcgggaggctgaggcaggagaatcgcttgaacctgggaggt

SEQ ID NO: 44265 - DNA, 201 bp, Homo sapiens
agcctcactctggatcccactcctcagctgagccagagttccctgagcaccttctatgccagcacattccagtaaaatagtatcattctgccctggcacartttggcgaggcaggcaatatcatccccgttttgcagaggaggagactggggctcagagttggagaagacttgaatccagctgcctctttttcatcctaca

SEQ ID NO: 44266 - DNA, 201 bp, Homo sapiens
taaaacttagatggaatcaatgcatcgcacttttctcttgttaatatgtcttttcttataggggtgtctgctatgaagcttgccatgggggaggaaagggwatagttttctccccctgcaatgctcagagtgcacttgggaaaccataagcaggtgattatcattgaggctttaggaggtacgttagtttcctgtggctgc

SEQ ID NO: 44267 - DNA, 201 bp, Homo sapiens
tcccagtggcttgatcttttgctgtttcggtttatcacaaatgattttccaagccagtggatttaattatattatacacttagggaaattggtgccatttyttaattacttttatagttgaaaagcaattacttagcaatcacatgaagggcttctcatgtttcctggagttctgtagagaaccagacctggtttgaagaa

SEQ ID NO: 44268 - DNA, 201 bp, Homo sapiens
actggaatggagctagttccattttccagtccctgtgtcccagcactggggtgccccctcctccggggcagtggccagcgcctggcagctcagaggaacasagagctcctcttccctggccctctcgggcagacctgacaatccccactgctgcggggaggctctgccatccttgtgctaatcccattacccacaaatgaa

SEQ ID NO: 44269 - DNA, 201 bp, Homo sapiens
tgaaaagctcttaattgactctgactcctctctgagtcctttccttagacctcccttaaaactctagcctggtttgttcactgtaggacgaaggagtttgkgagactctggctctgaaggctgcctaggagcttggcaaaagcgtctgtccggagtcctgcaataaccacgcccctcacccctttacgaccacacccactt

SEQ ID NO: 44270 - DNA, 201 bp, Homo sapiens
cataaagaaatagcacttgaacataagtttaatttcctcagcaaggcctttttttcctttttttactttctgtagaaagggtacactcgtcagcagttttkccacgagagtgcaccgaacaaaggagacagggtcatttataacctgacgtgtccaccttactgctgtgtccagtttccattggctggaaccgggcttcac

SEQ ID NO: 44271 - DNA, 201 bp, Homo sapiens
tcccgaccacgcccacgcatccctcctttagtcccagcccctgtccccttcaggaccacgcctaccccctccctgaccactcccatccctataggactagyctctcctcccctcaggaccacgcccctctcccattccaggccacgcccaccccattcaggacctcgcccacctcctcctcggaccacgcccgttctcctc

SEQ ID NO: 44272 - DNA, 201 bp, Homo sapiens
aaaaaaaaatgttgtttaccccataaaaaatttagcatgcactccatgtattcgcttgtctagaaattatatatttatacctacgaatatattatgaatgwtaaaaaccttacacaaaaatagaaatttcaaacctaggcacggtgatatgtgtctgtagtttaaataatcaggaggctgaggcaggaggattgcttgaac

SEQ ID NO: 44273 - DNA, 201 bp, Homo sapiens
cccgaccacgcccacgcatccctcctttagtcccagcccctgtccccttcaggaccacgcctaccccctccctgaccactcccatccctataggactagcytctcctcccctcaggaccacgcccctctcccattccaggccacgcccaccccattcaggacctcgcccacctcctcctcggaccacgcccgttctcctca

SEQ ID NO: 44274 - DNA, 201 bp, Homo sapiens
caggccacgcccaccccattcaggacctcgcccacctcctcctcggaccacgcccgttctcctcacgcccacgcccagctcatcttccattcaggtcttcyactccgagtggacttttggaagcctctttgatggttgcagcattagtagtatttctctgcacacattatcctgacgccgattcagaccacgttcccttac

SEQ ID NO: 44275 - DNA, 201 bp, Homo sapiens
ttagtagtatttctctgcacacattatcctgacgccgattcagaccacgttcccttaccccctgactttgctcaaagagacagatctccatacttcttccytccatttgctatcttaactccacccaccatcatcacacacatattgtaggaaatttagaacataaaggtgtaaaaagctgaaaaacttctatccatttat

SEQ ID NO: 44276 - DNA, 201 bp, Homo sapiens
tttggactccaaatctatgccacctgactttcactgttggttttgtcattactaggattttagtcataaaggcaaaaggcctatcttcctctctcaagctrtaacaggagcaactgattaccaatttaaagctgtgtgtgatgatgtacaactacttttaaatcccattgatagcctgtattagtcaactcttgcctggta

SEQ ID NO: 44277 - DNA, 201 bp, Homo sapiens
aatcactgttatttgtggtaaaggaagaggctttagagaaaaggcgtcacctgtgcagagatttgaaggatgaataggaagtttagatggagacaaaggtraaagagtggccctaatgccgctggattctcttcatccttcatgcatagtttttaattgtaccgtcttgagccatagctattaaaattgacaactcaatca

SEQ ID NO: 44278 - DNA, 201 bp, Homo sapiens
aatatcctgttcctcatgaaaccttcaatgtattcagttattaataacactatggactcctgttttcctgttttattctgtgggccataattcttaactcycattacttatttgtatttagattactccagaaatgtccagcagtggcttctgtgttctggcatgtttccatcattgtttgggtgcttaatttctgggtaa

SEQ ID NO: 44279 - DNA, 201 bp, Homo sapiens
tactatttttactgttcttccctctgcagttgataattatttttatataaatatcctgttcctcatgaaaccttcaatgtattcagttattaataacactrtggactcctgttttcctgttttattctgtgggccataattcttaactctcattacttatttgtatttagattactccagaaatgtccagcagtggcttct

SEQ ID NO: 44280 - DNA, 201 bp, Homo sapiens
tttgaaaaactgatggagactgggcacagtggctcacgcctgtaatccttgaactttgggaggccaaggtaggtggatcacctaaggtcaggagttcgagmacagcctggccaacatggtgaaaccctctctctactaaaaatacaaaaattagctgggcgtggtggcaggcgcctgtaatcccagctactcgggaggctg

SEQ ID NO: 44281 - DNA, 201 bp, Homo sapiens
actcttcgcccctgtccccatgtccccatgtccccatgcaacattattggcagggacttctcctccgttctgctggcatccgggctcttctctgccataaygtttcgctcacagcattatctcttaatttatctctctcacctggaagaaagaacctctttatatttctctgttcagaaccaggtctgccacagataaggc

SEQ ID NO: 44282 - DNA, 201 bp, Homo sapiens
cgcccctgtccccatgtccccatgtccccatgcaacattattggcagggacttctcctccgttctgctggcatccgggctcttctctgccataacgtttcrctcacagcattatctcttaatttatctctctcacctggaagaaagaacctctttatatttctctgttcagaaccaggtctgccacagataaggcattcag

SEQ ID NO: 44283 - DNA, 201 bp, Homo sapiens
agtttattagtaggttatgcagacaattttgtgttctgtttttatcatttaaaacgatctcacatattacccatttctttaaaatagtttgtaaatctctytctctctctcttttttttcttttgagacggagttttgctcttgttgcccaggctggagtgcaatggcgcgatctcggctcaccgcaacctccgcctcacg

SEQ ID NO: 44284 - DNA, 201 bp, Homo sapiens
tgtccctgtgcccaaacctttgctttgtcagcctcccccattagactatgaggtgcttgaggacaggggaaggtgtcacctgtctccacattccattgaamaaactggataacactgaaagaggttgtgtgctgcaaagagcactgggctgggagtctgaaccctgccggcaggtgaggctccttcttagcagacgtgact

SEQ ID NO: 44285 - DNA, 201 bp, Homo sapiens
tgtgatgatgtacaactacttttaaatcccattgatagcctgtattagtcaactcttgcctggtaatgcggtgtaacaaacaaccacaatattcggaagcrttcaacaatcaatatttacttcttatgggggtagaagtcgtctggggcagtgcatttgggctggcctcagctgggcggttctccttcaagctgggagtct

SEQ ID NO: 44286 - DNA, 201 bp, Homo sapiens
gaaggtgtcacctgtctccacattccattgaacaaactggataacactgaaagaggttgtgtgctgcaaagagcactgggctgggagtctgaaccctgccrgcaggtgaggctccttcttagcagacgtgactcatttgtggagtagttgcattagtcaggggaggctaggccatgccaaggtgacaaattaacagacatc

SEQ ID NO: 44287 - DNA, 201 bp, Homo sapiens
agactgtatggctgttcctggctgagaaatttgactttgacaccacggctgcaaaaagtcctgcagacttcagcatcctatgttaatttttatctaagtgrtgtgttagctgatggggttactctaacagcagaacaaagtacagtgcttatttctttaaagttttacacttttcatttccgtttcattctctttctttgt

SEQ ID NO: 44288 - DNA, 201 bp, Homo sapiens
cacgagggcagaggcatggcattcagggtctgccccttaatgggaaaccaactgtcctttagaaaaaggaattaattcaaaatcagttcgtgggatcatamatcaacagacacgttccaaaaatgttcgaatcattgcaacttcagggggatctgaaaagctctccattgtaaacagacaaattgtttgggataaaaggag

SEQ ID NO: 44289 - DNA, 201 bp, Homo sapiens
aactggataacactgaaagaggttgtgtgctgcaaagagcactgggctgggagtctgaaccctgccggcaggtgaggctccttcttagcagacgtgactcrtttgtggagtagttgcattagtcaggggaggctaggccatgccaaggtgacaaattaacagacatctcagggacttgacacaccgaaagtatattcctcg

SEQ ID NO: 44290 - DNA, 201 bp, Homo sapiens
acagccactgagtgagtggacccttcccccttagagtcttcccatgacatcacagcccctggactgacacagcttgatggcatcagccagagaccgtgaarcagagcacccagataagctgtgcttggacttctgacccacagaaaccacgagataataactgttgtttcaagccactaagttttggggtaatctcctaca

SEQ ID NO: 44291 - DNA, 201 bp, Homo sapiens
taactcacacagcacccactctcccactctgtgccattgtcctaaatgtcttctttggacaatttgcatctatttgtaccccttcctatgaacttcccaaycctgctatttcataggggatgaaatgtatttcctatgttcctttgctgctagggttctggataaaatttaggctctgccagccaggcgcagtggctcaca

SEQ ID NO: 44292 - DNA, 201 bp, Homo sapiens
caatatctccttgggcctttggatgttgatgtttgcaaactgttctttcatttctctgcaagtctgtgttgttaaagccagatatttcatgccaaaagcayaaatgtaatgtgttcctggtggactctggctcagagcagggggatgaactgatgaaggtcttcccatcacaacactgtgagtcctggaatcacgttccct

SEQ ID NO: 44293 - DNA, 201 bp, Homo sapiens
aacttaactttgccatttttgacattttcagtctctgaccccactcaggctaggcaccatacctcttgcctcagaatgtggatactcttgtgtgttcagarttggagattaggaaataatactattaaaagtaatagcaattgatgataaagccttcatatgctttattcacagacattactgacttctcctgttagctct

SEQ ID NO: 44294 - DNA, 201 bp, Homo sapiens
aaatctccagagggcagaggagacacctcaagcatctggggtcttctgtgcctgggaattgggggcaccaggcaagtgatcatggcaagcaaatcattccmtgcagagaagagcttttactacagtctaacagaaaattatcctaagatttcttttgttggtctctcaccactcctagtcaaccaagtattggaagttcta

SEQ ID NO: 44295 - DNA, 201 bp, Homo sapiens
ccgcccccatgattcaactatctcccaccagtccctcccacaactcgtgggaattatgggagctgcaattcaagatgagatttgggtggggacacagccamaccatgtcaatgtgttaaatgagatgatccatataaagtgtgtagcacagcatctggtgtagttagtcataaaaaaacccagccatcatggcaatgggga

SEQ ID NO: 44296 - DNA, 201 bp, Homo sapiens
tgcggaccagcacaggtctcatccttctccattgctagagagaatatcaggagccatgtggcccaggcagggggcagcctctgttacccagagccataggcactgcagggaagcagaatgaggagcaggacctcagggggtccatgtggccagtgctgctgcccagggctgtattctacatgctccaggctttcctgtgcg

SEQ ID NO: 44297 - DNA, 201 bp, Homo sapiens
acttcagactggcaatgccaaggtagctggaggtggtgagaagtcttctttagattttggaaggaagcttggttcctttcagtcctctatatcacccaacsaatgtgtgttgttcaagagcgaagactgagacggtaccttggacaagtgtttggaattaaaggaagcacttagaaagtaattggccacatggtttgggta

SEQ ID NO: 44298 - DNA, 201 bp, Homo sapiens
caatctggcctccccaagtggacctttgtgagcccaggttcttctcccaggcacacagatgcctggacaaggcaggtcctggggctcatgaaattcccagraaattaacccaggcagcaggagctaaaggacaccaaaccagctgccaagcctgggtttcctcacctgtgaagtggggtctcagtcgtcattgtaaggtct

SEQ ID NO: 44299 - DNA, 201 bp, Homo sapiens
caccaccgtacctggagtatcagtcatctcatcttgaccgtgagttacaggttctcagggacttcgtatcttagttatctgggtccctgcggaccagcacrggtctcatccttctccattgctagagagaatatcaggagccatgtggcccaggcagggggcagcctctgttacccagagccataggcactgcagggaagc

SEQ ID NO: 44300 - DNA, 201 bp, Homo sapiens
attctggtcaacagtaggctattattagttaagatgttagggagtcagaagttatacacaaatttccaactgtgaggggtggaggagtcatcaaggatcarctgtattggcacccctaaatatagctcactacagcagcaacacctatgcaaggagactagatgtaggctgccagtgaaaaccaacgtgtaatttctgggc

SEQ ID NO: 44301 - DNA, 201 bp, Homo sapiens
tggcaatgccaaggtagctggaggtggtgagaagtcttctttagattttggaaggaagcttggttcctttcagtcctctatatcacccaacgaatgtgtgktgttcaagagcgaagactgagacggtaccttggacaagtgtttggaattaaaggaagcacttagaaagtaattggccacatggtttgggtaaatctcaga

SEQ ID NO: 44302 - DNA, 201 bp, Homo sapiens
ggaaaacgcctggttctggcttcctccacttgtgccctcccctcactcactctgcctttggctctgcgcttctgcaagcatggtcacctgtggctgcacaygcagggcctctgtgctgctggttccctctgctgagagcaccttccctgatagccatggggctcacctcctgatgggggctgcattgtgtcccttcgcaaa

SEQ ID NO: 44303 - DNA, 201 bp, Homo sapiens
caaagggcagggatgctgttcttcctttgttccattgttcaccaccgtacctggagtatcagtcatctcatcttgaccgtgagttacaggttctcagggayttcgtatcttagttatctgggtccctgcggaccagcacaggtctcatccttctccattgctagagagaatatcaggagccatgtggcccaggcagggggc

SEQ ID NO: 44304 - DNA, 201 bp, Homo sapiens
catctttaggacagtgtgtcctggcagggacaaagggcagggatgctgttcttcctttgttccattgttcaccaccgtacctggagtatcagtcatctcakcttgaccgtgagttacaggttctcagggacttcgtatcttagttatctgggtccctgcggaccagcacaggtctcatccttctccattgctagagagaat

SEQ ID NO: 44305 - DNA, 201 bp, Homo sapiens
gcgagctcttctgtgtctgtttggggcgtgtgggctccgggagcgtgaggaccgggaagctaggaggctccttcccttctggcggctccctcactgagacygggcggtttggttgcgggggaagtggagacgagccacccttgacctttgactgcaagaactcaccttgagcaggatagaggcacgtggacggtgaccctc

SEQ ID NO: 44306 - DNA, 201 bp, Homo sapiens
agtattgcattgtcaatgaatcttccacgtccagaaccgtatcttgtactcagtaaacactgaacaatgaactcagtaaacattgaacacctttctcttargaattggcctggatagttagactttagaagtcccaaactgaactcacgtcttcctcccatgatccctgggccagtgctccttctccagggctccgcatct

SEQ ID NO: 44307 - DNA, 201 bp, Homo sapiens
cctcctccctctccatcctgcttcttctgaaaatgagacttactagactattttaatctgcaatctagaacattcacacattcttcatcatggagtagcaygatctaaggttgggctgcaatgaatattgtttggacagctcttctcacactgaatggacagggcaagtcactaaaagcaaggaccacactgtgtcagagc

SEQ ID NO: 44308 - DNA, 201 bp, Homo sapiens
gctttgttatatataattgtaattgtgccttgtacacaattccatctttaggacagtgtgtcctggcagggacaaagggcagggatgctgttcttcctttkttccattgttcaccaccgtacctggagtatcagtcatctcatcttgaccgtgagttacaggttctcagggacttcgtatcttagttatctgggtccctgc

SEQ ID NO: 44309 - DNA, 201 bp, Homo sapiens
gaaaaacaatgataataatagctgcagatctctcattggaatcaatgtaagccagaaagaagtggagcaaaatatttaaagaactgaaagaaaaaaaaaaaggttggataaaaatcttatgaccagcaaaaagttctttataaagaaaggggaaataaaaagagaggattgaaaaggacatacaaaaattaaaagcagcag

SEQ ID NO: 44310 - DNA, 201 bp, Homo sapiens
agtcactctgtagctcctgtccactccccaccctcagtgccaggccctttcctctgtgacaatctgggaagcagcagggtagagtccacccttccctgatycccctgcctgggaagcatcccccagtgtacacaggcttgtgtagagctcttacgtggggcagggcaatcccttggggtcacagaggattacgtcccgtta

SEQ ID NO: 44311 - DNA, 201 bp, Homo sapiens
tagaggtgggagcacatgttgtgctggttttcttgcttctctgctacagggactgttgtttggaagactggggctatgctgtcctggacacagctgccccrgtactactggccataaggttctccctttccactccatttccctctctctgggagcttgtaagatgtgtggggcatggcattttgaagatatacatttata

SEQ ID NO: 44312 - DNA, 201 bp, Homo sapiens
ggatctggttataaaagtgtgtggcacctccccccacctaatcccccacttttctcctgctctggtaatgtaaagtgctggcttccccttcaccttccacyatgattgtaagtttcctgaggtcttcccagaagcagatgctgccatgttgcctgtacagactgcagaactatgagccaattaaatctcttttatttgtaa

SEQ ID NO: 44313 - DNA, 201 bp, Homo sapiens
ctgggtgggcgctggtgctcttttccgctcatgaatcatctgagctcaacattggctaacgtgccctactggaacctgagctcccacctcaatccccaccycacccccagaaccagcggcaggctggcagcccctcttcctgtgatccatctttcagagatgtgtgcggcttggccttgatgaccccatggtctatttcca

SEQ ID NO: 44314 - DNA, 201 bp, Homo sapiens
tctgagatcccgaagcactgagcacattgtgatgtcactgtcttcatcacccggactcccttggagccaggcactggcttaatcctatctccatttccccygtgcccagcacatagttagtgctccagatgatgggagactcaatggagagacacgtgagtggatggatgttttgctgaaggcatccaatgtggcagaacc

SEQ ID NO: 44315 - DNA, 201 bp, Homo sapiens
agaaatattactggaggaccttaactaaatttttgtttcttcatataacaggaagtctagaaatgggaagacctggctgccatagcagctcagtggtgctyccagaggctcgggctccctgtgtctttctgttccatcatctgcagtacatggcacccattaacacggttgcttcctcgttacaagatgcatgtttcaccc

SEQ ID NO: 44316 - DNA, 201 bp, Homo sapiens
ctcctcccattaccactgtaccccttaggaacatcttaagagttccagaacttcccaggaccttcaaagcggttttatgccaccatgcctgcttatgaccytcctccaatacgcatgccctgttttgccagccaagccagcacctcacctcaggctcagctcatccatgaagtcttgactgactcaagtccccatccccaa

SEQ ID NO: 44317 - DNA, 201 bp, Homo sapiens
gttataaaagtgtgtggcacctccccccacctaatcccccacttttctcctgctctggtaatgtaaagtgctggcttccccttcaccttccaccatgattrtaagtttcctgaggtcttcccagaagcagatgctgccatgttgcctgtacagactgcagaactatgagccaattaaatctcttttatttgtaaattaccc

SEQ ID NO: 44318 - DNA, 201 bp, Homo sapiens
tcctacggctgaacaccagccccactcaaatcctacatttattaatatatgagatacccgttgatatggtttggctgtgtcctcattcagatctcaacttsaattgtatctcccagaattcccacatgttgtgggatggacctaggaggaggtaattgaatcataggggctggtctttcctgtgctattctcatgatagtg

SEQ ID NO: 44319 - DNA, 201 bp, Homo sapiens
ctgtaatctcagcactttgggaggctgaggcgggtggattgctttagggcaggagttcaagaccagcctgaccaacatggtgaaaccccatctctactaayaatacaaaaattagctgggcatggtggcaggcacctgtaatctcagctacttgggaggttgaggcaggagaattacttgaacccgggagatggaggttgc

SEQ ID NO: 44320 - DNA, 201 bp, Homo sapiens
ctccagaaggggatagctggggattaaaggcacgaaaagaccccccaccttatccccaccacacacacacacacacacacacacacacacacacacacacactcatatctcctcttcagggagatcctgtccatcagctgaggagttggggctgggtgagacagctggcctctgtgcactggaatggagctagttccattt

SEQ ID NO: 44321 - DNA, 201 bp, Homo sapiens
atatggtttggctgtgtcctcattcagatctcaacttgaattgtatctcccagaattcccacatgttgtgggatggacctaggaggaggtaattgaatcayaggggctggtctttcctgtgctattctcatgatagtgaataagtctcatgagatctaatgggtttatcaggggtttccacttttgcttcttcctcatttt

SEQ ID NO: 44322 - DNA, 201 bp, Homo sapiens
cctccagaaggggatagctggggattaaaggcacgaaaagaccccccaccttatccccaccacacacacacacacacacacacacacacacacacacacamactcatatctcctcttcagggagatcctgtccatcagctgaggagttggggctgggtgagacagctggcctctgtgcactggaatggagctagttccatt

SEQ ID NO: 44323 - DNA, 201 bp, Homo sapiens
tatttaggagacaactcatgtttgtctcatacttgtctacaaatggttcacaaaaaatatgtgtgcgcttttgcacacgtgcccacatgtgcgcgcacacrcacacacaccagtcgccccttatccatggtttcgctctcatggtttctgttagtctcagtcaaacaaggtctgaaaatatgaaatggaaaattccagaaa

SEQ ID NO: 44324 - DNA, 201 bp, Homo sapiens
tccagaaggggatagctggggattaaaggcacgaaaagaccccccaccttatccccaccacacacacacacacacacacacacacacacacacacacacactcatatctcctcttcagggagatcctgtccatcagctgaggagttggggctgggtgagacagctggcctctgtgcactggaatggagctagttccatttt

SEQ ID NO: 44325 - DNA, 201 bp, Homo sapiens
tctcggtagacattttttgagaatgaacaaagtgagtctgttgcttcaaggtgaacagctaatagtgtttatctgcagagagatctgagccttttttttttgagacagagtctcactctgtcacacaggccagagtaccgtggcacaatctcggctcactgcaacctccgcctcctaggttcaagcgattctcctgcctca

SEQ ID NO: 44326 - DNA, 201 bp, Homo sapiens
tgcagggagctctgagaacaagtgtagtcaggcaacccagacttatttcacccaagggagagggagctgtggtatttataccccaactaccccacatcagygactaagggctatttactgggaggtatggattcctgacacttctagctttgcctgtggtggccagagaaagctatcaggcaggaaaatacaggggcagcc

SEQ ID NO: 44327 - DNA, 201 bp, Homo sapiens
tggagtgctgtgacgccatgcagctctctgcagcctcgactccctgggctcaagcaatctgcaggcttcagcctcctgagtagctgggactacaggcctgygccaccacactggcttttttttttttttttttttttttaaagtagagagagggttttgtcttgttgcccaggctggtctcaaactcctggggtcaagcag

SEQ ID NO: 44328 - DNA, 201 bp, Homo sapiens
agaggtgacccttaagggatggccccaggctcctccggctctttggggcactgcgggaaactcactgaatttggaaaaattcggacttgggatttgctcamtccttgctatcatatcaggggagccacgtaaagatatgttgccttaaattctctcattccacagtattcctatgaaatcaggatgcctttgatggacatg

SEQ ID NO: 44329 - DNA, 201 bp, Homo sapiens
taaaataggaataataactgttgctttgcagggggattatgcggaaaacgcctggttctggcttcctccacttgtgccctcccctcactcactctgccttkggctctgcgcttctgcaagcatggtcacctgtggctgcacatgcagggcctctgtgctgctggttccctctgctgagagcaccttccctgatagccatgg

SEQ ID NO: 44330 - DNA, 201 bp, Homo sapiens
tatatcccaagaggtgccttgtggtcaggcctcctggaaagggtatggtgtgccgagtcaatgcagaaggaaggacagacaggctgcccaagccctgcgcrgctcatgtagcgccaggtggcctggagtggcttaaaggtacagcctccgcagccctccagagcagctggatcaggaagcccagtgtcggtggggtcttta

SEQ ID NO: 44331 - DNA, 201 bp, Homo sapiens
tctggagcgcaccttttttttttttttttttttttttgagacggagtctcgctctgtcgcccaggctggagtgcagtggcgggatctcggctcactgcaakctccgcctcccgggttcacgccattctcctgcctcagcctcccgagtagctgggactacaggcgcccgccactacgcccggctaattttttgtattttta

SEQ ID NO: 44332 - DNA, 201 bp, Homo sapiens
ggctaattttaaaaatggaaaataaatgttggtgagaatgtggagagatcagaacccttgggtgttgttggtgggaatgtaaaatggtgcatctgctgtaraaaacagtttggtgatttcttaaaaacttacacataaagctaccatatgacccagcaattccactcctaggtatatgcccaagagaaaggaaaagcgatg

SEQ ID NO: 44333 - DNA, 201 bp, Homo sapiens
atccatctggagcgcaccttttttttttttttttttttttttgagacggagtctcgctctgtcgcccaggctggagtgcagtggcgggatctcggctcacygcaatctccgcctcccgggttcacgccattctcctgcctcagcctcccgagtagctgggactacaggcgcccgccactacgcccggctaattttttgtat

SEQ ID NO: 44334 - DNA, 201 bp, Homo sapiens
tgtattgtcagaaggatgtaattacaagtatttatgtacactgattctgaaccagagaatcccgggatggctctggggccaaaaaaaaaaaaaaaaaaaaagagagagaaagagggagagagaaaaaaaaggcttaaaaactcctgacaatgagcaattcttcatggaacaaaactattacaatagccagcctttgatctt

SEQ ID NO: 44335 - DNA, 201 bp, Homo sapiens
atgtattgtcagaaggatgtaattacaagtatttatgtacactgattctgaaccagagaatcccgggatggctctggggccaaaaaaaaaaaaaaaaaaaaagagagagaaagagggagagagaaaaaaaaggcttaaaaactcctgacaatgagcaattcttcatggaacaaaactattacaatagccagcctttgatct

SEQ ID NO: 44336 - DNA, 201 bp, Homo sapiens
tcatcgaggtagacagcacatattttattcattgtctaagtatcgagcacctgctgtgtgtcaggcatcgccctacctgcaggaactgtaatagaaactasgatagccctgtcctcattgaaattttttcaagtactttaaaatttttttccagtacttttgctagttaaaaccctacacgaggtacaagatcaatgtaca

SEQ ID NO: 44337 - DNA, 201 bp, Homo sapiens
aatgtattgtcagaaggatgtaattacaagtatttatgtacactgattctgaaccagagaatcccgggatggctctggggccaaaaaaaaaaaaaaaaaaaaagagagagaaagagggagagagaaaaaaaaggcttaaaaactcctgacaatgagcaattcttcatggaacaaaactattacaatagccagcctttgatc

SEQ ID NO: 44338 - DNA, 201 bp, Homo sapiens
ttttcacctcccgccatgattctgaggcctccccagccatgtggaactgtaagtccaattaaacctctttttcttcccagtcttgggtatgtctttatcarcagcatgaaaacagactaatacagtaaattgggatcagtagagtggggcattgctgaaaagatacccgaaaatttggaagtgactttggaactgggtaac

SEQ ID NO: 44339 - DNA, 201 bp, Homo sapiens
caggaactgtaatagaaactacgatagccctgtcctcattgaaattttttcaagtactttaaaatttttttccagtacttttgctagttaaaaccctacasgaggtacaagatcaatgtacaatctgtataaactttgaagagcaaagcaaataaaagattatcaagagccagaatttcagggacagatgctcatatgatt

SEQ ID NO: 44340 - DNA, 201 bp, Homo sapiens
gaaatgtattgtcagaaggatgtaattacaagtatttatgtacactgattctgaaccagagaatcccgggatggctctggggccaaaaaaaaaaaaaaaaaaaaagagagagaaagagggagagagaaaaaaaaggcttaaaaactcctgacaatgagcaattcttcatggaacaaaactattacaatagccagcctttga

SEQ ID NO: 44341 - DNA, 201 bp, Homo sapiens
attgtccccttcccctctactttctatttgcccatcttcctaattagagggaaaaaatctacactcacttcctctattcaacctttcacttaaaaaaaaaatgcaactcccacccccctggttcccagcctcgaagggaagccaccctggccaggggcaagcatcgcagcaaaccacttagcaaaccgcaaatttcagagg

SEQ ID NO: 44342 - DNA, 201 bp, Homo sapiens
agatcatcagggtcatcaatgcagccgtataccatactaccttccccaagttcttgccttgactcactggaataaggaagttcaaccaatccctgttgggyatattaggtatattagtttggggatagtgggtataatagtttgcaggggtttacaaaacaaaatatcacaaactgggtggcttaaacaacagaaattaat

SEQ ID NO: 44343 - DNA, 201 bp, Homo sapiens
ttagaaaatttgcagcctgactatgcaatagaaaagaaaacccattttctggggagaaattcaagctggctgcagaaatttgcataagtagtgagaagccyaatgttaatccccaagaccatggggaaaatgtctccaggccatgtcagagaccttcatggcagcccctcccatcacaggcctagaggcccaagaggaaaa

SEQ ID NO: 44344 - DNA, 201 bp, Homo sapiens
gctttgaagtgccaacatcagtcaggccaggactaacttttttcattaaaaatttttcagcttctctaagggagctttttgccttttttttttttttttttaagcctgccgggacatttagataagttgagcctccaacccgtggccccaagacatcaaaaggcgcggggtccagtaatgctggaggcagccatcactaag

SEQ ID NO: 44345 - DNA, 201 bp, Homo sapiens
tttaaaagttatatttatgtctaaataactcaacataacattttccctaaataaaatgatgagtaagaaaagtctccaattacatcccaaataaaatccgmagactctcagaatcatatatacacatgtcaaccaaaggagtgtgtgtttcagctgatgttggcactgaaggaggccttccatattctgcccggtgtgagc

SEQ ID NO: 44346 - DNA, 201 bp, Homo sapiens
actccctgggctcaagcaatctgcaggcttcagcctcctgagtagctgggactacaggcctgcgccaccacactggcttttttttttttttttttttttttaaagtagagagagggttttgtcttgttgcccaggctggtctcaaactcctggggtcaagcagtttgtccagctgggccttccaaagtgatgggattacag

SEQ ID NO: 44347 - DNA, 201 bp, Homo sapiens
tgacctgagggcccgcaagctcagattcccacctggttgtgctatcatctgtgcagctatccatagctggggacagagtggcttgtgatggcccccagcargggatgaataagggggtgtggggtcagtagaaggtcagtcctagacaaagctgcaaagagagaagattcgggtttctgtgtcgctcccctattcactgcc

SEQ ID NO: 44348 - DNA, 201 bp, Homo sapiens
ctctttggacatcactaataaaagagaaacagatgtcagagacgtagacatggggagggctttaatatctagccttacggaacaaaatccttgggacccartagaacttagtgttgcagagctttctcctgagttcagctaaaaccaggctcttgtcacacgaccagggaagattaggctcccggacacatagaagggtga

SEQ ID NO: 44349 - DNA, 201 bp, Homo sapiens
taaaaacaaaagacagacagaaacattggcaaagggtggggaagggcaggggtagttgggttcaaaggaaaggaaagtaggaaagcaagacatggagtaawgcaaacagacacctgtcaactagatagaccctcagctcatctctcacggggctgtctgtctgtccacgtgcctgtagaaccacaaatccagccctaacat

SEQ ID NO: 44350 - DNA, 201 bp, Homo sapiens
agaagcaacccttaatttgtccaagtttaatcatgagattgcaacaattcgtcacgtcttcaggcttcatttctaattttaattctcttgcatgtccaccrtatctgcagttactttcttcactgaagtcttgaacccttcatggtcacccatgaaggttggaagcaacttccttcaaactcctattaatgttgatatttt

SEQ ID NO: 44351 - DNA, 201 bp, Homo sapiens
atagatggtgaactttctcaagaaaccactttttttgttcatccataagaagcaacccttaatttgtccaagtttaatcatgagattgcaacaattcgtcrcgtcttcaggcttcatttctaattttaattctcttgcatgtccaccatatctgcagttactttcttcactgaagtcttgaacccttcatggtcacccatg

SEQ ID NO: 44352 - DNA, 201 bp, Homo sapiens
cgcctgcccctcctccttgatagatatagatatagataggtatatctcaaaattagaacattattttctgagtttctcaattaaattatttcctatgcacrgatgatccataactacattattcaattccactgactccttcaactaagtacctgtcctcaagttttcatcctagcccaaactatctttattatagcaatt

SEQ ID NO: 44353 - DNA, 201 bp, Homo sapiens
accctaaaggacttgccaagaaagataaaaagtattttattatcccagaaagaatgcaaggttcttcatttcagttggcttataacaacaataacaacaacaaaaaaaaaaagtcaggcacttctaacaaaaagagggaagcttggcctgacagaagactcacaatggcagaataggtgagttgtggaagcagggagctga

SEQ ID NO: 44354 - DNA, 201 bp, Homo sapiens
ttgctcatttgtgttcaaagcacattggttaggtcatgtttcttcatggggctggcttgataagaaccaagatctaaacttggggaagaagtagcagaaarccctttattttgttagtacgcccatcccagatcttatttatgtctatttctcagttggttttgaatccagaaaagagatgtgagagattcgtttttccca

SEQ ID NO: 44355 - DNA, 201 bp, Homo sapiens
gaatacggcattgtgatgagaatacatgtgccatagtaaaccatgtgcatattcagggaggtaaaaaagacaacggattttaaagaaaaaatgagcaagaytacacagtggttttgaggtaattaagataattatccttggctctaaagatcaataaaaagagtaataccagtctgaagttagacagccagttgcaagaaa

SEQ ID NO: 44356 - DNA, 201 bp, Homo sapiens
cgcccatcccagatcttatttatgtctatttctcagttggttttgaatccagaaaagagatgtgagagattcgtttttcccaaaactcccaacataaaacrcttatatatactatatgacctttcaaagatatgccacatttaaatttttttatttgtataaatttaaggggcacaactatagttttgttacataaacata

SEQ ID NO: 44357 - DNA, 201 bp, Homo sapiens
ctaaaaatgctaacaattatctgaaacttcagcgagttatagtctttttgctggtgaagggtcttgcctcaatattgatggctgctgactgattagggtgrtagttgctgaaggctggagtggctgtggcaatttcttaaaataagacagcaatgaaatttgtcacatcagttgactcttcctttcatggaagatttctct

SEQ ID NO: 44358 - DNA, 201 bp, Homo sapiens
ttaggtacacaaatactcaccaatatgttgcaactgtccatagtattcagtacagtaacatgctgttgagatttgtagcctaggagcagtaagctatatcrtatagcctaggtgtgtagtaggctgtaccaattaggtttgtgtaagtacacgctatgatgttcgcacaatgacaaaattgcctaatgaagcatttttcag

SEQ ID NO: 44359 - DNA, 201 bp, Homo sapiens
aaacatattgtgcaatagtaatgtctgggcttttagcgtaaccatcacccaaataatgtacactgtgcccattaagtaatttttcacccctcattcctctyccccattccaccctctgagtcttcattatttatcctttctcactctatacccatgtgtacacgttatttagctcccacttataaggaagaacttgcagta

SEQ ID NO: 44360 - DNA, 201 bp, Homo sapiens
catctataatataaggctagattcctatcatactaagttatcattaggactaaatgagacagtaaacacacacacacacaattgaaatgatacagttctaygtaaatgtaaggatttttttttcactaaacaggtgttacaattaagatggacaaaatttttataatgaacatatgtctctatacaaatcagaaaaaaaaa

SEQ ID NO: 44361 - DNA, 201 bp, Homo sapiens
caaataaaataataatagaaaacataaaataagtgatcaataagttggtgttgtggagtcttccctggtaaaatctcaaaacaccaagactaaaagtaaartaacaaaagttttaaggaaggaaaaaaacctgaaagcttgtgagatatccaaaaatctcagacttcattccagatctcctgaatcaaatctgtatgttag

SEQ ID NO: 44362 - DNA, 201 bp, Homo sapiens
gaccttttatatgaaaacatgtctatttttgaaagggtcaattagcctctccacagttgtacattaagaaatattcataatggtaaaaatttcaaatgaartcattgatgcaaagatgaaactacctgtaccttagaagaaaacaaaaagctgagtaggaaaacacccattgtaaatattcatgagacaatcacagacttt

SEQ ID NO: 44363 - DNA, 201 bp, Homo sapiens
agacaaagtttaaaaacaattgaagagaattgtatgattgttttgagataattatccttgactacaaggagcaataagaagggtgatgctagtcagaaatyagatatgcagttgttgggcaaatgtcctcactgaagtattaaaaaatagattttgatggcctttgtgcaagtttgcagttttggcagtatttggtgatag

SEQ ID NO: 44364 - DNA, 201 bp, Homo sapiens
ttcctttcatgtgaagatttaaaggacaagccttgagaactaattgaactaaataaactgtacaggtgaactttagcacttcttggtaactaacacaataygttttgactcctataataattatttttctgtagaggctgcttcctcatgcttataagtttaatttggcaggcaatattatataaagaaatttgattttat

SEQ ID NO: 44365 - DNA, 201 bp, Homo sapiens
ctttctgaggctaatctctccacctggcctctggtcacctctccttctgcctgcccctgaaacttagtccattagttatgctttttccagcacttaactcwttattcttctccttctcaggctcttttctcacaagttaattctttagttcaagaaacttcaatgaaatacctgccatatgctttacacaatgctggacac

SEQ ID NO: 44366 - DNA, 201 bp, Homo sapiens
tttgtaatccttgaggcacgctatggacattgacttaccatgcctttctactacagatacagagaagccacagatggcattgtcaccagaaaatggaagcrcaaagcgctttgggtaacagcaattcaagaatgactgcagagaaaatctattaagaaattcaaatgcagatttcaatatttactccttttcattctcttc

SEQ ID NO: 44367 - DNA, 201 bp, Homo sapiens
tatccaggtacaaaactcacattaggcccaaatggttccctaatgtaccaatgccataggagcaaatctgtactttcaaaatagttacagcagaactgacwatatatatatatatatagtatatatatttatacacacacatatatacagcaaaactgtacatttatatgtgtacatgtatacatatacaaaactacattt

SEQ ID NO: 44368 - DNA, 201 bp, Homo sapiens; identical to SEQ ID NO: 33420

SEQ ID NO: 44369 - DNA, 201 bp, Homo sapiens
tcgcctgcccctcctccttgatagatatagatatagataggtatatctcaaaattagaacattattttctgagtttctcaattaaattatttcctatgcamagatgatccataactacattattcaattccactgactccttcaactaagtacctgtcctcaagttttcatcctagcccaaactatctttattatagcaat

SEQ ID NO: 44370 - DNA, 201 bp, Homo sapiens
ttttttcagtttcaaatgagtggaagattcagttttcaatctttacattttagctagaactggctgaattgtataaggaaaataaaatctctaaagagccrtaacttttagtaacaaatctattttttgttggctagttggatttgattgactaatcagtgcagatggagaagtattttagcatggtcgtttttttgtttg

SEQ ID NO: 44371 - DNA, 201 bp, Homo sapiens
aaaatctctaaagagccataacttttagtaacaaatctattttttgttggctagttggatttgattgactaatcagtgcagatggagaagtattttagcakggtcgtttttttgtttggttggttttcttttgggctcctgtgtggcagacaaagcaatttttatgatagatagagataacttatattattgctgtgagct

SEQ ID NO: 44372 - DNA, 201 bp, Homo sapiens
taatgtcttcctatgtgttgggtactatgcttggtgcttttacctacattattttttaatctccacaacaaatccagagctaagttgtattattatcctcrctctacaaatgagggaacagaagtagagagaggttcaatgacttgctttagatcacacagttactaaatagtatctacctgggttggttaagatgctttc

SEQ ID NO: 44373 - DNA, 201 bp, Homo sapiens
ttcagtttagtctgtaatattaacatgaattcactggccccagcccctgagaaggaaagttcactgtgatattttttctgttacaaatgtttttagcaagscttgctgtagtcatagtcactgggaaatatttagtgcctggctgtgtgcatagctctaaaacaaatgtgatgatggtcatttgggggcagagattggatc

SEQ ID NO: 44374 - DNA, 201 bp, Homo sapiens
gaatgcagaacattcccagaagaaggaacaacacatgcctttaacccctgtgttgcctctagtgttcagggtcccaggataatgcaaggatcataggaaayttctaacagcgttttcaacaccaaggtgaacacttacagcaaaatgcctggaagccacacaacatttcatgagtcttaaaacccactgactctactatct

SEQ ID NO: 44375 - DNA, 201 bp, Homo sapiens
cctactttttcccaattgttcttaagtaactgtagtataatatcaaatccaggaaattgacattagtgcaatacgtgtgaatcattctatgccatttcatyatgtgtgtatattcatgtaaccaccaccaaaagtgagacgcagaattattccatcaccacaaacttctccttcctatccattcttgcctttggcaatcac

SEQ ID NO: 44376 - DNA, 201 bp, Homo sapiens
ttgtggattttatgagtacttatttactggagactatcttatcccagctttattttattttatttattttattattttattattttatttttttgagacakggtctcactctgtagcccaggctggggtgcagtggcacaatcacggctcactgcagccttgacctcttgggctcaagcaatccttccccttcagcctccc

SEQ ID NO: 44377 - DNA, 201 bp, Homo sapiens
cagaacattcccagaagaaggaacaacacatgcctttaacccctgtgttgcctctagtgttcagggtcccaggataatgcaaggatcataggaaacttctracagcgttttcaacaccaaggtgaacacttacagcaaaatgcctggaagccacacaacatttcatgagtcttaaaacccactgactctactatctgccag

SEQ ID NO: 44378 - DNA, 201 bp, Homo sapiens
gaaagaaatctttctgagcagtaggtcacaacagtgggcttaaaatgctcagtaaactatgctataaacaggtacactctcatctaggctttgttatttcrtctatagagcacaggcagagtagacttagcgtaattcttaagagcccacagatttttggaatggtgaatgagcattagcttcaacttaaaactcaccagc

SEQ ID NO: 44379 - DNA, 201 bp, Homo sapiens
attaattactaaaaatctatggactttcagaattctatacccagcccacttcactcatttctcttatttcctggctcctgtaggtcttttcatttgcaacycttgctctaatgagtcatggaagaagggtagcatggcgaccttcatatatatttgcaggaattctcaaaagataatggcaaacaggcaggcataggctag

SEQ ID NO: 44380 - DNA, 201 bp, Homo sapiens
ctgtataattaagaagagtagagacatgagaggaaaatagttctatgatcaggaccttggacacaaatactgtgtcttcagccttatttctcatccctgcrgaataatcttcccctctgcaagccacttctcaaatatgaaatgctgaaaatcctttctaatatcaacacccttggcacacatccctttcccattatctcc

SEQ ID NO: 44381 - DNA, 201 bp, Homo sapiens
atatataataattagttataactctcagtaaccttaatttttagcaagcaattttgaactgtcacatatcagtatctgatagatgaaaaccattttacacsttttagaaatctgtttcctcataacataattgttatatgtataaatacaccaaataatgtgatatatttagtttttttataaaattttaagaagtaaaga

SEQ ID NO: 44382 - DNA, 201 bp, Homo sapiens
ttttcacttgagccaaatttttaactctatgctaagataattatagattcaaacaaagttgcaaaaatagtacagagatgtcctgtgcacgctttacctastttttcccaattgttcttaagtaactgtagtataatatcaaatccaggaaattgacattagtgcaatacgtgtgaatcattctatgccatttcatcatgt

SEQ ID NO: 44383 - DNA, 201 bp, Homo sapiens
tgtcacatatcagtatctgatagatgaaaaccattttacaccttttagaaatctgtttcctcataacataattgttatatgtataaatacaccaaataatrtgatatatttagtttttttataaaattttaagaagtaaagaacaaacatgttattatcagtaatatattttagtttttatcttatttggaaattacccag

SEQ ID NO: 44384 - DNA, 201 bp, Homo sapiens
acaatattctatggtgcgaatgtaccacaatttgcttaaccatttacctactctaggacattttgattgtttccattttggggctattacaaattaaattrctataaacattcatgtacaagtcttgtgttttgagccacttttattttctgtccattgcaaccaaaagttttaaataattcaagcagaaaaatgacaaag

SEQ ID NO: 44385 - DNA, 201 bp, Homo sapiens
attcctctattgggttgagttaaagtatagagcattactactctatttcatgtgtagccaaccctcttgctccattttctcaaatctctttttgccttctygtggcctttgttctcccagtttttacttccatacagtaaatagccacggtaggtacacaagccaagagccccactgtccttctcttagcatttccatttt

SEQ ID NO: 44386 - DNA, 201 bp, Homo sapiens
ctaccatgattaataagtgactagacctcatggtcctcctcatactaaaaggtatgagcacgattttcttatataccatttttatcaggtagagatttggmcttctataaaaattaataaaagggacttttgtcatataactatattaaggggaagttggggtaataaaccataatgaatgggaaaagacagctattaact

SEQ ID NO: 44387 - DNA, 201 bp, Homo sapiens
tgtgaatttaaactaaaacaagaatgctatttgataagtcactgtgaaaacatttttaagtgagccttatgtaaaaagtagatcactcataagtgaatatktaacagtgaattttcaaagtgaacatgcccacataaccagcactcaaatgatgaaatagaaaattatctgtacctcggaagactctcttacaccttctcc

SEQ ID NO: 44388 - DNA, 201 bp, Homo sapiens; identical to SEQ ID NO: 23798

SEQ ID NO: 44389 - DNA, 201 bp, Homo sapiens; identical to SEQ ID NO: 24085

SEQ ID NO: 44390 - DNA, 201 bp, Homo sapiens; identical to SEQ ID NO: 23790

SEQ ID NO: 44391 - DNA, 201 bp, Homo sapiens
tcctttaatttatttctgttttctaacaggttcagaaatcgttttgacagcacataattcttaaatagagtacatacaaatttggtctttcttgcatgtcygagaacacttgcctaagaaagatgtgtgatttttctttaaacctggaaattttaagcagcttatgctatcatctcatagtaacaatctagtgaagtaatt

SEQ ID NO: 44392 - DNA, 201 bp, Homo sapiens
ggccactgagcactagaaacagggcagctgtgacctaggaactggatggttaattttagttaatttaaatgtaaataaccatatgtggctagtggctaccrtattggacagtacagttccgggcaatttgactgaaaattatacctcctttaatttatttctgttttctaacaggttcagaaatcgttttgacagcacata

SEQ ID NO: 44393 - DNA, 201 bp, Homo sapiens
aaaaccactagtttccatactctttttttttttttttttttttttttttgagatggagtctcactgtgtcggccaggctggagtgcagtggtgcgatctcrgcacactgcaacctctacctcctgggttcaagcagttcccctgcctcagcctcccaagtagctgggattacaggcacacgccaccacgccctgctaactc

SEQ ID NO: 44394 - DNA, 201 bp, Homo sapiens
taaagtttgaaaaccactagtttccatactctttttttttttttttttttttttttttgagatggagtctcactgtgtcggccaggctggagtgcagtggygcgatctcggcacactgcaacctctacctcctgggttcaagcagttcccctgcctcagcctcccaagtagctgggattacaggcacacgccaccacgccc

SEQ ID NO: 44395 - DNA, 201 bp, Homo sapiens
gaggtgagtgtgtagtgagggagtccctgcttattgattgattgattggttgattgattgactgattgattgacagagtctcactctgtcgaccaggctgsagtgcagtggccccatcatgcctcactgcagcctcaacctcccaggctcaggtgatcctcccacgtcagcctcctgagtagctggagcacaggtgtgagc

SEQ ID NO: 44396 - DNA, 201 bp, Homo sapiens
tggaaactgttctggaagaggctgcaacatagcccatgcttagggactggatggtttttgcaagagctttttttttttttaaactaccatctcccaacttwtaaagccagatacttgacaaggattttagatcttaatgggttcgatggtagggaatacggaaaggatacactgctaatattgtgtctaacaataaagcaa

SEQ ID NO: 44397 - DNA, 201 bp, Homo sapiens
aggatggtctcgacctcttgacctcgtgatccacctgcctcgggctcccaaagtgctgggattacaggcatgagccaccgcgcctggccttttttttttttgagatgaagtcttgctcttgttgcccaggctgggtgcaatggcgcgatctcggctcactgcaacctccgccccccaggttcaagcgatctcctgcctcgg

SEQ ID NO: 44398 - DNA, 201 bp, Homo sapiens
ccatagtatgtcccattcagactgatttccaaatctgtcaactagaaactctactttatgtaaagggccttttaaaaatgcgggatcttcaattttttttwttcaataaactagtaaagagtatctagtttccatgaaaaaacataagtttttttccaaaatataggaagcttgattcagtcttgcactgaaattaactgc

SEQ ID NO: 44399 - DNA, 201 bp, Homo sapiens
cagaggccaaggcaggaggattgcttgagctcaggagttggagaccagcctgagcaacatagcgagatcttgtctctactaaaaaaaaaaaaaaaaaaaaattaacgaggcatggtggcgtacgcttgtagtaccagctgcttaggaagctgaggtggaacaattgcttgagcccaggagattgaggctgcagtgagcttg

SEQ ID NO: 44400 - DNA, 201 bp, Homo sapiens
gtagaaaaagtcaagcagctataatctttccatcctaatataactactgtgatttcgttctttctttccagtctttattttttttgagacagtctcattcygattgcgtaggctggagtgcggtggtgcaatcttggctcactgccacctcgacctccgaggttcaagtgattcccccacctcagcttcctgagtagctgg

SEQ ID NO: 44401 - DNA, 201 bp, Homo sapiens
ttctacattgttatactaggttaggagacgcctttgtagaatacaatttttgtttttgactttgacttcttaagcctctaagtaaatacagttgcagctggctgcaaatcctgctatctgacttcatcagcccggcccattatcatcctttcatgaggtttttatttttttatttttttattctagaaagaggggttgtcc

SEQ ID NO: 44402 - DNA, 201 bp, Homo sapiens
aatgttaaaatctgttattaagtactgaagatatacacatacacatctttttctactgctgggccttattttttggcctgttgaaatggaaacaaagtgaagtgatactaataatacagtatttccattcagagggaactttaaacacattgtgtggtccagtttcaccttataagggtaacaaaggtatagaaaggatgt

SEQ ID NO: 44403 - DNA, 201 bp, Homo sapiens
actcctggactcacgtgatccacctgcctcggccttccaaagtgctaggattataggcatgagccaccatgcctggcctgagattaatttcatttttttttcttttttctttttttttggagacagagtctcgctctgttgcccaggctggagtgcagtggtgtgatctccgctcactgcaagctctgccccccaggttca

SEQ ID NO: 44404 - DNA, 201 bp, Homo sapiens
gattttagatcttaatgggttcgatggtagggaatacggaaaggatacactgctaatattgtgtctaacaataaagcaaacaactcgatgctgtaagaagmcaagctgtttgagctttcaaacacacatgcacacagcacaattcagaaatacccaggaggattcctgcaggcttaacagttggcatcgtactgaaatgaa

SEQ ID NO: 44405 - DNA, 201 bp, Homo sapiens
aggtgaaacaatcttctcaaaatcatattggcagtatcaatacttttcagtctccattttgaagttaaatgtaattgaagaccttacttggtttcctagtrgcattctttttttttcttttgaaacagagtctcactttgtcacccaggctggagtgcagtggtgccatctcggctcagtacaacctctgcctcccaggtt

SEQ ID NO: 44406 - DNA, 201 bp, Homo sapiens
aagccgtgcatcatcaagtattggcttttgccctcaagcaatctgatattaaaaagcttcaactaagtgagggaaataggattttttcctgtttcaagatktttactttaggagacaaaaatgttttacttctgtatatatcttaaggcactaatacagacttcaaatttagttttatgccttttgggttaaaagtgaaga

SEQ ID NO: 44407 - DNA, 201 bp, Homo sapiens
aggatcataagagtgggattcctatttgatggtccttctcagtcccaaagtctttggacccttgtttctcttttggtaaaagaatttggtgtcttttcgakaacaaatgtgacaaggtaaacacttctctactaagatagcagtttccatttccaaagccgtgcatcatcaagtattggcttttgccctcaagcaatctga

SEQ ID NO: 44408 - DNA, 201 bp, Homo sapiens
ccgcagcagggaaagattcggttagaccgaagaacttgtgccctgaacggttgtgaacacagaagggcagatgaccaaggcgggttatggatcttctcttsactgtggcattaagaacaagctggattctaaactgtttggattgcggggccgtttgactccgaaggcgggaggaaagattttatcgcgatgcactcgcta

SEQ ID NO: 44409 - DNA, 201 bp, Homo sapiens
ctttgtatattgttgagagagattcttggccagagccttcataaatttatcttgcttgtgttcacagacctgcaaggggtttttatttcacagatcacacrcagctttattctcttttgattgtgtcatgaaaatagcctggtcagatgtcatgtcagcactaagcctaaatggacaattcagagaaaagaaaatgagctt

SEQ ID NO: 44410 - DNA, 201 bp, Homo sapiens
tattaaggacaataaaccctgctcagcctgacagggtggctgtgaggagaggatgaaacgttttaggagagcgtactttatcaattccaaagcccagtatrtgtcttcatcctcaagctgaactggaaaggtactcttaatagagcgctgtacatgaaaccacagtaaagctcttaaacaaaacagccttattgtgaccct

SEQ ID NO: 44411 - DNA, 201 bp, Homo sapiens
aaattcttccttatcctcctgggcccagctgagacaccattcatgttaaggatcctctcctagtactcagtcagcatccattgctggattcccatcaccayagtagctgtgaactgttgttaccaatgggtatggtgccaccattttcttgattcagctcagtaaatatttactgaatgcttcagcagccctagtggaacg

SEQ ID NO: 44412 - DNA, 201 bp, Homo sapiens
ggcgccgcgtagcttccatccgccagctgccatgagcgagcgcctccgtcccaggtgagagggaagggaccccctttccattcgtcgcctgaggatctggragatagagccgagggggcgcgcgaaatgggggtcggagcaagagtggacccggcggggctccctgtggggtgcactgcgggccgggggaggaggggagag

SEQ ID NO: 44413 - DNA, 201 bp, Homo sapiens
cacagtcctcctgggcctgccttcctgcttgttgtattaggaaagctcccagtagggctctgctttcagatccttaacctcattcatctcccacagattcytaggatccccactcgtaagtatagacctgagccagtcttccatgctcaggacccacctgttcctgcagccctcatggctcttgataatctagccatcacc

SEQ ID NO: 44414 - DNA, 201 bp, Homo sapiens
cacggcggcagcgacatgggggggcgcggagcagacgccggaagtagtggtggtacgggtccgactgaggggtactcgccaccggctgcgtccacccgagsggctgcgagagccaaggcccgagggggtgggcgtggcggccgccgaaacacaaccccctctgttccctctcttcgcggagcggcgccgcgtagcttccat

SEQ ID NO: 44415 - DNA, 201 bp, Homo sapiens
acataattcttaaatagagtacatacaaatttggtctttcttgcatgtccgagaacacttgcctaagaaagatgtgtgatttttctttaaacctggaaatwttaagcagcttatgctatcatctcatagtaacaatctagtgaagtaattgttatatcataataccggctagtgttgccagaataagcaggtgaatgtgac

SEQ ID NO: 44416 - DNA, 201 bp, Homo sapiens
tgtcctcctcgggggtggtgcgtgttctccttccttgtcatttccacagtcctcctgggcctgccttcctgcttgttgtattaggaaagctcccagtaggkctctgctttcagatccttaacctcattcatctcccacagattcctaggatccccactcgtaagtatagacctgagccagtcttccatgctcaggacccac

SEQ ID NO: 44417 - DNA, 201 bp, Homo sapiens
ttatgctatcatctcatagtaacaatctagtgaagtaattgttatatcataataccggctagtgttgccagaataagcaggtgaatgtgaccaagaggtayttttataagggttttcagggcaaataggcaaaggcagccactcttatatcaaatgttgtcatatggaagggagtacaattaggtaactcggaatcctaat

SEQ ID NO: 44418 - DNA, 201 bp, Homo sapiens
ttcagagggaactttaaacacattgtgtggtccagtttcaccttataagggtaacaaaggtatagaaaggatgttatttattcatggagacagaaaagttrtcacctgcattttctttccttgcttatttataaagtggttttaattaacccactgagttcatttggaatcttgtgtcaccaatattggtagatctgaagt

SEQ ID NO: 44419 - DNA, 201 bp, Homo sapiens
aacaatctagtgaagtaattgttatatcataataccggctagtgttgccagaataagcaggtgaatgtgaccaagaggtacttttataagggttttcaggrcaaataggcaaaggcagccactcttatatcaaatgttgtcatatggaagggagtacaattaggtaactcggaatcctaatttcagggagtgtaaaaagaa

SEQ ID NO: 44420 - DNA, 201 bp, Homo sapiens
taaactgtttggattgcggggccgtttgactccgaaggcgggaggaaagattttatcgcgatgcactcgctaccttcccgagggagcctggcctcgggacscgggtcttaaattaggggttctgtgcttgacatgtactactagagtccggactaagttgggatttcttaatttttttctctctcttaatttcctctgcaa

SEQ ID NO: 44421 - DNA, 201 bp, Homo sapiens
tacacatacacatctttttctactgctgggccttattttttggcctgttgaaatggaaacaaagtgaagtgatactaataatacagtatttccattcagarggaactttaaacacattgtgtggtccagtttcaccttataagggtaacaaaggtatagaaaggatgttatttattcatggagacagaaaagttatcacct

SEQ ID NO: 44422 - DNA, 201 bp, Homo sapiens
ttgattgacagagtctcactctgtcgaccaggctggagtgcagtggccccatcatgcctcactgcagcctcaacctcccaggctcaggtgatcctcccacrtcagcctcctgagtagctggagcacaggtgtgagctaccacacccagctaatctgtgtatttttggtagaggtggggtttcactatattgcccaggctgg

SEQ ID NO: 44423 - DNA, 201 bp, Homo sapiens
ggaaagattcggttagaccgaagaacttgtgccctgaacggttgtgaacacagaagggcagatgaccaaggcgggttatggatcttctcttgactgtggcrttaagaacaagctggattctaaactgtttggattgcggggccgtttgactccgaaggcgggaggaaagattttatcgcgatgcactcgctaccttcccga

SEQ ID NO: 44424 - DNA, 201 bp, Homo sapiens
tcccagctactcaggaggctgaggcaggagaactgcttggacccgggaggcggaggttgcagtgagctgagattgcaccactgcactccagactgggcgamagagcgagactccatctcaaaaaaaaaaaaaaaaaaaaaatctaaattaaaaaaaaagcaataccttttaaaagtacaaagacctcaattttttttaata

SEQ ID NO: 44425 - DNA, 201 bp, Homo sapiens
ctccatcttttttcccccctgtcttttcctatttggaacgaagtgtgatcggtcccggaagagagacggtggccctaaagctttcctgtcctaaatttagkagggtggggggatgggataaacgtctcatcttggagagggagcccccaaaggcttttgtgagggcaccgggcggggagctgccggctccccaaggtcaga

SEQ ID NO: 44426 - DNA, 201 bp, Homo sapiens
ctgtttctttcttcttccttccagtcttcaggcagtgacagtggtgggagcagcagcagcagcagcagcagcatcaatagcccggacagggccagcgggcyggaaggcagcttgagccagaccatggccggatccagccctaacacgcctcagcccgtgcccgagcagtccgcgctgtgccaaggcctctacttccacatc

SEQ ID NO: 44427 - DNA, 201 bp, Homo sapiens
aaattacactagaagtttctgtgtaaatctagcttctgttacctaggtatatgccttgtaaaaagtgcttctacttgagtaaataaaagcagtatcttctyatccttaggagggaagaaattaaaatctaaatttggctgggcccggtggctcatgcctgcaatcccagcactttgggaggccaaggcgggcagatcacga

SEQ ID NO: 44428 - DNA, 201 bp, Homo sapiens
agggggcgcgcgaaatgggggtcggagcaagagtggacccggcggggctccctgtggggtgcactgcgggccgggggaggaggggagagggatgcgcgagygatcggatgcttggttcctgtgggtagctggaaggtgactctccggggtccaggtctcccgcccctccatcttttttcccccctgtcttttcctatttgg

SEQ ID NO: 44429 - DNA, 201 bp, Homo sapiens
ttcaccatgttggccagaatggtctcgatctcttgatctcatgatccgcccgcctcggcctcccaaagtgctgggattacaggcgtgagccaccgcgcccrgcccacctggctagttttaaaattttttttgtggagatgggggtctcctcatgttgtccaggctgatcttgaactcctgggctcaagcaatccttccacc

SEQ ID NO: 44430 - DNA, 201 bp, Homo sapiens
agtctcgctctttccccaggctggaatgcagtggcgcatctcagctcactgcagcctccgcctctggggagggttcaagcaattctcctgcctcagcctcmcgagtagctgggactacaggggaccgccaccacgcccagctaatttttgtacttttagtagagacggggtttcaccatgttggccagaatggtctcgatc

SEQ ID NO: 44431 - DNA, 201 bp, Homo sapiens
atgatccttcctcctcagcctcctgaggtgctgggactacagggatgtgccaccaaacctggctaatttttttaattttttgtagagacagggtcttgctrtgttgcccaggctggtcttgaactcctggcctctgaccctcctccactgggcctggccaaattctttttcttattttcttttttttgttaacctggctgt

SEQ ID NO: 44432 - DNA, 201 bp, Homo sapiens
gagctttttttttttttaaactaccatctcccaacttttaaagccagatacttgacaaggattttagatcttaatgggttcgatggtagggaatacggaamggatacactgctaatattgtgtctaacaataaagcaaacaactcgatgctgtaagaagacaagctgtttgagctttcaaacacacatgcacacagcacaa

SEQ ID NO: 44433 - DNA, 201 bp, Homo sapiens
gctctcccacagtagattggatagccgcagagaggtgagtgtgtagtgagggagtccctgcttattgattgattgattggttgattgattgactgattgaytgacagagtctcactctgtcgaccaggctggagtgcagtggccccatcatgcctcactgcagcctcaacctcccaggctcaggtgatcctcccacgtcag

SEQ ID NO: 44434 - DNA, 201 bp, Homo sapiens
ggagaatcgcttgaacctggaaggcggaggttgcagtgagcggagatcactgcactcaagcctgagcaacaagagcgaaacttccatctaaaaaaaaaaaagggttttcaggctctcccacagtagattggatagccgcagagaggtgagtgtgtagtgagggagtccctgcttattgattgattgattggttgattgatt

SEQ ID NO: 44435 - DNA, 201 bp, Homo sapiens
aaatgaccttagttgattatactggtttaacctttctgtttccaaatcagggtccctttgaggaagctgtgtaccctgtccccagcaaaacagtacatatstgcacatagtcatatatgtacacactcatttgtatttgttagaaatttcgtggctttttgaaagcctatgtttgaactcactgttttgtatttcagcagc

SEQ ID NO: 44436 - DNA, 201 bp, Homo sapiens
tttgaggaagctgtgtaccctgtccccagcaaaacagtacatatgtgcacatagtcatatatgtacacactcatttgtatttgttagaaatttcgtggctytttgaaagcctatgtttgaactcactgttttgtatttcagcagcgaacttcttttctggtagtttataaaccatgaattgtccttaagataaacatattt

SEQ ID NO: 44437 - DNA, 201 bp, Homo sapiens
tcccagaagctcctagtcgctcctcccgctccgagcccgcctcttcccgtgggcggggttaccagtcggtgcggttgggatggtgccactgcgcagccgcragagggcggtaccacggcggcagcgacatgggggggcgcggagcagacgccggaagtagtggtggtacgggtccgactgaggggtactcgccaccggctg

SEQ ID NO: 44438 - DNA, 201 bp, Homo sapiens
atttttaattgatacggggtttcactatgttggctaggctggtctcaaaactcctgaggcatgagccactgcacccggccaatttttttgtatttttaatrgagatgggggttttgccatgttggccaggctggggttttgccatgttggccaggtctcgaactcctgcactcaagcagtccacctgcctcagccaaccaa

SEQ ID NO: 44439 - DNA, 201 bp, Homo sapiens
ggtttctccatgttggtcagggtggtctcgaactcccgagcccaggtgatctgcccacctcagcctcccaaagtgctcggattacaggcgtgagccaccgygcccggcagcagtttcttattgaaacagaatgttaaaatctgttattaagtactgaagatatacacatacacatctttttctactgctgggccttatttt

SEQ ID NO: 44440 - DNA, 201 bp, Homo sapiens
caatgtctttgcctaagggaacataaatgtggatgtattaaacggctaagttttaaaaaacaattatatgctagatattaattactagaattctttctcaygtgctgaatacaatattgtattgcactgtaaacacagaaaggtactgccaattcagttatcagggttgtcatttattagaaatgcaatagtaaaattgta

SEQ ID NO: 44441 - DNA, 201 bp, Homo sapiens
tttagtagagacggggtttcaccgtgttagccaggatggtctctatctcctgacctcgtgatccgcccgcctcggcctcccaaagtggtgggattacaggygtgagccactgcgcctggccattttttgtatttttagtagagacggggtttctccatgttggtcagggtggtctcgaactcccgagcccaggtgatctgc

SEQ ID NO: 44442 - DNA, 201 bp, Homo sapiens
acaattatatgctagatattaattactagaattctttctcatgtgctgaatacaatattgtattgcactgtaaacacagaaaggtactgccaattcagttrtcagggttgtcatttattagaaatgcaatagtaaaattgtaaaataaggctgggcatggtggctcatgcctgtaatctttcctgcctggcactttcagag

SEQ ID NO: 44443 - DNA, 201 bp, Homo sapiens
aacaaaacagccttattgtgaccctgtttctttcttcttccttccagtcttcaggcagtgacagtggtgggagcagcagcagcagcagcagcagcatcaayagcccggacagggccagcgggccggaaggcagcttgagccagaccatggccggatccagccctaacacgcctcagcccgtgcccgagcagtccgcgctgt

SEQ ID NO: 44444 - DNA, 201 bp, Homo sapiens
tttttgtatttttagtagagacggggtttcaccgtgttagccaggatggtctctatctcctgacctcgtgatccgcccgcctcggcctcccaaagtggtgkgattacaggcgtgagccactgcgcctggccattttttgtatttttagtagagacggggtttctccatgttggtcagggtggtctcgaactcccgagccca

SEQ ID NO: 44445 - DNA, 201 bp, Homo sapiens
gattataggcgtgagccaccgcgcccagccctagttttgttttgagtcaggaacagagaagaacaattttccttctctttttatctagaagctgttttttycaagtacatggcatgatatgatcttagctataaagcaattttagatttctagcaagaaaaaaaacaaaaatgtggtcttgtgttttttttttccaaatct

SEQ ID NO: 44446 - DNA, 201 bp, Homo sapiens
agaggccaaggcaggaggattgcttgagctcaggagttggagaccagcctgagcaacatagcgagatcttgtctctactaaaaaaaaaaaaaaaaaaaaawtaacgaggcatggtggcgtacgcttgtagtaccagctgcttaggaagctgaggtggaacaattgcttgagcccaggagattgaggctgcagtgagcttga

SEQ ID NO: 44447 - DNA, 201 bp, Homo sapiens
cttcttccttccagtcttcaggcagtgacagtggtgggagcagcagcagcagcagcagcagcatcaatagcccggacagggccagcgggccggaaggcagyttgagccagaccatggccggatccagccctaacacgcctcagcccgtgcccgagcagtccgcgctgtgccaaggcctctacttccacatcaaccagaccc

SEQ ID NO: 44448 - DNA, 201 bp, Homo sapiens
acaggcgcgcactgccatgcccagcttatttttatattctttttgtagagacaggttttcaccatgttgcccaggctgatctcgaactcctggactcacgygatccacctgcctcggccttccaaagtgctaggattataggcatgagccaccatgcctggcctgagattaatttcatttttttttcttttttcttttttt

SEQ ID NO: 44449 - DNA, 201 bp, Homo sapiens
ctaaaaaaaataaaaaataaaaaaaaattatgtacagaaatcttccctaatctgtttaaagaacttttgccttttcttagagtagcatcacccttgtgctrttatagtacgaaatagatataatttgagatgaaaacttgacttactagaaactgattgtagttcttgccttgattttcagacagtacctgtaatgagaaa

SEQ ID NO: 44450 - DNA, 201 bp, Homo sapiens
acctccccaggctcaggtgatcctcccacctcagcctcctgagtaactgggactacaggcgcgcactgccatgcccagcttatttttatattctttttgtrgagacaggttttcaccatgttgcccaggctgatctcgaactcctggactcacgtgatccacctgcctcggccttccaaagtgctaggattataggcatga

SEQ ID NO: 44451 - DNA, 201 bp, Homo sapiens
tagacacttgagaaaataaattttaaaataaaatagaagatccaaatcgtaaatattttgtcatatatatccttccagattgtttttggtgtatataaatrtatgtatgaatacacttgagaaaaacattttaagaatcaactgatatactatatatactgcttagtatgaactgaaatgatgtaaaaaatgatgccaaag

SEQ ID NO: 44452 - DNA, 201 bp, Homo sapiens
acctggctctggaatcacaaccggtggtagccagtccccaggacagctccagtcccttagatagtcacccccatgagcccacccagcctctgggttgacayagacacccccagcagcccctagctgcctctggctgacatcaactgaggacatggggcctggaacctggaaacagctacctcggggaatgctgttggtgag

SEQ ID NO: 44453 - DNA, 201 bp, Homo sapiens
ttagagtggtgacagctgcccccctgaggaaggccctggaggattatgacagaccctgagaagggtcaaatgaatactcagtgcccctcttcctggggccyccccgcagggtgcccgacaagaaaatcaagacacctccactctcatccctgcgccaaatgatgagctttacatgttttagcacatttaactttcacagga

SEQ ID NO: 44454 - DNA, 201 bp, Homo sapiens
tggcatccggtgtgctcctaactgctccgtgcctctgttttctcgcctctaaaatggggcaataacacccccacctcctaggggtgctaaacacactcttkcgcttgaatgagctaaacacagcctggggcagaaaagtgtgctctctgagtgtggatggctgttagtattatgacttctgggttggtgaaggattcagtg

SEQ ID NO: 44455 - DNA, 201 bp, Homo sapiens
tctaactcacctcctcccgggcctactgtggaggaagccccatcaccagggaagaaatcaatctgcacacactcaattaaaatgataaatcaggcatcagrgtgaggctgccccagagatgcaggggaagtttttgtctgattggctggaacatggtaggtgcccagggaccttatttcctggggctgggctgccagtcca

SEQ ID NO: 44456 - DNA, 201 bp, Homo sapiens
agtgatgataccgatggctgtgcttttagtagctgttaggtaccaggaactgtgcttggcccttgacacatataatttcacggaatcctcacagcagattaaaaaaaaaaaaaaggtaccatattgtccccattttacagaccaccccttacaagagatgagatgatgtgctgtgtgtcgcccagctcattagtggttgaa

SEQ ID NO: 44457 - DNA, 201 bp, Homo sapiens
cacctgtaatcccagcactttgggaggctgaggcaggtggatcacctgaggtcaggagttcgagaccagcctggccaacatggtgaaatcccgtctctackaaaaatacaaaaaaaattagctgggtgacacatacctgtaatgccagctacttgggagtctgaggcaggagaatcgtttgaacctgggaggcagaggttg

SEQ ID NO: 44458 - DNA, 201 bp, Homo sapiens
gattacagaggccagtcatgagtctactgcaatggtccaggcaggagagataacatggcggggactgggtggtgtgagtgcagtggggagcagtggtcagmtgtggatgtgtttgaaggtggagatgactggatttactgacagattggaggtgggatatgaggtagaagtcaaggatgagaccaagatttgggggtccaa

SEQ ID NO: 44459 - DNA, 201 bp, Homo sapiens
accttcccagggccctccccctggctggggtaagcattgccctccccagcttcctctgttctagggggcgaaggttcacttgttccaaggtgttactcacytggccctgtggaaatgacagtcagggagcctgggtccaaggcctgtctctaatttgccaggtgatcttgcccaagtttctctctgcagctcagcttaccc

SEQ ID NO: 44460 - DNA, 201 bp, Homo sapiens
agtttgagaccaatctgggcaacatagtgagacttggagaggctgatgtgggacgattgttggagcccaggagttcgaggctgcagtgagctctggttgcrctgctgcactccagcctgagcaacacagcaagactctgcctcaaaaaaaaaaaaaaaaaaagaaaaagaaaaaaaagaaaaggaaagaaaagaaaagaaa

SEQ ID NO: 44461 - DNA, 201 bp, Homo sapiens
tctctactaaaaatacaaaaattagcccagcaaggtggtgcatgcctgtagtcccagctactcaggaggctgaggcaggagaatcgcttgaacctggaggyggagattgcattgagcctagattgtgccactgtattccagcctgggcgacagagcaatactctgcctggaaaaaaaaaaaaaaaaaaagtggggccggtc

SEQ ID NO: 44462 - DNA, 201 bp, Homo sapiens
ttcccacacatctatctccatgcataaggaccctatgaggtaggtaccatcatcacctccagttcacagatgaagaactaactcccccaagatcagacagytcacaagtgatggggccataatagcaacatcagcaatggtgcgtgttccatgtttattatttgctaaacccgttatatgtatcacctcgtttattctgcc

SEQ ID NO: 44463 - DNA, 201 bp, Homo sapiens
ctagtcatgagcagcattcagttaggttcattcagatgtatttggttattcattcatttattcattcatccaacattttgcaaggacctacctccctgcaytcctgaccacagagggatgccaaggtgactgtaaaccagcccagccttggaggggctgccaggcccgaaggaacacagacacctccgcacctagtgagct

SEQ ID NO: 44464 - DNA, 201 bp, Homo sapiens
tcttggccacttctcttttttttttttttttttttttttttttttgagatacagtttcactctgttgcccaggctggagtgcagtggcacaatctccactsactgcaacttctgcctccagggttcaagtgattcttctgcctcagtcttctgagtagctgggactacaggtgcatgccaccattcccggctactgtgtgt

SEQ ID NO: 44465 - DNA, 201 bp, Homo sapiens
acaatctccactgactgcaacttctgcctccagggttcaagtgattcttctgcctcagtcttctgagtagctgggactacaggtgcatgccaccattcccrgctactgtgtgtgtgtgtgtgtgtgtgtgtgtgtgtgtgtgtgtgtgttagtggagatgggatttcaccatgtttcccaggcttgtcttgaactcctgac

SEQ ID NO: 44466 - DNA, 201 bp, Homo sapiens
attctcatgccttagcctcctgagtaactgggattacagtcacgtaccaccacgcctggctaatgtttgtattttttagtagagatcgggggtttcaccaygtgggccaggctggtcccgaattcctgacctcagatgatccacccgcctcagcttcccaaagtgttgggattacaggcatgagccactgcacctggctcg

SEQ ID NO: 44467 - DNA, 201 bp, Homo sapiens
ctctgggtaaatttattgtaacccacaagaagactggaaatcagaaggttaaaagaaaaaaaagaaatcagaaggttgtagccagaattttcttggaacadaatggaatggaatggaatggaatggaatggaatggaatggaatggaaaacagaatagaactagaatagattggcatgtgtaatacatagtaaaaataaga

SEQ ID NO: 44468 - DNA, 201 bp, Homo sapiens
tctctctaactcacctcctcccgggcctactgtggaggaagccccatcaccagggaagaaatcaatctgcacacactcaattaaaatgataaatcaggcakcagagtgaggctgccccagagatgcaggggaagtttttgtctgattggctggaacatggtaggtgcccagggaccttatttcctggggctgggctgccag

SEQ ID NO: 44469 - DNA, 201 bp, Homo sapiens
ccaatgcaggagctggctgatttttttctaatagcatcagataataaatcttttaactttgtgggacctgcagtctctgttgtaactattcaactctatcrgagcagaaaagcagcatagacaatatgtaagtgaatgcgtgtggctgtgttctaatcaaactagttgtggacacagaaatttgaatttcatatctttttc

SEQ ID NO: 44470 - DNA, 201 bp, Homo sapiens
ggggatagaggctcccttctggaacagtgggggctgagattttttaccccaaatgggggtacaaggccaggttgggtggcctcagggaagcctgggcttgrtgctgccatcagtggggagctatagagtgtgcttgagctctagagggctgtagtgaaaaggaagttttctctttgggggtgcggatcattaaacatgtcc

SEQ ID NO: 44471 - DNA, 201 bp, Homo sapiens
tagtggtatgcactcatatatttgacattcctgctctaactttgtctggcagaagaggcggtgtggaccagatcatacagggcctggtcatgcttaaagasggataacattaggagatatatctaatgtaaatgatgagttaatgggcgcagcacgccagcgtggcacatgtatacatatttaacaaacctgcacgttgtg

SEQ ID NO: 44472 - DNA, 201 bp, Homo sapiens
ggcctcctgggtgacaggccctgtctggcggggaacagggaccaagagacaacacagaagaggctggacctcgaacaggggcggctgcctcactccctacmtgagccagccgagggggccaaggactttagagctgtttcctccggcataagagagacacttgctttccagggcagcaccctttatcggagaaggctctac

SEQ ID NO: 44473 - DNA, 201 bp, Homo sapiens
tccagacctctccacagccctcagaggggtctgggatgggagtcctggccacgtgatactatcctgtatagccgagcagccaccaagtgggtgtgtgtgcrctgcacctgtgtgcatgtgtgattgtgcctctgcatgtgtgcaggtgtgggcctcccaggctgagtgtctgtgtgtcagtgtcaggaggtgtgggtcaga

SEQ ID NO: 44474 - DNA, 201 bp, Homo sapiens
actggctatactgattgatagaggctgcttggagagctgtactgaggactctgctaagcttgagagagtgctgtgatggattagtgatgtctgccacaggyaggagaccaaccagtggtggtatgcatgctcaatatttttctttccacccaatttataggtagtcctggagaaaaaaagagatactttcttcttgtgagg

SEQ ID NO: 44475 - DNA, 201 bp, Homo sapiens
agtttggagggctcaggctgtggaggactgtccagccctctgtcccctccccctccacttcctgctttgctagggatctgaatcccctgctgggtgtgtgrgaagccaggtgaccagaaagccccccatacagcccatggcgtatgagtgcccgcctccgcctgccagcagcctccaaggtggtagcctctccgagtgcca

SEQ ID NO: 44476 - DNA, 201 bp, Homo sapiens
ccatcagggtcttggggtgagggggttggctgccactggcagtcggggaaaggtttgagaatggctttctgctcccagagaagaagccacatcttccctgsggggtcatttacatcccctgccactgggacagccgcctccgagggcctcacccagaccctgaatttcccacccagttcacacagctggacagaggtgtaa

SEQ ID NO: 44477 - DNA, 201 bp, Homo sapiens
ccccaaactgagatcacttccctccgggaagccacccccaaagggaggggttccctgctgggccttgaagctggcccagcccagagaggaaccgtttagasgctgagggaccagcaggaggaaggctcgggggctcagaaccctcccccttctccatggagtcagctgcttcttaaggccaagaggtgggggctgaggcac

SEQ ID NO: 44478 - DNA, 201 bp, Homo sapiens
gcctcatatgactggagctggggaggggcacctatctgcctggtatctcccatgtcgctctccatgtgctgctggaggggtgcatggcagcctcctgcccmttctgctgatgggatagctgaggccgagggatgccagctggggaccatccaaagatgccatacccgaggctgcaagcctggccttttctggtgcccccaa

SEQ ID NO: 44479 - DNA, 201 bp, Homo sapiens
atggtgccttctcatttattccaccaaacagttctaccatgtgcatattacagatggggaagccaaggctgggaaagctatggtgccttctcagggtcacyggggaagggtagacattggagtccagacctgcccaattccaaagtctgtgctgtgttgtcttaggatttttagagggcttcagagtccatctgtccttgt

SEQ ID NO: 44480 - DNA, 201 bp, Homo sapiens
tatctgcctggtatctcccatgtcgctctccatgtgctgctggaggggtgcatggcagcctcctgccccttctgctgatgggatagctgaggccgagggakgccagctggggaccatccaaagatgccatacccgaggctgcaagcctggccttttctggtgcccccaagctggccaacaggctggagtggcaggtggtgg

SEQ ID NO: 44481 - DNA, 201 bp, Homo sapiens
cttgccagcctgaccccggccaacccttgccagcctgacccctgccctctgacccctgacccagttctgagccaagccttcggggacagactctgggtacyctcaaacccaccccgctgtgtccctgcaggtaagaatcccgaggatgtggttcgaagatacatgcagaaggtgaaaaacccacctgatgaggtgaggagg

SEQ ID NO: 44482 - DNA, 201 bp, Homo sapiens
ttgcaaattcttgggttaaggtgtcccaggccccaggatagggacccagtgagctgctgttgggtgcctaccctggaccccagattcagtcatctgagcamagaaccaagccctgaggggtggcaatgagaggaaagatcaaagaccttgaacttgggacagaccagaagagaaaagaccaggggggtttggactgtggtc

SEQ ID NO: 44483 - DNA, 201 bp, Homo sapiens
tggggcagagggtgtgtcctgtctccctttgccaaatgggtaccagagagagtgtggtctgctgcctatggtgacccaccaaggggcagtgctgacccagyaggtgccctgccctccccagtcctcagtctcccctgctgccacctgcaggactgcaccatctgcatggagcgactggtcacagcatcaggctacgagggc

SEQ ID NO: 44484 - DNA, 201 bp, Homo sapiens
ttgggttaaggtgtcccaggccccaggatagggacccagtgagctgctgttgggtgcctaccctggaccccagattcagtcatctgagcaaagaaccaagycctgaggggtggcaatgagaggaaagatcaaagaccttgaacttgggacagaccagaagagaaaagaccaggggggtttggactgtggtccccaagagga

SEQ ID NO: 44485 - DNA, 201 bp, Homo sapiens
acccaccaaggggcagtgctgacccagtaggtgccctgccctccccagtcctcagtctcccctgctgccacctgcaggactgcaccatctgcatggagcgrctggtcacagcatcaggctacgagggcgtgcttcggcacaagggcgtgcggcctgagctcgtgggccgcctgggccgctgtggccacatgtaccacctgc

SEQ ID NO: 44486 - DNA, 201 bp, Homo sapiens
ttcccaggcttgtcttgaactcctgacctcttgtgatctgccagccttgcctcccaaagtgctgggattacaggcatgagccaccatgcccggcccccttyttgaccacttctgagctgggagacctgggacgagtccctctccttccttgagcctcagttttgtcatctgtcaaatgggagcagatcttcccaccatgtg

SEQ ID NO: 44487 - DNA, 201 bp, Homo sapiens
gcagggaacggagtggggtttgggggggtgctgggaactcactgccagcctcccctgcccaggatggcagcctgcagtgccccacctgcaaggccatctayggggagaagacgggtacgcagccgcctgggaagatggagttccacctcatcccccactcgctgcccggcttccctgatacccagaccatccgcatcgtct

SEQ ID NO: 44488 - DNA, 201 bp, Homo sapiens
aggctggagtgcaatggtgtgatctcagctcactgcaacctctgcctcctgggttcaagcgattctcatgccttagcctcctgagtaactgggattacagkcacgtaccaccacgcctggctaatgtttgtattttttagtagagatcgggggtttcaccacgtgggccaggctggtcccgaattcctgacctcagatgat

SEQ ID NO: 44489 - DNA, 201 bp, Homo sapiens
gctgcccaccccctcggcctggtccatggccagcctgggccggagaggcggacggatgggcaggcgggcagcggcgggcgctgcggggtgcagggcccagyggggaggacagcagctgccctaattactcctgctctccaggttccaatcttgtttcaaaaggactccagggacacagcctttaataactaccagtaaaca

SEQ ID NO: 44490 - DNA, 201 bp, Homo sapiens
tgctgctggaggggtgcatggcagcctcctgccccttctgctgatgggatagctgaggccgagggatgccagctggggaccatccaaagatgccatacccraggctgcaagcctggccttttctggtgcccccaagctggccaacaggctggagtggcaggtggtggctggttctgggatcttccagcctgcctccttccc

SEQ ID NO: 44491 - DNA, 201 bp, Homo sapiens
ctccatcaagcccagattttcctctttcccactcctccaagtgccaagtaggttgcccgtctcgcttgcagatgtcttctttgcaccaggctttgtgcctsgtgctccaaacatagttgcatatctgacctagtagtctttgtcctcccaaaagtgatctaccaatgaggatgactaagaacaaaaacaaataatgacagt

SEQ ID NO: 44492 - DNA, 201 bp, Homo sapiens
tctaggcagacggaggtgctggggtaaggaaaggggaagtgaggaccccagacagcagctgaggaggagtccatgggcacctggtcccccgggcttgcagygatgtccttcaagtctctgcagtgggggtggcggcagggacttggccccaggctgtgttccccaggactgtggggggaggagggggagaaggcagctatg

SEQ ID NO: 44493 - DNA, 201 bp, Homo sapiens
acgtggggggtgcacatttttaaataggatgatggtaaatgaaggaatgtctgaatgcctgaatacgggagtgggctgaagatggagaatacataaaggtrtcaatttaaaaaaagcataaggggcccaggggcggtggctcacacctgtaatcccagcactttgggaggctgaggtgggtggatcacctgaggtcaggag

SEQ ID NO: 44494 - DNA, 201 bp, Homo sapiens
gtattacatttcaggggtttgaaaatgttaaagtactgacaggtacactgtgaagtcaaggaccccaccaggcccctggctgcccaccctcccccactttyctgccccgctagccactggtgtgcagtgactgtcaccccgcctcaccgctgctgcaaggtcaaaccaaacactccccccaccctgccccccacctgaagc

SEQ ID NO: 44495 - DNA, 201 bp, Homo sapiens
ggctgattttatcccacaaacatcaactaattatctactgtgcatctagcacgtgctcaccactgtgggtacaagagagacaagcaaaagatcttaaatcttttttttttcttctttttttgagacagtgtctcactctgtctcccaggctagagtacagtggtgtgatgtcggctcactgcagcctctttccccgggttc

SEQ ID NO: 44496 - DNA, 201 bp, Homo sapiens
ctcacctgtaatatggacctgatgatagtactgaacttgtgtgattgtggtcactattcattcattcatcaggaatttcatgagcacctactgtgtgccaggcactgtccgggcactaggaatgtcacaatcaacaggacagacacagaagccctcaaggtgcttctgttctgggggtgaggggtggagtgatgatgggtg

SEQ ID NO: 44497 - DNA, 201 bp, Homo sapiens
ctaaacctggcccagaggtactcagggaaggctagcctgagaaagtgatgtttgaacagagatctgaagaatgagtgagggtgccagtgtcccaggcagarggcacagccagtgcaaaggccctggggtaggaaggggcagaggacatttaagtccgttctgtttgggatgcatctcccaccaaggggaagatggtgcaag

SEQ ID NO: 44498 - DNA, 201 bp, Homo sapiens
tgacagaaccacacgtaataaccccaggctggtaggatgctcgctttccctctagagctgtgccaaccaatatgttagccaccaaccacatgtggctactwaaatttacattaattaaaactaagtaaaatgtaaaatccagttcttcagtctcactagccacacttcaagtgctcatagccacatgtgtcttgtggtacc

SEQ ID NO: 44499 - DNA, 201 bp, Homo sapiens
cacctgtaatatggacctgatgatagtactgaacttgtgtgattgtggtcactattcattcattcatcaggaatttcatgagcacctactgtgtgccaggcactgtccgggcactaggaatgtcacaatcaacaggacagacacagaagccctcaaggtgcttctgttctgggggtgaggggtggagtgatgatgggtgtg

SEQ ID NO: 44500 - DNA, 201 bp, Homo sapiens
ctgagaaagtgatgtttgaacagagatctgaagaatgagtgagggtgccagtgtcccaggcagagggcacagccagtgcaaaggccctggggtaggaaggrgcagaggacatttaagtccgttctgtttgggatgcatctcccaccaaggggaagatggtgcaagatggcagctgagcaaggaccggatgtacaggcctgg

SEQ ID NO: 44501 - DNA, 201 bp, Homo sapiens
ccagcactttgggaggctgagacaggaggatcacttgagcacaggagtttaagaccagcctgagcaatgtagtgaaaccccatctccaccaaataaaaacaaaaaaaaaaatagctagacatgatggcacacacctgtgatcccagctactcaggaggctgaggctggaggattgcttgagaccaggaggtgcaggctgca

SEQ ID NO: 44502 - DNA, 201 bp, Homo sapiens
caccccattttacacatagtaaagctgaagctcagagggtggggagccgcctgccgacgctgagaagagacgggtctgagatcagatccaggtctgcagcygggtgcgcacggcccttcccaggctcgcccgggccaccgagtaccttggacagcaccatcaacgacccgcccgcgccttccgggctgggggtggggatgc

SEQ ID NO: 44503 - DNA, 201 bp, Homo sapiens
atgcaggaggccaggcgccaaggaagtcccagcatataggactgtcccctaccttggagcccaggagctgccgggctaggagctgagtctcctctaggtcycgcatagttgtgtccttgctcggccaccctggccaagcgcctctccctctctgggctccttccatcatccctctggagctgctccaggctgctactgctg

SEQ ID NO: 44504 - DNA, 201 bp, Homo sapiens
tttgggaggctgaggcaggtggatcacctgaggtcaggagttcgagaccagcctggccaacatggtgaaatcccgtctctacgaaaaatacaaaaaaaatyagctgggtgacacatacctgtaatgccagctacttgggagtctgaggcaggagaatcgtttgaacctgggaggcagaggttgcagtgagccgagatcacg

SEQ ID NO: 44505 - DNA, 201 bp, Homo sapiens
ctgctgttgggtgcctaccctggaccccagattcagtcatctgagcaaagaaccaagccctgaggggtggcaatgagaggaaagatcaaagaccttgaacwtgggacagaccagaagagaaaagaccaggggggtttggactgtggtccccaagaggaagagagggcacccaaaaccaactgtgcttcaatcactatggca

SEQ ID NO: 44506 - DNA, 201 bp, Homo sapiens
tagggagacccctgtctctaaataaataaataaaataaaataacataatggatgactgcaggcacgaatgaatgacctaaggaaagaatcaatgaatgaaygaatcattgaatgaaggaatatatgaatatgtgaactagggcatggataagtgaatgaactaatgcaagaattgttgaatgactaaatgaaatagtgctt

SEQ ID NO: 44507 - DNA, 201 bp, Homo sapiens
gggtggcctcagggaagcctgggcttggtgctgccatcagtggggagctatagagtgtgcttgagctctagagggctgtagtgaaaaggaagttttctctktgggggtgcggatcattaaacatgtcctcctctgacctgccagagctctgttgtctccagccacatgccgctcccccacagccgacatcatttctcctgc

SEQ ID NO: 44508 - DNA, 201 bp, Homo sapiens
tctcactatgttgcccaggctggtctcaaactcctggcctcaagcatccgcctgcctcagcctccaaaagtgctgggaattataggcgtgagccacagcgmctggcctgtctctatgactttaagtctgtattagtttgctggggcagtggtaacaaagtaacagcttaaaccacagaaatgtattctctctttcacattc

SEQ ID NO: 44509 - DNA, 201 bp, Homo sapiens
cctggccttttctggtgcccccaagctggccaacaggctggagtggcaggtggtggctggttctgggatcttccagcctgcctccttccctggaaaccttrggcttcactcagccctggtccctgccatgagaggaagcactatctgaggacacttaggctggagacccttaggctgttaccacccagatgggaggagctt

SEQ ID NO: 44510 - DNA, 201 bp, Homo sapiens
ttcctgcattaagggcattaaccctttgtctcccatcttttctgtagtttgctgtttctttttcctttatagcatatgttcatctgttttttaattaattmattcatatttattgaataacttctgtgtggcaggcactgtttggggccctggggacacagcagtgaactaaacagacagtccttgctctcttggagctca

SEQ ID NO: 44511 - DNA, 201 bp, Homo sapiens
gaaactagcatcagagaaagtaacaagtctaggcctgctgggggtgggaggggagagataaggagaccagactttggaggagggaggggacttggctgccstaaagggagggtcagttgtcagtgtttcgggatcctggacccctctaggggacagagagaggtggccaaagcaggccaatggatccagttagacagccct

SEQ ID NO: 44512 - DNA, 201 bp, Homo sapiens
gccagggctgagagaaccccttcccccttcccccttctcccttgagagcgctcttggggcttgttgtcagggtctagcccaaggcagggacagcctgcacyaccctggaggcctccagggctcagctcctggttacaggaccctttgggaccctctctccagcctcctcactggagactagggctgggcctgatgccaggg

SEQ ID NO: 44513 - DNA, 201 bp, Homo sapiens
ttcgggatcctggacccctctaggggacagagagaggtggccaaagcaggccaatggatccagttagacagccctgatctaccctgcccaggcctgagccrgctccaggatccaggtcaaagacttcagcccacctgtagagcacagagggctctctaggctggctcaactccagatggctccacagaccaacctggcagg

SEQ ID NO: 44514 - DNA, 201 bp, Homo sapiens
agacttggagtttggaagccagatggaccaagcaaggagcctgactctgagctcaccagctgtgcaattcgggtgagttccttcacccttctgagccatcycttggctcgtctggaaaatgcaaaaaaaaaaaaaagaaaaacaccaggtttttgcatcctcctggatgagggatataaagtgcctgacacagcatatgac

SEQ ID NO: 44515 - DNA, 201 bp, Homo sapiens
aaaaaaaaaaaaagaaaaacaccaggtttttgcatcctcctggatgagggatataaagtgcctgacacagcatatgacagggatttgataaatgggggctrttagctgtcccattgtggatgtgagaatagcattctgctggctaaaaggcagacatgaatgttctagaacatggcgatcccggaatgtgcagtgaaggca

SEQ ID NO: 44516 - DNA, 201 bp, Homo sapiens
gggtggagcagacagacttggagtttggaagccagatggaccaagcaaggagcctgactctgagctcaccagctgtgcaattcgggtgagttccttcaccyttctgagccatcccttggctcgtctggaaaatgcaaaaaaaaaaaaaagaaaaacaccaggtttttgcatcctcctggatgagggatataaagtgcctga

SEQ ID NO: 44517 - DNA, 201 bp, Homo sapiens
gcacatgacagcctccgctgagccaaatggcccaaagacttctgaatgagcttttgctgcaacaaaaaactttggatcattttgagagcctcccgtgaggygccaatatgttgcagtaccttcccggccccgacactgatgtgattcatcgtaggtaacatatgaatacgctcaagctggccagcagcttgaaaaattgga

SEQ ID NO: 44518 - DNA, 201 bp, Homo sapiens
ttttttcttttaaatctttcctcttctggttttgaagttatacattctatttatgttcttctttttagacaagttcttgtgctgttgtccaggacagtggygtaatcacggctcactgcagccttgacctcctgggctcaggtgatcttcccatctcagcttccagtgtagctgggactatagatgcgcgccaccatgccc

SEQ ID NO: 44519 - DNA, 201 bp, Homo sapiens
  misc_feature (1)...(201): n = A,T,C or G, or insertion/deletion polymorphism (see Tables 1-2)
caggctggtctcgaactcctgacctcgtgatctgccctcctcggcctcccaaagtgctgggattacaggcttcagccactgcgcctggccaccctcacttntttttttgcttcccagcagggggagttactaccagggctctttggggagccaggacccctcggccgagcaacctgggccgtccccaccgtgcgcagcggc

SEQ ID NO: 44520 - DNA, 201 bp, Homo sapiens
tttcattcaccatgtttgccaggatggtctcaatctcctgacctcgtgatctgcctgccttggccttcaaaagtgctgggattacaggcgtgagccaccaygccccgccttttttttttttagagagacagggtctccctctgtcgcccaggctggagtacagtggtgcagtgatagcttgctgcagcctcgaactcctgg

SEQ ID NO: 44521 - DNA, 201 bp, Homo sapiens
ttcaggccatcacaaccttctattattgtcgttagtattttaattctgttttgtttcaaaacccttcaacaatgattttttagattttgaactcagtggcrttgttttttgtttgtttgtttgtttgtttttgagacagagtcttgccctgtcaccaggctggagtgcagtggtgcgatctcggctcaccgcaacctccac

SEQ ID NO: 44522 - DNA, 201 bp, Homo sapiens
cttcaggccatcacaaccttctattattgtcgttagtattttaattctgttttgtttcaaaacccttcaacaatgattttttagattttgaactcagtggsattgttttttgtttgtttgtttgtttgtttttgagacagagtcttgccctgtcaccaggctggagtgcagtggtgcgatctcggctcaccgcaacctcca

SEQ ID NO: 44523 - DNA, 201 bp, Homo sapiens
gacacggagcagttcgtggccactgtgctgcaggcggcgagccgagacctggactgggaggtccgcgcccagggcctggagctggccctcgtgttcctggrccagactttggggccgccgcgtacccactgcccctatgccgtggccctacccgaggtggccccagcccagccactcaccgaggcactgagggctctctgc

SEQ ID NO: 44524 - DNA, 201 bp, Homo sapiens
cgccgcacactcgttcgtggacctgcttctctgtgtggctcggtcagggccccgggacgcagctggggggcctgggtgggcaactgttttcctcggataaygcccagggatgtcccactggcagccggagactctctgaggacatggcctgcagtgaagcggcaccggggtgaccctggaaccctcatggggaaaggcctg

SEQ ID NO: 44525 - DNA, 201 bp, Homo sapiens
ccaggccttccaggtccttctccagcccctggcctgtgtcctgaaggccacggttcaggcccccggacccccaggtgtgctgcttagaaagggctgggagkgcagaacctgggtccctgcggctgggggaagggagatggatgagagtagctggctcgccacccccgccccactttaatcacacccaggcctccctccaag

SEQ ID NO: 44526 - DNA, 201 bp, Homo sapiens
cctgcatccacgccggcagtgggaccgcaaccttggctgacggccctcttcctcgcagccccagcgcccttcaccgtggccccaggcgtctctactggggrctacagtgactgtcctgcggctctgtgacggctcggctgcccctgcctccagtgtggggggccacctctgtgggaccctggcgggctgcgtccgggtcca

SEQ ID NO: 44527 - DNA, 201 bp, Homo sapiens
atcacgttgaagagtccttgtgctccgcggccacccccaaggtcactcaggccctgaacgtcctgaccacgaccttcgggcgctgccagagcccctggacrgaagccctgtgggtgcggctgagtccccgcgtggcctgtctgctggagagagaccccatccccgccgcacactcgttcgtggacctgcttctctgtgtgg

SEQ ID NO: 44528 - DNA, 201 bp, Homo sapiens
gtgatcctcccaccccagcctcctggatggctgggactacagggacacaccaccacacccagctaattttttgtatttttttgcggagacggggtttcacyacgttgcccaggctgctttacacgttttgaagtgaggttaggtatacatagatgtaggaatgttgtgtctttctggaatttatctccgtgatcagttaac

SEQ ID NO: 44529 - DNA, 201 bp, Homo sapiens
ggtgggcaggcttttcctcccgcagccaggtggggcatttgtagccatcaccatcccaagtcccagcggcctgccccgaccctgtgtcctcactagaactrcatgttttttacccccgactgtagccccctttgaaaaattcgcccggagtgatgctggggctaaggagttgaggttttttggaataagatgactggcacg

SEQ ID NO: 44530 - DNA, 201 bp, Homo sapiens
gtggcatgatctcggttcactgcagcctcgacttcttgggctcagatgattctctcacctcagcctccctaatagctgggaccacaggagcccgccaccaygcccggctaagtttttgtattttttgtagtgacggggtttcactatgtagcccaggctggtctcaaactcctgggctcaagcagtctgcccgccttggcc

SEQ ID NO: 44531 - DNA, 201 bp, Homo sapiens
tagagatgaggtctcaccatcttgtccaggccagcttggaactcctgggctcaagcagtcttcccgcctgggcttcccaaagtgctgggattacaggagcragccaccatgcctggcctgtatttaaattttaagaagtatttttcagtagctttattgagatataatttgcataccatgccattctcccatttaaggtgt

SEQ ID NO: 44532 - DNA, 201 bp, Homo sapiens
cacggctcactgcagccttgacctcctgggcagtccgcctgcctcattctcttgagttcctgggatcaaggtgtgtaccaggcccagctattttttttttycccatagagatgaggtctcaccatcttgtccaggccagcttggaactcctgggctcaagcagtcttcccgcctgggcttcccaaagtgctgggattacag

SEQ ID NO: 44533 - DNA, 201 bp, Homo sapiens
cagcactttgggaggctgaggcgagcggattgcttaagtccaggagttcaagaccagcctggtccaacatagcgagacgtcatctctaaaaaaaaaaaaaacaaaaattagctgtgcctggtggcgcacctgtagtcccagctactctggaggctgagatgggaggatcctttgagtccgggaggtagaggttgcagtgag

SEQ ID NO: 44534 - DNA, 201 bp, Homo sapiens
gaggccgaggcgacaaggctcggccctcagtcacagctgcatgtggccgtttcgacccccaggacaggctgacttcagatgcgcactcttggcttcagagktgcctcagctggccctgcagctcctccaggaccctgagagttatgtccgagcgagtgcagtgaccgccatggggcagctgtccagccagggcctgcacgc

SEQ ID NO: 44535 - DNA, 201 bp, Homo sapiens
gcttcttgggatcctaaggaaaaggtgccctgcgtaattggtcatgttttgatgtagaaatcccgttgcctgggttgtgggtcttctggtgagggctgccyccacctcctcctgctcacagtctgggaagccggttctgcagcatattctgccctattaaaatcagcccaggaggggcgtggggctcacagctgtgattac

SEQ ID NO: 44536 - DNA, 201 bp, Homo sapiens
acttcctaaggattatctgtggcagactgagggcaagttaagatgaagcccgagagaatgatctggagagttagagcctgaaattcagccagttgagccaygatcagggcaccccaaggttcagttctacagaaggcgtgaacaaacttgttttattgttgttctcgttgtatttagtgtgtttaagacatcagatttgtt

SEQ ID NO: 44537 - DNA, 201 bp, Homo sapiens
ctttccttcacttcctaaggattatctgtggcagactgagggcaagttaagatgaagcccgagagaatgatctggagagttagagcctgaaattcagccarttgagccacgatcagggcaccccaaggttcagttctacagaaggcgtgaacaaacttgttttattgttgttctcgttgtatttagtgtgtttaagacatc

SEQ ID NO: 44538 - DNA, 201 bp, Homo sapiens
tcaaagatgcccctgactctggcccacctgcagcctgggccagcaccacgctgttgccccgactgcaccaaagaccaagggtgacagactttgagttccgraggccttgtggtttcagctagaccctcatctgcccctttcagccccgccaccagcgctcagggccccacctagaccaaagctttgcatccatccctgcag

SEQ ID NO: 44539 - DNA, 201 bp, Homo sapiens
tgcagccaccacttgacgctgggagggacagaaactttccagcccaggctggccctggggcatgggtagacatccccttgcacacatggctgaccccggamctcaaagatgcccctgactctggcccacctgcagcctgggccagcaccacgctgttgccccgactgcaccaaagaccaagggtgacagactttgagttcc

SEQ ID NO: 44540 - DNA, 201 bp, Homo sapiens
ccaccacacccagcaaatttttgtatttctagtagagatggggtttcaccatgttggtcaggctggtctcgaactcctgacctcgtgatctgccctcctcrgcctcccaaagtgctgggattacaggcttcagccactgcgcctggccaccctcacttctttttttgcttcccagcagggggagttactaccagggctctt

SEQ ID NO: 44541 - DNA, 201 bp, Homo sapiens
tgagcatgcagaggcccggcaggtaggaggtggcaggttcctcagccagcaactcccgcctggccatcgtgtgtgctcgtttgcttgcgggtggtcgagcrgccagcatgcagcgtgggagcagctgctgctgtgggcagcgcctgcagcagtgactgccgaggccctggggctgtgctgggtgtgggacctgtgcgcttc

SEQ ID NO: 44542 - DNA, 201 bp, Homo sapiens
cctgtggggggctcactgagccagggtgcaccagcagcctcttgctggctctagaaacttgggccatgtcggctgcccacaaggggatggaggcagaggcygaggcgacaaggctcggccctcagtcacagctgcatgtggccgtttcgacccccaggacaggctgacttcagatgcgcactcttggcttcagaggtgcct

SEQ ID NO: 44543 - DNA, 201 bp, Homo sapiens
ggcttcagaggtgcctcagctggccctgcagctcctccaggaccctgagagttatgtccgagcgagtgcagtgaccgccatggggcagctgtccagccagrgcctgcacgcccccaccagccctgagcatgcagaggcccggcaggtaggaggtggcaggttcctcagccagcaactcccgcctggccatcgtgtgtgctc

SEQ ID NO: 44544 - DNA, 201 bp, Homo sapiens
gcggtcatgcaagtcttcactgagtggctgcgggacggccacgccgacgcggcccaggacacggagcagttcgtggccactgtgctgcaggcggcgagccyagacctggactgggaggtccgcgcccagggcctggagctggccctcgtgttcctgggccagactttggggccgccgcgtacccactgcccctatgccgtg

SEQ ID NO: 44545 - DNA, 201 bp, Homo sapiens
ccgaggggggcgggcgggccagggagcagcccagcccggggcgtgcgcgacctgggctcgcttcccagcccgactgtggccgcctgctctggcgccccttrtggactctcgggcctggcgctcgcggccaaaactgacttcaaagtgtggggagggttcctcttcccgggacgcagccttcccgggcattggcagacggtg

SEQ ID NO: 44546 - DNA, 201 bp, Homo sapiens
gctcaggtccctagacctggagggcctgcggagcacgctggccgagagcagcgaccacgtggaaaagagtccccagtccctcctgcaggacatgctggccmcgggaggcttcctgcagggggacgaggccgactgctactgagcagaaccagagtctgccactggggctcaggaccaagggaggcagcaccatgtccttct

SEQ ID NO: 44547 - DNA, 201 bp, Homo sapiens
tgaagcggcaccggggtgaccctggaaccctcatggggaaaggcctgtcttgggctgggcgcctccagtgccggagccatggcagtctcagccaggcctcraatggggttttgagggtgggggagtaatttttctctctggggtctccctgcagttctcccgtgttcagttcttccgacggcagcctgtgggagacagtgg

SEQ ID NO: 44548 - DNA, 201 bp, Homo sapiens
ccctcagtcacagctgcatgtggccgtttcgacccccaggacaggctgacttcagatgcgcactcttggcttcagaggtgcctcagctggccctgcagctyctccaggaccctgagagttatgtccgagcgagtgcagtgaccgccatggggcagctgtccagccagggcctgcacgcccccaccagccctgagcatgcag

SEQ ID NO: 44549 - DNA, 201 bp, Homo sapiens
  misc_feature (1)...(201): n = A,T,C or G, or insertion/deletion polymorphism (see Tables 1-2)
tggtcaggcggcctgcggggaattctggacaagggaaatgaggtggcaccaagacggccctgggcgtgggctttgggttctcctaagcgccatttgtgaangtgcctactccacagcccctcacggagctgggccctggcaggtacagaccttgtgccacctgccgctgagcagacagcagacaactttggaggaagggcc

SEQ ID NO: 44550 - DNA, 201 bp, Homo sapiens
ggctggtgtgcagtggtgcgatcttggctcactgcaaccttcgcctcccgggttcaagcaattctcctgcctcagccttcttagtagctgggattacaggkgcatgccaccacacccagcaaatttttgtatttctagtagagatggggtttcaccatgttggtcaggctggtctcgaactcctgacctcgtgatctgccc

SEQ ID NO: 44551 - DNA, 201 bp, Homo sapiens
gagatggatgagagtagctggctcgccacccccgccccactttaatcacacccaggcctccctccaagagcaaaggggaccggggacatggccatctcccytggtgagctgctgctctgcacctaggtcctggcctgtgctgtgggtggtgaccgtggggtggctggtgaccgtggggaggctgaagtgctctctaaggga

SEQ ID NO: 44552 - DNA, 201 bp, Homo sapiens
tgcctgtgtgatcccagggaattcactgcaccttgctgaatctgagtgtctggtctgtgcgatgtctcagggttgttgcaaagactgcactgtgacagtayggctgtccagtgttctctggttggcaggtcaggccctaggagccaggacggctttctcagccacttacagatcagccgtgaggactcagtctttgaaact

SEQ ID NO: 44553 - DNA, 201 bp, Homo sapiens
atccctgcagtacagacctctggtctggggatcatggttctcctggtctgagatgaaagttctggggccccttcccaggcctgagcaggcatggtgggctrctgtgactagagcgagctgggtctggagtgggcattgaggtttggctctcacattgcctttgcagggcctgcggcctcaccatggacccagaatgcgccc

SEQ ID NO: 44554 - DNA, 201 bp, Homo sapiens
ccacctctgtgggaccctggcgggctgcgtccgggtccagcgagcagccctcgacttcctggggacgctgtcacaggggacaggtgagtgtgttctgtacrgctttggcgtggggctatccctgtgcccccactctcctttctgctcggaggcacccgggaactgctgtccctctctgtttcttctctggggtgggggctg

SEQ ID NO: 44555 - DNA, 201 bp, Homo sapiens
taccggagtcctgttgcgggagcctcgctcctgccaccccaccaaccatccgcacttgctccctgtcccccagagcctgttcctggagctcctgcacatcytctccgtagactcggagggcttcccacggcgggcggtcatgcaagtcttcactgagtggctgcgggacggccacgccgacgcggcccaggacacggagca

SEQ ID NO: 44556 - DNA, 201 bp, Homo sapiens
  misc_feature (1)...(201): n = A,T,C or G, or insertion/deletion polymorphism (see Tables 1-2)
ggaataagatgactggcacgggctcccagctctgaccagctgtctgagcttgcccacggccgcaagcctccatctcttcctgggatggagacaggagtcgnagctgcgccatggcctccgtctcttcctgggacggagacaggagtcgtagctgccccgtggcccccgtctcttcctgggacggagacaggagtcgtagct

SEQ ID NO: 44557 - DNA, 201 bp, Homo sapiens
atgggaaggtgtcagagcgggctgtggccctagactgcatgtccggggccagcccccatcatgtaccggagtcctgttgcgggagcctcgctcctgccacmccaccaaccatccgcacttgctccctgtcccccagagcctgttcctggagctcctgcacatcctctccgtagactcggagggcttcccacggcgggcggt

SEQ ID NO: 44558 - DNA, 201 bp, Homo sapiens
atgtttgttccattgtacctgcttgcatggagcactgtctaaggaaaagtacccatttggaaggtgaaaatgctcttccacttttttttttttttttttttggaatggagtctcgctctgtcgcccagggctggagtgtgccgtgtgcaatgacgtggtcttggctcactgcagcctctgcctcccaggttcaagcgattc

SEQ ID NO: 44559 - DNA, 201 bp, Homo sapiens
ccgtgttcagttcttccgacggcagcctgtgggagacagtggcgcgggctctgagctgcctgggtcccacccacatgggacccctggctttggggatcctraagctcgagcactggtatggtctggggtgcatttcattccgaggcgggtgctgggagctggggcaggcagggaggttgagagcgcagccctcatggcagg

SEQ ID NO: 44560 - DNA, 201 bp, Homo sapiens
ccctcctggaggcccctcagtatctgctcctaaggacatcaggagtgtcaggcccatctccttggtcaggcctgtcctccccgccactctgtcccatggcrtcccctggccagtggcctgcagagaatgtttctcggggggtgtcccaaccccctggctgatttgccccaggcttgctggggacattaggagcacagccaa

SEQ ID NO: 44561 - DNA, 201 bp, Homo sapiens
  misc_feature (1)...(201): n = A,T,C or G, or insertion/deletion polymorphism (see Tables 1-2)
gagttgaggttttttggaataagatgactggcacgggctcccagctctgaccagctgtctgagcttgcccacggccgcaagcctccatctcttcctggganggagacaggagtcgtagctgcgccatggcctccgtctcttcctgggacggagacaggagtcgtagctgccccgtggcccccgtctcttcctgggacggag

SEQ ID NO: 44562 - DNA, 201 bp, Homo sapiens
taccatgagggtccagctctgagctccggggtctccgaatgtttaggagagagtagaccgggggaggatggaggaacaggcccggccctgcaggaatgcaytgtggggacactgcctccacctaggcccagacgtgagggcaggtccctcccacagagtggacgctgtacacacctggggacacccgggaggctgggggca

SEQ ID NO: 44563 - DNA, 201 bp, Homo sapiens
acgctgttgccccgactgcaccaaagaccaagggtgacagactttgagttccggaggccttgtggtttcagctagaccctcatctgcccctttcagccccrccaccagcgctcagggccccacctagaccaaagctttgcatccatccctgcagtacagacctctggtctggggatcatggttctcctggtctgagatgaa

SEQ ID NO: 44564 - DNA, 201 bp, Homo sapiens
cgcggcagcttctgaaggttctttagcaacagaataattgtttcagaccaaagctctgcgagatccccagaggtgagaaggatgcgggagctgctctgctyagagcagggtggtcctgccgacgccctgcgctccgctgccctcccacctgtcccccaccgcagctttggttgggggtttcggagctccccagcacacaca

SEQ ID NO: 44565 - DNA, 201 bp, Homo sapiens
tgagcccaggggttcgaggctacagtgagcagtggttgagccactgcactccaacttaggcaacagagcaagaccccgtctcaaaaaaacaagaaacgagsctgggcacggtggctcacgcctgtaatctcagcactttgggaggccgaggcgggtggatcacctgaggtcaggagttcaagaccagcctggccaacatgg

SEQ ID NO: 44566 - DNA, 201 bp, Homo sapiens
ccaccgtgcgcagcggctggatccagggcctgcgctccctggcacagcaccccagcgccctgcgcttcctggccgaccatggtgagtgcgcccacaccccrccccattcctcatcctgcctgtgtgatcccagggaattcactgcaccttgctgaatctgagtgtctggtctgtgcgatgtctcagggttgttgcaaagac

SEQ ID NO: 44567 - DNA, 201 bp, Homo sapiens
gcagtggcagctcactgcagccttgacctcctgggctcaagtgaccctccccattcagcttcccgagtagctgggtccacaggtgcatgaaccacacctgrctaactttgttatctttggtagagatggggtctcactatgttgcccaggctggtctcaaactcctggtctcaagcgatcatcctgcctcggcctcccaaa

SEQ ID NO: 44568 - DNA, 201 bp, Homo sapiens
cacggcgggcggtcatgcaagtcttcactgagtggctgcgggacggccacgccgacgcggcccaggacacggagcagttcgtggccactgtgctgcaggcrgcgagccgagacctggactgggaggtccgcgcccagggcctggagctggccctcgtgttcctgggccagactttggggccgccgcgtacccactgcccct

SEQ ID NO: 44569 - DNA, 201 bp, Homo sapiens
gaccaaatgagaccgcacatcctgcacctccagcgacccagcctacaaatgaatgaataactaatgagaatgtgaatgactaatgagaatgtctttttttwaaaaaattaattttatttatttttattttattttattattatttttcgagacagagtcttgctctgtcacccaggctggagtgcaatggttcgaactcag

SEQ ID NO: 44570 - DNA, 201 bp, Homo sapiens
cacgggaggcttcctgcagggggacgaggccgactgctactgagcagaaccagagtctgccactggggctcaggaccaagggaggcagcaccatgtccttytgtgggacactgccagccccagggctccagcccagcccggtggatcctctggggaagccaggaccaggagagaagcaaggtcaagaaatcccacagtttg

SEQ ID NO: 44571 - DNA, 201 bp, Homo sapiens
accacgtggaaaagagtccccagtccctcctgcaggacatgctggccacgggaggcttcctgcagggggacgaggccgactgctactgagcagaaccagastctgccactggggctcaggaccaagggaggcagcaccatgtccttctgtgggacactgccagccccagggctccagcccagcccggtggatcctctgggg

SEQ ID NO: 44572 - DNA, 201 bp, Homo sapiens
  misc_feature (1)...(201): n = A,T,C or G, or insertion/deletion polymorphism (see Tables 1-2)
ccccaggggaccaggagcctgaggctgtgctggccatgctcaggtccctagacctggagggcctgcggagcacgctggccgagagcagcgaccacgtgganaagagtccccagtccctcctgcaggacatgctggccacgggaggcttcctgcagggggacgaggccgactgctactgagcagaaccagagtctgccactg

SEQ ID NO: 44573 - DNA, 201 bp, Homo sapiens
tgtccttctgtgggacactgccagccccagggctccagcccagcccggtggatcctctggggaagccaggaccaggagagaagcaaggtcaagaaatcccmcagtttgatgtattaaagaaatgacttatttctactcaaaataaatggcattgaagtctttctttaaccctttttgagttaatttaataataatgatctg

SEQ ID NO: 44574 - DNA, 201 bp, Homo sapiens
aaggccacggttcaggcccccggacccccaggtgtgctgcttagaaagggctgggagggcagaacctgggtccctgcggctgggggaagggagatggatgrgagtagctggctcgccacccccgccccactttaatcacacccaggcctccctccaagagcaaaggggaccggggacatggccatctcccctggtgagctg

SEQ ID NO: 44575 - DNA, 201 bp, Homo sapiens
cctgccgaggtggcgggcgggtgagcaggcccagcccccaggggaccaggagcctgaggctgtgctggccatgctcaggtccctagacctggagggcctgyggagcacgctggccgagagcagcgaccacgtggaaaagagtccccagtccctcctgcaggacatgctggccacgggaggcttcctgcagggggacgaggc

SEQ ID NO: 44576 - DNA, 201 bp, Homo sapiens
cccacctgagtgtcccgtggagaggtgggcaggcttttcctcccgcagccaggtggggcatttgtagccatcaccatcccaagtcccagcggcctgccccraccctgtgtcctcactagaactgcatgttttttacccccgactgtagccccctttgaaaaattcgcccggagtgatgctggggctaaggagttgaggttt

SEQ ID NO: 44577 - DNA, 201 bp, Homo sapiens
  misc_feature (1)...(201): n = A,T,C or G, or insertion/deletion polymorphism (see Tables 1-2)
cggtcatgcaagtcttcactgagtggctgcgggacggccacgccgacgcggcccaggacacggagcagttcgtggccactgtgctgcaggcggcgagccgngacctggactgggaggtccgcgcccagggcctggagctggccctcgtgttcctgggccagactttggggccgccgcgtacccactgcccctatgccgtgg

SEQ ID NO: 44578 - DNA, 201 bp, Homo sapiens
tgggcaggcttttcctcccgcagccaggtggggcatttgtagccatcaccatcccaagtcccagcggcctgccccgaccctgtgtcctcactagaactgcmtgttttttacccccgactgtagccccctttgaaaaattcgcccggagtgatgctggggctaaggagttgaggttttttggaataagatgactggcacggg

SEQ ID NO: 44579 - DNA, 201 bp, Homo sapiens
  misc_feature (1)...(201): n = A,T,C or G, or insertion/deletion polymorphism (see Tables 1-2)
ctaacaccctgcaagaaaagggtctgggaattgctaggagaagagcggtcatccagggggacacctggtgccgtacccctggtgacccctgggctgggccntccccacagagtccagtgtcgtgctgctgcaggagcacccctgcctggtggagctgctgtcccatgtgctgaaagtccaggacctgagttctggggtcct

SEQ ID NO: 44580 - DNA, 201 bp, Homo sapiens
  misc_feature (1)...(201): n = A,T,C or G, or insertion/deletion polymorphism (see Tables 1-2)
tatttttttcccagttggatccctaaatctaacaccctgcaagaaaagggtctgggaattgctaggagaagagcggtcatccagggggacacctggtgccntacccctggtgacccctgggctgggccgtccccacagagtccagtgtcgtgctgctgcaggagcacccctgcctggtggagctgctgtcccatgtgctga

SEQ ID NO: 44581 - DNA, 201 bp, Homo sapiens
ctctgtcgcccagggctggagtgtgccgtgtgcaatgacgtggtcttggctcactgcagcctctgcctcccaggttcaagcgattctcctgcctcagcctyccaattagctgggactacaggcatgagccaccacacctggctaattttttgtatttttagtagagatgggacttcgccatgttggccaggctggtctcga

SEQ ID NO: 44582 - DNA, 201 bp, Homo sapiens
ggggtttcaccatgttggtcaggctggtctcgaactcctgacctcgtgatctgccctcctcggcctcccaaagtgctgggattacaggcttcagccactgsgcctggccaccctcacttctttttttgcttcccagcagggggagttactaccagggctctttggggagccaggacccctcggccgagcaacctgggccgt

SEQ ID NO: 44583 - DNA, 201 bp, Homo sapiens
ctcagggccccacctagaccaaagctttgcatccatccctgcagtacagacctctggtctggggatcatggttctcctggtctgagatgaaagttctgggrccccttcccaggcctgagcaggcatggtgggctgctgtgactagagcgagctgggtctggagtgggcattgaggtttggctctcacattgcctttgcagg

SEQ ID NO: 44584 - DNA, 201 bp, Homo sapiens
ggaaaagtacccatttggaaggtgaaaatgctcttccacttttttttttttttttttttggaatggagtctcgctctgtcgcccagggctggagtgtgccrtgtgcaatgacgtggtcttggctcactgcagcctctgcctcccaggttcaagcgattctcctgcctcagccttccaattagctgggactacaggcatgag

SEQ ID NO: 44585 - DNA, 201 bp, Homo sapiens
ttgcatggagcactgtctaaggaaaagtacccatttggaaggtgaaaatgctcttccacttttttttttttttttttttggaatggagtctcgctctgtcrcccagggctggagtgtgccgtgtgcaatgacgtggtcttggctcactgcagcctctgcctcccaggttcaagcgattctcctgcctcagccttccaatta

SEQ ID NO: 44586 - DNA, 201 bp, Homo sapiens
ggggttttgagggtgggggagtaatttttctctctggggtctccctgcagttctcccgtgttcagttcttccgacggcagcctgtgggagacagtggcgcrggctctgagctgcctgggtcccacccacatgggacccctggctttggggatcctgaagctcgagcactggtatggtctggggtgcatttcattccgaggc

SEQ ID NO: 44587 - DNA, 201 bp, Homo sapiens
acaggttttttaataagttcatcattttctttaaaaatagtttatttttaaaaatagtttgattctattactcactgttgaacagtttccaaccttcttaygatgttttagattttgaaacatcatgtcttccttacaaatggacattctaattgtggatctgaaaaatgcagagactcttaagagctaaaggaatgtaca

SEQ ID NO: 44588 - DNA, 201 bp, Homo sapiens
tccttgtgcctgaaggactgactattccaagggaagtgaggtagactaaccccactacatacatacatacatacatacatatatgtatatatatatatatwtatatatattttttttttttttttgagacagagtctcaatctgtagcccaggctggagtgcagtggcacgatctcggctcactgtaacctccacctcctg

SEQ ID NO: 44589 - DNA, 201 bp, Homo sapiens
ggcacaataggaggaaataacaagcaagctctggggatgagtaagtaggagttacctagactgaagaaaagaaggcacaccatgtcaaggagctgaagcarcatgtttagaagttctgtggcgtaagggaggatgatatcagaagggatggagcaaaggctgtgaggttggagctgagggagagggagtgtgatataagct

SEQ ID NO: 44590 - DNA, 201 bp, Homo sapiens
tatcgtgagatattattttgtttttactcttcataatagctgaaaaaatgacagtgaccagtgttttcaaaatgttcttattgagcattctcatatattgktggttggcatatttgttgaaaataatttggctgtatgttgtgaattatttaaaattgtgtaaactcttttactcagtaaattccacttctaggaatctgc

SEQ ID NO: 44591 - DNA, 201 bp, Homo sapiens
actcatcattcaaggcctatcttaaatactacctcttccttgaagacttttctttggttagaatataagcttcttgagagctgggaacgatatcatattcttttttttttttttttttagacaggctctcgctctgtttcccaggctggagtgtggtggcatgatcatgggtcactgcaaccttggtctccccggctcatg

SEQ ID NO: 44592 - DNA, 201 bp, Homo sapiens
tgtgcctgaaggactgactattccaagggaagtgaggtagactaaccccactacatacatacatacatacatacatatatgtatatatatatatatatatatatattttttttttttttttgagacagagtctcaatctgtagcccaggctggagtgcagtggcacgatctcggctcactgtaacctccacctcctgggtt

SEQ ID NO: 44593 - DNA, 201 bp, Homo sapiens
ttggttagtttaaactcacatatttgccatgctactaaactactcagattttccttaaacccagttttgttttttgagatggggtttctgtcacccgggcrggagtgcagtggcatgatctccactcactgcatcctccacctccctggctcaagcagtcctcctacatcagcctgccaagtaactgggacaacaggtgtg

SEQ ID NO: 44594 - DNA, 201 bp, Homo sapiens
tgcctgaaggactgactattccaagggaagtgaggtagactaaccccactacatacatacatacatacatacatatatgtatatatatatatatatatatatattttttttttttttttgagacagagtctcaatctgtagcccaggctggagtgcagtggcacgatctcggctcactgtaacctccacctcctgggttca

SEQ ID NO: 44595 - DNA, 201 bp, Homo sapiens
aatcttactcatcattcaaggcctatcttaaatactacctcttccttgaagacttttctttggttagaatataagcttcttgagagctgggaacgatatcatattcttttttttttttttttttagacaggctctcgctctgtttcccaggctggagtgtggtggcatgatcatgggtcactgcaaccttggtctccccgg

SEQ ID NO: 44596 - DNA, 201 bp, Homo sapiens
aaagaagaaaaggccttgggatctattatttatttttattggccaagaagagcttaccctatttcttaaccaccttagttattctttctttttttatttgcccccccccacccccaagaggtagaggagataaaactttaactaggaaggtagatttaactctttgttcactttgatgtctttaagagacctagagcattt

SEQ ID NO: 44597 - DNA, 201 bp, Homo sapiens
cctgaaggactgactattccaagggaagtgaggtagactaaccccactacatacatacatacatacatacatatatgtatatatatatatatatatatatattttttttttttttttgagacagagtctcaatctgtagcccaggctggagtgcagtggcacgatctcggctcactgtaacctccacctcctgggttcaag

SEQ ID NO: 44598 - DNA, 201 bp, Homo sapiens
gcaaggattatgggcatgagccactgagcccagcctaaacaaagcttttaaaagctcctgcaacctcaaggttgttaacctggtcatctcatggtaattasaaactctgattggctgctttagatttcttgattaaaaacctaagtaaactgattaagttttaggcattctttcaaaggtttctcagtgaaaagattggga

SEQ ID NO: 44599 - DNA, 201 bp, Homo sapiens
tcttgaacttctcgcctcaagtgatctgcctgcctcggcctcccaaagtgctagaattacaggcgtgagccaccatgcctggcctatttcttttttttttwaaaaaaaagttctctggaagagcatagtattttgaaagtattatatgtttctgatccatctttgtctattatctcagaatctcaccatggcttagctgat

SEQ ID NO: 44600 - DNA, 201 bp, Homo sapiens
tcttaaatactacctcttccttgaagacttttctttggttagaatataagcttcttgagagctgggaacgatatcatattcttttttttttttttttttaracaggctctcgctctgtttcccaggctggagtgtggtggcatgatcatgggtcactgcaaccttggtctccccggctcatgcagtcctcccacctcatcc

SEQ ID NO: 44601 - DNA, 201 bp, Homo sapiens
atcattattaatttatgcccaatcctagtttctaagcactagggaggataataaaattaatcatttagatgcaatatactaagtgtagatacataggaagmtttcctgggggattcattgtgcttttatttttttatattgtgtattaaagtatgataattttttttttttacatgggactctgcttgataaaagtataat

SEQ ID NO: 44602 - DNA, 201 bp, Homo sapiens
agtcattggccaaggatactatgatgaacaaaaatgaacctagcctttaacttcatgtaaaagtacaattttgctaagttccacaaaggagagacacatgwtatgagaaggcacaataggaggaaataacaagcaagctctggggatgagtaagtaggagttacctagactgaagaaaagaaggcacaccatgtcaaggag

SEQ ID NO: 44603 - DNA, 201 bp, Homo sapiens
gttctccgggagggttatattggttcccattccacagcggccgcaacgtgtcgagagccgtaagtaaagtgtcgcaaagcagaaggaaggcgggagtcccractgcaaacattgaggaaagccaggcagtagaggccgctatggcgaacgttccgtgggcagaggtctgcgagaaattccaggcggcgctcgctctgtcgc

SEQ ID NO: 44604 - DNA, 201 bp, Homo sapiens
gtatatgaaagaggtatgttacatgtcagatgagttttaagttttgattgaaactagttaagaattgatagtaagaatccctcattcgtaatattggtgtractcttcactgtgccctagaacttctctatagagccatctgggaagtcacctcatagctgaaattattgcatattaaagacttcagggttttaaaaaaat

SEQ ID NO: 44605 - DNA, 201 bp, Homo sapiens
  misc_feature (1)...(201): n = A,T,C or G, or insertion/deletion polymorphism (see Tables 1-2)
tcacagttaacatgtgtctttgagtcatttaacaggttttttaataagttcatcattttctttaaaaatagtttatttttaaaaatagtttgattctattnctcactgttgaacagtttccaaccttcttacgatgttttagattttgaaacatcatgtcttccttacaaatggacattctaattgtggatctgaaaaatg

SEQ ID NO: 44606 - DNA, 201 bp, Homo sapiens
ataatagaatatctatttaattgtatataatggtgtacttaaaaatgaagctaagagttgataatgatatgagtaaagtgtttgtggtgcgagaaagaaayatgcaaaaataatagtgagtgcttctgggtagtaggatttggggggggatctttcttcccttttccccaagccccctgcttcagtaaagatctgttactt

SEQ ID NO: 44607 - DNA, 201 bp, Homo sapiens
ctttaatattatttaacagcaggaggtgagtgtcctacttaaccataatttatttttttttccttcaggacaacataggagagcttgatcttgataaacartctgaacttagagctttaaggaaaaaagaactagatgaggaggaaagcattcggaaaaaagctgtgcagtttggaaccggtgaactgtgtgatgccatct

SEQ ID NO: 44608 - DNA, 201 bp, Homo sapiens
ctgagggcctcagactgttgacctctctcatttcctttccatatgggcttctccatagggtggctcacaacatggcagttggcttccttaagaaggagcargcaattgaccgggcgcggtggctgacgcctgtaatcccagcactttgggaggctgaggtgggtggatcatgaggtcaggagatcgagaccatcctggcta

SEQ ID NO: 44609 - DNA, 201 bp, Homo sapiens
agtgacacctcatcgctactaaaaataagaaaaaaaaattattccaggcatggctgctttgctaggcagtatgttctttgggcagccatcggggccccaaccaccaccggggctctggggccaggcttcctttacttaccagcagctccggggcctctgagaccttctaacagtactttggtggatgacatggagtcatct

SEQ ID NO: 44610 - DNA, 201 bp, Homo sapiens
tgaaattgttaatttaaaatgtaaagtctgaggccaggcacagtggctcacgcctttaatcccagcactttgggaggctgaggtgggtggattgcctgacytagaggttcaaagatcagcctgggccacatagtgatacgctgtctctacaaaaactaaaaaaaaattagctgggtgtggtggcgtgtgcttgtggtccca

SEQ ID NO: 44611 - DNA, 201 bp, Homo sapiens
atggctgctttgctaggcagtatgttctttgggcagccatcggggccccaaccaccaccggggctctggggccaggcttcctttacttaccagcagctccygggcctctgagaccttctaacagtactttggtggatgacatggagtcatctttccagacttgctttgcctctccgttaagtcaggactatgtcaatggca

SEQ ID NO: 44612 - DNA, 201 bp, Homo sapiens
aaacctccatttaccacttacttgttatttgaccttgttcaaacctgagactcagtttccttatctgtcaaatagatacaataaacaaatccaactcaaakggttggtgggataatcaaaataaatatatatgaaatttacttataaaacgtaaaccatggtccggacacggtggcttacacctgtaatcccagcactttg

SEQ ID NO: 44613 - DNA, 201 bp, Homo sapiens
aaaaaatgctgggtaatgtacctggtaacaagcctgttaatatattaagattgaaaaagtaacttctatagttactccttctaaaatatttgacttcctamattccccccacccaaaatctttcccttttgaaaatactaaaaactaagttatgttattataaagtgtaaaatggtttgtcttaattataggagaaaaagg

SEQ ID NO: 44614 - DNA, 201 bp, Homo sapiens
gttcgtatgatgatacactttcttttttatgtgggttttttttttttgcttgttttttatttttatttttatttttgagacagaatcttcctctgttgccmaggctacatagcagtggcaccttcacagctcattgcaacttccaccctcctggcttaagcgatccttccacctcagcctcccaaatagctgggaccacag

SEQ ID NO: 44615 - DNA, 201 bp, Homo sapiens
tcttgattaaaaacctaagtaaactgattaagttttaggcattctttcaaaggtttctcagtgaaaagattgggaactattctatttggtgctttgtgaamatattttgaattagtatatgtgccagttattgccatttcttaagtccaaaatgtttttctggtcaaataaatagcagtttttcaaaaacaaaaattagct

SEQ ID NO: 44616 - DNA, 201 bp, Homo sapiens
ctcagcctcctgaatagctgggactatgtagaaattttattttatttttgaagacggggtctggctctgtcacccaggctggagtgcagtggtgggatttyggctcactgcaacctctgctttctgggctcaagccatcctcccacctcagcctcctaagtagctgagactacagggtcacaccaccacgcccagctaatt

SEQ ID NO: 44617 - DNA, 201 bp, Homo sapiens
gtggtgggatttcggctcactgcaacctctgctttctgggctcaagccatcctcccacctcagcctcctaagtagctgagactacagggtcacaccaccaygcccagctaatttttgtattttttgtagaggcagggtttcaccatgttgcccaggcctcaagtgattcgcctgcgttggcctcccaaagtgctgggatta

SEQ ID NO: 44618 - DNA, 201 bp, Homo sapiens
ccttaagaccaggaggttgaggctgcagtgaactatgattgtgccactgcactccagccttgggccagagtgagacccctgtctcgtaaaaaaaaaaaaaaaatatatatatatatatatatatatatattcagtcttctgacacaatgtaaatagtctaagaatttattgtgcatgggattttggctacttagactgaac

SEQ ID NO: 44619 - DNA, 201 bp, Homo sapiens
tcgtattcttcgaattgcttgaatccgggaggcagaggctgcgtgagccgagattggaccactgcactccagcctgggcaacagagcgagactccatctcwaaataaataaataaataaaataaatcttactcatcattcaaggcctatcttaaatactacctcttccttgaagacttttctttggttagaatataagctt

SEQ ID NO: 44620 - DNA, 201 bp, Homo sapiens
atcttactcatcattcaaggcctatcttaaatactacctcttccttgaagacttttctttggttagaatataagcttcttgagagctgggaacgatatcatattcttttttttttttttttttagacaggctctcgctctgtttcccaggctggagtgtggtggcatgatcatgggtcactgcaaccttggtctccccggc

SEQ ID NO: 44621 - DNA, 201 bp, Homo sapiens
agaccaggaggttgaggctgcagtgaactatgattgtgccactgcactccagccttgggccagagtgagacccctgtctcgtaaaaaaaaaaaaaaaatawatatatatatatatatatatatattcagtcttctgacacaatgtaaatagtctaagaatttattgtgcatgggattttggctacttagactgaacctaaa

SEQ ID NO: 44622 - DNA, 201 bp, Homo sapiens
  misc_feature (1)...(201): n = A,T,C or G, or insertion/deletion polymorphism (see Tables 1-2)
gggtggattgcctgacttagaggttcaaagatcagcctgggccacatagtgatacgctgtctctacaaaaactaaaaaaaaattagctgggtgtggtggcntgtgcttgtggtcccagctacttcgggggctgaggtgggaggatggcttgagtccgggagggcagtccaggaggtcaaagcagcagtgagcgaggatcct

SEQ ID NO: 44623 - DNA, 201 bp, Homo sapiens
taagaccaggaggttgaggctgcagtgaactatgattgtgccactgcactccagccttgggccagagtgagacccctgtctcgtaaaaaaaaaaaaaaaawatatatatatatatatatatatatattcagtcttctgacacaatgtaaatagtctaagaatttattgtgcatgggattttggctacttagactgaaccta

SEQ ID NO: 44624 - DNA, 201 bp, Homo sapiens
  misc_feature (1)...(201): n = A,T,C or G, or insertion/deletion polymorphism (see Tables 1-2)
atacaagtccaaatacagcgcccgggcgctactggaagaggtcaaggcgctgctcggccctgcgcctgaggacgaggatgagcggcctgaggccgaggacngcccgggtgccggtgaccacgccctggggctgccggctgaggtggtggagcccgaggggcccgtcgcccagcgagcggtgaggctggcagtcatcgagtt

SEQ ID NO: 44625 - DNA, 201 bp, Homo sapiens
aactttcttcctgaagtactaacaagagcagagtgccacaaaaccaaatagagatattagtctaccctttcttgcttttaggctcacagtcttatatgtgraattgttaatttaaaatgtaaagtctgaggccaggcacagtggctcacgcctttaatcccagcactttgggaggctgaggtgggtggattgcctgactta

SEQ ID NO: 44626 - DNA, 201 bp, Homo sapiens
tataacatgcctgtaccttgggtaaaccaagtaaacttttttttgtcttaggcaaagtttagactgttcgtatgatgatacactttcttttttatgtgggttttttttttttgcttgttttttatttttatttttatttttgagacagaatcttcctctgttgcccaggctacatagcagtggcaccttcacagctcattg

SEQ ID NO: 44627 - DNA, 201 bp, Homo sapiens
agctcttcttagactccctgagagacccaaataaagtattccctgagcatataggggaagatgttcttcgccctgccatgttagctaagtttcgagttgcycgtctctatggcaaaatcattactgcagatcccaagaaagagctggaaaatttggcaacatcattggaacattacaaatttattgttgattactgtgaaa

SEQ ID NO: 44628 - DNA, 201 bp, Homo sapiens
cttactcatcattcaaggcctatcttaaatactacctcttccttgaagacttttctttggttagaatataagcttcttgagagctgggaacgatatcatattcttttttttttttttttttagacaggctctcgctctgtttcccaggctggagtgtggtggcatgatcatgggtcactgcaaccttggtctccccggctc

SEQ ID NO: 44629 - DNA, 201 bp, Homo sapiens
  misc_feature (1)...(201): n = A,T,C or G, or insertion/deletion polymorphism (see Tables 1-2)
caagagcagagtgccacaaaaccaaatagagatattagtctaccctttcttgcttttaggctcacagtcttatatgtgaaattgttaatttaaaatgtaangtctgaggccaggcacagtggctcacgcctttaatcccagcactttgggaggctgaggtgggtggattgcctgacttagaggttcaaagatcagcctggg

SEQ ID NO: 44630 - DNA, 201 bp, Homo sapiens
cacccagcccaaaagatttttaaaacaaaatgtgtgatatagtaatatatatgcttctttattaacacattatataatgtgtctaatatctatgatgattktaaagtaatgatgagcataaatgatattttgagatatctgcaaactagcataatagaaaggtttttttttttcatttctattgttcacaaagtcccaggt

SEQ ID NO: 44631 - DNA, 201 bp, Homo sapiens
tgaggcacaagaatcgctagaacccgggaggcggaggttgcagtgagccaagatcatgtcacagcactccagactgggcaacagagcaagactctatctcaaaaaaaaaaaatggtaataataattcaaataaaatgtcaatagtgattatctctgtggagtcaagctttaaaaaaaaaatccaaaacaccaaacctaatt

SEQ ID NO: 44632 - DNA, 201 bp, Homo sapiens
ttggctcactgaagccttgatctcctggggtcaagcgatcctcccacctcaaacccccaagtagctgggactacaggcatatgccaccatgcctggctaayttttatatttttgtgtagagacagggttttgccatgttgtccatgctggtctgaactgagctctggcaatccacctgccttgacctcccaaagtgttggg

SEQ ID NO: 44633 - DNA, 201 bp, Homo sapiens
gggcgtggtggcgggtgcctgtagtcccagctactcgggaggctgaggtaggagaatggcgtcaacccgggaggcggagcttgcagtgagccgagatcacrgcactgcaccccagtgtgggtgacagagcgagactccatctcaaaaaaaaaaaaaaaagttccatcataacttcatttttactagaagggtcaagattaa

SEQ ID NO: 44634 - DNA, 201 bp, Homo sapiens
ttctgtgagtctaatatggctgtagtgatttaatagaaacccttgtgttttgcttttctcccttcccctttctgtttcttagagttggaaaggctcctggrtaaatttggacaggatgcacaaagaatagaagattctgtgctgattggatgctctgagcagcaggaagcatggtttgctctggatctaggtctggatagc

SEQ ID NO: 44635 - DNA, 201 bp, Homo sapiens
ggttgtgccccatactccggaggaaggaaggctgcacagagaggccaaggagaacctgaacagacaggcattgctgggtttccggtcagtctattattatkaaatcataaccattttgtccaatcagatttctacatggttgtcaatcatgcctatgtaatgaagccaccataaaaacccaaaaggacagggttcagagag

SEQ ID NO: 44636 - DNA, 201 bp, Homo sapiens
gccccctgctctgagcacacccctagattccatgaatttttactacacttactttatcacaaagctgtccatctatccattaatctatcttattttttgaygcatagattgaagatattagtacacttcttcctatttcagcatgcgtaacatttgctagaattcagtatttatttacaggttggtttttttctctagtct

SEQ ID NO: 44637 - DNA, 201 bp, Homo sapiens
ctccctccttggcctcccaaagtgctaagattataggtatgagccaccacacctggcctatacattttgtatatttctttttttttttttttttgaggcaragtttcactcttgttgcccaggctggagtgcaatggcgcgatctcggctcgccacaaccttcgcctcccaggttcaagcgattctcctgcctcagcctcc

SEQ ID NO: 44638 - DNA, 201 bp, Homo sapiens
gtattatcttctaagattgcttagttctagaatcattttctgacctttggccatagtattctaaattttgtagctcctgaccttacatccttttcttcctwatgtctttcagatccaggtgaacttgagagaattagagacagctgcctggttcagtcatgatgaggtagccacagccctgaagagaaagggcccctatac

SEQ ID NO: 44639 - DNA, 201 bp, Homo sapiens
gtgtatatgtgtgtgtgtgtatatatatatattcatatatatatatattcatccatggtttctggctcataactcctatggcccttattacagtcttttgytataatgtggggcactttagacctcaggggcaggcctcaggaaacaaaatctcttttaccttctcctgtcctccttttacctgcccatggcaggactcta

SEQ ID NO: 44640 - DNA, 201 bp, Homo sapiens
  misc_feature (1)...(201): n = A,T,C or G, or insertion/deletion polymorphism (see Tables 1-2)
tctctaggtattttgtggttgatgttttatcactgtacttgttttcctttcactccactgcatgtaaattcttgcctcacagtgtaatattggcagagtancttgaagttcaattcagtaaatatttattacccttgaagttcaattcaataaatatttattgaatcgagccattcaatatgctaactacagagatacaga

SEQ ID NO: 44641 - DNA, 201 bp, Homo sapiens
ctaacctgaagatcccaggtattatcttctaagattgcttagttctagaatcattttctgacctttggccatagtattctaaattttgtagctcctgaccktacatccttttcttccttatgtctttcagatccaggtgaacttgagagaattagagacagctgcctggttcagtcatgatgaggtagccacagccctgaa

SEQ ID NO: 44642 - DNA, 201 bp, Homo sapiens
acagagtgatcccattctggcttaaagtataaccctcttggcaattcattactttaaatttcatattatgactttttttaaaactccttttttttttttttaaggacctgacaatgtccctgtattgtggaatagcttgcaggagaaaatttttttggtgctataggctgctgtcaacctatgttactaagacacggtgag

SEQ ID NO: 44643 - DNA, 201 bp, Homo sapiens
atacttgctgtccgttgtacttttttaatggtagccattaaagaaggtatgagttaatagtagccatcaaagaaggtatgaggttttcatttgcatttccctgatgattagtgatgttgagcaccttttcacatacctgttggccatttgaataccttctttggagaaatgtctattcagattctttgcccatttttaaat

SEQ ID NO: 44644 - DNA, 201 bp, Homo sapiens
agaccagcctgaccaacatggagaaaccccatctctactaaaaaaaatacaaaattagctaggcgtggtggcgtatgcctgtaatcccaactactcgagargctgaggcaggagaatcgcttgaacccgggaggtggaggttgcggtgagccgagattgcgccattgcactccagcccgggcaacaagagcgaaactccgt

SEQ ID NO: 44645 - DNA, 201 bp, Homo sapiens
tcattactgagttacttgttacccttacagaattaagaaaaatagcacagtatgacattttaaaattcatgtacaggtgcattctagttacatgaacatgstagttaaataaaagtcacaattaagtcattatgactcagagtactttataataaatcagatgccctgaggctctgttgaggaagtagaatcccaatggga

SEQ ID NO: 44646 - DNA, 201 bp, Homo sapiens
  misc_feature (1)...(201): n = A,T,C or G, or insertion/deletion polymorphism (see Tables 1-2)
cagtaagtgtgggcaaatccatgtgtacacacaaggctagagtgacgtttgatttcttcttttgcagattatagtcctttctacaaacactggcaggacantgtgctgtagggagattgcttattcttccttcttctgcccttgtttttggcagaaccactgtcaagatcattgtctcctaaagacatgcagatctatggc

SEQ ID NO: 44647 - DNA, 201 bp, Homo sapiens
aaataaaccaatagtgcaaccacagaagtatgggtgaggtacacagtaagacaaaggagggaatgaatgattatctatagccacctcaaaccctttttggygcaaattaggttgtaaataaataaagggaaataaccatggtaagagagggatgcagcgacagcattctcaaagatgaatgctatacaggtaactaagggt

SEQ ID NO: 44648 - DNA, 201 bp, Homo sapiens
gcacctttctcaaatgggctgtctgtatcacccttctagcctacagggctgtcctgaattaatctgagtgcttgtaggtgaaagtgtggaagagaccatcygccgagaagttgcagaagaggtgggattggaggtggaaagcctgcagtactatgcatcccagcattggcccttccctagtggctcactcatgattgcttg

SEQ ID NO: 44649 - DNA, 201 bp, Homo sapiens
acattattcctaacgggtacttcccagtggtcttcagaatttgggatttcacataatggtaaaatttaaaggaaaatttggggaatacaaaaggttatcamctttctattttttaaaaaaggacattaaaaagtgtcatctgctatcatcatcatttaaatgacaataaaggacattttaatgccttctaagttaggtgat

SEQ ID NO: 44650 - DNA, 201 bp, Homo sapiens
ttgtgtagagacagggttttgccatgttgtccatgctggtctgaactgagctctggcaatccacctgccttgacctcccaaagtgttgggattacaggcgyaagtcaccaaacctggccgaaaaattttaaacaaactaaatatccaataatatctaaaatatctcacacacttgaatataagttctattaagatcagact

SEQ ID NO: 44651 - DNA, 201 bp, Homo sapiens
gcagtactatgcatcccagcattggcccttccctagtggctcactcatgattgcttgccatgcaactgtgaaaccagggcagacagaagtaagttctcatsttcccttatactgtgatatttcttttgcttcatccaacctgctcatcagcaagtacttattaagcacttgtctagtccagcatcatctagattacataaa

SEQ ID NO: 44652 - DNA, 201 bp, Homo sapiens
ctgagtgcttgtaggtgaaagtgtggaagagaccatccgccgagaagttgcagaagaggtgggattggaggtggaaagcctgcagtactatgcatcccagyattggcccttccctagtggctcactcatgattgcttgccatgcaactgtgaaaccagggcagacagaagtaagttctcatcttcccttatactgtgatat

SEQ ID NO: 44653 - DNA, 201 bp, Homo sapiens
aggctggtctcgaactcctgacctcaggtgatccgcctgcctcagcctcccaaagtgctgggattacaggcatgagccaccaagcccggtcacattttgtwtatttcagtatttcataagaaatgttaaaaaacttataacatcattctaatttcttttttgaatacaggtgaataaaaatgtttccatatagctctgggt

SEQ ID NO: 44654 - DNA, 201 bp, Homo sapiens
atcatttgaacctgggaggggaggttgcagtgagccaagatcacaccattgccctctagcctgggtaaaaagagcaaaactccatctcaaaaaaaaaaaaagtaatatttgtatgttcttttttaattgaaaaatttatacaatcaatagagacacaaggaaaaataggtattattcataatttattctcaatgttaacca

SEQ ID NO: 44655 - DNA, 201 bp, Homo sapiens
tccacatccttgtggattcccctgcattgtttgttttatataacatttgatatttgttgtagcttgtatatgaacataattttctttagaggtagtcactsttctctccagtatgacccaggtttcttgactctgagtaatgcaccttctataactatctaaatttctactgaagctttttggattatgagtatgctgact

SEQ ID NO: 44656 - DNA, 201 bp, Homo sapiens
actggatttccaagactctgtttttgttctgggattctctgaagaattaaacaaattgttgcttcagctttatctggacaacagaaaagagatcagaacgmttctgagtgaattggcaccaagccttcccagttatcataaccttgaatggcgactagatgtacaggtatagcatttttaaaattaacttaacatagaata

SEQ ID NO: 44657 - DNA, 201 bp, Homo sapiens
atctagtcttcttgacatgactccactatttttgataacttttttgctttctcctataacaagatgtttcaggctcatcttgtacagtttctctcctagarttcaagtcagctattgctttggatagtcctggttccttttaatggagaatctaaagattgaaaggaccttgaagttggtcattgtttatagttttgtgtt

SEQ ID NO: 44658 - DNA, 201 bp, Homo sapiens
gagtggaatgacaaggagcaggagcctctggccaacttactgtttttcatgcagtgtttgaaaacatgtaataatgaatagtgtttatttttaaatacaaatatgaacaagataaatactacagtagtaatttatttgctcgtttttacttttctttctcaggaaaactcaatgtgagtagtgacactgtccagcatggtg

SEQ ID NO: 44659 - DNA, 201 bp, Homo sapiens
atgaacataattttctttagaggtagtcactcttctctccagtatgacccaggtttcttgactctgagtaatgcaccttctataactatctaaatttctaytgaagctttttggattatgagtatgctgacttttcacgattggctggtgcatgtttagacttaaatgtcatatccttcatgtctcaaagccaaaatagta

SEQ ID NO: 44660 - DNA, 201 bp, Homo sapiens
gtagggttcattggggaaatgactgtggataagcctttatacttaggtcctttaataataacccggtggagatgtggggatggtcatgtatgtggctcagmggtaatttatcttgtagatctttacgtctctcttgtgtgcgaatgtcccctgacttttggggtccagtaggctttaacagttctttttttggctttattg

SEQ ID NO: 44661 - DNA, 201 bp, Homo sapiens
ggtttcaccacgttggccaggctggtctcgaactcctgacctgaagtgatccacctgcctcagcctccccaagtgctgggattacaggcatgagccagcaygcccagcctatactaagacttcttgaaagagttgtctctctgtttgtatattctctcttcccgtcatctcttaaactcttcctaatcaggctttataatc

SEQ ID NO: 44662 - DNA, 201 bp, Homo sapiens; identical to SEQ ID NO: 28281

SEQ ID NO: 44663 - DNA, 201 bp, Homo sapiens
tcgtaggccggaacccaaagctccggacgctgcgacgccggagcctctaggcgccgggacacgggcgccggaagtggcgaaggcggggtcggcgctgccgsgtgaaatcgtaggacagtgaagatgctgctggaattgtccgaggagcataaggaacacctggccttcctgcctcaagtggacagcgcgggtcagcgggcg

SEQ ID NO: 44664 - DNA, 201 bp, Homo sapiens
ttactccaaaaagtgtaaactgttttacaagaaagacaatgagtttaaagagaaaggcataggtactctgcatttaaaacctacagcaaatcagaagacayagcttttggtgcgggcagacaccaatttaggcaacatattgctgaatgttctgattccacccaatatgccatgtacgcgaacagggaagaataacgttct

SEQ ID NO: 44665 - DNA, 201 bp, Homo sapiens
gatgcagacgagttgcacaaaattttactggagaaaaaggatgcctgaacacgcgaagttggctgcggaattattgccaagttgctgcttcttccaccgcyccttaaagttagtcagtttttcttctcttctttgacattctaagaacttatagataacctaaaacttttgtgagaaagattaatgtggccaataaaacct

SEQ ID NO: 44666 - DNA, 201 bp, Homo sapiens
tgtggccaataaaacctttaaatgttaagtgtcaaaaaaccgcactctcccttcttaagaactgcctaaagtgtaaaatacatttgaatgcaatttttggaaaaaaaaaaaaaaaaaactaaaatgaattttaatacacctactttttaacatttcaatattttttcaaatacattaatattcttgaaaataaccattaaa

SEQ ID NO: 44667 - DNA, 201 bp, Homo sapiens
ccctgctgaacacagcgtgaggaccccccctccatggacatggtgtttgagtctctgggcttgccgaacaccaagtcctctgagttccgcagcgcagcacyggaagcggccgagcgcgctcagcccggcgacccctgcgggctccagacccctgcgccgctgcgccctgggtttcgccgcacccaagacccagcgagtgca

SEQ ID NO: 44668 - DNA, 201 bp, Homo sapiens
cgcgaagttggctgcggaattattgccaagttgctgcttcttccaccgccccttaaagttagtcagtttttcttctcttctttgacattctaagaacttayagataacctaaaacttttgtgagaaagattaatgtggccaataaaacctttaaatgttaagtgtcaaaaaaccgcactctcccttcttaagaactgccta

SEQ ID NO: 44669 - DNA, 201 bp, Homo sapiens
tctcgcctccctgctgaacacagcgtgaggaccccccctccatggacatggtgtttgagtctctgggcttgccgaacaccaagtcctctgagttccgcagsgcagcaccggaagcggccgagcgcgctcagcccggcgacccctgcgggctccagacccctgcgccgctgcgccctgggtttcgccgcacccaagacccag

SEQ ID NO: 44670 - DNA, 201 bp, Homo sapiens
gcgagtgcagcggcggccgccgaggaggttcgaaaacacggccaaaagaaatgccgagaaggaactgacagataggaattgggatcaagaagatgaagctkaagaggtgggaacattctccatggccagtgaggaagtcttgaagaatagagccataaagaaagcaaagcgcagaaatgttggattcgaatctgacactgg

SEQ ID NO: 44671 - DNA, 201 bp, Homo sapiens
tgccgaacaccaagtcctctgagttccgcagcgcagcaccggaagcggccgagcgcgctcagcccggcgacccctgcgggctccagacccctgcgccgctkcgccctgggtttcgccgcacccaagacccagcgagtgcagcggcggccgccgaggaggttcgaaaacacggccaaaagaaatgccgagaaggaactgaca

SEQ ID NO: 44672 - DNA, 201 bp, Homo sapiens
ctccagtttatttggcaaagatactacccagagtaaaccagtctcttcaccatttcccactaaaccattggagggccaagcggaaggtgacagtggtgaaygcaaaggtggagatgaagaagagaatgatgagccgcccaaagtagtagttaccgaagtaaaagaagatgctttttactccaaaaagtgtaaactgtttta

SEQ ID NO: 44673 - DNA, 201 bp, Homo sapiens
gcttaagaggtgggaacattctccatggccagtgaggaagtcttgaagaatagagccataaagaaagcaaagcgcagaaatgttggattcgaatctgacastggaggagcctttaaaggttttaaaggtttggtggtaccttctggaggaggacgctttcctggatttggtagtggcgctggagggaagcctttggaagga

SEQ ID NO: 44674 - DNA, 201 bp, Homo sapiens
gaggaggttcgaaaacacggccaaaagaaatgccgagaaggaactgacagataggaattgggatcaagaagatgaagcttaagaggtgggaacattctccrtggccagtgaggaagtcttgaagaatagagccataaagaaagcaaagcgcagaaatgttggattcgaatctgacactggaggagcctttaaaggttttaa

SEQ ID NO: 44675 - DNA, 201 bp, Homo sapiens
tgggatcaagaagatgaagcttaagaggtgggaacattctccatggccagtgaggaagtcttgaagaatagagccataaagaaagcaaagcgcagaaatgktggattcgaatctgacactggaggagcctttaaaggttttaaaggtttggtggtaccttctggaggaggacgctttcctggatttggtagtggcgctgga

SEQ ID NO: 44676 - DNA, 201 bp, Homo sapiens
gtgaatgcaaaggtggagatgaagaagagaatgatgagccgcccaaagtagtagttaccgaagtaaaagaagatgctttttactccaaaaagtgtaaactrttttacaagaaagacaatgagtttaaagagaaaggcataggtactctgcatttaaaacctacagcaaatcagaagacacagcttttggtgcgggcagaca

SEQ ID NO: 44677 - DNA, 201 bp, Homo sapiens
acgttcttatcgtctgtgttccaaatccaccaattgacgagaagaatgccaccatgccagtcaccatgttgattcgggtaaaaaccagcgaggatgcagaygagttgcacaaaattttactggagaaaaaggatgcctgaacacgcgaagttggctgcggaattattgccaagttgctgcttcttccaccgccccttaaag

SEQ ID NO: 44678 - DNA, 201 bp, Homo sapiens
ttgaatgaaccctagacagttctaagagaaagcagcaattgcacagttatatacatggtcaattaaatttcaacattaaaaataatttagttttaggtttrgccactgtggatctgtatcagttccaaaactgtagaaagcatgggcatggaaaagtacatttgtctctaataaaagaagacaaaacctattttatctgtg

SEQ ID NO: 44679 - DNA, 201 bp, Homo sapiens
  misc_feature (1)...(201): n = A,T,C or G, or insertion/deletion polymorphism (see Tables 1-2)
tgcagggtatcccaccatgacatgggccagaatgtggtcaacctttgcctgtgtggcccatttggtgctgggcatggtggcgccttttggcctacaaacanttgatcagtgccggaggagggaatctgtgcctcaaaaacccatgctacacagcatgggtcctctttgatccagcagaagctcttgcaatggtagcccaac

SEQ ID NO: 44680 - DNA, 201 bp, Homo sapiens
tttttcttttaggctgccaaggacactaaagacaattattgcatcatttcttccagtgaagaaagtgaacttgataactagccgtgtttttaaaaagaatygtgtcagaactgtaagtagtgcatatttaagtttaaaaactcaggattgatgtaagcactggaatattttatttgcagaaatgtgtatcacagttactta

SEQ ID NO: 44681 - DNA, 201 bp, Homo sapiens
  misc_feature (1)...(201): n = A,T,C or G, or insertion/deletion polymorphism (see Tables 1-2)
gcataacagaagaaagtctgtttgtttctgaatgtatggaaagacattttggttatgcattttaaattacttaccattttcactttgaatgtattgttccnaatttaacataactggtaaatgtatttttaggattcgtgaatagttttgtgggagttatttagaacaggaaaaggtaaattggaaattttacctggaaat

SEQ ID NO: 44682 - DNA, 201 bp, Homo sapiens
aagccgctacttgagcaattactaaaggtctgttctatttggtaacataatacattataaaatacaacacgtgcataacagaagaaagtctgtttgtttcrgaatgtatggaaagacattttggttatgcattttaaattacttaccattttcactttgaatgtattgttccaaatttaacataactggtaaatgtatttt

SEQ ID NO: 44683 - DNA, 201 bp, Homo sapiens
attaaaagctgtttccttttgacatctgattaaccctgtttaaaacgtgagatgtaaagtggtggtttgtcagtgaactagactttttcttttaggctgcyaaggacactaaagacaattattgcatcatttcttccagtgaagaaagtgaacttgataactagccgtgtttttaaaaagaatcgtgtcagaactgtaagt

SEQ ID NO: 44684 - DNA, 201 bp, Homo sapiens
gctgcttaagtgaccatgcagtgtctggcactgttattttgacttcattatatttttaattttcaggtacactgagttagataaattgtaactcctggtcygtgacatttgcaacattgttccaggtatagcccattttacttatttagctaactatttaattaggtattgttaatagcgtaatggacaccagaaaatccc

SEQ ID NO: 44685 - DNA, 201 bp, Homo sapiens
tgaactagactttttcttttaggctgccaaggacactaaagacaattattgcatcatttcttccagtgaagaaagtgaacttgataactagccgtgttttyaaaaagaatcgtgtcagaactgtaagtagtgcatatttaagtttaaaaactcaggattgatgtaagcactggaatattttatttgcagaaatgtgtatca

SEQ ID NO: 44686 - DNA, 201 bp, Homo sapiens
acattaaaaagggccttgctgcaaaaagagaaatgataaaaatagataaagcagcttacaggaaaaccaagaacacaattgaacgtgctttgaaaaaaaamcaactaaaaaggtatgattgttggcttttttgcataatgatatttatatcatttctttgtatttgttggtgcaaataatttcaaaaactgtcctgtacat

SEQ ID NO: 44687 - DNA, 201 bp, Homo sapiens
ttctttaacaggggagaattttcaatcatttgtttttttccttggggtttaatttctattctgctctcctcagacaattttatcttaaagttatattattwgatatttgaaaatcttttattgataacttattttacttacctaaaacaaaactgcatcaaattgtaaatatttacttttcaaaaattcttgcaaccacaa

SEQ ID NO: 44688 - DNA, 201 bp, Homo sapiens
tttttatttgtgcatttgctcatgtcacaggattatggaagagattgtgcttacattttttacatcttccttagcattaacatacaccattttcaggagtrggaactgttgaactatttgttgagggaatagtatatatttcaaacatagttacatttttctctaacttgatgaggtcatatcaccaaccattttatccct

SEQ ID NO: 44689 - DNA, 201 bp, Homo sapiens
tatcatgctaacgaagtcaaataaaatggtgtcaggagttacagtccgccccaaatatttttactctcttattgtatatacattgacactgtattgatttmgataaatcctttaagatgtacttaaataaagagaatgggaagcggccaagggaaaatagcaaaggtacctgaaagctacagaagtcaaataggaaggaga

SEQ ID NO: 44690 - DNA, 201 bp, Homo sapiens
gcagctgggagacctaattatccccatttggcacagcaagagaggcaggcatcaccctgttaccttcagcttctcctgtcttaacaaactgtatgacatcwctcagagaagcggagataagattcttttttaatattcacttcttggaagcccataatccatttccagcatataaaggtgcagcagtttaactgtttgtac

SEQ ID NO: 44691 - DNA, 201 bp, Homo sapiens
atagaatcacttaattctcatatcctcctgtcaaataacgttcaacacttctactcacaacaaggatatcaaatcaattacatgaattgatcgtccctttycaggaccatacgtttcatgaataatagagatgtatcttaaatcaaaagatcgttttctattccccagactcacaaggtaaaaccattatacataatggat

SEQ ID NO: 44692 - DNA, 201 bp, Homo sapiens
gggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctggaggg

SEQ ID NO: 44693 - DNA, 201 bp, Homo sapiens
tgggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctggagg

SEQ ID NO: 44694 - DNA, 201 bp, Homo sapiens
ctgggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctggag

SEQ ID NO: 44695 - DNA, 201 bp, Homo sapiens
  misc_feature (1)...(201): n = A,T,C or G, or insertion/deletion polymorphism (see Tables 1-2)
ctaaaagggatggttacagtcattctcaaatagggtttgtgaaacaatgaaactatgacactttcatgaaggaaagagcttcccaaagggcaccttctttnacaacctcagacttcagagctcagtgatgtcataggcacccacatggatgagacttttctttatgcttttccaatggactgataatgattttaaggcctg

SEQ ID NO: 44696 - DNA, 201 bp, Homo sapiens
gctgggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctgga

SEQ ID NO: 44697 - DNA, 201 bp, Homo sapiens
  misc_feature (1)...(201): n = A,T,C or G, or insertion/deletion polymorphism (see Tables 1-2)
tttaagttcgtcaattaaaataagttagtgaaatttttggaattaaaaataaaaacatacacttattgccctgcagttctatagtttcagtgtaaagtctngaatgagtgtctttgtgttaaaaatcaagatggcagtggggcagtgtcccttctgggggttgtaggggaggagctgttttcttgtgtttttcagactctg

SEQ ID NO: 44698 - DNA, 201 bp, Homo sapiens
  misc_feature (1)...(201): n = A,T,C or G, or insertion/deletion polymorphism (see Tables 1-2)
tgtagttctgagttgcacaaacatgctttagttgtttttctgtaggatcctgggcagggtcacctgtttcacgatagctgtgtcctcagacccagtgtagnagagaggtaaaagatgttgattggataaatgtgttacattgctagttcatacctctctgagcctctcttgaagccactgcagggaaaattcctccatctt

SEQ ID NO: 44699 - DNA, 201 bp, Homo sapiens
  misc_feature (1)...(201): n = A,T,C or G, or insertion/deletion polymorphism (see Tables 1-2)
ttctttaagtctgacactgcaaaattttttttgctttgatctcattgcacgaaaatgttattcagttagcccaacaattttgaaattattatttaaaagcntttaatatcatgaatgactatttgcatttgtaaagttggtgttcaaaatgcttttcagctacaagagacagaaaagggcttatggccttcaaaagggaag

SEQ ID NO: 44700 - DNA, 201 bp, Homo sapiens
tttaagtcacttttgcctgtcggatagggtcttttaggaaaagtcagctttggttcatgtcatcactattctattctatgcggaacatttcacataagacrtatcttcccaacaaacatggcattttgtgtagcattatgataaaattttgatgtaactttttttacaggattcataccatgaagctagaacatattgcag

SEQ ID NO: 44701 - DNA, 201 bp, Homo sapiens
  misc_feature (1)...(201): n = A,T,C or G, or insertion/deletion polymorphism (see Tables 1-2)
ggttgccaaatgttgcaaaactaagcatagtcttacaaaactaaatatagatgtgccatatgatctaacaattgcactctttggtaattacccaaatgatntgaaaatttatttccacacaaaaacttgtatgcaaatgtttaagcagctttatctatcattaccaaaatttggaagcaactaagatgtccttcaatgggc

SEQ ID NO: 44702 - DNA, 201 bp, Homo sapiens
gactatttggatttgtaaagttgatgttcaaaatgcttttaggctacaagagacagaaaggggcttatgaccttcaaaagggaagggatttatcacccacktgtctgcaggcccctatggctaaagggggaaccttaattaacttcctgagagctcgattttagggaattggatcagctctgtacaacagtggtattcaaa

SEQ ID NO: 44703 - DNA, 201 bp, Homo sapiens
gcagcccctgacattctcccagagatggctggggaggtcctgtggcacccgtggtcctccgggccacgcaggtctctggggcacacaggggcagggctgarctctgtcccagggacaccgcaaggatcctgcaggggccattcaggtgtgcgaggcagctgtgagttctgcagccagccccagggaggggctggacgggcc

SEQ ID NO: 44704 - DNA, 201 bp, Homo sapiens
gaaatttctggcatattccaaatgtaaatatttaaagacagagctgcaacatcacgcttttaaacttttccgatgtaagctaattatcataacagtttgasacctgttatagttaattaaaatccctaaaaatgctcttctttaacaggggagaattttcaatcatttgtttttttccttggggtttaatttctattctgc

SEQ ID NO: 44705 - DNA, 201 bp, Homo sapiens
caggacacctggggtcacgaggggtcacctgggcatccaggcaggcaagtggcagtgcagcccctgacattctcccagagatggctggggaggtcctgtgrcacccgtggtcctccgggccacgcaggtctctggggcacacaggggcagggctgagctctgtcccagggacaccgcaaggatcctgcaggggccattcag

SEQ ID NO: 44706 - DNA, 201 bp, Homo sapiens
ttcgtgtctgtgtgtgtgtctctgtgtgtgtgttgttatataatgctgttttagttgaaggatgtgtttatttatttggttggttttcctagaactaatgratgatttgaaaaacatgggattggttatgtcagtgcttctcaattggggagcggggcgattttgccccaccggggtccctttggcaatgtcggagacaca

SEQ ID NO: 44707 - DNA, 201 bp, Homo sapiens
actcatggccaattccatttcatcccaactcctagacatttctgcctgccccagagtagaatatcttgtatatatacagatgcacacacacacacacacacattcatgtgcttggcttatggcccaaataagatccatgcataaaaattaaaggtaaaatttttcttttaaatatgtactttgtcaaacttgtgcaataat

SEQ ID NO: 44708 - DNA, 201 bp, Homo sapiens
tgcatccctccccaggaggaggcgctgaaaacttctggggacagaggccccaaagaaccaccacccaccccagtccacagcaaatatgggtggtcccttayggaaagagggaaggcgtgtcagcaggggtcgtggcccccaaggtccttcacccgcatgcgcatgcgcacttagctgaccaatcagagaggagcgtggata

SEQ ID NO: 44709 - DNA, 201 bp, Homo sapiens
cccagtggagccactatgccttctgaagcctcagaatgtcatctggaaagtagaacatattttgatatcatgtgccaagtggtttaaatacagaaactctsgtgttcagaacatccctgaacattgtgtgatcagctctattttctcaatggtcacaccccaagcaaaccgttgtcctggatcacctagcagaaggaaaag

SEQ ID NO: 44710 - DNA, 201 bp, Homo sapiens
  misc_feature (1)...(201): n = A,T,C or G, or insertion/deletion polymorphism (see Tables 1-2)
cctgtacagtactgttctccaataatgaagcattgttttgagcaccaactctcaagtgaagatgtctcttattagcactaacagctggaattgacctggtntgggaaaaatagtatcccctgtaatgaaaatcctatttgccaattcagcaaggacagctaaaagggatggttacagtcattctcaaatagggtttgtgaa

SEQ ID NO: 44711 - DNA, 201 bp, Homo sapiens
gggattacaggcacacgccaccatgcccggctaatttttttttttttttttttttttttttttttttgtatttttagtagagacggggtttcaccatgttygccagactggtctcgaactcctgacctcaggcaatcctcccgcctcggcctcccaaagtgctgagattacagatgtgagccactgcgcccggcctctcta

SEQ ID NO: 44712 - DNA, 201 bp, Homo sapiens
ctgcaattgtgctgggaactttgtgcggagaagtgattcaaattattacggctttgttgaatacaggcttccaagtcaccatcccacggggttccatgtgktgagtgaacatccaagttcagctcatttgggcgaataaggttccctatggcatgttgaatgcccttgtgtgggtggggcctttcggaggcaattcagcat

SEQ ID NO: 44713 - DNA, 201 bp, Homo sapiens
tgcggtagcttcagttgggttgcaccaggagtgaaaatgagggatcgtcatctatgcgggtggttggttttttggtggtgatgtccgactcttttccagartcattgcattaatcgatactcgcaccagcaaagtatcaaagatgctttgaagccaggtgcagcggttcatgcctgtagtcccagctactcagaaggctga

SEQ ID NO: 44714 - DNA, 201 bp, Homo sapiens
cttctcccgctatctacccgtatgcctccccaaaaaactttgtcatctttggaagttatttgggtaccagccatttactctgaaaatgaatattttttttwaaaaaatacacatgtatcctgacttttttgtttggatttttctccaagataacctgatggtcaatggtggaagtgtatttgttttagaagaatcatacta

SEQ ID NO: 44715 - DNA, 201 bp, Homo sapiens
tagtttttagtatattcacaagggtgtacaagtatcaccatcaccactatctaattccagaacatctccatcacctcgaaaagaaagcccattagtaatcmccctccaatcttcccttctcccagcccctggcaaccactaatctttggattctgtctctatggatttaggactggttaatattaaagtctccatgaactt

SEQ ID NO: 44716 - DNA, 201 bp, Homo sapiens
agaggaatccttgctgccaggagttcgagatcagcctgagcaacacagtgagattctgtctccacacacacaaaaaattttaaattaagaagtgagccagrcttggtggtgctgtagtcccagcttctcaggaggctgaggtgggagaattgactgagcctgggaggtcaaggctgcagtgagctatgatagcaccactgc

SEQ ID NO: 44717 - DNA, 201 bp, Homo sapiens
gtccctccagcccggccgccggtcaggacaggacacctggggtcacgaggggtcacctgggcatccaggcaggcaagtggcagtgcagcccctgacattcycccagagatggctggggaggtcctgtggcacccgtggtcctccgggccacgcaggtctctggggcacacaggggcagggctgagctctgtcccagggaca

SEQ ID NO: 44718 - DNA, 201 bp, Homo sapiens
tttatttctccttcacttatgaagcttagtttggctggatatgaaattctgggttgaaaattcttttctttaaaatgttgaatattggcccccactctctyctggcttgtagggtttctgccgagagatctgctgttagtctgatgggcttccctttgtgagtaatctgacctttctctgtggctgcccttagcatttttt

SEQ ID NO: 44719 - DNA, 201 bp, Homo sapiens
ctcatggccaattccatttcatcccaactcctagacatttctgcctgccccagagtagaatatcttgtatatatacagatgcacacacacacacacacacattcatgtgcttggcttatggcccaaataagatccatgcataaaaattaaaggtaaaatttttcttttaaatatgtactttgtcaaacttgtgcaataatt

SEQ ID NO: 44720 - DNA, 201 bp, Homo sapiens
gaccctgcattactgtaccactgtgcaaactgagtacctgcatctgcatctgcgtgtgtgtgtgtgtgtgtgtgtgtgtgtgtgtgtgtgtgtgtgtgtgtagcctggcccacaagaaatactcagcagcaagtattggctggtattcttagctattatgggtaaagttgctttgaggtcagttagcggagaaggtgattg

SEQ ID NO: 44721 - DNA, 201 bp, Homo sapiens
ttttcggactcagcccgcctgcacccaggtgaaataaacagccttgttgctcacaaaaaataaataaataaataaataaataaataaataaataaataaawaaaaatatgtgctttctatttcttgcttgtatttttttgtattttgaaattgatttaggaagtatatataatccatagagacctcagcccatttttaaag

SEQ ID NO: 44722 - DNA, 201 bp, Homo sapiens
tgaccctgcattactgtaccactgtgcaaactgagtacctgcatctgcatctgcgtgtgtgtgtgtgtgtgtgtgtgtgtgtgtgtgtgtgtgtgtgtgtgtagcctggcccacaagaaatactcagcagcaagtattggctggtattcttagctattatgggtaaagttgctttgaggtcagttagcggagaaggtgatt

SEQ ID NO: 44723 - DNA, 201 bp, Homo sapiens
tgaaattccttctcctggctcatcctggctcaaaagctcccccactgagcaccttgtgacctccgcccctgcctgccagataacaaccccctttgactgtrattttcctttacctacccaaatcctataaaacggccccacccctatctcccttcactgactgtcttttcggactcagcccgcctgcacccaggtgaaata

SEQ ID NO: 44724 - DNA, 201 bp, Homo sapiens
  misc_feature (1)...(201): n = A,T,C or G, or insertion/deletion polymorphism (see Tables 1-2)
cgacttgcattcattatttgtgggagatttcagatactacagttatggttttagaggacgtttctgagtctaatatgcctcccatgctttattttagctangcacattaacacatgtctggcatgtgagagtaagtcttttattttgcagctgatcaaaggtttgctttgattaagggaattttccacctacgtgtttctt

SEQ ID NO: 44725 - DNA, 201 bp, Homo sapiens
ggattgcaggcatgagccactgtatccagctgacctatacactttgtattttattttattttattttattttattttattttattttattttattttatttattttattttattttatttattttattttattttattttatttattttattttattttattttgagacagggtcttgctctatcatccaggctggagggc

SEQ ID NO: 44726 - DNA, 201 bp, Homo sapiens
gtgagtgtctgtgtctatgcctgctctcgagctacagtggctgagttgggtagatgtgataggctgtatgtctgcacaggtgaaaatatttgctatctttstctttacagaaaacgtttgctgaacagtgccttagattatcatataatgtatgttacccaacttgctgctgttgggttagtctgtgccgacttgcattca

SEQ ID NO: 44727 - DNA, 201 bp, Homo sapiens
acattattcaactgcccttaagaaaatttgaaataaatcttcagatttctagcccttgggttttgttaagtagggaaagctcttagtctcagataaatgasctcttttctttctcaaaggaagaggattatgaactgtatatgttaaattcacttaatgaatatttaaattaagaatccaacaaagcagttataggatcat

SEQ ID NO: 44728 - DNA, 201 bp, Homo sapiens
agcgccatcaccagggcattctgagacatacatgatctttggagttagtgtcaagaattgggaagagacttacatggagggaacacttaatctgagatccygatgacgatgataatggtgatggtgatgatgatgatgatggtggtaatgatggtaatgatgggatgatgacaatggtgatggtgatgatgatgatgatga

SEQ ID NO: 44729 - DNA, 201 bp, Homo sapiens
aagatgactaataaaagtgatcgctttaaactgtatggactgcaactaaatttttataatctcgttgaaggtgaaaaatgtgttatatgctaaagttatcmccaaatagggtatctagccttgcaaggtgataaaagaaagcagaagactgtaaatggatgcggtggtcttttgtgtaaactagagtgtatattcaaagac

SEQ ID NO: 44730 - DNA, 201 bp, Homo sapiens
ttccaggcaaataatttgttgagcgcctatcagaaatagccatcagccataagaagtggagatggacatggacatgtaaacaaagacttgataaggcgtgrcgaacataataaaaatgaacagcatgaagaaaatactcaggaggtgtcatctgagaatgttagaaaaggctgcccataggacaatacagttacctaaggt

SEQ ID NO: 44731 - DNA, 201 bp, Homo sapiens
cacaagacctatttttatttatttatttattttttatttatttattgtgagacagggtctctgttgctcaggctgaagtgcagtggtgtgatcacagctcmctgtagcctcaacctcctgtgctgacatgatcttctcacatcagttttgtgagtatgtgagaccacaggcacctgccaccatgcccggccaatctttcta

SEQ ID NO: 44732 - DNA, 201 bp, Homo sapiens
acctataaaatgagaatacttctgctgaacttattgagctgcaaaattatttggttttattatgtggtgggacaagaacttaatgcccattgcgttgattygctatctctgacctgactttccagacaacttaaaaaccagaagaaatataaaaatctttcaagatctaccaggaaaactattctgagtatttaaaagagg

SEQ ID NO: 44733 - DNA, 201 bp, Homo sapiens
tcctttggcaaaatagtgatgaagacatgaatgggttctctcttgttccatcaggacagctggtaaactcccacacctttgcttctaggctttcttttggyggggcacaaaaagctcagctacaataaatcatcatctagcctcagacatttatgaacagatatgttttatgagaggagcatattcaggctctgaagaaaa

SEQ ID NO: 44734 - DNA, 201 bp, Homo sapiens
agtactttttctgcaaggttgcgatgacatttgtgcaaggttgtggtttttgcagccttttgtgatagtttttgttatcagacctacaagcatgtgaaccrtctccatggttttccctggctctgtttgccaggattttcttaacactagtcacccccacttcattctcacaactttcacagattgcagcctcgttcgtgt

SEQ ID NO: 44735 - DNA, 201 bp, Homo sapiens; identical to SEQ ID NO: 13643

SEQ ID NO: 44736 - DNA, 201 bp, Homo sapiens
ggggtttcaccatgttggccagcctggtcttgaacgcctggcctcaagtgatccgtctgcctccacctcgcaaagtgctggaattacaggcgcgagctacygcgtctggcgtcatgccaccttttttcttttttttcagatggagtttcgctcttgttgcccaggctggagtgcaatgtgcaatcacagctcactgtagcc

SEQ ID NO: 44737 - DNA, 201 bp, Homo sapiens
aaatgcaacaaaagacaatgtgccagcactctgtttacaaagagtgcagagtttcttcttccttcagagttctactggagaccatggttagccccgtgccrccttgttttttgtttgtttggagacagtcttgctctgtcgcccaggctagagtgcagtggcgtgatctcggctcactgcaacctgtgtctcctgggttca

SEQ ID NO: 44738 - DNA, 201 bp, Homo sapiens
gaaggtttgttttttgttttgagacagggtctcgctctcgttgccctggcgcaatatcggttcactgtggccttgactcttgggcttacgtgatcctcccrtctccgcttcctgagtagctaggactacaggcatgcaacaccatacccagctaatttttcgtattttttgtagagacggggcttcaccgtgttgccctag

SEQ ID NO: 44739 - DNA, 201 bp, Homo sapiens
  misc_feature (1)...(201): n = A,T,C or G, or insertion/deletion polymorphism (see Tables 1-2)
tcttgcctatagcttggttatgttgaaaacagatattttaccccgcctgtttgtgtgtttggggattgggtgggtgggagatagatgcagacggtgtggcntttggcttcaattcagtcagccatcttgatgggaagcccaatttttgtctcgaggtttgttttctggctttctctgggacttgtctattttctccactgc

SEQ ID NO: 44740 - DNA, 201 bp, Homo sapiens
  misc_feature (1)...(201): n = A,T,C or G, or insertion/deletion polymorphism (see Tables 1-2)
agccacaattttggagcctcagcatcacagacgcccctctgcgggtgcccctgtgcacctcagccccctttcctatcttgcatttatctggggaagtctcnaaagatgtcaatacattggtatttatttatgaaggtgatccgaggggagatggctccaacagactgtggcctcttgcttctcagaacaagcgagccaagg

SEQ ID NO: 44741 - DNA, 201 bp, Homo sapiens
acctgggaggcagaggttgcagtgagccgagattgtgccactgcactgcagcctggatgacacagcaagactccatctaaaaaaaaaaaatcagatagcaytgatggttctgtaactcctgaatatactaaaaaccaatgaattgtttattttaaaagggcaaaacgtatggtatatggattatatctccataaagctgtt

SEQ ID NO: 44742 - DNA, 201 bp, Homo sapiens
acaagcgagccaaggagaagagacatttttcttgctcgttgtatcactggggaagcacgggggctctgaagtggaattagccagaagcgagattcttatcycagattggacaggggcatgcatgtgtatgtgtgagtgagagagagagagaaaatcaggtcttatccagtgaggcaaaagcaccaaacagaaatagatcag

SEQ ID NO: 44743 - DNA, 201 bp, Homo sapiens
gtggtggctcgcgcctgtaatcccagcactttggggggctgaggtaggcagatcacttgaggttaggagttcaggaccagcctggccaacatggcgaaacsctgtctctactaaaaatacaaaaattagccaggcgtggtggtgggcacctgtaattccagctactcgggaggctgaggcaggagaatcacttgaacctgg

SEQ ID NO: 44744 - DNA, 201 bp, Homo sapiens
gtattttttgtagagacggggcttcaccgtgttgccctagctgttctctaacttctaagctcaagcaatccgcctaccttgcctcccaaagtgccgggatyacaggcataagccaacatgcccggccaaataatttcttttgttgttgttttttgttttgtttgttttgagacagggtctaactcagttgcccaggctgga

SEQ ID NO: 44745 - DNA, 201 bp, Homo sapiens
tgacagagcaagattctgtctcaaaaaaaaaaaaaaaaacaaagaagaaaaaagggcaggtggtaaaaaaacaaggctggatgtagtggctcacacctatratcccagcactttaggaggccacggtggacagatcacatgagctcaggagttcaagaccagcctgggctgcatcgacaaaactctgtctctacaaaaaat

SEQ ID NO: 44746 - DNA, 201 bp, Homo sapiens
tgggtgataggagtgaaaccctttttcaaacaagaaaaaaaaaggctgggcgtggtggttcacacctgtaatcccagcactttgggaggccaaggcaggcrgatcacgaggtcaggagttcgagaccagcctgtccaatatggtgaaaccctgcttctagtaaaaagtacaaaaattagcaaggcatagttgcgcgtgcct

SEQ ID NO: 44747 - DNA, 201 bp, Homo sapiens
aagctcaagcaatccgcctaccttgcctcccaaagtgccgggattacaggcataagccaacatgcccggccaaataatttcttttgttgttgttttttgtyttgtttgttttgagacagggtctaactcagttgcccaggctggagtgcaatagtgcaatcatagctgactacagcttcgagttctaggactcaaaagatc

SEQ ID NO: 44748 - DNA, 201 bp, Homo sapiens
gatccacctgcctcggcctcccaaagtgctggcattacaggcgtgagccaccgcacccagccaacccaggagtttgacagcagtttgggtaacatagaccycatctctacaaaaattaaaaaaaaaaaaataggcaggtatggtggcatgcaccagtaatgccagctattctcatgaggctgaggtgggaggatcaactga

SEQ ID NO: 44749 - DNA, 201 bp, Homo sapiens
gctcacacctgtgatcccagcactttgggagtccgaggcaggaggatcatttgaggtcaggagttcgagaccagcctggacaacatggtgaaaccctgttyctactaaaaatgcaaaattagtcgggtgtggtgctgcgtgcctgtaatcccagctactcgggaggctgaggcaggagaatcgcttgaacctcggaggtgg

SEQ ID NO: 44750 - DNA, 201 bp, Homo sapiens
  misc_feature (1)...(201): n = A,T,C or G, or insertion/deletion polymorphism (see Tables 1-2)
tcagaggagagacaacgtgatgaactataacactgtaaatgtcccttgtttcctggggccatttggatggttgccacgacaccacctgatgctactgggcnttggctttagcctgatcaacacttcctcctttggctcaggtaccagcgtcccgtgacacaaaggctgcattggaggtagccataggacacagtcgaactg

SEQ ID NO: 44751 - DNA, 201 bp, Homo sapiens
  misc_feature (1)...(201): n = A,T,C or G, or insertion/deletion polymorphism (see Tables 1-2)
gcaaatacctattttgttaatggggactgattcaaggatttgagtgaacaaaacgttgacttaatttcaacaatactttttcaggtggcaggagcccgggnaggagattatattgtctccattcagcttgtggattgtaagtggctgacgctgagtgaggttatgaagctgctgaagagctttggcgaggacgagatcgag

SEQ ID NO: 44752 - DNA, 201 bp, Homo sapiens
ccaaaataactttggcagataaacacaccctagtatgttcctccaatagaattctatcccacaataaaaaaggaacacacaaattagccgggtgtggtggygggtgcctgcaattctagctactcaggaggctgaggcaggagaatcgcttgagcccgggaggtggagtttgcagtgagccgagttcacgccactgtgctc

SEQ ID NO: 44753 - DNA, 201 bp, Homo sapiens
  misc_feature (1)...(201): n = A,T,C or G, or insertion/deletion polymorphism (see Tables 1-2)
gatccctggaagtacagtcttcctgcctgtgggctttgtctaggtgctgctcttaaatacgtgtcttacaggtgaacaatctgactgtacattaagggcangtaagtgacctgtaaagagagttttcactctaggccagtgcggtggctcgcacctgtagtcccagcactttgggagggcgaggtgggcagatcacttaag

SEQ ID NO: 44754 - DNA, 201 bp, Homo sapiens
catgaattagggagaagctgtctgcacaccccctggttcatgagtaaactttaaaacaagtcctagggccaggtgcggtggctcacgcctgtaatcctagyattttgggaggccgaggtgggtggatcacctgaggtcaggagttcaagaccatcctgaccaacacggcgaaaccctgtctctactaaaaatacaaaaatt

SEQ ID NO: 44755 - DNA, 201 bp, Homo sapiens
gcacgtcagggtggtatggccgtagacccaattggtattttcaaaggttagtatagtttaaatacttgggaggccgggtacagtggctcacacctgtaatrccaacactttgggaggccgaggcaggcagatcacttgagcccaggagtttgagaccagcctggacaatgtggcaaaaccccatatctacaaacaatacaa

SEQ ID NO: 44756 - DNA, 201 bp, Homo sapiens
aggcaggagactcgcttgaacccaggaggcggaggttgcagtgagctgagattgtgccactgcactccagcctgggcaacagagtgagactccgtaccccygcaacccaaaaaaaaaaaaaaatcccagcactttgggaggctgagtctagtggatcacgaggtcaggagatcgagaccttcctggctaacacagtgaaac

SEQ ID NO: 44757 - DNA, 201 bp, Homo sapiens
tccagcctgggtgacaaaacaagaccctctcccaaaaataatagaatagaatagagtagaatagaatagaatagaatagaatagaatagaatagaatagaaagaatagaatagaataaaattctgaacgatgaggttcagggagcttctgggttggtgaacacattgaggtgtctggagtgagcatggaagccctgcccct

SEQ ID NO: 44758 - DNA, 201 bp, Homo sapiens
  misc_feature (1)...(201): n = A,T,C or G, or insertion/deletion polymorphism (see Tables 1-2)
ggcttgccctgctcatagcgggttttcctgctgccccttcagagcctggtcgtgcaggtcagatcacatcagtcccctgctctcactccagtgggctcccntctcacgcagaacaggagcgagagccctcatctcacacgcgtgaggtccgccatgatctggcctggctctttcttccctgcactcattctctcccaccct

SEQ ID NO: 44759 - DNA, 201 bp, Homo sapiens
ctatgacttctgtgagacttttgttgcaggggcatgtgtctgtgtgtgtgcatgcatgtactgagttgtaaaataaaatgtatttcttttttctttttttygtgatggagtcttgctctgtcacccaggctggtgtgcagtggtgcgctctcagctcactgcaacctccacctcccgggttcaagcgattctcatacctca

SEQ ID NO: 44760 - DNA, 201 bp, Homo sapiens
ggaggctgaggcagatggattgcttgagcccaggagtttgagaccagcctgggcaatgtggtgaaaccccatctctactaaaaatacaaaaattagctgcrcatggtggcacatgcctgtaatcccagctacttgggaggctgaggcacgagaatcacttgagcctgggaggtggaggttgcagtgagccgagatcgcaag

SEQ ID NO: 44761 - DNA, 201 bp, Homo sapiens
tgaatggaatggttttctcaattttaagattgttcattgctagtatatagaaatagaattggccaggcacagtggctcatgcctgtaatctcagcactttsggaggctgaggcaggaagattgcttgagcccaggatttctgggccagcctgggcaacatagtgagactccatctctacaaagaaacacaaaaattagcca

SEQ ID NO: 44762 - DNA, 201 bp, Homo sapiens
aatacaaaaattagctgcgcatggtggcacatgcctgtaatcccagctacttgggaggctgaggcacgagaatcacttgagcctgggaggtggaggttgcrgtgagccgagatcgcaagattgcactctagcctgggcaacaggagtgaaactctgttttttgttttttgtttttgtttttttaaaaaaaaactatggccg

SEQ ID NO: 44763 - DNA, 201 bp, Homo sapiens
tttcactatatgttggccaggctggtctcgaactcctgacctcagctgatccacctgcctcggcctcccagagtgctgggattacagacgtaagccaccaygcccggctggaatcattcatttcttttcaagtgggtatcttatggtattttagggcatggctgggagcagttttgttttctcttctcaagactgagtgtt

SEQ ID NO: 44764 - DNA, 201 bp, Homo sapiens
actggggattgggtctgctcacctagaagccaggatacctggctgagggcacttctctccctcttctctttgaacagagtggccacaaactcaaaggtgcrggagcaagtgcggctggagctgagcttcgtcaactcagacctgcagatgctcaaggaagagctggaggggctgaacatctcggtgggcgtctatcagaac

SEQ ID NO: 44765 - DNA, 201 bp, Homo sapiens
gggaggccactatgcacacacagagattctgtgcactgtacttacgttggactgcagtctgtttcctagctggagggacaaactgaaacagaaaaatccarattaaagtaacacaccagtctccttttaaggttgtatttccttttttttttttgacacagagtctccctctcttacccaggttggagtgcagtggagcga

SEQ ID NO: 44766 - DNA, 201 bp, Homo sapiens
gagtgcagtggcgtgatcttggctcactgctacctccacctcctggttgaagtgattctcctgcctcagcctcctgagtagctgggattacaggcacacaycaccatgcccaggtagtttttgtatttttagtagagacggggttttaccatgttggccaggctggtcttgaactcctgacctcaggtgatctacccattt

SEQ ID NO: 44767 - DNA, 201 bp, Homo sapiens
catctgtaatcccagcactttgggagggcgaggtggggggatcacctgaggtcagaagtttgagaccagcctgaccaacatggtgaaactctgtctctacyaaaaatacaacaattagccagacattgtggtgagcgcctgtaatcccagctccttgagaggctgaggaaggagaattgcgtgaacccgggaggcagaggt

SEQ ID NO: 44768 - DNA, 201 bp, Homo sapiens
  misc_feature (1)...(201): n = A,T,C or G, or insertion/deletion polymorphism (see Tables 1-2)
aaaatctccaagaagctttccttcctgagttggggcaccaacaagaacagacagaagtcagccagcaccttgtgcctcccatcggtcggggctgcacggcntcaggtcaagaagaagctgccctcccctttcagccttctcaactcagacagttcttggtactaatgtgaggaaacaaacatgttcaggccctgaacattt

SEQ ID NO: 44769 - DNA, 201 bp, Homo sapiens
gtgcctggctattgagcacctgttaagtggcaggcacagttgaggtgcctgaagatcaggcgaggctctgcttttgtgatttctcttgttggaggatgggrggagacttttatagacaagtaaacaaatcagatcacctagggaagtgatgttttctagggaataatgaactctgaatatcatagaggttggcccaggatg

SEQ ID NO: 44770 - DNA, 201 bp, Homo sapiens
tagggtttatattaggaacaatgtcctcaactattgcagcgatatattgtatgcctaattttagtgccagaacatagtagaccatcaataaacatgtggcraactaaacaatctcaatgttaggcaaaccttagaagccggtgatagcccatgtggaagtcttcagaaagcaagcttccttagatttccagtttgaatcct

SEQ ID NO: 44771 - DNA, 201 bp, Homo sapiens
caatgtcctcaactattgcagcgatatattgtatgcctaattttagtgccagaacatagtagaccatcaataaacatgtggcgaactaaacaatctcaatrttaggcaaaccttagaagccggtgatagcccatgtggaagtcttcagaaagcaagcttccttagatttccagtttgaatcctacatgattcttggaaagt

SEQ ID NO: 44772 - DNA, 201 bp, Homo sapiens
actaaacaatctcaatgttaggcaaaccttagaagccggtgatagcccatgtggaagtcttcagaaagcaagcttccttagatttccagtttgaatcctayatgattcttggaaagttaatagtagagagtgtttaatggtacaaagtttcagctgaggaagatgaaaaagttttagagatggatggtggcagtggagcat

SEQ ID NO: 44773 - DNA, 201 bp, Homo sapiens
attcttggaaagttaatagtagagagtgtttaatggtacaaagtttcagctgaggaagatgaaaaagttttagagatggatggtggcagtggagcataatsatgtgaatgtaattaatgccaccgaactctacacttgaaaatgataaaaatggcactccagcctgggcgacagagcgagactccatcttaaaaaaaaaaa

SEQ ID NO: 44774 - DNA, 201 bp, Homo sapiens
tagtgaaaacattatccaagtgtggtggtgcatgcctgtggtcccagctgctcaagagtcagaagagggaggttcagttgagcccaggagtttgaggctgyggtaagccatgattgcaccactgtactccagcgtgcgaaacaaagtgagaccctgtctctaaatataaaatataaaatgaaaaaaataatattttaataa

SEQ ID NO: 44775 - DNA, 201 bp, Homo sapiens
ctaagccagatcttaaaggccaggctggatccaggctgactgtggccttggagaggggagggtctgcccagctgcatggtatccaccatcagccccgaggrtctgcctgaccaacagtcttcaactgtgggatcctggctgggaggtatcccctggcagaaacagaattttcagggtgactcagaggagagacaacgtgat

SEQ ID NO: 44776 - DNA, 201 bp, Homo sapiens
  misc_feature (1)...(201): n = A,T,C or G, or insertion/deletion polymorphism (see Tables 1-2)
gagggcctttcccaagaggccaagtcaaagagggtctgtagtggacatgctttgaaatttaaaacttatatcctcttttattaatagtgtatttttttctnaaatcatataaccagtttaggttatgtctttagaagaatagctaaagttttttctctaacattttattatgaaaatttccaaacttttcaaaaaatttta

SEQ ID NO: 44777 - DNA, 201 bp, Homo sapiens
agctgagattgcgccattgcactccagcctgggcgacagaacaagagtctctaaaaaaaataataataaaataaaaaaggaaccattgaggcattgaaacyggaagataaatcagtgtcaagatgccaggggcctgatgtgttaggaggggtggtccagcagtcttagggagcggggtcagttttagagcagagggtgggg

SEQ ID NO: 44778 - DNA, 201 bp, Homo sapiens
cccttgagtcaattcccaggtggagagggagggaggcagaggagagtaaaggttggtgatgctgaccccactcctgattccccatgatggtctaaaacagytttttttttttttaaagatgacagaatctggctgtgtcacccaggctggagtgcagtggcaccgttgtagctcactgtagccttgacctcctgggctcaa

SEQ ID NO: 44779 - DNA, 201 bp, Homo sapiens
aatttttttttttttttttgtatttttattagagatggggtttcaccatgttagccaggatggtctcaatctcatgaccttgtgatctgcccgcctcggcytcccaaagtgctgggattacaggcgtgagccactgcgcccggcctggtctcgaactctttgggcccaagcctcagccttccacagtgctcggattacagg

SEQ ID NO: 44780 - DNA, 201 bp, Homo sapiens
gaagcattgagactgagctgggctcagaggctcacgcccgtcatcccagcacattgggaggccaaggtgggcggatcgcttgaggtcagaagaccagcctrgccaacgtggtcaacatggcgaaaccccattgctactaaaaaaatatacaaaaattagctgggtgtggtgtcgtgtgcctgtaatcccagttactcgggg

SEQ ID NO: 44781 - DNA, 201 bp, Homo sapiens
caccatctcggctcactgcaagctccacctcccgggtccacgccattctcctacctcagcctcctgagtagctgggactacaggcgaccgccaccatgtcsggctaatttttttttttttttttgtatttttattagagatggggtttcaccatgttagccaggatggtctcaatctcatgaccttgtgatctgcccgcct

SEQ ID NO: 44782 - DNA, 201 bp, Homo sapiens
ttgtcaagtgatgcattcaaaggatgtctcatagctcagttcccttcttctgggaactgtcttttgttattttattttatttatttgtttattttgagatagagtcttgctcttgtcacccaggctggagtgcagtggcacaatctctgctcactacgacgtctgcctactgggttcaagtaattcttctgcctcagcctc

SEQ ID NO: 44783 - DNA, 201 bp, Homo sapiens
  misc_feature (1)...(201): n = A,T,C or G, or insertion/deletion polymorphism (see Tables 1-2)
aggcgcgtgccaccacgcccagctaatttttgtatttttagtagagttggggtttcaccatgttgtccaggatggtctcaacctcttgactgcgtaatccncctgcctcggcctcccaaagtgctgggattacaggcatgagccactgcgcctggtgactattgggattttatgcacacttaaggatcaaatgaatttcca

SEQ ID NO: 44784 - DNA, 201 bp, Homo sapiens
tgtcaagtgatgcattcaaaggatgtctcatagctcagttcccttcttctgggaactgtcttttgttattttattttatttatttgtttattttgagatagagtcttgctcttgtcacccaggctggagtgcagtggcacaatctctgctcactacgacgtctgcctactgggttcaagtaattcttctgcctcagcctcc

SEQ ID NO: 44785 - DNA, 201 bp, Homo sapiens
tagtagagacggggttttaccatgttggccaggctggtcttgaactcctgacctcaggtgatctacccatttcagcctcctaaagtgatgggattatgggygtgagccactgcacctggcctgcactactgtgttttcaaagtagactgtttctttcttagcatggttgatctttacagtcttctaggaggtaggtgggaa

SEQ ID NO: 44786 - DNA, 201 bp, Homo sapiens
ggggtgaagattgccaacagctgctgcattgattgggtggctgagccagccgggggcagtgagtgagaacccatgaggcttcccatcttgtattattattwtttttttttgagacagagtcttgctctgtcccccaggctggagtgcagtggcacaatctcagctccccgcaaccttcacctcctgggttcaagcgattct

SEQ ID NO: 44787 - DNA, 201 bp, Homo sapiens
aattaaattagtgtcactaaaaactgtcccaaagtgctgcttcctaataggaattcattaacctaaaacaagatgttactattatatcgatagactatgaytgctatttctagaaaaagtctagtgccaaatttgtcttattaaataaaaacaatgtaggagcagcttttcttctagtttgatgtcatttaagaattacta

SEQ ID NO: 44788 - DNA, 201 bp, Homo sapiens
tcttttgttattttattttatttatttgtttattttgagatagagtcttgctcttgtcacccaggctggagtgcagtggcacaatctctgctcactacgamgtctgcctactgggttcaagtaattcttctgcctcagcctcccaagtagctgggattacaggcgcctgccaccatgcctggctaatttttgtatttttag

SEQ ID NO: 44789 - DNA, 201 bp, Homo sapiens
tgaactcctgacctcaggtgatctacccatttcagcctcctaaagtgatgggattatgggtgtgagccactgcacctggcctgcactactgtgttttcaargtagactgtttctttcttagcatggttgatctttacagtcttctaggaggtaggtgggaaagaaataacctcatggtgcagatgggaaaactcagggagg

SEQ ID NO: 44790 - DNA, 201 bp, Homo sapiens
gatttagttctttaggagtcgttaggaaatgcatggttggagaattggggacaaaactcagtgtgacagggtacagggggagaagggcagggaagatattrctggagaaagaggggagctgagaagagagaaggcagctttgttttagaatgtggaagtccagagctggttaaagacaaaggtgtggcagggcacagtggc

SEQ ID NO: 44791 - DNA, 201 bp, Homo sapiens
tgttctcaaatcctgtttttctcatagtgtaaactcacatttgatgtgtttttatgaaggaaagtaaccaagaaacctctaggaattagtgaaaaaagaayttttttgaggtgtgttactatactgctgtaagttatttattatataaagtattgtaaatagaatagtgttgaagatatgaaatatggctatttttaatgg

SEQ ID NO: 44792 - DNA, 201 bp, Homo sapiens
  misc_feature (1)...(201): n = A,T,C or G, or insertion/deletion polymorphism (see Tables 1-2)
ctgggactcaggacactcgctcctcctcttctcattgcctggacagctgcaaacctggcttcctgccctgagtagcctggaggagccttcagcaggatccngctttccatgcccccggatgggactcacctggctgtagcacagctgcactgcagagccaggttcagcttacagctgcattgtcccctcgccctgcccagc

SEQ ID NO: 44793 - DNA, 201 bp, Homo sapiens
gtcgagcaaggcgtgacaagtcagaagaatgctggaaggtcctagatttagttctttaggagtcgttaggaaatgcatggttggagaattggggacaaaastcagtgtgacagggtacagggggagaagggcagggaagatattactggagaaagaggggagctgagaagagagaaggcagctttgttttagaatgtggaa

SEQ ID NO: 44794 - DNA, 201 bp, Homo sapiens
cccagcgctgtgggtgagcctggcttggctcacctgtgcctgcgggttctgccttgctcccccatagcagggctgtgtctgggtcagactccacgtggggwtggatgcaagagcagggcacagtgtagaccacagtgtgttccccacgctagctctatagcgtgttgccttctgggctgatcatcgacattctgctttggg

SEQ ID NO: 44795 - DNA, 201 bp, Homo sapiens
ttgcaaaacacagcctgagcttcattcacttccttctggccctgcccctaggaatgtaggctcagggagcactccccaggcgacctgtggttacggagtgktcagctgggggagaggaggtggagggtgtctgaccctgggctgggaggcaggtgcatttcggtgtcagatggggcttctgccctgacggcatctcctgtg

SEQ ID NO: 44796 - DNA, 201 bp, Homo sapiens
gatggaggctgcagtgagccgagatcacgccactgcattccaacctggacagcagaatgagaccctgtctcaaaaaaaacgtcacaatgcctgcctgaggygtctggtcatgcgcctcctcaagatccatgaatgcgggtgaacgcggaggctagtgtgtagacttgatggccctcatgggatatccatgtggcggtccca

SEQ ID NO: 44797 - DNA, 201 bp, Homo sapiens
agttccagctactccagtggctaagacgggaagatcacttaagcccaggagtttgaggctgcagtgagctatgattgcaccactgtactctagcctgggtracagagtaagactccatccctaaaaagaattttttttttttaaattaatgaaataggctgggcatggtggctcatgcctgtaatcccagcactttaggag

SEQ ID NO: 44798 - DNA, 201 bp, Homo sapiens
tggggggatcacctgaggtcagaagtttgagaccagcctgaccaacatggtgaaactctgtctctaccaaaaatacaacaattagccagacattgtggtgrgcgcctgtaatcccagctccttgagaggctgaggaaggagaattgcgtgaacccgggaggcagaggttgcagtgagccgagattgtgccactgcactcca

SEQ ID NO: 44799 - DNA, 201 bp, Homo sapiens
aagatcacttaagcccaggagtttgaggctgcagtgagctatgattgcaccactgtactctagcctgggtgacagagtaagactccatccctaaaaagaattttttttttttaaattaatgaaataggctgggcatggtggctcatgcctgtaatcccagcactttaggaggctgaggtgggtggattgctggagcccagg

SEQ ID NO: 44800 - DNA, 201 bp, Homo sapiens
aaaagaaaaaaaatggagatagagaaaatatgtatcccttgcaatggccttaggctcaacaggcagagtcagttgatatctacagagtgaccctgaggccyttctcagccagctacatgcataatttatatgtttattcctgccatatttttgttgttgcctttgatggcttctgaagctcctcctgggtcttggacaagg

SEQ ID NO: 44801 - DNA, 201 bp, Homo sapiens
attaatgaaataggctgggcatggtggctcatgcctgtaatcccagcactttaggaggctgaggtgggtggattgctggagcccaggaatttgagatcagyctgggcaacaaggcgaaactccatctctacaaaaagtacaaaagttagctgggcctggtggtgcatgcctgtagtctcagctacttgggaggctgagaca

SEQ ID NO: 44802 - DNA, 201 bp, Homo sapiens
tgaggaaggagaattgcgtgaacccgggaggcagaggttgcagtgagccgagattgtgccactgcactccagcctgggctacaaagagagactccgtattwaaaaaaactacataaattaagaaaataaattcccccactttgaaaatcactataagtttttctttattctgcctttttaaaaatgggttcacaattgaca

SEQ ID NO: 44803 - DNA, 201 bp, Homo sapiens
cttttcaaaaaattttaagaattttatagcaaactcctgtgtactcaattcttccaagaacatactgccagcattgcttcctgacatatttgtccatctgygcattcttgtgtctgttaggttggtttgaaggtaattgcagtttttccattgaaagtaatggctaaaggccgggcacagtggctcacgcctgtaatccca

SEQ ID NO: 44804 - DNA, 201 bp, Homo sapiens
gtctgggcaacaaggcgaaactccatctctacaaaaagtacaaaagttagctgggcctggtggtgcatgcctgtagtctcagctacttgggaggctgagayagaaggatcagccgaggttgtggtaagccaagatcgcgccattgcactccagcttgggcgacagagcaagaccctgtcccaaaaaataattaattaatta

SEQ ID NO: 44805 - DNA, 201 bp, Homo sapiens
tttgaaggtaattgcagtttttccattgaaagtaatggctaaaggccgggcacagtggctcacgcctgtaatcccagcactttgggaggctgaagcaggcrgatcacttgagctcaggagttgaagaccagcctggctaaaatggtaaaacccctgtctctactaaatgtacagaaattagctggacgtggtggtgcacac

SEQ ID NO: 44806 - DNA, 201 bp, Homo sapiens
ggctgaagcaggcagatcacttgagctcaggagttgaagaccagcctggctaaaatggtaaaacccctgtctctactaaatgtacagaaattagctggacrtggtggtgcacacctgtaatcccagttacttgggaggctgaggcaggtgagtcgttcgaacctggaaggtggaggtggaggttgcagggagccgagatca

SEQ ID NO: 44807 - DNA, 201 bp, Homo sapiens
ttattttactttctatcttatatatttttatattttatttcattttatcttattttagcttttagagacagtgtcttgctctgtcacccaggctggattgyggtggtgtgatcatagctcactgcagtatcaacctcctggactcaagcaatcctcctgcctgggactataggcatgcaccaccatgcccagctataatca

SEQ ID NO: 44808 - DNA, 201 bp, Homo sapiens
tggtggtgcacacctgtaatcccagttacttgggaggctgaggcaggtgagtcgttcgaacctggaaggtggaggtggaggttgcagggagccgagatcaygccactgccctccagcctgggcgacagagtgagatcccatttcaaaaaaaaaaaaaaaaattagctgggcatagtggcatatgcctgtaatcctagttac

SEQ ID NO: 44809 - DNA, 201 bp, Homo sapiens
agaaatagttacaggcacctgctggtatgtgcagggcaccttctgggaagggccatcagctgtgtcctcctctgctcatgccctcttgggttcttttcctygcaggcttgtcggacgcctagccgggatgaggccggggtggaactgctgatgacatacttcatccagctgggctttgtcgagagtcgattcttcccgccc

SEQ ID NO: 44810 - DNA, 201 bp, Homo sapiens
aattcattaacctaaaacaagatgttactattatatcgatagactatgaatgctatttctagaaaaagtctagtgccaaatttgtcttattaaataaaaakaatgtaggagcagcttttcttctagtttgatgtcatttaagaattactaacacagtggcagtgttagatgaagatgctgtctacaaggtagataatatac

SEQ ID NO: 44811 - DNA, 201 bp, Homo sapiens
tccagcctgggcgacagagcgagactccatcttaaaaaaaaaaaaaaaaaggaaaaagaaaaaaaagaaaaaaagaaaatcaggtgtagaatagtgtagtwtattccttttaagaaaatgaatggtaatatacttaggtacatatagaaatacttgtacatcatctctagaagtataacatggagggccttagaagcccag

SEQ ID NO: 44812 - DNA, 201 bp, Homo sapiens
caggatcgctgagcctgggagatggaggctgcagtgagccgagatcacgccactgcattccaacctggacagcagaatgagaccctgtctcaaaaaaaacrtcacaatgcctgcctgaggtgtctggtcatgcgcctcctcaagatccatgaatgcgggtgaacgcggaggctagtgtgtagacttgatggccctcatggg

SEQ ID NO: 44813 - DNA, 201 bp, Homo sapiens
taaaaaaaaaaaaaaaaaggaaaaagaaaaaaaagaaaaaaagaaaatcaggtgtagaatagtgtagtatattccttttaagaaaatgaatggtaatatayttaggtacatatagaaatacttgtacatcatctctagaagtataacatggagggccttagaagcccaggtgacagggagacctattgctcactgcatact

SEQ ID NO: 44814 - DNA, 201 bp, Homo sapiens
aaaaggaaaaagaaaaaaaagaaaaaaagaaaatcaggtgtagaatagtgtagtatattccttttaagaaaatgaatggtaatatacttaggtacatataraaatacttgtacatcatctctagaagtataacatggagggccttagaagcccaggtgacagggagacctattgctcactgcatactcttttttttttttt

SEQ ID NO: 44815 - DNA, 201 bp, Homo sapiens
taaaaaacaaaaacaaaaaacaaacaaaaaattatccttgttggacctggtggtgcacacctagagccccagctactcaggaggccaaggcaggaagatcrcttgagcccaggagtttaagaccagcctgggcaacatagcaagaccctgtctcaaaaaagaaaaaaagtttgtccttgttttaagaacctaattctatat

SEQ ID NO: 44816 - DNA, 201 bp, Homo sapiens
caccacacctggttaatttttgtattttagtagagatggggtttcaccatgttggccaggctggtcttgaactcctgacctcaagtgatccgccttcctcrgcctcccaaactgttgggattacaggtgtgagccaccgcgcctggccaaacttcgtagtttttatcatctatcttgatgatgcctgacgccctttttctt

SEQ ID NO: 44817 - DNA, 201 bp, Homo sapiens
  misc_feature (1)...(201): n = A,T,C or G, or insertion/deletion polymorphism (see Tables 1-2)
tgcacggcctcaggtcaagaagaagctgccctcccctttcagccttctcaactcagacagttcttggtactaatgtgaggaaacaaacatgttcaggcccngaacatttccggtgctgactcggccttaaacgtttgtgccataatggaaaatatctatctatctgttctcaaatcctgtttttctcatagtgtaaactca

SEQ ID NO: 44818 - DNA, 201 bp, Homo sapiens
agaggcccctatgaacccagagttgcaaatgtgagggtattggagagcttccacagctgtggggcccgctgaggggggcagaggaggtgggggtgaggagstgacaaaggaggcagcagggtggtgcacccaggtgggagcagcaagtgcaccaggcacagaccctggcacacaatagactctcagcacagctgccgaaag

SEQ ID NO: 44819 - DNA, 201 bp, Homo sapiens
gtgaaactgcagaaaaaaggaagctggagacgtggtagagaaatctctacgtgggtctgtggccaggtccatgagaggggatttaacctgtggttctcttwgcagtgaagccaggcacggatctggaccaccaggagaagtgcctgtcccagctctacgaccacatgccagaggggctgacacccttggccacactgaaga

SEQ ID NO: 44820 - DNA, 201 bp, Homo sapiens
aatcagcctggcatagtgttgtgttcctgtaatcccatatactcaggaggcctaggtgggaggatatccggagcccacgaggttgaggctgcagtgagctsttatcatgtcactgcactccagcctggatgacagagtgagaccttgtctcacaaaaaacaaacaaacaaacaaagaaacggccgtgtaaacacagcctca

SEQ ID NO: 44821 - DNA, 201 bp, Homo sapiens
gggcagaaaggagacccatgatcccaaatgccttgtgaaactgcagaaaaaaggaagctggagacgtggtagagaaatctctacgtgggtctgtggccagrtccatgagaggggatttaacctgtggttctctttgcagtgaagccaggcacggatctggaccaccaggagaagtgcctgtcccagctctacgaccacatg

SEQ ID NO: 44822 - DNA, 201 bp, Homo sapiens
gaattcaagcccactctgggcaataagcaagaccccatctctataagaagtttaaaaatcagcctggcatagtgttgtgttcctgtaatcccatatactcmggaggcctaggtgggaggatatccggagcccacgaggttgaggctgcagtgagctgttatcatgtcactgcactccagcctggatgacagagtgagacct

SEQ ID NO: 44823 - DNA, 201 bp, Homo sapiens
ccgaggttgtggtaagccaagatcgcgccattgcactccagcttgggcgacagagcaagaccctgtcccaaaaaataattaattaattaaaaaaataaaarattggtctatcgggatgaagcgatatgctaagattccaagtatgagttgatttcttttgctgtaaatcttttttctggactcatctttctgaggaatctt

SEQ ID NO: 44824 - DNA, 201 bp, Homo sapiens
cagttcagggtcatgcatcttgcttgacctgggaactgtggaatccatcaaagtatttaaagcaggaccagacctgtgagatttgtgtaagaaaaagaccrctttgacacgtgaatggtgaatgggtggcgaatgggaaagaagctatggtggagccaggcagggaggcattgggaggatttagccccttgtaatacctat

SEQ ID NO: 44825 - DNA, 201 bp, Homo sapiens
cttgggagactgaggcaggagactcgcttgaacccaggaggcggaggttgcagtgagctgagattgtgccactgcactccagcctgggcaacagagtgagmctccgtacccctgcaacccaaaaaaaaaaaaaaatcccagcactttgggaggctgagtctagtggatcacgaggtcaggagatcgagaccttcctggcta

SEQ ID NO: 44826 - DNA, 201 bp, Homo sapiens
  misc_feature (1)...(201): n = A,T,C or G, or insertion/deletion polymorphism (see Tables 1-2)
ttcaggccctgaacatttccggtgctgactcggccttaaacgtttgtgccataatggaaaatatctatctatctgttctcaaatcctgtttttctcatagngtaaactcacatttgatgtgtttttatgaaggaaagtaaccaagaaacctctaggaattagtgaaaaaagaacttttttgaggtgtgttactatactgct

SEQ ID NO: 44827 - DNA, 201 bp, Homo sapiens
gagtgcagtagtgagatctcagctcactgcaacctctgcctcctgggctcaagcaatcctcctgcctcagcctccagaggagctgagactatagtcgcacrccatcacacccggctaatttttgtattttttgtagagacagggtttcaccacgttgcccacgctggtcttgaattcctgatacaagtgatctgctcactt

SEQ ID NO: 44828 - DNA, 201 bp, Homo sapiens
cagattctggagcagcccctggcaggggctgttgcatgggaagaagaaagggctctttctctgcaaatgggttcatgagggcccttgtgccgggctgcccyttcccagtgtcccttctatttcaggtgggagaggtctaccaacagctacacgcagccatgagccaggcgccggtgaaagagaacatcccctactcctggg

SEQ ID NO: 44829 - DNA, 201 bp, Homo sapiens
ccctcttcaactccatcagtttgagtttttaaccagtcacctccaaattccatcaaggaggggaaaggggatgaggtgcagggtggcccaagtttgcgccrtgcagcccaggcattggttataggaattaatcctagtatcatgaaaattgctttgaagaaatattttacgttctttttttttttctttttctttattatt

SEQ ID NO: 44830 - DNA, 201 bp, Homo sapiens
gcatttttctttctttctttcttttttattgagatggaatttagctctcgttgcccaggctagagtgcaatggcgtgatctcggctcaccgcaaccttcayctcccaggttcaagcgattctcctgcctcagccttacgagtagctgggattacaggcatgtgccaccatgcctggctaattatgtatttttagcagagac

SEQ ID NO: 44831 - DNA, 201 bp, Homo sapiens
tgcctcagccttacgagtagctgggattacaggcatgtgccaccatgcctggctaattatgtatttttagcagagacggggtttctccatgttggtcaggwgggtctcgaactcctgaccacaggtgatccacctgtcttggccttccaaagtgctgggattacaggcgtgagccaccatgcctggctaatttttgtattt

SEQ ID NO: 44832 - DNA, 201 bp, Homo sapiens
ccttacgagtagctgggattacaggcatgtgccaccatgcctggctaattatgtatttttagcagagacggggtttctccatgttggtcaggtgggtctcraactcctgaccacaggtgatccacctgtcttggccttccaaagtgctgggattacaggcgtgagccaccatgcctggctaatttttgtatttttcgtaaa

SEQ ID NO: 44833 - DNA, 201 bp, Homo sapiens
caagttacgacatgagccctgccatgctcagcgtgctcgtcaaaatgatgcttgcacaagcccaagaaagcgtgtttgagaaaatcagccttcctgggatscggaatgaattcttcatgctggtgaaggtggctcaggaggctgctaaggtaggactccctggttcctgtgactttggggagtgggcaggagatgctggca

SEQ ID NO: 44834 - DNA, 201 bp, Homo sapiens
ctgggttcaagcagtcctcctgccttggcctcccaaagtgctgggattataggcatgagccactgtgcctggcttattttactttccatgataatcctctwaattggctcatcttggactacttttagtttagaaaagaaaacatcttatgacattttgactattactatttttttctttctttctttctttctttttttt

SEQ ID NO: 44835 - DNA, 201 bp, Homo sapiens
  misc_feature (1)...(201): n = A,T,C or G, or insertion/deletion polymorphism (see Tables 1-2)
gagttgctcccagattctggagcagcccctggcaggggctgttgcatgggaagaagaaagggctctttctctgcaaatgggttcatgagggcccttgtgcngggctgccccttcccagtgtcccttctatttcaggtgggagaggtctaccaacagctacacgcagccatgagccaggcgccggtgaaagagaacatcccc

SEQ ID NO: 44836 - DNA, 201 bp, Homo sapiens
ccatgataatcctcttaattggctcatcttggactacttttagtttagaaaagaaaacatcttatgacattttgactattactatttttttctttctttctttctttctttttttttttttgagctggagtttcgctcttgttgcccaggctggagggcaatgacggcatctcggctcactgcaacctccgcctcccaggt

SEQ ID NO: 44837 - DNA, 201 bp, Homo sapiens
accaggagaagtgcctgtcccagctctacgaccacatgccagaggggctgacacccttggccacactgaagaatgatcagcagcgccgacagctgggtgcrtgtccccctgcacccagatgtgggccccacttggtgcccagctggtcctgctcacagccagccacagagaggtccctgaagagggcccgggagagggggg

SEQ ID NO: 44838 - DNA, 201 bp, Homo sapiens
tttctcatctgtaaaatgggtatatggagagaacctgcctcacaggctgtcatgaaaacgaaaacgaagggcctgtacgcaaagctcaataatgctttatatactgtaggttctctgaaagtgtgagccgccactcctagtactatatagtctattaggtgagacaagatgtgaaaacaaatagaaataccatatagtgcc

SEQ ID NO: 44839 - DNA, 201 bp, Homo sapiens
ccattctcctgcctcagcttgccgagtagctgggactacaggtgcccaccaccacacacagctaatttttttgtatttttagtagagataggttttcaccrtgttagccaggatggtctatatctcctgacctggtggtctgcccacctcggcctcccaaagtgctgggattataggcgtgagccatggcgcccggcccga

SEQ ID NO: 44840 - DNA, 201 bp, Homo sapiens
ttctcatctgtaaaatgggtatatggagagaacctgcctcacaggctgtcatgaaaacgaaaacgaagggcctgtacgcaaagctcaataatgctttatatactgtaggttctctgaaagtgtgagccgccactcctagtactatatagtctattaggtgagacaagatgtgaaaacaaatagaaataccatatagtgcct

SEQ ID NO: 44841 - DNA, 201 bp, Homo sapiens
tctcatctgtaaaatgggtatatggagagaacctgcctcacaggctgtcatgaaaacgaaaacgaagggcctgtacgcaaagctcaataatgctttatatactgtaggttctctgaaagtgtgagccgccactcctagtactatatagtctattaggtgagacaagatgtgaaaacaaatagaaataccatatagtgcctc

SEQ ID NO: 44842 - DNA, 201 bp, Homo sapiens
catgataatcctcttaattggctcatcttggactacttttagtttagaaaagaaaacatcttatgacattttgactattactatttttttctttctttctttctttctttttttttttttgagctggagtttcgctcttgttgcccaggctggagggcaatgacggcatctcggctcactgcaacctccgcctcccaggtt

SEQ ID NO: 44843 - DNA, 201 bp, Homo sapiens
tgataatcctcttaattggctcatcttggactacttttagtttagaaaagaaaacatcttatgacattttgactattactatttttttctttctttctttctttctttttttttttttgagctggagtttcgctcttgttgcccaggctggagggcaatgacggcatctcggctcactgcaacctccgcctcccaggttca

SEQ ID NO: 44844 - DNA, 201 bp, Homo sapiens
aggagttcaaggcggcagtgaactatgattgtgccattgcactccagcctggtaacagagtgagaccgtctcaaagaaaagaaaaccttgagggttagackgcctggggtgtgtccgggggcagaaaggagacccatgatcccaaatgccttgtgaaactgcagaaaaaaggaagctggagacgtggtagagaaatctcta

SEQ ID NO: 44845 - DNA, 201 bp, Homo sapiens
aatcctcttaattggctcatcttggactacttttagtttagaaaagaaaacatcttatgacattttgactattactatttttttctttctttctttctttctttttttttttttgagctggagtttcgctcttgttgcccaggctggagggcaatgacggcatctcggctcactgcaacctccgcctcccaggttcaagtg

SEQ ID NO: 44846 - DNA, 201 bp, Homo sapiens
caccaggagaagtgcctgtcccagctctacgaccacatgccagaggggctgacacccttggccacactgaagaatgatcagcagcgccgacagctgggtgygtgtccccctgcacccagatgtgggccccacttggtgcccagctggtcctgctcacagccagccacagagaggtccctgaagagggcccgggagaggggg

SEQ ID NO: 44847 - DNA, 201 bp, Homo sapiens
tagtagagacagggtttcaccatgttggccaggctgatctcgaactcctgacctcaggtgatccgcccacctcggccttccaaagtgctgggattacaggygtcaaccaccatggccagtcatctctctctctcttttttttttttttttttttttaagagatggggtctcctcactatgatgcccaggctggtcttgaac

SEQ ID NO: 44848 - DNA, 201 bp, Homo sapiens
ctgatctcgaactcctgacctcaggtgatccgcccacctcggccttccaaagtgctgggattacaggtgtcaaccaccatggccagtcatctctctctctyttttttttttttttttttttttaagagatggggtctcctcactatgatgcccaggctggtcttgaactctcctggccccaagtgatcttcctgcttccac

SEQ ID NO: 44849 - DNA, 201 bp, Homo sapiens
  misc_feature (1)...(201): n = A,T,C or G, or insertion/deletion polymorphism (see Tables 1-2)
atatcgatagactatgaatgctatttctagaaaaagtctagtgccaaatttgtcttattaaataaaaacaatgtaggagcagcttttcttctagtttgatntcatttaagaattactaacacagtggcagtgttagatgaagatgctgtctacaaggtagataatatactgtttgatactcaaaacatttttcattttgtt

SEQ ID NO: 44850 - DNA, 201 bp, Homo sapiens
tcccagctctacgaccacatgccagaggggctgacacccttggccacactgaagaatgatcagcagcgccgacagctgggtgcgtgtccccctgcacccasatgtgggccccacttggtgcccagctggtcctgctcacagccagccacagagaggtccctgaagagggcccgggagaggggggtgttccgagtcatcgtg

SEQ ID NO: 44851 - DNA, 201 bp, Homo sapiens
  misc_feature (1)...(201): n = A,T,C or G, or insertion/deletion polymorphism (see Tables 1-2)
tgggtgcgtgtccccctgcacccagatgtgggccccacttggtgcccagctggtcctgctcacagccagccacagagaggtccctgaagagggcccggganaggggggtgttccgagtcatcgtggccactttgggttcagaagtcatgaggcgcggtcctgagcctcagagggcttcccaggctgtgttctcatgggttc

SEQ ID NO: 44852 - DNA, 201 bp, Homo sapiens
  misc_feature (1)...(201): n = A,T,C or G, or insertion/deletion polymorphism (see Tables 1-2)
cccaggctgtgttctcatgggttccatagcacccaggcctcccactgtggagccaggactttaaccatctcccttggggtccacagggtggcatgtgtcangctaacagggaaggagacgtttgttgatttccttatgcatggctgaattaccaagaacacctaatgactggtaatgcagtgtcctggtttggtctctgcc

SEQ ID NO: 44853 - DNA, 201 bp, Homo sapiens
tgtatctatttatttagagagggagtctcactctgttgcccaggctggagtgcagtggcgcaatcttggctcactgcaacctctgcctcccaggttcaagygattctcctgcttcagcctcctgagtacctaggattacaggcacctgccaccacacccagctaatttttatatttttagtagagacagggtttcaccatg

SEQ ID NO: 44854 - DNA, 201 bp, Homo sapiens
gacttgccactggtctgtgggactcaaaacaatccacatgtctagaaatgtctgttgctgctgttgtagaagtttctttacgatttaatttgtctgttgcwtggtgctgtgctacaagaatgtaagcatttttttttttgagatggagtttcactcttgttgcgcaggctggagtccaatggcacgatctcagctcactgc

SEQ ID NO: 44855 - DNA, 201 bp, Homo sapiens
cctggtcccctgtgagccccttagtccttctgcctgccgtctgcttgcatctccatacctgtcgtgatggaattttgtcccaggtgacacaggagttgtgrggagcaggctggtttctttactcaatagagatgtgttttggaaggtaatccaatttttaaaaattgggttaaaaggctgggtggggtggctcacgcctgt

SEQ ID NO: 44856 - DNA, 201 bp, Homo sapiens
tccagcctgggtgacagagcaagactccatctcaaaaaaactaataataataaaataaaaattaatgcaaaaaaaatctgtgatgatcggaattttatttwattttattattttatttattttattttattgttagagatggggctggagtgcagtggtatgatcatggctcactgccttcttgaactcctgggctcaagc

SEQ ID NO: 44857 - DNA, 201 bp, Homo sapiens
atgtgtctgtgtgtgtgcatgcatgtactgagttgtaaaataaaatgtatttcttttttcttttttttgtgatggagtcttgctctgtcacccaggctggygtgcagtggtgcgctctcagctcactgcaacctccacctcccgggttcaagcgattctcatacctcagcctcctgagtagctgggactacaggcgtgtgc

SEQ ID NO: 44858 - DNA, 201 bp, Homo sapiens
cttgttgtccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatac

SEQ ID NO: 44859 - DNA, 201 bp, Homo sapiens
ttgttgtccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacc

SEQ ID NO: 44860 - DNA, 201 bp, Homo sapiens
tgggaattgtccactcccatagcagagagcaactcatgtcatctgtgtgacgtgagagaggcccccgattttgggactccctgtcatgtgctgggaaggcygtggtatgttttgtggcctagggttctggttgacccttggacaggcctgctctgtggccaagggggcaggtgggcagccttgatggtgtatggctttcct

SEQ ID NO: 44861 - DNA, 201 bp, Homo sapiens
ggacaacaattgatttacctattcatggattcattgagcaccttttttttttttttgagatggagtttcactcttgttgcccaggctggaatgcaatggckcaatcttggctcactgcaacctctgcctcccatgttcaagtggttctcctgcctcagcctcccaaatagctgggactacaggcacgtgccagcacacctg

SEQ ID NO: 44862 - DNA, 201 bp, Homo sapiens
aagcagtgtccctatcccaagacaagtttggacatgggaattgtccactcccatagcagagagcaactcatgtcatctgtgtgacgtgagagaggcccccrattttgggactccctgtcatgtgctgggaaggccgtggtatgttttgtggcctagggttctggttgacccttggacaggcctgctctgtggccaaggggg

SEQ ID NO: 44863 - DNA, 201 bp, Homo sapiens
atttctattgccagtgtccaccttgctaatgagagggctcagtacacccccgtgatctagggcactcattagtatgctctcgtggtaaaacagttacttayccagcatagaactcagagaagccttacctgtgtctagacctctataaaccctctccaggcaacgaaatgcaacaaaagacaatgtgccagcactctgttt

SEQ ID NO: 44864 - DNA, 201 bp, Homo sapiens
ctgtctcaaaaaaacagaatcaaaaataaaaacaaaacaaaaaaaccacctgatctagacattttatttctatatttatagccaagagaaacaaaagcacrtatccatataaaaccttgtacgcacataaacagccttattcgtaatagtcaaaaagtgaaaacactccccatgcccattgtatgatgaatgatgaatgga

SEQ ID NO: 44865 - DNA, 201 bp, Homo sapiens
tttccttatgcatggctgaattaccaagaacacctaatgactggtaatgcagtgtcctggtttggtctctgccatgtctcagtgtgaatatctcttcccaygtgcagacctcacctccaccaccctaacctgcccctctgcgcaccacccatgcacacatacgcagcttctccgtctcagtgatggcaactcccacccctc

SEQ ID NO: 44866 - DNA, 201 bp, Homo sapiens
ttaacaaacattcactcacttaaaccccacacaacactatgaggtgcgtctcgtggcatccccattttacagctgaggaaactgagacccagagaggtcaygtggcttgccctgctcatagcgggttttcctgctgccccttcagagcctggtcgtgcaggtcagatcacatcagtcccctgctctcactccagtgggctc

SEQ ID NO: 44867 - DNA, 201 bp, Homo sapiens
  misc_feature (1)...(201): n = A,T,C or G, or insertion/deletion polymorphism (see Tables 1-2)
actcattctctcccaccctccctgcctccaggcacaccctagctcctccttgcccttgaaaacctgcacgtgcccctgccccagggccctcgcacctgctnctctttcacatcaatcagggctctgctcaaaaaggaccatatcacaaagctttccttggccgggtgtggtggctcacacctgcaatcccagcactttggg

SEQ ID NO: 44868 - DNA, 201 bp, Homo sapiens
ggagaattgcttgaacctgggaggtggaggttgcagtgagccgagatcgtgccactgcattccagcctgggtgacagagcaagactccatctcaagaaagaaaaaaaaaagcctttctctgtcacccatcataggacaaccccattcccagtcttctcttaccatctccgcttaccctgctttatttttccctataacctc

SEQ ID NO: 44869 - DNA, 201 bp, Homo sapiens
ggagtgcagtggcgcaatcttggctcactgcaacctctgcctcccaggttcaagtgattctcctgcttcagcctcctgagtacctaggattacaggcaccygccaccacacccagctaatttttatatttttagtagagacagggtttcaccatgttgtccaggctgttctcgaactcctgacctcaagtgatccaccctc

SEQ ID NO: 44870 - DNA, 201 bp, Homo sapiens
atgaaagaaaatgaaataacatctgttcttcagtaaagtttaacagttttctgcttaattatattaattttatccctagaaatgtacttttgttgctattrtgaaaggtattatttctctgttaggttttgtttgtttgtttgtttgtttttgaaacagagtctcactatgttgcccaggctggagtacagtggtacaatc

SEQ ID NO: 44871 - DNA, 201 bp, Homo sapiens
  misc_feature (1)...(201): n = A,T,C or G, or insertion/deletion polymorphism (see Tables 1-2)
agcacatttggtaaatatttgttgagtgaacatcttatggacacaagtgaggttattacatacgcattgaagggaggcttgggctgggcgcggtgactcangcctgtcatcccagcagtctgggaggctaaggcaggcagattgcttgaggccaggagtttgagaccagcctgggcaacatagcaatgataatgaaatgat

SEQ ID NO: 44872 - DNA, 201 bp, Homo sapiens
cagtaaagtttaacagttttctgcttaattatattaattttatccctagaaatgtacttttgttgctattgtgaaaggtattatttctctgttaggttttktttgtttgtttgtttgtttttgaaacagagtctcactatgttgcccaggctggagtacagtggtacaatcttggctcactgcaacctctgccccccaggt

SEQ ID NO: 44873 - DNA, 201 bp, Homo sapiens
gttgtccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccg

SEQ ID NO: 44874 - DNA, 201 bp, Homo sapiens
  misc_feature (1)...(201): n = A,T,C or G, or insertion/deletion polymorphism (see Tables 1-2)
gtgtttcagatacagatcactgattccatctgcagcttaacctaaaaaccagcataatgacagcagcctgatccccctgttaactgtgacaatgacagaangaggggtctcttggagttgctcccagattctggagcagcccctggcaggggctgttgcatgggaagaagaaagggctctttctctgcaaatgggttcatg

SEQ ID NO: 44875 - DNA, 201 bp, Homo sapiens
cttggtggatctgcaagtcacgtgggtgctggcttccgtctgcagggaagtcccacttgcgcagagccatggctcatcacgaggagtcggtgcgggaggcsagcctctgcaagaagctgcggagcattgaggtgctacagaaggtgctgtgtgccgcacaggaacgctcccggctcacgtacgcccagcaccaggaggagg

SEQ ID NO: 44876 - DNA, 201 bp, Homo sapiens
tgtccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgca

SEQ ID NO: 44877 - DNA, 201 bp, Homo sapiens
acttgcgcagagccatggctcatcacgaggagtcggtgcgggaggcgagcctctgcaagaagctgcggagcattgaggtgctacagaaggtgctgtgtgcsgcacaggaacgctcccggctcacgtacgcccagcaccaggaggaggatgacctgctgaacctgatcgacgcccccagtgttgttggtgagtagcctagac

SEQ ID NO: 44878 - DNA, 201 bp, Homo sapiens
gtccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcag

SEQ ID NO: 44879 - DNA, 201 bp, Homo sapiens
ttaggattttttttttttttgaggcgaagtctcgctctgtcatccaagctggagtgcaatggctcaatctcagctcactgcaacctctgcctcctgggctyaagctattctcctgcctcagcctcctgagtagctgggattacaggcacctgccagcatgcctggttaatttttgtatttttagtagagacagggtttcac

SEQ ID NO: 44880 - DNA, 201 bp, Homo sapiens
tccgggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcagg

SEQ ID NO: 44881 - DNA, 201 bp, Homo sapiens
tcccggctcacgtacgcccagcaccaggaggaggatgacctgctgaacctgatcgacgcccccagtgttgttggtgagtagcctagactgtgttccctctytgggggtgcctgtgccgcggaaagagtacgcctggcctgtgggggttgagcgagccctcgctgtgtgcttggcacaaggagggctgcacagggcagggac

SEQ ID NO: 44882 - DNA, 201 bp, Homo sapiens
ctcctgggctcaagctattctcctgcctcagcctcctgagtagctgggattacaggcacctgccagcatgcctggttaatttttgtatttttagtagagayagggtttcaccacgctggccaggctggtcttgaactcttggcctcaagtgatccacctgccttggcctcccaaagtgctgagattacaggtgtgagccac

SEQ ID NO: 44883 - DNA, 201 bp, Homo sapiens
gggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcgg

SEQ ID NO: 44884 - DNA, 201 bp, Homo sapiens
tcctgggctcaagctattctcctgcctcagcctcctgagtagctgggattacaggcacctgccagcatgcctggttaatttttgtatttttagtagagacrgggtttcaccacgctggccaggctggtcttgaactcttggcctcaagtgatccacctgccttggcctcccaaagtgctgagattacaggtgtgagccacc

SEQ ID NO: 44885 - DNA, 201 bp, Homo sapiens
gagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggca

SEQ ID NO: 44886 - DNA, 201 bp, Homo sapiens
tttttagatttcagaaagaattatgaggggttagtaattgccatatttcatttaggagaagccataccgccttggcctcccaaagtgctgggattactggyatgagccaccgctcccagcccattttttttttttataattgaagaacttacctgacacatcattatcacccagagtccatagtttccattagggttcatt

SEQ ID NO: 44887 - DNA, 201 bp, Homo sapiens
ctgcctcagcctcctgagtagctgggattacaggcacctgccagcatgcctggttaatttttgtatttttagtagagacagggtttcaccacgctggccargctggtcttgaactcttggcctcaagtgatccacctgccttggcctcccaaagtgctgagattacaggtgtgagccaccgtgcctggccagttagataat

SEQ ID NO: 44888 - DNA, 201 bp, Homo sapiens
agacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggcag

SEQ ID NO: 44889 - DNA, 201 bp, Homo sapiens
agaacttacctgacacatcattatcacccagagtccatagtttccattagggttcattcttgcacttgtgtattctgtggcttttggccaacatagaatgrcagtgatccacctttgcagtgtcatacagaagagtttcactactggaaaaatcctttgtgctccccctccctccctccccctaagtcctggcaacccctg

SEQ ID NO: 44890 - DNA, 201 bp, Homo sapiens
gacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggcagg

SEQ ID NO: 44891 - DNA, 201 bp, Homo sapiens
cttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggcagggc

SEQ ID NO: 44892 - DNA, 201 bp, Homo sapiens
ttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggcagggcc

SEQ ID NO: 44893 - DNA, 201 bp, Homo sapiens
tcccgtctcacgcagaacaggagcgagagccctcatctcacacgcgtgaggtccgccatgatctggcctggctctttcttccctgcactcattctctcccrccctccctgcctccaggcacaccctagctcctccttgcccttgaaaacctgcacgtgcccctgccccagggccctcgcacctgctgctctttcacatcaa

SEQ ID NO: 44894 - DNA, 201 bp, Homo sapiens
cactccagtgggctcccgtctcacgcagaacaggagcgagagccctcatctcacacgcgtgaggtccgccatgatctggcctggctctttcttccctgcastcattctctcccaccctccctgcctccaggcacaccctagctcctccttgcccttgaaaacctgcacgtgcccctgccccagggccctcgcacctgctgc

SEQ ID NO: 44895 - DNA, 201 bp, Homo sapiens
gctgccccttcagagcctggtcgtgcaggtcagatcacatcagtcccctgctctcactccagtgggctcccgtctcacgcagaacaggagcgagagccctyatctcacacgcgtgaggtccgccatgatctggcctggctctttcttccctgcactcattctctcccaccctccctgcctccaggcacaccctagctcctc

SEQ ID NO: 44896 - DNA, 201 bp, Homo sapiens
  misc_feature (1)...(201): n = A,T,C or G, or insertion/deletion polymorphism (see Tables 1-2)
acttcgtagtttttatcatctatcttgatgatgcctgacgccctttttcttacttttctatgtgcagcataataagagtgccacatactccgtgggaatgnagaaaacgtactccatgatctgcttagccattgatgatgacgacaaaactgataaaaccaagaaaatctccaagaagctttccttcctgagttggggcac

SEQ ID NO: 44897 - DNA, 201 bp, Homo sapiens
caatgtctcaaaaaaaaagagaaaaagataattaatacaatgcctaaaagataattttattgaaaatatattgggtatgtttgagaagatggctttccagsttctcgcatgactgctgtagcatgtatgcccccagatgtgtcatttgtccctgaacaaggccaagtgagatcttcaaggacagcaggcaaaattcccttt

SEQ ID NO: 44898 - DNA, 201 bp, Homo sapiens
tctgcaaggagcagggatctactctttgatgaatgagcagcattcatcttagtgagggctaatttcgtgttagacacttgtgtgcatcttttatgaacgcwtgtgtggatgaggaagccttctgatgggctgagtccaccaggaacagcgtgggtcatgtgggatcagcagctccagctctattggtactgatactacccc

SEQ ID NO: 44899 - DNA, 201 bp, Homo sapiens
ccccagtgttgttggtgagtagcctagactgtgttccctctgtgggggtgcctgtgccgcggaaagagtacgcctggcctgtgggggttgagcgagccctygctgtgtgcttggcacaaggagggctgcacagggcagggaccgaggtgctgcttttgccctggagttctcttttctttttgagatggagtctcgctctgt

SEQ ID NO: 44900 - DNA, 201 bp, Homo sapiens
gcctccgggttcattgtgtcctggtttatggtccctgttgactctgggcttcctggaggctccggcagagaaggaaggagaatttttgtttgttgttgttktttttttttttttaacccagaagctccttgcagtcttctctctgcaaggagcagggatctactctttgatgaatgagcagcattcatcttagtgagggct

SEQ ID NO: 44901 - DNA, 201 bp, Homo sapiens
  misc_feature (1)...(201): n = A,T,C or G, or insertion/deletion polymorphism (see Tables 1-2)
ccgcggaaagagtacgcctggcctgtgggggttgagcgagccctcgctgtgtgcttggcacaaggagggctgcacagggcagggaccgaggtgctgctttngccctggagttctcttttctttttgagatggagtctcgctctgttgcccaggctggagtgcagtggcgtgatctcggctcactgcaacctctgcttcccg

SEQ ID NO: 44902 - DNA, 201 bp, Homo sapiens
gggcagggaccgaggtgctgcttttgccctggagttctcttttctttttgagatggagtctcgctctgttgcccaggctggagtgcagtggcgtgatctcrgctcactgcaacctctgcttcccgggttcaagtgattcttctgcctcagcctcccgaggagctgggattacaagcacccaccaccacacccagctaattt

SEQ ID NO: 44903 - DNA, 201 bp, Homo sapiens
cctcctgagtagctgggattacaggcacctgccagcatgcctggttaatttttgtatttttagtagagacagggtttcaccacgctggccaggctggtctygaactcttggcctcaagtgatccacctgccttggcctcccaaagtgctgagattacaggtgtgagccaccgtgcctggccagttagataatttttttatc

SEQ ID NO: 44904 - DNA, 201 bp, Homo sapiens
attctgtggcttttggccaacatagaatgacagtgatccacctttgcagtgtcatacagaagagtttcactactggaaaaatcctttgtgctccccctccstccctccccctaagtcctggcaacccctgatctttcttctgtctccagggttttggcttttcagaatgttggaatcacacagcgtgctatacagtaggta

SEQ ID NO: 44905 - DNA, 201 bp, Homo sapiens
ttaaagaaaagaggcatagtcagctgggtgcagtggctcatgcctgtaatcccaacactttgggaagctgaggtgggaggatcacctgaggccaggagtcsgagaccagcctaggcaacataggaagactttgtctttatgaaaaataacaatattagctgagtgtggtggtgcacacctatagtcccctctcctggagag

SEQ ID NO: 44906 - DNA, 201 bp, Homo sapiens
ctctgttccatcttcttctgctacttgtctaaaccgaggggaaggatgtgtgactaagagaaagttctgtactgtctccttcccaaggatcactttttttyccccccggagtctgactctgtcacccaggctggagtgcagtggcatgacttcaactcactgcagcctctgcctcctgggttcaagtgattctcctgcctc

SEQ ID NO: 44907 - DNA, 201 bp, Homo sapiens
gcttttggccaacatagaatgacagtgatccacctttgcagtgtcatacagaagagtttcactactggaaaaatcctttgtgctccccctccctccctccscctaagtcctggcaacccctgatctttcttctgtctccagggttttggcttttcagaatgttggaatcacacagcgtgctatacagtaggtagcaatgtt

SEQ ID NO: 44908 - DNA, 201 bp, Homo sapiens
cagtggctcatgcctgtaatcccaacactttgggaagctgaggtgggaggatcacctgaggccaggagtccgagaccagcctaggcaacataggaagactytgtctttatgaaaaataacaatattagctgagtgtggtggtgcacacctatagtcccctctcctggagaggctgaagtgggaggatgacttgagcccggg

SEQ ID NO: 44909 - DNA, 201 bp, Homo sapiens
aaagaaggcttgtcctctaggaattataattgaattataattatttatcttccctcattttaaagtagatttgaagtaccttaacatattcatacaacatktaagattaaatcaggagtgaatgaagatatgaaggcaagagaaagaagaataaaggagagatttagctggaggtaaggctagtgcatgccacaaagtcct

SEQ ID NO: 44910 - DNA, 201 bp, Homo sapiens
agaaatatatttcttagttccggaggctgggaagtccaagaccaaggtatgggcagattcggtatctgctgaaggcccatgttctggtttataggtggggycttctacctgtgtcctcatggcagaaaaggtgatgagcttccttgggcctgttttaaaagcatgtatcccattcttgagggttccaccccaagactgaat

SEQ ID NO: 44911 - DNA, 201 bp, Homo sapiens
gctgagtaatattccattgtctggatgtcccatggtgtgtttatccagttaccccgtcagatatttttgtgtgtggctgtggcggtcagtgtgattagtcstgtcatcttgcttggaaacaaaagcctcagtgcacatgcattcttgacttttactgaagaaatgagtttgttgttgttgttgtcgcccaggctggagcac

SEQ ID NO: 44912 - DNA, 201 bp, Homo sapiens
cccggcctattttaatttttattttttttgagatggagactcgctctgtcgccaggctggagtgcagtggcgtgatcactgctcactgcaatcttcgcttyccaggttcaagtgattctcctgcctcagcctcccgagtagctgagagtacaggcgtgtgcccccatgcccagataatttttgtatttttagtagagatgg

SEQ ID NO: 44913 - DNA, 201 bp, Homo sapiens
aagttgtgtatttagtacaaatccatttttgtaagacaagtgtttgtctgtttgtgtgtctgtatgttgaacacacaaaaacaggaggagctttaatgtaraagttgtgtaaagaggttactcacagtcacttgggaagacataattgagcgatctatgtgatcacctttcttgcagcttgggggagccagcacttgtagg

SEQ ID NO: 44914 - DNA, 201 bp, Homo sapiens
ggtctccaactcctgggctcaaaccatcctcctgcctaggcgtcccagagtgctgggattacaggtatgagccactgtgcctggcctgagatttttttccttttttttttttttttttaagacagggtctaactctgttttcacccaggctggagtgcagtggcacaatcatagttcactgcagcctcgaactcctgggct

SEQ ID NO: 44915 - DNA, 201 bp, Homo sapiens
gttgtgtaaagaggttactcacagtcacttgggaagacataattgagcgatctatgtgatcacctttcttgcagcttgggggagccagcacttgtaggggygggggtggggcgacagggcaaaaccccatctctattaaaaaacacaaaaatgaaattagcttgtggcacgtgcctgtggtcccagctacttgggaggctg

SEQ ID NO: 44916 - DNA, 201 bp, Homo sapiens
gctggagtgcagtggcacaatcatagttcactgcagcctcgaactcctgggctcaagaagtcctcctgcctcagcagcctgagtagatgggagcattggcrtgcaccaccatgcctggctaattcttttatgtttttagtagagaatggttcccactatattgcctaggctggtctcaaacccctggcctcgagcgatcct

SEQ ID NO: 44917 - DNA, 201 bp, Homo sapiens
gcaaaaccccatctctattaaaaaacacaaaaatgaaattagcttgtggcacgtgcctgtggtcccagctacttgggaggctgaagtaggaggattgcttsagcctggagaagttgaggctgcagtgagccgcgatcgcaccactgcactccagccgaggcaacaaagtgagaccctgcctcaaagtaaaataaaataaaa

SEQ ID NO: 44918 - DNA, 201 bp, Homo sapiens
taggaggattgcttcagcctggagaagttgaggctgcagtgagccgcgatcgcaccactgcactccagccgaggcaacaaagtgagaccctgcctcaaagwaaaataaaataaaataaaataaagtaaaataaaataaaatgcctttataacatggttaagggtcttcttggcaaaggaaacctgtatctggagactgtta

SEQ ID NO: 44919 - DNA, 201 bp, Homo sapiens
aggaggattgcttcagcctggagaagttgaggctgcagtgagccgcgatcgcaccactgcactccagccgaggcaacaaagtgagaccctgcctcaaagtaaaataaaataaaataaaataaagtaaaataaaataaaatgcctttataacatggttaagggtcttcttggcaaaggaaacctgtatctggagactgttat

SEQ ID NO: 44920 - DNA, 201 bp, Homo sapiens
tctcaaaaaaaaagagaaaaagataattaatacaatgcctaaaagataattttattgaaaatatattgggtatgtttgagaagatggctttccaggttctygcatgactgctgtagcatgtatgcccccagatgtgtcatttgtccctgaacaaggccaagtgagatcttcaaggacagcaggcaaaattccctttagctt

SEQ ID NO: 44921 - DNA, 201 bp, Homo sapiens
ggaggattgcttcagcctggagaagttgaggctgcagtgagccgcgatcgcaccactgcactccagccgaggcaacaaagtgagaccctgcctcaaagtaaaataaaataaaataaaataaagtaaaataaaataaaatgcctttataacatggttaagggtcttcttggcaaaggaaacctgtatctggagactgttatt

SEQ ID NO: 44922 - DNA, 201 bp, Homo sapiens
tctgatccagccttcaaatcctacacctaacgatgctctcttccaaagggccccttatctgtgttttcggctaacaagcggtggacgcctcctcgaagcawccgcttcactgcagaagaaggggacttggggttcaccttgagagggaacgcccccgttcaggttcacttcctggatccttactgctctgcctcggtaagc

SEQ ID NO: 44923 - DNA, 201 bp, Homo sapiens
ctgggcaggacagtgtggggcagagtgggaaaacttcttttttgtgaagttgcttttagcattaaaaaaaaaaaaagtagttttgaggtatatttaagttyaaagatgtcatcatggaattacaggattataacttctaattatgtgtggcgtttgggacagaggatcacaggccatggaattgcaggaggaggcctggcc

SEQ ID NO: 44924 - DNA, 201 bp, Homo sapiens
attgatgatgacgacaaaactgataaaaccaagaaaatctccaagaagctttccttcctgagttggggcaccaacaagaacagacagaagtcagccagcamcttgtgcctcccatcggtcggggctgcacggcctcaggtcaagaagaagctgccctcccctttcagccttctcaactcagacagttcttggtactaatgt

SEQ ID NO: 44925 - DNA, 201 bp, Homo sapiens
ccctctgtgggggtgcctgtgccgcggaaagagtacgcctggcctgtgggggttgagcgagccctcgctgtgtgcttggcacaaggagggctgcacagggragggaccgaggtgctgcttttgccctggagttctcttttctttttgagatggagtctcgctctgttgcccaggctggagtgcagtggcgtgatctcggct

SEQ ID NO: 44926 - DNA, 201 bp, Homo sapiens
gtagtcccagctactcgggaggctgaggcaggagaatggcggagcttgcagtgagccgagattgcgccactgcctgggtgacagagcgagactccgtctcaaaaaaaaaaaaaaaaaaaaagaaaggcaggtgctgtccaggtgaaaggagagaaagagcccttcaggaagagggaacagcttggacagagctgtggactt

SEQ ID NO: 44927 - DNA, 201 bp, Homo sapiens
tgggggtgcctgtgccgcggaaagagtacgcctggcctgtgggggttgagcgagccctcgctgtgtgcttggcacaaggagggctgcacagggcagggacrgaggtgctgcttttgccctggagttctcttttctttttgagatggagtctcgctctgttgcccaggctggagtgcagtggcgtgatctcggctcactgca

SEQ ID NO: 44928 - DNA, 201 bp, Homo sapiens
tagtcccagctactcgggaggctgaggcaggagaatggcggagcttgcagtgagccgagattgcgccactgcctgggtgacagagcgagactccgtctcaaaaaaaaaaaaaaaaaaaaagaaaggcaggtgctgtccaggtgaaaggagagaaagagcccttcaggaagagggaacagcttggacagagctgtggacttg

SEQ ID NO: 44929 - DNA, 201 bp, Homo sapiens
aggttgaggctgcagtgagctgttatcatgtcactgcactccagcctggatgacagagtgagaccttgtctcacaaaaaacaaacaaacaaacaaagaaayggccgtgtaaacacagcctcaatcacccattctttccaccagcttgcacccttagctcagaccaggggtccacacagaaggcagggattctagtgatgag

SEQ ID NO: 44930 - DNA, 201 bp, Homo sapiens
gggcctccgggttcattgtgtcctggtttatggtccctgttgactctgggcttcctggaggctccggcagagaaggaaggagaatttttgtttgttgttgttttttttttttttttaacccagaagctccttgcagtcttctctctgcaaggagcagggatctactctttgatgaatgagcagcattcatcttagtgaggg

SEQ ID NO: 44931 - DNA, 201 bp, Homo sapiens
gctcaagtgatcctcctgcctcagcctcccaactagctgggactagagatgtgattaaaaattgccacacctggctgatttttatttttattttttgtagmgatggggtcttactgtgttgcctaggctggtcttcaactcctggcctcaagcaatcctcccatctcagtggtgggctattacaggtgtgaatcactgcac

SEQ ID NO: 44932 - DNA, 201 bp, Homo sapiens
ttgcctagggctggggttaaggggaaaaggaaatgaggagcgatgctaatggctacttgctttttttttaggctgatgaaaatgttctaaaatcagatagkggttgatgggcgtggtggctcgcgcctgtaatcccagcactttggggggctgaggtaggcagatcacttgaggttaggagttcaggaccagcctggccaa

SEQ ID NO: 44933 - DNA, 201 bp, Homo sapiens
ggcaggagaatcgcttgaacctcggaggtgggggttgcagtcagctgagattgtgccactgcactccggcctgctgggtgacagagcaagattctgtctcaaaaaaaaaaaaaaaaacaaagaagaaaaaagggcaggtggtaaaaaaacaaggctggatgtagtggctcacacctatgatcccagcactttaggaggcca

SEQ ID NO: 44934 - DNA, 201 bp, Homo sapiens
gggtggatcacttgaggccaggagtttgagagcagcctggccaacatggtgaaacctcgtctctactaaaacaaaacaaaacaaaacaaaacaaaaattasccaggtgtgttggcacattcctgtaatcccagctactcaggaggctgaaacaggagaatcgcttgaacccgggaggtggaggttgcagtgagccgagatc

SEQ ID NO: 44935 - DNA, 201 bp, Homo sapiens
gagtcaaactgaatcgtcgtcatttttggaagtggaaaggaaagagatgaacagttattttagttatttaatatttaattataatagcttaacattaaagttttttttttttttttttttttgagactgagtctcgctgtgtcacccaggctggagtgcagtggtgttatcttggctcactgcaacctctgcctcccgggt

SEQ ID NO: 44936 - DNA, 201 bp, Homo sapiens
gggctggcggcgggcggcgggcggcgggcggcgggtggcgggtgccggcctcgcaggttcttggcatgtccaggagctcttgggctcacactacggacttstgcccagaagataacagtcagggagctcagtccctcaaaagcgaccccagcctgtggagcaggggccctgggatacccgcaggcggcagggcctgggcta

SEQ ID NO: 44937 - DNA, 201 bp, Homo sapiens
agtcaaactgaatcgtcgtcatttttggaagtggaaaggaaagagatgaacagttattttagttatttaatatttaattataatagcttaacattaaagttttttttttttttttttttttgagactgagtctcgctgtgtcacccaggctggagtgcagtggtgttatcttggctcactgcaacctctgcctcccgggtt

SEQ ID NO: 44938 - DNA, 201 bp, Homo sapiens
ggagacttggcgggggctggcggcgggcggcgggcggcgggcggcgggtggcgggtgccggcctcgcaggttcttggcatgtccaggagctcttgggctcacactacggacttctgcccagaagataacagtcagggagctcagtccctcaaaagcgaccccagcctgtggagcaggggccctgggatacccgcaggcggc

SEQ ID NO: 44939 - DNA, 201 bp, Homo sapiens
gctgctggcccaggtgctaagcccctcactgcccggggccagcgggccggacgtcggctcctagtgcggggcccgtccagcccacgcccacctggaactcscgctagcccgcaagcaccgcgggcagccctggttcccgcccgcgcctctccctccacacttccccagaagctgagggagccggctcgggccttggccagc

SEQ ID NO: 44940 - DNA, 201 bp, Homo sapiens
ctcccagagtgctaggattacaggcgtgagccactgtgcctggccaattttggctttttttttttttttttaattgcacccaggctggaggacagtggcaygatctcggctcactgcaatgtctgcctcccgggttcaagcaattctcctgcctcagcctcccaagtagctaggactacaggtgcccaccaccacacctgg

SEQ ID NO: 44941 - DNA, 201 bp, Homo sapiens
tgctgagccctgccccacgggaaggcagctaaggccaggcgagaaattgagcacagcagctgctggcccaggtgctaagcccctcactgcccggggccagygggccggacgtcggctcctagtgcggggcccgtccagcccacgcccacctggaactcgcgctagcccgcaagcaccgcgggcagccctggttcccgcccg

SEQ ID NO: 44942 - DNA, 201 bp, Homo sapiens
gctcaggcatggcgggctacaggtgctgagccctgccccacgggaaggcagctaaggccaggcgagaaattgagcacagcagctgctggcccaggtgctawgcccctcactgcccggggccagcgggccggacgtcggctcctagtgcggggcccgtccagcccacgcccacctggaactcgcgctagcccgcaagcaccg

SEQ ID NO: 44943 - DNA, 201 bp, Homo sapiens
atcatggcttactgcagcctctatctcttgggtttaagtgatcctcccacctcagccacacgagcagctggaattataggcacccactaccacccctggcyctttctttctttctttctttctttctttctttctttctttattcattttcttttttaattttattttttttttgagacggagtctcgctctgtctcccag

SEQ ID NO: 44944 - DNA, 201 bp, Homo sapiens
gaggattgcttcagcctggagaagttgaggctgcagtgagccgcgatcgcaccactgcactccagccgaggcaacaaagtgagaccctgcctcaaagtaaaataaaataaaataaaataaagtaaaataaaataaaatgcctttataacatggttaagggtcttcttggcaaaggaaacctgtatctggagactgttattg

SEQ ID NO: 44945 - DNA, 201 bp, Homo sapiens
aacctggagttcagtggtatgatcacagctcactgcagcctcaaccttctgggctcaagctgtcctcccgcctcagcctccacaggtgtgtaccaccatastaggctaatttttttttttttttgagatggagtctcgctctgttgcctcctgggttcaagcgattctcctgcctcagcctccctagtagctgagattaca

SEQ ID NO: 44946 - DNA, 201 bp, Homo sapiens
gggcatggtggtgcacgcctgtaaccccagctactcaggaggctgaggcaggagaacagtttgaacctgggaggtggaggttgcagtgagtggagatcgcrccattgcactccagcctgggcaacagagtgagactctgtctgcaaaaaaaccctaaaattttccccaagtgctaggattcatgccatacttaatgacgtt

SEQ ID NO: 44947 - DNA, 201 bp, Homo sapiens
aaagtaaaataaaataaaatgcctttataacatggttaagggtcttcttggcaaaggaaacctgtatctggagactgttattgacagtcctaccctcaggrtctgtgctgggaaacttgtccgggtcctgagggaggcccagaattgcaagtctgagcccctgaatagctgcagtgtttgcagtatagttgaatgtatagg

SEQ ID NO: 44948 - DNA, 201 bp, Homo sapiens
catgcgccatcatacccggctaatttttgtatttttagtagagacgaggttttgccatgttggccaagctgatctcaaactcctgacctcaagtgatctgyctgcctcagcctcccaaagtgctgggattacaggcatgacccactgtgcctggccgattgttgaatttttaagttttggggactcgtttcagagggggga

SEQ ID NO: 44949 - DNA, 201 bp, Homo sapiens
ggaggtgaggcctcagtttttggcttgatcaatctcatgggtagtggttatttttctacctttaatttcttttttctgttgttgttgttttgtttgtttgttttttttgttgttgttgttgtttttgagacagggtctcactctgttgcttggctggaatgcagtggtgcaatcgtagctcactgtagccttgacttccta

SEQ ID NO: 44950 - DNA, 201 bp, Homo sapiens
ggcacgagaatcacttgagcctgggaggtggaggttgcagtgagccgagatcgcaagattgcactctagcctgggcaacaggagtgaaactctgttttttgttttttgtttttgtttttttaaaaaaaaactatggccgggcacggtggctgacatctgtaatcccagcactttgggagggcgaggtggggggatcacctg

SEQ ID NO: 44951 - DNA, 201 bp, Homo sapiens
ctgcctcagcctcctgagtagctgggactacaagcatgcgccatcatacccggctaatttttgtatttttagtagagacgaggttttgccatgttggccargctgatctcaaactcctgacctcaagtgatctgtctgcctcagcctcccaaagtgctgggattacaggcatgacccactgtgcctggccgattgttgaat

SEQ ID NO: 44952 - DNA, 201 bp, Homo sapiens
tgggaggtggaggttgcagtgagccgagatcgcaagattgcactctagcctgggcaacaggagtgaaactctgttttttgttttttgtttttgtttttttaaaaaaaaactatggccgggcacggtggctgacatctgtaatcccagcactttgggagggcgaggtggggggatcacctgaggtcagaagtttgagaccag

SEQ ID NO: 44953 - DNA, 201 bp, Homo sapiens
tggcgtgatcttagctcactgcaacctctgcctcccaggttcatgtgattctcctgcctcagcctcctgagtagctgggactacaagcatgcgccatcatrcccggctaatttttgtatttttagtagagacgaggttttgccatgttggccaagctgatctcaaactcctgacctcaagtgatctgtctgcctcagcctc

SEQ ID NO: 44954 - DNA, 201 bp, Homo sapiens
caacatggtgaaactctgtctctaccaaaaatacaacaattagccagacattgtggtgagcgcctgtaatcccagctccttgagaggctgaggaaggagarttgcgtgaacccgggaggcagaggttgcagtgagccgagattgtgccactgcactccagcctgggctacaaagagagactccgtattaaaaaaaactaca

SEQ ID NO: 44955 - DNA, 201 bp, Homo sapiens
ccattattgcacgcttgtggtcttaacagaatcgcgggtggatagaggtgatggttggggggtgctggaatcatccattccacttgctgcataagaaaacygtagaaggaggccaggcgcggtggttcatgcctgtgtaatcccagcactttggggtgtggaggtgggcggatcacctgaggtcaggagttccagaccatc

SEQ ID NO: 44956 - DNA, 201 bp, Homo sapiens
ccagagagccaatggattttgagtccatggatataaaatgctcagcataggcaaatccagagacaaaaagtagatggtgctggggctgggcaatgggagtrgggagggactgctgaagggtcataaggtagaaggtttctttttagggggatggaaatgttctgaaattaggtagtagtgatggtcacctaactttgtgaa

SEQ ID NO: 44957 - DNA, 201 bp, Homo sapiens
atgttggccagcctggtcttgaacgcctggcctcaagtgatccgtctgcctccacctcgcaaagtgctggaattacaggcgcgagctactgcgtctggcgycatgccaccttttttcttttttttcagatggagtttcgctcttgttgcccaggctggagtgcaatgtgcaatcacagctcactgtagcccccaacctcct

SEQ ID NO: 44958 - DNA, 201 bp, Homo sapiens
  misc_feature (1)...(201): n = A,T,C or G, or insertion/deletion polymorphism (see Tables 1-2)
tcctggccaacatggtgaaaccctgtctctactaaaaatacaaaaattagctgggcgtggtggtgcatgctggtaattccagcactttgggaggctgaagngggtggatcacctgaggtcagaagtttgagaccagactggccaacatggcaaaaccctgtttctactaaaaatacaaaaacaagccaggcatggtgctac

SEQ ID NO: 44959 - DNA, 201 bp, Homo sapiens
gccatgatctggcctggctctttcttccctgcactcattctctcccaccctccctgcctccaggcacaccctagctcctccttgcccttgaaaacctgcaygtgcccctgccccagggccctcgcacctgctgctctttcacatcaatcagggctctgctcaaaaaggaccatatcacaaagctttccttggccgggtgtg

SEQ ID NO: 44960 - DNA, 201 bp, Homo sapiens
agatgggtttcaccgtgttgtacaggctggtcttgaactactgacctcaagtgatctacccgtctcagccacccaaagtgaatttttgctttcttgatgcraacttacgcaaatacctattttgttaatggggactgattcaaggatttgagtgaacaaaacgttgacttaatttcaacaatactttttcaggtggcagga

SEQ ID NO: 44961 - DNA, 201 bp, Homo sapiens
taaaaacataggcgtgtgttgcagtggctcacacctgtaatcccagcactttgggaggctgaggcagatggattgcttgagcccaggagtttgagaccagyctgggcaatgtggtgaaaccccatctctactaaaaatacaaaaattagctgcgcatggtggcacatgcctgtaatcccagctacttgggaggctgaggca

SEQ ID NO: 44962 - DNA, 201 bp, Homo sapiens
gggaggctgaggcagatggattgcttgagcccaggagtttgagaccagcctgggcaatgtggtgaaaccccatctctactaaaaatacaaaaattagctgygcatggtggcacatgcctgtaatcccagctacttgggaggctgaggcacgagaatcacttgagcctgggaggtggaggttgcagtgagccgagatcgcaa

SEQ ID NO: 44963 - DNA, 201 bp, Homo sapiens
cgtaacccaggtcctgaggcttctacctgtctggggtgggaagaacaccattcagctaaaatgcagcttttattctgatcttaaacttttagcgtgaagcrttgtaatccaaataccccagggcacaatggtcagagaacacagacaatttgttgaaaaagaaattaaagtgtcaagattatatggaaaaacctttacctt

SEQ ID NO: 44964 - DNA, 201 bp, Homo sapiens
cgcagtgggcaggacctagagataagcgtcaaagaggaatgtgggcgtaacccaggtcctgaggcttctacctgtctggggtgggaagaacaccattcagytaaaatgcagcttttattctgatcttaaacttttagcgtgaagcgttgtaatccaaataccccagggcacaatggtcagagaacacagacaatttgttga

SEQ ID NO: 44965 - DNA, 201 bp, Homo sapiens; identical to SEQ ID NO: 29069
  misc_feature (1)...(201): n = A,T,C or G, or insertion/deletion polymorphism (see Tables 1-2)

SEQ ID NO: 44966 - DNA, 201 bp, Homo sapiens
ggggatgggtggtggtgacctgatgggaaatgagaatgagaagtcttttatttttattattatttaaaaatttttattattatttgtagagacagagtctyactctgttatccaggctggagtgcagtggcgcaattgtagctcaccgcagcctcaaactcctggcctcaagcgatcctctggcctcagcctctcaaagtg

SEQ ID NO: 44967 - DNA, 201 bp, Homo sapiens
tctgtattttgataggagtgatggttacgcaggtttatatgtttgttcaaactcattgaactatatacttaaaatatgtgtattttattatatataaattrtatctcaattcagaaaattgagatacaaagaagggaatgaattggttgctgtaaatgaaaagtacagagggatggcttcaggcctagcttgatccagggc

SEQ ID NO: 44968 - DNA, 201 bp, Homo sapiens
gaaactctgtctaaaaaaacaaaaaaaggaacaaactactggtaaatgaaacagcatgggtgaatctgaaaacatggtattgagcaaaataaaccagacayaaaagtctacatcctatctgattacatttacatagttcaaaagcagacaaaaatatgtggtgatagaaatcagagtattggttgcctggggatgatggaa

SEQ ID NO: 44969 - DNA, 201 bp, Homo sapiens
atgccactacgcccagctaatttttatatttttagtagagacagggtttcaccatgttggccaggctgttctcgaactcctgtcctcaggtgatctacccrcctcagcctcccaaagtgctgggattacaggcgtgaactactatgcccggccaaagatattttaatcttaaatctgaagaaagacaaaattggaaaccgt

SEQ ID NO: 44970 - DNA, 201 bp, Homo sapiens
tctgtggccaagggggcaggtgggcagccttgatggtgtatggctttcctaggagtggacaacaattgatttacctattcatggattcattgagcaccttytttttttttttgagatggagtttcactcttgttgcccaggctggaatgcaatggcgcaatcttggctcactgcaacctctgcctcccatgttcaagtggt

SEQ ID NO: 44971 - DNA, 201 bp, Homo sapiens
gtgctccagcccgggcaacaagagcgaaactctgtctaaaaaaacaaaaaaaggaacaaactactggtaaatgaaacagcatgggtgaatctgaaaacatsgtattgagcaaaataaaccagacataaaagtctacatcctatctgattacatttacatagttcaaaagcagacaaaaatatgtggtgatagaaatcagag

SEQ ID NO: 44972 - DNA, 201 bp, Homo sapiens
caggtgggcagccttgatggtgtatggctttcctaggagtggacaacaattgatttacctattcatggattcattgagcaccttttttttttttttgagayggagtttcactcttgttgcccaggctggaatgcaatggcgcaatcttggctcactgcaacctctgcctcccatgttcaagtggttctcctgcctcagcct

SEQ ID NO: 44973 - DNA, 201 bp, Homo sapiens
tctttttttttaatttttttttttttgagatggagtctggctctttcacccaggctggagtgcagtggcctgatctctgctcactgcaagctctgcctccygggttcatgccattctcctgcctcagcttgccgagtagctgggactacaggtgcccaccaccacacacagctaatttttttgtatttttagtagagatag

SEQ ID NO: 44974 - DNA, 201 bp, Homo sapiens
tgaggcaggagaattgcttgaacctgggaggtggaggttgcagtgagctgagatcgcaccactgcattccagcccgggggaaagagtgagactctgcctcaaaaaaaaaaaaaaaaaaaaaagaccggcccggtggctcacgcctgtaatcccagcactttgggaggctgagacaggtggatcacgaggtcaggagatcaa

SEQ ID NO: 44975 - DNA, 201 bp, Homo sapiens
tgagccctggagggcaaggctgcagtaagccatgatgtgccactgcactccagcctgggtgacaaaacaagaccctctcccaaaaataatagaatagaatrgagtagaatagaatagaatagaatagaatagaatagaatagaatagaaagaatagaatagaataaaattctgaacgatgaggttcagggagcttctgggt

SEQ ID NO: 44976 - DNA, 201 bp, Homo sapiens
gcactccagcctgggtgacaaaacaagaccctctcccaaaaataatagaatagaatagagtagaatagaatagaatagaatagaatagaatagaatagaatagaaagaatagaatagaataaaattctgaacgatgaggttcagggagcttctgggttggtgaacacattgaggtgtctggagtgagcatggaagccctgc

SEQ ID NO: 44977 - DNA, 201 bp, Homo sapiens
cactccagcctgggtgacaaaacaagaccctctcccaaaaataatagaatagaatagagtagaatagaatagaatagaatagaatagaatagaatagaatagaaagaatagaatagaataaaattctgaacgatgaggttcagggagcttctgggttggtgaacacattgaggtgtctggagtgagcatggaagccctgcc

SEQ ID NO: 44978 - DNA, 201 bp, Homo sapiens
actccagcctgggtgacaaaacaagaccctctcccaaaaataatagaatagaatagagtagaatagaatagaatagaatagaatagaatagaatagaatagaaagaatagaatagaataaaattctgaacgatgaggttcagggagcttctgggttggtgaacacattgaggtgtctggagtgagcatggaagccctgccc

SEQ ID NO: 44979 - DNA, 201 bp, Homo sapiens
ctccagcctgggtgacaaaacaagaccctctcccaaaaataatagaatagaatagagtagaatagaatagaatagaatagaatagaatagaatagaatagaaagaatagaatagaataaaattctgaacgatgaggttcagggagcttctgggttggtgaacacattgaggtgtctggagtgagcatggaagccctgcccc

SEQ ID NO: 44980 - DNA, 201 bp, Homo sapiens
ccagtgatgcaggaggcatttctagggtttcagcaacaggtgtttccagtggagaaagaaaaagggaaaaaaaaaaacaaaaaactcagaagaggacagarcatatgcaataggaatctaccaaacagagttgcttctgtagccagatgcctccttgggttacctggaacctttgcatggccagtcaaggagggaggcctt

SEQ ID NO: 44981 - DNA, 201 bp, Homo sapiens
tcacttgaccccaggagttcgaggctgcggtgagctatgatctcaccactgcactccagcctgggcaacacagtaagaccctgtctcaaaaaaaaaaaaaraagaaagaaagaaagaaaagaaaaaaagaaatgatgaggatgtcaaaaggacacagatccagctttagagaagccacactgaccacatcaaggagtatct

SEQ ID NO: 44982 - DNA, 201 bp, Homo sapiens
tcccgagtagctgggactacaggcacaagccaccaatgcctggctaatttttgtatttttagtagagacagggtttcaccatgttggccaggatggtctckatctcctgacctcatgatccacccgcctcggcctcccaaagtgctgggattacaggtgtgaaccaccacacctggccttgcacttactttttttatggaa

SEQ ID NO: 44983 - DNA, 201 bp, Homo sapiens
atgcctcttcctaatagcttagtgcttagaatctttatgaataaactatttatatgcaatattattttactgaatacatgagagattgaaatacagatgtyaaaaaattatttagtaaaaaaaaaatccatttgtttaagggacagttctagctgtgcttggcaggaaacattatttctgtcataagactttgggtggagg

SEQ ID NO: 44984 - DNA, 201 bp, Homo sapiens
acatgctacctagaggtgggaggatgtgtgcatacagtttatgcgcatttactcacattcatacgtgtgtgcacacagatgtgcacttactttttttttttaatcagatggagtctcgctctgtcacccaggctagaatgcagtggtgcgatctcggctcactgcaacctccacctcctgggttcaagcgatgatcctgcc

SEQ ID NO: 44985 - DNA, 201 bp, Homo sapiens
  misc_feature (1)...(201): n = A,T,C or G, or insertion/deletion polymorphism (see Tables 1-2)
ttgcctgtgtcttctctccccatgttgagctgagaggtgtagggcatcatctctggggcttgagggctgcagggttgagtttctgacacctgactgaagcncctgaaggcagaaactggcgagctcagggttcacagggctgtggtgggctgtacaggccaggacatggggccgtaggggatgtaaggccaggatgctgcg

SEQ ID NO: 44986 - DNA, 201 bp, Homo sapiens
gatcatgtgttagtatctctccctacctaaacctgcattcatgggcacacatgggcaagtgtgagtgcgcgtgcgtgcacacacacacacacacacacacmgcacagtgctagacctgtagtggataatcagtaactatttgtcacatgactgacctcagcttattgatcctaagcaataagtcttgttcctcaagccaca

SEQ ID NO: 44987 - DNA, 201 bp, Homo sapiens
gtgaaggcaggaagctcaggctcccacccagtggtggagaagccatctggtctacactcgcaggaggccttgaggaagtgggtctcactcttcagggagtrgtcaaaggtgcttgtggtgcaattcgcgcctgaagatcagggatctgcctgggacaggagtcctagtagccaacatgtcttcctcgtccctcacgctgaa

SEQ ID NO: 44988 - DNA, 201 bp, Homo sapiens
tttgcctgtgtcttctctccccatgttgagctgagaggtgtagggcatcatctctggggcttgagggctgcagggttgagtttctgacacctgactgaagsacctgaaggcagaaactggcgagctcagggttcacagggctgtggtgggctgtacaggccaggacatggggccgtaggggatgtaaggccaggatgctgc

SEQ ID NO: 44989 - DNA, 201 bp, Homo sapiens
cttcacttcttttgaacgtcttttctgttatttttttccatattttgcattttaatttttatcacttatattttaccttccagactagcattttaagatgrgactctggcttcatccagtcttgaaaaataccttttaaaaacccaaacttagtgagttaagatgttaaattatgaatagctcattgtttatgttgggcac

SEQ ID NO: 44990 - DNA, 201 bp, Homo sapiens
tagaaggctcctcagatcttggtggtaatgaccccaccagcccatcagatgtgcccagggaacccctgggtccctgagagaaataaacaggagaggaaccsctccatccctctggcccccactgcttccttgtgaaacacccccagaaagccaatagccctgctaccacaggctctggtgggctgcctccgcctgcagaga

SEQ ID NO: 44991 - DNA, 201 bp, Homo sapiens
aatacatttttgttaagtagaatcaccctattctgctatccaacattgaatgtattccatcttactgtatgtgtgtaccctttaacccacttctcttcatygtccctcaccactcacccttcccagtctctggtatctgtctttgcactctctacctctatgtgatcacatttctaactcccacatataattcagaacata

SEQ ID NO: 44992 - DNA, 201 bp, Homo sapiens
cagctcagcactgacgattgctaatagctcgggtgatcatagcagctgcctgagtgctgtgtttcgtgtgaagcacagtctcatgcaaggttgtaggtagrccccaccatgttaccttctccttgagccctaccatgcttagcaaaagccttcacttcttttgaacgtcttttctgttatttttttccatattttgcattt

SEQ ID NO: 44993 - DNA, 201 bp, Homo sapiens
ttccccttgctcctaaatcccagtcctcctttaaggagaactctatgcttctttgccttgcttctctctttccccagacaactcctccgtgggtgttgaaygaaagataggaaagaccatgggctttagagaaaacgggagacccgccacttcctgtggacttgggcaagtcaggtgatctctctcagcctcagtttctcc

SEQ ID NO: 44994 - DNA, 201 bp, Homo sapiens
tgtacatgtatgtgcgctgtgtgtcctgtgtatttgtgtgtgcaaatacatctatatgtgtacacgtatatagtatgtgtatagtctgtagtgtatgtgcrtgggcatgtatgtatgtgtgtagtatatgtgccaactgtttctatgtgtgtgtctgcatgcatgtatgtgtatgctatgtagtgtgtgcacatgtatgta

SEQ ID NO: 44995 - DNA, 201 bp, Homo sapiens
gacctgatgttttcacatccctatttattctgcacatgaatgcattattagtcccattaacatttttttaatcccaagttaattctttgtctttattattrttattattattttgcattctgatattctatttatctctttgcatgtatttactaggctcattttttaatctagtcctcctggccagtactttgttgcctt

SEQ ID NO: 44996 - DNA, 201 bp, Homo sapiens
gcagtgcctttcacagcaccagtgtatagtaagtgctcaatgaatatttattggttttttggttggaaatatgatggccctgctttaagttttgcatgagragaatgctgtgccagtacaaaggtgcccaatactgagccttcacgctgttgttaccatgggggtcctcctgtgtagctgctcagatcccagagtgttctg

SEQ ID NO: 44997 - DNA, 201 bp, Homo sapiens
cgcctgcagagagactcgccttcacagcggccggcacccttcacctgcgggctctttccaactcatcttctgagaccgctcccacggtggggtaggggagstgggacctgtgcatttgccatcggcggatggcatgagaagtggcccaggatggcgcagctgccggggtccatgaagataatatccagagtggggagggct

SEQ ID NO: 44998 - DNA, 201 bp, Homo sapiens
  misc_feature (1)...(201): n = A,T,C or G, or insertion/deletion polymorphism (see Tables 1-2)
cacccccatgcctgagcacatcacccagcacttcccacattgcttctgcccacagaccatggatgccactaggtgcctgttccccctaaatcctggggccngggtggctaagacatggagtggtggctgggctgatgttctccaacagcaattctaccctgggaagcgggtggacagccagacccaaaatgtccaagttgc

SEQ ID NO: 44999 - DNA, 201 bp, Homo sapiens
  misc_feature (1)...(201): n = A,T,C or G, or insertion/deletion polymorphism (see Tables 1-2)
ctctctgtcggcctcacccattcccacctcctgcccctgaggatttctaggtgtgtgtgaggacaggacactgaggctatgcactgtcttgcccctcttgntgattattcttaaattcggtttcatttctgccattagacctgactccagaggaaccaccccttccagtccttggctcggtcttgtgctcagggccttcct

SEQ ID NO: 45000 - DNA, 201 bp, Homo sapiens
ctgatcctgctgcatttacacaggagatggctcggagaccggggtctctgggttgggaagtatcatctgctgcctgtggcagcagctaaccaccatgtggktgagatggtgtggttcttcagtgtgtctgggggcagagggcagaggcatttttgtgtaatgcaggagtcactgcatacatgggagatggaaacgcatgtt

SEQ ID NO: 45001 - DNA, 201 bp, Homo sapiens
tggggaggcctcaggaagcttacaatcatgcagaaggcaaagggggaacaggcacttcacatggccagggtaggagcaggagagagtgagttggaaggcaraggtgctgcatacttttaaatgatcagatctcatgtgaactcagaatgagagctcacttatcaccaaggggttggcccgagccattcatgagggatctgc

SEQ ID NO: 45002 - DNA, 201 bp, Homo sapiens
atctgaaggcctgagaaccaggagtgctgagggcagaaagtccatgtcccagctcaaacaggtttggttattccgccctccgccactgttttgttcccatsatgaatagatcagatgagccccacccatattggtgaaagccctctgctttctgctctccagcaattcaaatgctaatctcacccaaaatgccctcacaga

SEQ ID NO: 45003 - DNA, 201 bp, Homo sapiens
ttattccgccctccgccactgttttgttcccatcatgaatagatcagatgagccccacccatattggtgaaagccctctgctttctgctctccagcaattsaaatgctaatctcacccaaaatgccctcacagacacatgcagaaataacgtttaaccagctatctaaccatcacaggttagcttccaatgtcccacagcc

SEQ ID NO: 45004 - DNA, 201 bp, Homo sapiens
ccagaacctgaacttagaactgaccaaagaaacctaagcccacactcttgacaaatgcagaccaggcatgaggagtaggaatcaacaacttatcttgactrtggtgaaaataatcatttttgttctttaaacttttaaaagaactacttatttgttttctgtttgatgagaagggctaagtggaagctgagaggccagtcc

SEQ ID NO: 45005 - DNA, 201 bp, Homo sapiens
gtaagtgctcaatgaatatttattggttttttggttggaaatatgatggccctgctttaagttttgcatgaggagaatgctgtgccagtacaaaggtgccyaatactgagccttcacgctgttgttaccatgggggtcctcctgtgtagctgctcagatcccagagtgttctgccaggaagtgaagatgggactcagaacc

SEQ ID NO: 45006 - DNA, 201 bp, Homo sapiens
tgaaccagggaggcagagcttgcagtgagccaagatcgtgccactgcactccagcctgggcgacagagcgagactccatctcaaaaaaaaaaaaaatcatytatcaaataccaatcaaattggtctatttgtgtacctatctgaataaaataatggaggaagtatgtaatgcctattacaagacattacggtaagaatcag

SEQ ID NO: 45007 - DNA, 201 bp, Homo sapiens
  misc_feature (1)...(201): n = A,T,C or G, or insertion/deletion polymorphism (see Tables 1-2)
gaaatttactttacatttcctgcacatttgttatctgggtaaatgatttttttaaaatattgttaagggaaggtgtttttcagtgtattctgttggtagantttatgctgtgttacgttgaaattttacaagccaagtttaaactgtactataaaaattatttttgtattattttcagaacatgccacagagcaatatttt

SEQ ID NO: 45008 - DNA, 201 bp, Homo sapiens
ccagaggatcccagatacttctaaacccctgcgaaggttatttcagaaatttactttacatttcctgcacatttgttatctgggtaaatgatttttttaawatattgttaagggaaggtgtttttcagtgtattctgttggtagactttatgctgtgttacgttgaaattttacaagccaagtttaaactgtactataaaa

SEQ ID NO: 45009 - DNA, 201 bp, Homo sapiens
  misc_feature (1)...(201): n = A,T,C or G, or insertion/deletion polymorphism (see Tables 1-2)
tttgtgagagagctggatccatccttcctctaaacagtattaaaaatgcaaaagggagagagcggatggtcatattaaatgtgctagtcccgtgcaccganagcatgctccttgagaagaggcgtgtagacctcgtccctggccagagaccaacttcagcaggctggccagaaactattaaaaactgtgttgactgcatgt

SEQ ID NO: 45010 - DNA, 201 bp, Homo sapiens
ccactcagtccacatgacttaggaatagccatttccttttgtgagagagctggatccatccttcctctaaacagtattaaaaatgcaaaagggagagagcsgatggtcatattaaatgtgctagtcccgtgcaccgacagcatgctccttgagaagaggcgtgtagacctcgtccctggccagagaccaacttcagcaggc

SEQ ID NO: 45011 - DNA, 201 bp, Homo sapiens
gagtgggggaaagacgacaacgataacgcccggctggcccagtaagatcctactctgtccctttccccagcgcccacagggagggctatggctggggcatyctggggagggaatgtaccacccctgctcctcctgggacagctggcatgcaagtggactgggtgctataagggccagctcagaccatttcaataggatatt

SEQ ID NO: 45012 - DNA, 201 bp, Homo sapiens
taaagttttattggaacacccccacgctcactcatgtatgtactgtcttcgacggctttagtgctgcaaagacagaggtgagtagttgagactgcatggcscacaaagcctaaaatatttctgtctcaccctttaggaaaagttttgtccacctgttttaaaatatacccaggatcggttttaatcaggtgtcataagaca

SEQ ID NO: 45013 - DNA, 201 bp, Homo sapiens
ctcctttagttgagttcttcctgaaaccatagtgtgccaaaatggaaaatggaacatttcatattctaaatcagggcccagaaaaagacctgtgagcccartctgggctgttttttaagtaaagttttattggaacacccccacgctcactcatgtatgtactgtcttcgacggctttagtgctgcaaagacagaggtgag

SEQ ID NO: 45014 - DNA, 201 bp, Homo sapiens
agagcccccagctaaattggagttccagtaccagagcagctagaaaacctgcaataaggagaaatgaaaagggacctggacataggcgtttacagtgtgcrtttcatgggatacttctcttacctggcaggtgtcctaatgcctggttgcctaacccatgacccatgtccctcacatgggaagcttgtttgtactggcaga

SEQ ID NO: 45015 - DNA, 201 bp, Homo sapiens
  misc_feature (1)...(201): n = A,T,C or G, or insertion/deletion polymorphism (see Tables 1-2)
cttaaattttcatttagtagattaaaaactctagattgaaattattttctttgaacaccttccaacccttcctccatcatgttcttgcaccttgttctcangtcttctaagagattcacttgacctgatgttttcacatccctatttattctgcacatgaatgcattattagtcccattaacatttttttaatcccaagtt

SEQ ID NO: 45016 - DNA, 201 bp, Homo sapiens
gaaatctgcttttgttgatattaaacagctaccctggctttctgttggttcatatttgccagaaatatcattttttctgctgatataatttcaacttttcyatatcctttcatgttaaatgtgattcttgtagacaatttattattaggtttcattttattatccaatccaagaatctctgtcttttgagtggttaattca

SEQ ID NO: 45017 - DNA, 201 bp, Homo sapiens
ccagtgaactacataaattctcttattagtcatttgcttaatgactaagagaatcacttggatatctaagtatacaatagtatcatctgaaataattgtawgttcttcttcatatttatacaattaattcagttttttattttattgaattaggtagactctcctgaactgttgcaaatgaatgctgtctttgtttctatt

SEQ ID NO: 45018 - DNA, 201 bp, Homo sapiens
  misc_feature (1)...(201): n = A,T,C or G, or insertion/deletion polymorphism (see Tables 1-2)
aagcatggaaaaaagaaactcattttttacttatttatcttttatccagtgaactacataaattctcttattagtcatttgcttaatgactaagagaatcncttggatatctaagtatacaatagtatcatctgaaataattgtaagttcttcttcatatttatacaattaattcagttttttattttattgaattaggta

SEQ ID NO: 45019 - DNA, 201 bp, Homo sapiens
  misc_feature (1)...(201): n = A,T,C or G, or insertion/deletion polymorphism (see Tables 1-2)
tttttctttctttgccacatggctaggctgcaaatttttcaaacttttacattctgcttcccttttacattctgcttcccttaaatataagttccaactcntatctttgctgcagcatctgaatgcagactgttagaagcagccatgccacctcttgaatactttgctgcttataaatttcttctaccacataccctaaat

SEQ ID NO: 45020 - DNA, 201 bp, Homo sapiens
agctctttccccaggccatgccaggggccacatttgccagccctggccccacctgctgccgtcgtcacagactccctcagctaattctgagcattcctcaracactcaggaacaagtctgagagccacctctggggagtcttggctggtgctgtcatctcagctggcaggcactgcaggtgcagccgaggctccataacgc

SEQ ID NO: 45021 - DNA, 201 bp, Homo sapiens
gttgggtttttttttttatctttcctttcgcctcataggttttttgttgtcgttgctgaaagccaggcatcttgagtaggacagtaaagactgcagtaaawcacttttattcctggaaagaagcatgcctttccttttgctaggttttcagagtctaggtttggaccagtctagttatgatagcccaggaaggtcaccccc

SEQ ID NO: 45022 - DNA, 201 bp, Homo sapiens
aacaaaggcaacctacccttaaatagcttttactgttttccctttcacatgtatacatattttataggaatgcaattagtcttagatataaattaaagggraaaaaacttcaaaagcaagtattaatgaactatggcccaccacccattttataaataaagttttattggaacagagccacattcattcacagatgcatca

SEQ ID NO: 45023 - DNA, 201 bp, Homo sapiens
agaaaaagcaggaggtcgaccatctcttcactggagccagcttctcctctagaaacgatgcttttttccctaactaaagagcagcaaaaacaaaaaaaaarggggggcgaggggattttttttacttgtttgagaaattataataaaataattgagtatctcctgtgagtaatgcctttttgtttttaattattccacagc

SEQ ID NO: 45024 - DNA, 201 bp, Homo sapiens; identical to SEQ ID NO: 22684

SEQ ID NO: 45025 - DNA, 201 bp, Homo sapiens
tttaaaaactagcaatagtggttttggtcttcatgctcctgctggcacagatctgtgtagatgtccactcggtgcatttgtcacccagatacctggcttgsgaatttccttgccatcctgcctggggactgccggggctccaagcacggctctgtctcttctgttccagccgtgatccccctgacggattctgagcacaag

SEQ ID NO: 45026 - DNA, 201 bp, Homo sapiens
  misc_feature (1)...(201): n = A,T,C or G, or insertion/deletion polymorphism (see Tables 1-2)
gggttcccatctcacaatttggatttgctcatagaggagcagataggacaggctgctcacatttctcctttgaaggcacttccacagtggactgtcgctgncgggcccctgggcggtgaccatcggtgccccgggagacagcgaggaattgaccctttggtcactgtgtaagcccccactaggctgctgctctttccaaag

SEQ ID NO: 45027 - DNA, 201 bp, Homo sapiens
atgttttttgaaatctcagtagtgaactgccagggaaaaggatttgtaaaaaacagcctgcaagtaattggtcctctccagacatttacttaaagtggggytcacaaagaattagtaaaggagtggcatgagtcaaggagtcgggcggtggccagcactgctcagtgctctcagactccagcctctgcctgtacgtcatct

SEQ ID NO: 45028 - DNA, 201 bp, Homo sapiens
  misc_feature (1)...(201): n = A,T,C or G, or insertion/deletion polymorphism (see Tables 1-2)
cccctgcttgcaaacgctgagggattcattttaagcatctgactgattgatgttttttgaaatctcagtagtgaactgccagggaaaaggatttgtaaaanacagcctgcaagtaattggtcctctccagacatttacttaaagtggggctcacaaagaattagtaaaggagtggcatgagtcaaggagtcgggcggtggc

SEQ ID NO: 45029 - DNA, 201 bp, Homo sapiens
cactttgcagtggaccctggcaaggactgggagtgggggaaagacgacaacgataacgcccggctggcccagtaagatcctactctgtccctttccccagygcccacagggagggctatggctggggcatcctggggagggaatgtaccacccctgctcctcctgggacagctggcatgcaagtggactgggtgctataag

SEQ ID NO: 45030 - DNA, 201 bp, Homo sapiens
  misc_feature (1)...(201): n = A,T,C or G, or insertion/deletion polymorphism (see Tables 1-2)
ttgtggcacaaaattacaaaccagtagaggtcagcaacacccttgctcacctgacttgcacattcggcccttctctgggacgagacaggagagctgagccncaggcccacctgcaaggtggcctcccaaagtgtgcctaacctgcctagatccttcctagaaatagcagaggcagcaatagcttttttcccattctgctgc

SEQ ID NO: 45031 - DNA, 201 bp, Homo sapiens
  misc_feature (1)...(201): n = A,T,C or G, or insertion/deletion polymorphism (see Tables 1-2)
tgtgtgtgactcccaggtgtggggcctgcaggggagctaagtggagcccatggaggaggctgctgcttgttgcgaggaaagacttggggagaccatctccnagttcctcctgcccttgtccctgacaatgcccttgggaggagtcaaccgtgtcactaggcactcctctcatcaggtcccccagcagctcagaagctccta

SEQ ID NO: 45032 - DNA, 201 bp, Homo sapiens
tgtgggctccggggggttaaacgctttttgctgcttgttcaaataccttctgaaagtgggaatgtatcagtgtctttttttattgaaagcttgatttcctwttttctgttcatggattttggtactgcacctttcctcttaaatgaatactttgtattcactaaattactgtggaccttttcatacctattaccacccagt

SEQ ID NO: 45033 - DNA, 201 bp, Homo sapiens
aataaacatctttaattaatgagatttgtttttttttttttttttgagacagagtctcactctgtcactcaggctggagtgcagtggcatgatcttgcagsctctcactgcagcctccgcctcctgggttcaagcgattctcctgcctctgcctccagagtagctggattacaggcacacagcaccatgcccagctaattt

SEQ ID NO: 45034 - DNA, 201 bp, Homo sapiens
tgacaacctgagccttgggccttcagctttttgcaggaagcagcctccttgcagccacatcttaaaatggcctgcaggggagctctgtgaaacccagatcygggcattctctcagcacccagctcaggtcagttcctactggccactgagcaaatgtgtacattatgaaaaatcaaatcaattaacaggagaagcagaggt

SEQ ID NO: 45035 - DNA, 201 bp, Homo sapiens
  misc_feature (1)...(201): n = A,T,C or G, or insertion/deletion polymorphism (see Tables 1-2)
ggcccccactgtgaagcacaggtgtcaccctctgccatggtaccctgtccgtcctataaacagcaccctgtgacagaggctaatagatacaataatcacangccccaggaagagcagacaccgcatccttgtgcctgcggaacgatgctttgagagcctggaaatgagataaaaaatgtatttcaggctgagacaaggctc

SEQ ID NO: 45036 - DNA, 201 bp, Homo sapiens
  misc_feature (1)...(201): n = A,T,C or G, or insertion/deletion polymorphism (see Tables 1-2)
aaactgaagcccagagaggctaggcaatgtccccagcggggatcagccaagggcagggagtgatccaaagcctgtcctccctccagcgtgcagctgcccantttgaatttacacctgcaccttaacaaaagtcataggtcttccagggagctctacgaatcaggatgtggctcttcacgctaaatcacagctgccataaaa

SEQ ID NO: 45037 - DNA, 201 bp, Homo sapiens
atgaggacgggagctgagagggaagccctgaagcggaggtggaggtggcagcagacgcagcagaataaggaggttggtatccactggcatggccagagccygggacccaggccagatgcagcctcgggccgtggtcgagtccacagcatggcctccaggccccagacagtcttatgaggggaaggcagaaacagcccctgg

SEQ ID NO: 45038 - DNA, 201 bp, Homo sapiens
  misc_feature (1)...(201): n = A,T,C or G, or insertion/deletion polymorphism (see Tables 1-2)
tccctgcctctaagaccatcctgtggccaggctgcacattcacccataaggtccccacgacccactgcagggcaggtgccatggccacgctctttgtcacntgcacccttgtgcccccttagaccttcacctctgcagccttccctctgtgcctcaaaggacactgtggggacgggacagagtcccagctgtgctctcaag

SEQ ID NO: 45039 - DNA, 201 bp, Homo sapiens
aggggctggccttggcctcacgtacaggctatcattacttccctcctccctctctgctttgagtttaatttgctaccccttttctagtttcttaaggcagraattttgattactaatttgagactgttttctcatctaatatgagcattttaatgctataacttttcccctaagtactgctgtaactacaccatacaaatt

SEQ ID NO: 45040 - DNA, 201 bp, Homo sapiens
cctggttctgctctctgaggagaccccagttgtcattgtcccacagggccacatctgatgtgtgcacagagtgcaccctctggggctgagagcttcaccayccacttttggcatgagttcaggagcccagaaattgtgttagatgctgaacgctctctcagcctgagagttttttcagcagtacagtttccttaattctgg

SEQ ID NO: 45041 - DNA, 201 bp, Homo sapiens
  misc_feature (1)...(201): n = A,T,C or G, or insertion/deletion polymorphism (see Tables 1-2)
ttctctgggacgagacaggagagctgagccccaggcccacctgcaaggtggcctcccaaagtgtgcctaacctgcctagatccttcctagaaatagcagangcagcaatagcttttttcccattctgctgcccaatggagtatctgccattggacagacccaaagagagccagggtccaggtgacgcttccaactgctctc

SEQ ID NO: 45042 - DNA, 201 bp, Homo sapiens
  misc_feature (1)...(201): n = A,T,C or G, or insertion/deletion polymorphism (see Tables 1-2)
ccagccaccatcgcccctgattcccaaatgagggccccagccatctctgtgtgatgtgcagtttcctccatctggccactccaggctcctgaggactccangctcccatgcatggtactggagtgagaacatgtgctccaacaaaaccgcttctgagaggggctgggaggcagcagcaccagccacctgtcctacctgcag

SEQ ID NO: 45043 - DNA, 201 bp, Homo sapiens
ctgttttccctttcacatgtatacatattttataggaatgcaattagtcttagatataaattaaagggaaaaaaacttcaaaagcaagtattaatgaactrtggcccaccacccattttataaataaagttttattggaacagagccacattcattcacagatgcatcatctgtggccgtttttgcactacagtggtagag

SEQ ID NO: 45044 - DNA, 201 bp, Homo sapiens
acctacccttaaatagcttttactgttttccctttcacatgtatacatattttataggaatgcaattagtcttagatataaattaaagggaaaaaaacttmaaaagcaagtattaatgaactatggcccaccacccattttataaataaagttttattggaacagagccacattcattcacagatgcatcatctgtggccg

SEQ ID NO: 45045 - DNA, 201 bp, Homo sapiens
  misc_feature (1)...(201): n = A,T,C or G, or insertion/deletion polymorphism (see Tables 1-2)
tcccattcggagggatctacctgcccttggaggtccctcccaacagatgccactgctcgcctctggttctggcctatgatcaagcccatttctctgccctngtgtccatggaacagagagaccagcaaagagaacaaggtatgcctgtctcccaagagagtgcacgcaggagcctagggtgggggcagagccatcagaagg

SEQ ID NO: 45046 - DNA, 201 bp, Homo sapiens
tagacaaagtgaggatggcggaggaactcataagagttcatcaaagacatccctgaaattaccgtccctgaattctgctcaaggagtgcagcaatacactsactctagggccaaaagtaaagacgtttcatgacctcaaagcagatgctgctttaggacagatatttccagaagttattctattttgctgagggtgttagg

SEQ ID NO: 45047 - DNA, 201 bp, Homo sapiens
  misc_feature (1)...(201): n = A,T,C or G, or insertion/deletion polymorphism (see Tables 1-2)
ccaggagaaatctggtcgtgtgaggaccaggaccaagcccagaggggctcctgtctcctgtcgtgtgcctagggcatagcagacagcccacacccctccancagccctgggccatgtcctggaggcactcagtcactcaggtgtgttcccacccctccgcagaccacatgtgtgttaaagactaaaaagaaaggaagacag

SEQ ID NO: 45048 - DNA, 201 bp, Homo sapiens
aaaataaaaaattaaagacagaccttagccatcaaaacaatacatcaaaatacaaatgcctagctaaaatattccattcacactttaaaaacaattattayactattacatttgtacacatggtactccagaggcccaaattatcccctttccacttaaatggtcacctcatcaaccaaatataaactatatagtagctct

SEQ ID NO: 45049 - DNA, 201 bp, Homo sapiens
gaaaggacctaactcttacgactaacgacaggtgtctgccaagcctgtgggccagtgatggccctgggccaggactgcagccggccgggggccaagactayagccatgcaaatcccacccagcccagaaaactaagtgtagaaaaaataaataaatcagggaaaaaaaaaaaaaacaggggaaacagacggcagcgcatac

SEQ ID NO: 45050 - DNA, 201 bp, Homo sapiens
taaaaggcattattgggacagctggcacacacacgtggggtctggtgattgcatgtaactgtgtgaattcctgatgtcggtagccgtgtggtggttgtgtmggaggatgttctgttcatagaaaatgagcaagaactttccagggtgatggggtgccaggttggctgtttattttcaaatggttcagggaaacaaaagctc

SEQ ID NO: 45051 - DNA, 201 bp, Homo sapiens
tccatgtgagtcttttatttacgaagagacctggagtaaaagctgaaggcatctactgtatgtttggggctcctttctttatggccatgattttttttctyctcatcttggtgtggactttaaaattaagtacccccagtgttctgtcctttttctttcctcagtgcttctaatagataagaagaaatgtgtttctgtggc

SEQ ID NO: 45052 - DNA, 201 bp, Homo sapiens
ccctcccaccatgcccccaacctggctccatgcagtggtgagcatgagttggacacacttgtctggagcatggacagaaaacaagctttccaaagactcargctggggccctacagtattgagggctgaggaacagaagaaggagccagcagaagagactgggaatgtgcgggcctgggaatcagggcgaaccagcggtgg

SEQ ID NO: 45053 - DNA, 201 bp, Homo sapiens
agcgagagccacagcccgggcacaaggtggagcgaccctgcctgcagaggcaggacgacattgcccaaggtaccgctgagggactgagcctaggcacagcygcccaggccagtgcaccgcagcttgcaggcgggttgcgtggtacaaagaatggtggggtcatcacctcccggatgcagacatattggcctctcagtgcct

SEQ ID NO: 45054 - DNA, 201 bp, Homo sapiens
ctggctgccttcaacactgaggctcctggtatagaaccaggaccctccctaagtcttggacaaggagccagaagcaagtagggaacatcattatgattttyaggctgccccccgctggagctgggatcctctccgccaccccctgggtcactgagcaggtttcagttgctcacatggctcccatgctcaacaccaaaactg

SEQ ID NO: 45055 - DNA, 201 bp, Homo sapiens
gatgcagaaaaataactgataatttcttatttgatcatgtgttagtatctctccctacctaaacctgcattcatgggcacacatgggcaagtgtgagtgcrcgtgcgtgcacacacacacacacacacacacagcacagtgctagacctgtagtggataatcagtaactatttgtcacatgactgacctcagcttattgat

SEQ ID NO: 45056 - DNA, 201 bp, Homo sapiens
acaaagaggagaagagagcagagcaagagggaccgtttgggggaccctctggcagcccccgggggcatcttctgtctaggtccttacttttctcacatgcyaacctctctgctttctctttgtagttgagtttctgaaatttcactgacaatgtgtttgctgcatttctttttattagcttttttcggaagtagctagaat

SEQ ID NO: 45057 - DNA, 201 bp, Homo sapiens
agcctgaaagacacaaagccagaacctgaacttagaactgaccaaagaaacctaagcccacactcttgacaaatgcagaccaggcatgaggagtaggaatmaacaacttatcttgactatggtgaaaataatcatttttgttctttaaacttttaaaagaactacttatttgttttctgtttgatgagaagggctaagtgg

SEQ ID NO: 45058 - DNA, 201 bp, Homo sapiens
agagagctctgaagacccaaaaaaagcacttcctcagacagcaggtcagcactgggacctccagcgagcccagcgggccctgaaggaagacagcaagaaakactttgccaccctcctgcccctcctccctgcctgtgccggccccacaggggacacagacagcagccagagaaggggaggaggcaaaaggtgaaacagaga

SEQ ID NO: 45059 - DNA, 201 bp, Homo sapiens
acaacctcaccagtgatgggacaatctgcagttcacacaacctgataagatgtcacaagaaggactcagcttgacccaatccaatctaactgtgaggaaayagagaaacccttatgaaggacattctacaaaatacccaacctgtaatcttcaaaaatgtcaaggtcatggaagtcaaggatatcctgagaaatgttccag

SEQ ID NO: 45060 - DNA, 201 bp, Homo sapiens
aaatccatagtgataccaataaacctataaagatttggtgaggaatggagtatttgcataggttcaagttcctctccacaaaatgcttgttaatttcaaaygaaaaattagtagtctgcaggggcaaggcctggaagatgaccttaaggagtggtccaggtcaacctcaccagtgatgggacaacctcaccagtgatggga

SEQ ID NO: 45061 - DNA, 201 bp, Homo sapiens
gtggcctgtggtcccagctacttgggaggtcagaatgggaggctcacttgaccccaggagttcgaggctgcggtgagctatgatctcaccactgcactccrgcctgggcaacacagtaagaccctgtctcaaaaaaaaaaaaaaaagaaagaaagaaagaaaagaaaaaaagaaatgatgaggatgtcaaaaggacacaga

SEQ ID NO: 45062 - DNA, 201 bp, Homo sapiens
aaaatgaaaaaagttttctgggcataatggtggcctgtggtcccagctacttgggaggtcagaatgggaggctcacttgaccccaggagttcgaggctgcrgtgagctatgatctcaccactgcactccagcctgggcaacacagtaagaccctgtctcaaaaaaaaaaaaaaaagaaagaaagaaagaaaagaaaaaaag

SEQ ID NO: 45063 - DNA, 201 bp, Homo sapiens
gtctctacaaaaatgaaaaaagttttctgggcataatggtggcctgtggtcccagctacttgggaggtcagaatgggaggctcacttgaccccaggagttygaggctgcggtgagctatgatctcaccactgcactccagcctgggcaacacagtaagaccctgtctcaaaaaaaaaaaaaaaagaaagaaagaaagaaaa

SEQ ID NO: 45064 - DNA, 201 bp, Homo sapiens
  misc_feature (1)...(201): n = A,T,C or G, or insertion/deletion polymorphism (see Tables 1-2)
catgtttaggaatagcttgttcctacagaaacaccttggatgttctagtatggaatgaagaccgtggccagaccagtggggcagccatagagccttggccncggcttattcttcagttcatattctctggaacctgaaagcaaaggtgttgctcctagagaaggtctcagccaaacatgagaaagtgtgagcagtaacacc

SEQ ID NO: 45065 - DNA, 201 bp, Homo sapiens
agacacccaaccttaaaaatgctccaataatccattcagaaaccaaactcatatgcacaagatgtcaaggaggcataaagtcaattcttgcttgtttttttcatttcttaatgtaaaaacagccaaccagaaatttctaaaactggctatgctaattcagatattttctttctcacgctatctgccaggtttgtctaattt

SEQ ID NO: 45066 - DNA, 201 bp, Homo sapiens
tgcagcccccacatgcactatgcaggcagaggtgagctcacatgagctgcctccaggccactttccttgaactttattgtgcagaacagttggggtgtgcrccttcagggcacagcaggcctctggaggtcacacgtgatggtgagcattcccacacattgccatcgcacgaacctggctctgaagtttgggttttctccc

SEQ ID NO: 45067 - DNA, 201 bp, Homo sapiens; identical to SEQ ID NO: 22689

SEQ ID NO: 45068 - DNA, 201 bp, Homo sapiens
ggggatggcacgggggggaatgtgggactcttgtgctgtggaagacagaaagattccagctttccagcattagcttcaagacaaggacgcacgggaggacygtgggtgatggctggccccgccaggtgctagtggaagggtatgcagcccccacatgcactatgcaggcagaggtgagctcacatgagctgcctccaggcc

SEQ ID NO: 45069 - DNA, 201 bp, Homo sapiens
catggccccagcccctgtgtgtgagctcagtccaaagggattcccgattgtccccaaccatggtaaacatgaggaccttgctctcctagaagaatctgaayggccagccccagttaggtgcaggcacaggttaatgctcggtcatccccagcccctgagaatgacccttgttggtgggcagattcccagcagctctggaat

SEQ ID NO: 45070 - DNA, 201 bp, Homo sapiens
cagaaaaagcaggaggtcgaccatctcttcactggagccagcttctcctctagaaacgatgcttttttccctaactaaagagcagcaaaaacaaaaaaaaagggggggcgaggggattttttttacttgtttgagaaattataataaaataattgagtatctcctgtgagtaatgcctttttgtttttaattattccacag

SEQ ID NO: 45071 - DNA, 201 bp, Homo sapiens
tgggtggatggctggatggacggatggatggatggattcccctgtgttttcccttgtagccagagctgcccttctcttgagcacttctcccatgagttggrgttcttgatcacatctaagctgcccagagcacattctcagagatggctggtttctctctatatcctctcagcacctggcacagggtgagaccctctcact

SEQ ID NO: 45072 - DNA, 201 bp, Homo sapiens; identical to SEQ ID NO: 22692

SEQ ID NO: 45073 - DNA, 201 bp, Homo sapiens
gaccatcagggccggttggttcttacccgccctggaggatagcgcctctccaaaacacacaaccctcacacaggaatgcagtccttgtttgtcaaacttgsatccccaacaaacatggctttaactgggtgccatgacctacatcaagggccagcccccagacctctctctctttggacctgcggtgaggcctattcagca

SEQ ID NO: 45074 - DNA, 201 bp, Homo sapiens
ccttcctcccctcccagaggcagcacactggtgggtggagctggcaggaaggtgaggagaggggcctacgccccatgaggctgcctgcctccagagggtccggggctgcccctgcttgcaaacgctgagggattcattttaagcatctgactgattgatgttttttgaaatctcagtagtgaactgccagggaaaaggatt

SEQ ID NO: 45075 - DNA, 201 bp, Homo sapiens
ctggtacaaataaaaaggacttcctgggaggaggtgggatctttactgaaacttgaagaacttgagagactagaagagggcattgcaggcagggagacccygcagataaagcataaaggcaggaatggacagggtgtttggaggtaggggtgaacgaggtaaagctggagtaggaagttttgggagcagtgcatgaggttg

SEQ ID NO: 45076 - DNA, 201 bp, Homo sapiens
actatggacctgttatacccctatttttaattgttagtggtttccctagggtttgcaataaacatctttaattaatgagatttgtttttttttttttttttgagacagagtctcactctgtcactcaggctggagtgcagtggcatgatcttgcaggctctcactgcagcctccgcctcctgggttcaagcgattctcctg

SEQ ID NO: 45077 - DNA, 201 bp, Homo sapiens
cactatggacctgttatacccctatttttaattgttagtggtttccctagggtttgcaataaacatctttaattaatgagatttgtttttttttttttttttgagacagagtctcactctgtcactcaggctggagtgcagtggcatgatcttgcaggctctcactgcagcctccgcctcctgggttcaagcgattctcct

SEQ ID NO: 45078 - DNA, 201 bp, Homo sapiens
ttcttgaatctgtatgtttgtttgttcatttgcaaaaattgggaaccttttagtgatttagtgattatttctttgaacactttttttttttttttttttttgatacggagtctcgctctttcacccaggcctaagtgcagtggcgcgatttcggctccctacaagctccacctcccaggttcacgccattctcctgcctca

SEQ ID NO: 45079 - DNA, 201 bp, Homo sapiens
atggcctccaggccccagacagtcttatgaggggaaggcagaaacagcccctgggatcaggaaagtctcctgcttttaagcccacagaggaggagcctgtyaaaatagcagagtcccggcagacagcaactatgcgtccacttgtgcttccttaaggcataatcatgaaagctgcctaccttcattcccaaaagcatcctg

SEQ ID NO: 45080 - DNA, 201 bp, Homo sapiens
ttttatttgaggagagaagtagccataatgttccccctttctattgaaacctgtagaaaatctgtccctgatgtttatgcctccttagcaaacacccccastggccccttccttttctgggatcctgttctaaagtgagcttcttttccaggtcgcctgaactggtggtccactgtgtgcacgagctgtaaacggcttctt

SEQ ID NO: 45081 - DNA, 201 bp, Homo sapiens
cagtggtgggaaatttgtacaagaaaaaacagacttttccaaatccatgtgtgtaagttccattccatgtgagtcttttatttacgaagagacctggagtraaagctgaaggcatctactgtatgtttggggctcctttctttatggccatgattttttttctcctcatcttggtgtggactttaaaattaagtaccccca

SEQ ID NO: 45082 - DNA, 201 bp, Homo sapiens
ttctagaaatgtcaattacctcaaattctctgagagtgcagctcagttcttctatatccttactggtttctgcctacttgctctgtcagttactgagcaayaagtagcaaagtctgcagctgtaatacatttgtttatttctctcatttttgttagtatttgcttcatgtactttgaagctatgttgttagcatgcataca

SEQ ID NO: 45083 - DNA, 201 bp, Homo sapiens; identical to SEQ ID NO: 22685

SEQ ID NO: 45084 - DNA, 201 bp, Homo sapiens
ccactatggacctgttatacccctatttttaattgttagtggtttccctagggtttgcaataaacatctttaattaatgagatttgtttttttttttttttttgagacagagtctcactctgtcactcaggctggagtgcagtggcatgatcttgcaggctctcactgcagcctccgcctcctgggttcaagcgattctcc

SEQ ID NO: 45085 - DNA, 201 bp, Homo sapiens
acataaatatggctactctagctctctttccattagtgaatatcttttaacctccatatgtctttatatttaaaatgggattctttttcttttttttttttcctacaacctcaacctctcaggttcaagcaattctcctgcctcagcctcccgagtagctaggattacaggcacacactatcatgcccagctaatttttgt

SEQ ID NO: 45086 - DNA, 201 bp, Homo sapiens
agtttcttaaggcagaaattttgattactaatttgagactgttttctcatctaatatgagcattttaatgctataacttttcccctaagtactgctgtaamtacaccatacaaattttgatgtgctatatttgcattttcattccgttcaaactattcgttaatttcccatgagacttcctctgacttatggattatttag

SEQ ID NO: 45087 - DNA, 201 bp, Homo sapiens
gtggtggctcatgcctgtaattccagcactttgagaggccaacgcaggcagatcacttgaggtcaggagttcgagactagcctggccaacatggtaaaacyctatctctactaaaaataccaaaaattagccaagtttggtggtgcatgtctgtgtcccagctacttaggaggctgaggcaggaaaatcacttgaacctaa

SEQ ID NO: 45088 - DNA, 201 bp, Homo sapiens
atctcttgaacctgggaggtggaggttgcagtgagccaagcttgcgtcactgcactccaacctggatgacagagtgagacttcatctcaaaaaaaaaaaaattaacatataagtcaattatttaaatagtttttccctcatatatacaaacagcctgtgagcctctgaggcatatccaggggccacacagaggtcagggca

SEQ ID NO: 45089 - DNA, 201 bp, Homo sapiens
caaaagtttttctaaaataattgtgcctttttacaatcccaacagcaaagtatgaaaactccagttgctccatggccccttagacatctgtgctagtatgyaaaatacaattgactcttgaacagcacaggtttgaactgcacaggtccacttccacttatatgtggatttttttcaaccaagtgaggatcaaaattacag

SEQ ID NO: 45090 - DNA, 201 bp, Homo sapiens
ctcctgagggccttaattttcaagcttactcgcagtctttatccttcatatttcattatttctattctgatagaaacaacaccttttattaaaattagatwtttttatttgtacaaatttatggggtatatctgaaatttcgttacatgtatataatgtgtagtgattgagtcagagtgttcatcacccgagtacaataca

SEQ ID NO: 45091 - DNA, 201 bp, Homo sapiens
aagatactacctcagactgggtaatttataaacaaaaggggtttaattgactcacagttcagcatgactggggaggcttcaggaaacttacaatcatggcrgaaggggaaggggaagtaggcaccttcttcccaaggtggcaggagagagacagcacagggaaaactgccacttttaaaaccatcagatctcatgagaact

SEQ ID NO: 45092 - DNA, 201 bp, Homo sapiens
catcttgtgagccaggcgacagcagtccatggcaaggggagtggaattgcacagatcgtcttggacgtatgaacatttgcacgttgccccatggggcaggsaaggaggcttgcctgaaaagccccagacacaagcagggcgctgtcagcaaggatgggagggaaacgctgtggggcgggcaagacaacgaggtctgccgca

SEQ ID NO: 45093 - DNA, 201 bp, Homo sapiens
tgtggagacccccccttagaagcacacctgtgcacactcagcagtgacagtttttgcataaagctaccttatgcatgtgtgaacgttttcattgaaaatarcaatgttaaagacaacattctctttaaaatactaaacaaaggcaacctacccttaaatagcttttactgttttccctttcacatgtatacatattttata

SEQ ID NO: 45094 - DNA, 201 bp, Homo sapiens
gaacccaaggtaactcccaatggctatttatttcagagacacagtcccagatgtgttagcaactagttttattgagaaataaggctgctctgaatttcttrtatgagtcttatgttttcatttctcttgggtaaataaatatccacgagtggaattgctgggtcatatggtaaaggtaggtaatagtccatttcacactgc

SEQ ID NO: 45095 - DNA, 201 bp, Homo sapiens
tgtgaggtcatcattatcccacacaactcagagtctgaaaacagggatgttcatggcagggctggcagctgcacagtgttatggaggacccaggcacacayagcaccctgctcttctctccccagcgggtcagtgctagctccagctggggatgcagtgtagctgtggccgcatcaggccacacatcctcacactgcatca

SEQ ID NO: 45096 - DNA, 201 bp, Homo sapiens
gcagacagcccacacccctccaacagccctgggccatgtcctggaggcactcagtcactcaggtgtgttcccacccctccgcagaccacatgtgtgttaaagactaaaaagaaaggaagacagaatgcatagagtcatttggcaaaagctatggtagaatcagaactggcagagaaagaggcaagggcagtttatggcctg

SEQ ID NO: 45097 - DNA, 201 bp, Homo sapiens
ggttgcagtgagccaagatcgcgccactgcactccagcgtgggtgacagagcgagactctgtctcaaaaaaaaaaaaacaaaaaacaaaaacagaacccaaggtaactcccaatggctatttatttcagagacacagtcccagatgtgttagcaactagttttattgagaaataaggctgctctgaatttcttatatgagt

SEQ ID NO: 45098 - DNA, 201 bp, Homo sapiens
ttagactggccttttttgtgatctgattttgtcctggatgtgtgagggctcctgttaaggttcagcggatcgtgggcaagtttacttactccctgtgagcstcagtttccttctctgtaaaatgggaataacatcccctgacacagagctggttgatttattgaaggtcctgcagtgtgcaggagaacacactaacccagc

SEQ ID NO: 45099 - DNA, 201 bp, Homo sapiens
agcagacagcccacacccctccaacagccctgggccatgtcctggaggcactcagtcactcaggtgtgttcccacccctccgcagaccacatgtgtgttaaagactaaaaagaaaggaagacagaatgcatagagtcatttggcaaaagctatggtagaatcagaactggcagagaaagaggcaagggcagtttatggcct

SEQ ID NO: 45100 - DNA, 201 bp, Homo sapiens
tggcatgaacccaggaggtggaggttgcagtgagccaagatcgcgccactgcactccagcgtgggtgacagagcgagactctgtctcaaaaaaaaaaaaamaaaaaacaaaaacagaacccaaggtaactcccaatggctatttatttcagagacacagtcccagatgtgttagcaactagttttattgagaaataaggct

SEQ ID NO: 45101 - DNA, 201 bp, Homo sapiens
taaaattggcttgccacaaactcaaccataacaaacaaaattagactggccttttttgtgatctgattttgtcctggatgtgtgagggctcctgttaaggktcagcggatcgtgggcaagtttacttactccctgtgagcctcagtttccttctctgtaaaatgggaataacatcccctgacacagagctggttgatttat

SEQ ID NO: 45102 - DNA, 201 bp, Homo sapiens
tctcctcgacgtgtttctttctcctccctgatggcagcagagattgttcttgactagctgccctgcctatcaacggcaggtggccaggagaaatctggtcrtgtgaggaccaggaccaagcccagaggggctcctgtctcctgtcgtgtgcctagggcatagcagacagcccacacccctccaacagccctgggccatgtc

SEQ ID NO: 45103 - DNA, 201 bp, Homo sapiens
agcctgctgtgggtttgatacctgggggatacagtcattattgggctaaaacattgaaatacatcctgttctcggagggaccagaacagagtccagactgktccagctagtttcccgtgatctcaggatactgcattcccagcacattcttttttttttttttttcctggagacagggtctccctctgttgcccaggctgg

SEQ ID NO: 45104 - DNA, 201 bp, Homo sapiens
caccagaaaacaaacatttcaagcaggttgcattgagctgagataacgccactgcactccaggctgggtaacaaagcaagactctgtctcaaaaaaaaaaaggtaaattgagtcataagaaaaagaaaaaacatgggtagtatgtaaccaaaattccacaggtgatggtaatgcattccctaggattcacaccctgcattc

SEQ ID NO: 45105 - DNA, 201 bp, Homo sapiens
gcaggttcactgtgcgctgcttccttgccaagtctcatgcatgtgtacaggttgcacaaagcaggtgtcttacagacaggcagtgagggacaatagcagcytagggttcagggtaagacagtcacacaagagttaggacagtgcccagggtgcatgctgtcttgtgctgcagctgagggaccccagaaagcagcctgctgt

SEQ ID NO: 45106 - DNA, 201 bp, Homo sapiens
aagtcttaaagaagaatcctcagtctctactgcaggggagaggccaagccagcgcctccccagaaccggtggcagaggaataaacattgtgtacagcacayattcgtcagcatttaatagtatcatttatctgaagatttgaatatataatgtatttttaaatactgtcttcatgtgatataatgaaaaaaattgccaaat

SEQ ID NO: 45107 - DNA, 201 bp, Homo sapiens
caaggttgtaggtagaccccaccatgttaccttctccttgagccctaccatgcttagcaaaagccttcacttcttttgaacgtcttttctgttatttttttccatattttgcattttaatttttatcacttatattttaccttccagactagcattttaagatgggactctggcttcatccagtcttgaaaaatacctttt

SEQ ID NO: 45108 - DNA, 201 bp, Homo sapiens
ctcccaagtgtagacctcggggtcatatgaccctgggttactctccttatatctgtaataaaggctggaacaagcagaggccctgctgatctgcacagtcygtagggataggaaggggaaagtcctgctatgcctagacactggcagtgagccaggttggggagagagaaagctcaagggaaaggaattggggtgtgggga

SEQ ID NO: 45109 - DNA, 201 bp, Homo sapiens
agaaattctcatctcagctgcttcgcagccatcaagagcaatccaatgactggcacccacagccttgctctgtcttacctcagcaagactcaacaaacataaaacaattcagctagattagcaataatctaaaccactcactgtgggggctggctattttaaagacgcttctatatgactaattcagataagatattttca

SEQ ID NO: 45110 - DNA, 201 bp, Homo sapiens
tctccaaaacacacaaccctcacacaggaatgcagtccttgtttgtcaaacttgcatccccaacaaacatggctttaactgggtgccatgacctacatcargggccagcccccagacctctctctctttggacctgcggtgaggcctattcagcaagaggtaggtgagataagactgtaaagggcttcaagggaaatacat

SEQ ID NO: 45111 - DNA, 201 bp, Homo sapiens
  misc_feature (1)...(201): n = A,T,C or G, or insertion/deletion polymorphism (see Tables 1-2)
ggaggatttggccacttcttgtcctcaaagggaaaagaaatctatattttatttgaggagagaagtagccataatgttccccctttctattgaaacctgtngaaaatctgtccctgatgtttatgcctccttagcaaacacccccagtggccccttccttttctgggatcctgttctaaagtgagcttcttttccaggtcg

SEQ ID NO: 45112 - DNA, 201 bp, Homo sapiens
  misc_feature (1)...(201): n = A,T,C or G, or insertion/deletion polymorphism (see Tables 1-2)
gacagtcatcttggagtcaggcctgtaggcagatatatgcaggacaaggaggccatctctgcaagagagacctgcccaaggagctgtgggagagtcccagnaggcagctgaaagaggtctgaggatgagcgaggagtgacagtggtcattccccctcccctgccatcctatagaaaaaggcgaagccttgctggctagaag

SEQ ID NO: 45113 - DNA, 201 bp, Homo sapiens
cagtgcctcttaatggcagaagggcagattgcggggagctcactgatgtggtccacgcaggtcaccctctgcatacagagcagcatggagaaggatagacrgtagatctgtggggccaatgggaaacatccagaaagtcaatgtgccgggaagttttaccagacctggcttctgtgtacacgtgtacacctgctttcatgc

SEQ ID NO: 45114 - DNA, 201 bp, Homo sapiens
ctttatggccatgattttttttctcctcatcttggtgtggactttaaaattaagtacccccagtgttctgtcctttttctttcctcagtgcttctaatagrtaagaagaaatgtgtttctgtggctgagcaagccctgctgggccagacagaccttaccagccctggcttcatcctcgctgggctgcagaggcggcccctg

SEQ ID NO: 45115 - DNA, 201 bp, Homo sapiens
catttcatcaatctaaaaaaataaaaacaaaacaccgcaggccaaaaaaaattccttgtaagtcctttaatcctcaagtttatataaatgctattaaaatsctgtaaaaaaaatttcaaataaatttaaaatacaaaatcaaatagctgcaaaatttaagtccacgttattctggtaagtatgaatttaaaaaatgtaaac

SEQ ID NO: 45116 - DNA, 201 bp, Homo sapiens
cttgaacatcttcacatctacaggaaaattggaagatgagtatttatatatcttgcaccaaaaatcaccagttttcgggactttgtcacatttgctttatytctctttatgtgtatggaagtacatacactttttctgaatcatttgaatgtgtattgtggatacttcacttcttctgaaaataaagacattctcctatat

SEQ ID NO: 45117 - DNA, 201 bp, Homo sapiens
gctgtgttacgttgaaattttacaagccaagtttaaactgtactataaaaattatttttgtattattttcagaacatgccacagagcaatattttgcaccygttattgccacagggttgtcccttggaagggtaactggaggtgggaaggagctccactgtgggctccggggggttaaacgctttttgctgcttgttcaaa

SEQ ID NO: 45118 - DNA, 201 bp, Homo sapiens
tgaggcaaaagaatggcgtgaacccaggaggtggaatttgcggtgagctgagatcgcaccactgcactccagcctgggcaacagagcaagactccgtctcmaaaaaaaaaagtttaaacaaatttaaaaatattaattataaagaaaattctgtatgtaaacatattagctaaagaggtatccaatttttctgtaaactaa

SEQ ID NO: 45119 - DNA, 201 bp, Homo sapiens
cctcattttcaacttgaatcagttggtctttattgcacagacctctgaattgaaaagggaaatcaggtctttcacctcctttgtgggaagagtgatgattsgttagcgtgtctgccatggaaagtgtggtgatttttcaatgctgcttgctatggtgtagaggggattgacagaagacacttcagagaagtcacctattag

SEQ ID NO: 45120 - DNA, 201 bp, Homo sapiens
ggaacccctccatccctctggcccccactgcttccttgtgaaacacccccagaaagccaatagccctgctaccacaggctctggtgggctgcctccgcctrcagagagactcgccttcacagcggccggcacccttcacctgcgggctctttccaactcatcttctgagaccgctcccacggtggggtaggggagctggga

SEQ ID NO: 45121 - DNA, 201 bp, Homo sapiens
ctactaaaaatacaaaaaaaatagccgggcatggaggcaggcacctgtagtcccagctactcgggaggctgaggcaaaagaatggcgtgaacccaggaggyggaatttgcggtgagctgagatcgcaccactgcactccagcctgggcaacagagcaagactccgtctccaaaaaaaaaagtttaaacaaatttaaaaata

SEQ ID NO: 45122 - DNA, 201 bp, Homo sapiens
agtggttaagtaagttgcccaacaccacactgctaagaaatagtggaactgagatttgaacccaggaagtctaactccagcttctgtgcctaaccagtctrctggctgcctctctgatgactaccttagacactctagtccagattctgcaagggtaggtgttccaaagcccactatttcatcctcattttcaacttgaat

SEQ ID NO: 45123 - DNA, 201 bp, Homo sapiens
gagaaattctcatctcagctgcttcgcagccatcaagagcaatccaatgactggcacccacagccttgctctgtcttacctcagcaagactcaacaaacataaaacaattcagctagattagcaataatctaaaccactcactgtgggggctggctattttaaagacgcttctatatgactaattcagataagatattttc

SEQ ID NO: 45124 - DNA, 201 bp, Homo sapiens
aagaaagacacggtaaaattaggaaaagaaataatgtaaaaggcagaacgttaaaacatgttaaaaattgtctataaaagtcataaaaagttataaaaaaatttatgcaaaaaatattacgtaatttaaaagtaattaggcctcctaaatgtaaaactatttaaaaaacagtttatacagtttatatacaaaatatgtaaa

SEQ ID NO: 45125 - DNA, 201 bp, Homo sapiens
cttgatggcttcaaatttcaaacagcttgtctctgagccctccaaagatatcataccctttgattgggctcttttgacaatcagaaccatggatgtggtcrtctgggataggatggggtgggcactatggcaactatgcttttgataatagcagccttcacgtattggggatctcctatgtgctaggtgtattatacgcca

SEQ ID NO: 45126 - DNA, 201 bp, Homo sapiens
ggctgttgcagagagaatatgggtgtgcatgtgtatgtgtgtgcacacatgtatgtgtacgtgtgtatgcatatagtctgtgcatgtatgtacatgtatgygcgctgtgtgtcctgtgtatttgtgtgtgcaaatacatctatatgtgtacacgtatatagtatgtgtatagtctgtagtgtatgtgcgtgggcatgtatg

SEQ ID NO: 45127 - DNA, 201 bp, Homo sapiens
aaagacaaaaatcaaagaaagacacggtaaaattaggaaaagaaataatgtaaaaggcagaacgttaaaacatgttaaaaattgtctataaaagtcataaraagttataaaaaaatttatgcaaaaaatattacgtaatttaaaagtaattaggcctcctaaatgtaaaactatttaaaaaacagtttatacagtttatat

SEQ ID NO: 45128 - DNA, 201 bp, Homo sapiens
caagaccagccagagaatctctcctctctccccctttccctcttccctcttccgtattccctttatattctaccatctaccctttctctgtaaatctctcygactttccttttctctgaccactaaaccctcttttggtcctcagattaggtcaggccaacccaggataatctcccttttgatcaactcagagtcagtgaa

SEQ ID NO: 45129 - DNA, 201 bp, Homo sapiens
acaaagcctaaaatatttctgtctcaccctttaggaaaagttttgtccacctgttttaaaatatacccaggatcggttttaatcaggtgtcataagacacrcagacacagaaatgactgtcatgaaggtggaagttgttttttttttttaactcacagttccttggaaacaggaggcccagcacagcatgcagggccacac

SEQ ID NO: 45130 - DNA, 201 bp, Homo sapiens
aaatgcaaattaaaaaaaaaggaaaataaagtgcaaataagaaaaaaaaatagaaaaaagtaaaaaaataactagaaaagacaaaaatcaaagaaagacayggtaaaattaggaaaagaaataatgtaaaaggcagaacgttaaaacatgttaaaaattgtctataaaagtcataaaaagttataaaaaaatttatgcaaa

SEQ ID NO: 45131 - DNA, 201 bp, Homo sapiens
  misc_feature (1)...(201): n = A,T,C or G, or insertion/deletion polymorphism (see Tables 1-2)
tgcccttgagcattcaggtgtttctctgtgcatagctcccgttagcagcatgcacttcagggacacgagtaaacctcccagacacctgctgaacactcccnggatacgcctcccaggatacacatgtgaaatgaatggacagaattcctatttaaatatccttgggctaaaggacgctgtatgcatttctatttctgccta

SEQ ID NO: 45132 - DNA, 201 bp, Homo sapiens
cacatccctatttattctgcacatgaatgcattattagtcccattaacatttttttaatcccaagttaattctttgtctttattattattattattattttgcattctgatattctatttatctctttgcatgtatttactaggctcattttttaatctagtcctcctggccagtactttgttgcctttctttaacagttt

SEQ ID NO: 45133 - DNA, 201 bp, Homo sapiens
tatacatatatatgtgtgttacatatagatatacatatatatgtgtgttacatatagatatacatatatatgtgtgttacatatagatatacatatatatkttacatatagatatacatatgtatgttacatatagatatacatatgtatgttacatatagatatacatatgtatgttacatatagatatacatatgtatg

SEQ ID NO: 45134 - DNA, 201 bp, Homo sapiens
gctattcacaatgccagtgcccgtgtcttgttcctgttctgtggttatgtcatggggagttgggaatgaccactctgtcaaagccaggaatagaaacatgraaccatgaaactttgcatgttcccaatcgcactccttgtatggagcacacctttatctcgggcaccacattctaggttctgctggatgttagaatagcac

SEQ ID NO: 45135 - DNA, 201 bp, Homo sapiens
ccttgttctcatgtcttctaagagattcacttgacctgatgttttcacatccctatttattctgcacatgaatgcattattagtcccattaacatttttttaatcccaagttaattctttgtctttattattattattattattttgcattctgatattctatttatctctttgcatgtatttactaggctcattttttaa

SEQ ID NO: 45136 - DNA, 201 bp, Homo sapiens
ctcatttagcttccttttcgtcatgcaaatatctctagcaagtagttgctcctcaggctgcttgaattcttctgaaaaagctttttctttctttgccacayggctaggctgcaaatttttcaaacttttacattctgcttcccttttacattctgcttcccttaaatataagttccaactcctatctttgctgcagcatct

SEQ ID NO: 45137 - DNA, 201 bp, Homo sapiens
gaaatccccatgggggaggagttgaacctcacacaaacctccgatagtaaaatatatatacatatatatgtatgttacatatagatatacatatatatgtrtgttacatatagatatacatatatatgtgtgttacatatagatatacatatatatgtgtgttacatatagatatacatatatatgttacatatagatata

SEQ ID NO: 45138 - DNA, 201 bp, Homo sapiens
ccagaggagcaaaggacatgaaggcaataccgcagtcccatggcaggagctctcacagaagcacgtgcaaagcacagtgatgcccagagaggggacatccragggcccaggtggggagggagcactccagtgatattaaaaggagttacagtgtcacatttagggcaagaatcccctcatctttctgatagagaattgtca

SEQ ID NO: 45139 - DNA, 201 bp, Homo sapiens
agcactcatttagcttccttttcgtcatgcaaatatctctagcaagtagttgctcctcaggctgcttgaattcttctgaaaaagctttttctttctttgccacatggctaggctgcaaatttttcaaacttttacattctgcttcccttttacattctgcttcccttaaatataagttccaactcctatctttgctgcagc

SEQ ID NO: 45140 - DNA, 201 bp, Homo sapiens
tccacccatcagtcaggcagagtcgcggctgcgactctgggcaagcctggaaataccacgttcctttgtgggccaggtgcagcgttgggcaaccctgggcrtagggcctgggccagagtgtgggagagacagaggccagggttcacatctcctcagcgtagtggtcacagtgtggttcctgtgcagccccctgagggggcg

SEQ ID NO: 45141 - DNA, 201 bp, Homo sapiens
agacaggttgctatttcacagcctagagacaaagaagtgactaagtaactgcgtgttttttccaatgacgtccacaacggtccatccagtggtagtgtcarttaaagcccttacttgcatttctcatttagctttaataaggtgacttgtaggtggtaagaatataccaatttgttagtgtaagcattaacatcttcatat

SEQ ID NO: 45142 - DNA, 201 bp, Homo sapiens
catgaacccagggctcaggtggttctgaaaactggcaaacagtggccttcactcagttaacattgcccaccatccagctgtccatcctggggcctgattcyactctcctggggccctgcgtggtatctgcctggcctcccgagccacataggcagccccgtctatttttgaggcctctgtgtcaagtggggtgccagtctg

SEQ ID NO: 45143 - DNA, 201 bp, Homo sapiens
  misc_feature (1)...(201): n = A,T,C or G, or insertion/deletion polymorphism (see Tables 1-2)
gaagcagcagcctgaactgtatctgggaccttttgagccaaggctggagctggagcagccaggatgtggggagcagtgtcccaaggctacacaaggtagcngggccctgggcctggcccatgaaaccattctttccaactaggcctgtaggcctttgatgggaggggctgctgtgaaggtctctgaaatgccttcaaggct

SEQ ID NO: 45144 - DNA, 201 bp, Homo sapiens
caggcggatcatgaggtcaggagatcaagaccatcctggctaacacagtgaaaccccgtctctactaaaaatacaaaaagaaattagccgagcgtggtggygggcgcctgtagtcccagctactggggaggctgaggcgggagaatggtgtgaacccaggaggcggagcttgcagtgagcggagatcgcgccactgcactc

SEQ ID NO: 45145 - DNA, 201 bp, Homo sapiens
agctttaataaggtgacttgtaggtggtaagaatataccaatttgttagtgtaagcattaacatcttcatataataaatagatgttcgtctacttaacttygtagtgttaattttaatacatgcttttatttagaattaagggcgcagttattttttatcagtaatgccacttattacaatggaatcactgaatcttaacc

SEQ ID NO: 45146 - DNA, 201 bp, Homo sapiens
  misc_feature (1)...(201): n = A,T,C or G, or insertion/deletion polymorphism (see Tables 1-2)
gagagagtgagttggaaggcagaggtgctgcatacttttaaatgatcagatctcatgtgaactcagaatgagagctcacttatcaccaaggggttggcccnagccattcatgagggatctgcccccgtgatccaaacacctcccactaggccttacctccaagatggcggattgcatttcaatatgagatttgggtggtga

SEQ ID NO: 45147 - DNA, 201 bp, Homo sapiens; identical to SEQ ID NO: 3655

SEQ ID NO: 45148 - DNA, 201 bp, Homo sapiens
ccacccaggctcaagcaatcctctcacctcagcctgctgtgtagttggtaccacaggcatgcaccatcacactgggctaatttttttttttttttttttgrgatatcgtgtctcactatgttgcccaggctcgtctcatactcctgggctcaagcagtcctccaacctcgacctctctaagagctggaattgcaggcacga

SEQ ID NO: 45149 - DNA, 201 bp, Homo sapiens
gatctattaactgggatatagatcaatagaaattcccaatgtgaacaacagagagaaaattgaacctttaaagtgtaggcttagggacaggtgggacggtaaaaaaaaaaaaaaaaaaaaaatctatcattcttgtcactggagtcctagaaggagaggagaaaaatgcatatggctaaaaaattaaatagcagctgaaga

SEQ ID NO: 45150 - DNA, 201 bp, Homo sapiens; identical to SEQ ID NO: 22770

SEQ ID NO: 45151 - DNA, 201 bp, Homo sapiens
tagcaatgggcttagcaggcaagattccctaccctctggtgccttcctgtgtatccagcatcacagttcatcacacgcccagtgctctggctacattcagyttattgtgaagcaaaccacaggcttgcacatttgtagttccttcttcctggaatgtcctttcacttagaatcctaatcatccttatcagtcaggcgtggt

SEQ ID NO: 45152 - DNA, 201 bp, Homo sapiens
ttgtctttctgtgcctggcttatttcacttaacataatatcctcctgtttcatccatgttgttgcaaatgactggatcccgttctttggtatggctgaatrgtactccactgtgtatgtgtgccacgttttctttatccattcatctgttgacagacaccctttcccatttggctccgcttgcatgacttctgtgtggcta

SEQ ID NO: 45153 - DNA, 201 bp, Homo sapiens
tgaggtgagaggatcgcttgagcctgggtaggtcgagtgcagtgagcccatgatcgtaccactgctctccagcctaggtgacagagtgagaccctgtctcaaaaaaaaaaaaaaaagggaaaagagaaagaaatagcacatgaagctcaggcatggtggctcacatctgtaagaagttaaataccagcctgggctatgttg

SEQ ID NO: 45154 - DNA, 201 bp, Homo sapiens
gaggtgagaggatcgcttgagcctgggtaggtcgagtgcagtgagcccatgatcgtaccactgctctccagcctaggtgacagagtgagaccctgtctcaaaaaaaaaaaaaaaagggaaaagagaaagaaatagcacatgaagctcaggcatggtggctcacatctgtaagaagttaaataccagcctgggctatgttgt

SEQ ID NO: 45155 - DNA, 201 bp, Homo sapiens
taagtaacaaccattaccgcagtcaactttagaacattttcatcatctcaaaaaggaacccatgccctttctctatcccctttattcccatcctctccccycttagtgctcagtgaccaccactctattttctgtctctagatttccctggtatggatgttcagatgaatggaatcatataacgggtggtcttttataacc

SEQ ID NO: 45156 - DNA, 201 bp, Homo sapiens
aaatccagtgtgaaaattttacctgtatattttcttctgagagctttagttttagcttttacatttaggtctttgattgattctgagttaatttttgtacrtggtatgaagtaagcatctaacatctaacatcgttcttttgtacgtggctatccaattttcccagcactatttgttgaaaagactcttttttctccattg

SEQ ID NO: 45157 - DNA, 201 bp, Homo sapiens
gtcttcttagactcggagctattgttattgtttctgtctaattcatactgagcttttaatgtgtgccaagtaatccacagagcactcctttattttttttytagctcttaaagagcatctgtacaagtcttttggcatagataataggctgtactggaactagcttgataaaaaaagaaaaaagcagttaggggaccaggg

SEQ ID NO: 45158 - DNA, 201 bp, Homo sapiens
tcttcttagactcggagctattgttattgtttctgtctaattcatactgagcttttaatgtgtgccaagtaatccacagagcactcctttattttttttckagctcttaaagagcatctgtacaagtcttttggcatagataataggctgtactggaactagcttgataaaaaaagaaaaaagcagttaggggaccagggt

SEQ ID NO: 45159 - DNA, 201 bp, Homo sapiens
cttttcctttttccttcttccttcctcctctctttccctccctcattccctccctccttcattcccttcttccctctcttacagcctgaagataatggaakcactcactttttcttcataattgctaagactttagttagtagaatgataattccttttcaacagcactttgtcatttgttcattggttagcagtaagaag

SEQ ID NO: 45160 - DNA, 201 bp, Homo sapiens
gcttattgttgcctgccgccgggtccgagcctgcagaagctgacagctgcctgtggccacccgcctgcgcatgcgcgcttctggaagacccaggccccccycccccgcagccccgcctcgagttccgattgggcgcacctctggtgacgtcacggggacgggcgttcgccgaaggcgcgtgtcttcggcgatgtcacagca

SEQ ID NO: 45161 - DNA, 201 bp, Homo sapiens
tgaggcaggagaattgcttgcacccaggtatcggaggttgcagtgagctgagactgtgccactgcactccagcctgggcgacagggtgagactctgtctcaaaaaaaaaaaaattaaatgatgggatggctactgagcataggaactaataaaatgccatgaataatgttaattctttgccagagcattttagaaattcta

SEQ ID NO: 45162 - DNA, 201 bp, Homo sapiens
agggcagtggcatgatctcggctcattgcaacctccacctcccagctttaagcaattctcctgcctcagcctcccgagtagctgggagtacaggtgtccaycaacatgccccgctgatttttgcatttttagtagagacggggatttaccattattggccaggctggtcttgaactcctgagcttgtgatctgcccgcctt

SEQ ID NO: 45163 - DNA, 201 bp, Homo sapiens
tatgcttcaaagacctgtgggttgcaaagttaccacttttgagggcacatgctccatgaagcaccttatgtgacaatttacaattattgttttgttttgtyactctgtagaaacctcaaatgaaggtgtagttgggctcaagcatccagattatcttttctcttcttattttttcttcttttcccaagatggagtcttgct

SEQ ID NO: 45164 - DNA, 201 bp, Homo sapiens
ctgggttcaagcaattctcttgtttcagcctcccgagtagttgggattacaggcacctgccaccacacacggctaatttttgtatttttagtagagagagtgtttcatcatgtcggccaggctggtctagaactcctgattttgtgatctgccagtctcggcctcccaaagtgctgggattacaggtgtgagcgatcgtgc

SEQ ID NO: 45165 - DNA, 201 bp, Homo sapiens
tccttttgtccttatagctcaagctgtaaaagccaaaggtccaccccttttttccagtctcatgttgaagatctttatgtagaaggccttcccacaggaatttttttttttttttttttttttttgtgtgacggagtttttactcttgttgcccaggctggagtgccatggcgccatcttggctcactgcaacctctgcct

SEQ ID NO: 45166 - DNA, 201 bp, Homo sapiens
agcctgttttatgtatttttatgtaccactttttaatttacctgggtccaacattgagtcagtcatgccagtgttacctttcgaaacatgaacactgcccrcacctgactggcgtgcaactgacattttctttcacaattttctgttacttttgctaaaaatagaatagtatccatgtcttgtttttaggcctgagatttt

SEQ ID NO: 45167 - DNA, 201 bp, Homo sapiens; identical to SEQ ID NO: 3656

SEQ ID NO: 45168 - DNA, 201 bp, Homo sapiens
ttgggtctagactagaaacagactttttggattttgtattcttgatcttctttagtccgtgatgcccttgctcttggtattttgcttgtttctgttagtarcataaaggaaagcttttcgccatacacagcagcttggtagcagacaaaatacaaataaccttctaaggaatttgaagaatattttcacatttttttagag

SEQ ID NO: 45169 - DNA, 201 bp, Homo sapiens
gccactgcgcctggtcataatgttttctataatgttgttttattttaggaaagtaaatacaatgagtaggacacagctccacgattctcttaactgttttkttgttgttgttgttgttgttgttttttgaggtggagtttcactgttgttgcctaggctggagtgcagtgctgtgatctcagctcactgcagcctgtgcct

SEQ ID NO: 45170 - DNA, 201 bp, Homo sapiens
gaattggaaacagggaattacgctgtttgtagatgatttcttttcaagatgggctagtggagtttctgagcagcagctacgttctcctttcacatcttcakgtttcataaggttacctttagccctctgagtgatcagatttccctcacagtcactcacgggagcccttgatcttgacaaaatagaacttgagtagctgag

SEQ ID NO: 45171 - DNA, 201 bp, Homo sapiens
agagacaagagtttttccatgtaggcccggctggcctcgaactcctgacctcaagtgatccacctgcctcccaaagtgggattacagatgtgagccaccaytatgtttttattatattgttaatttagtactattctgagtaaaaataatttgctattacagtcttataaattgactatgacaattttataaatgtcaatg

SEQ ID NO: 45172 - DNA, 201 bp, Homo sapiens
gggaggcttgaggggaagaccacctaagcccaggaatttgagcttgcagtgagctgtgatctcaccactgcatgctggcctgagtgagactctttcacagaaaaaaaaaaaaaaaaaaaaggaaaaaagaaaacccaaaagaatttatattgaaactatagaatttcatctccatcttagagatgaaattctaaaataacc

SEQ ID NO: 45173 - DNA, 201 bp, Homo sapiens
aagctagcctcccttctcagccacctgagtagctgagactacacatgtgtgccactgcacccagctaattttaaaattttttatagagacagcctctcacttttttttttttttttttttaagttggagtcttgttctgtcgcccaggctggagtgcagtggcacgatctcagttcactgcaacctccacctcttgggttc

SEQ ID NO: 45174 - DNA, 201 bp, Homo sapiens
caatgggcttagcaggcaagattccctaccctctggtgccttcctgtgtatccagcatcacagttcatcacacgcccagtgctctggctacattcagtttrttgtgaagcaaaccacaggcttgcacatttgtagttccttcttcctggaatgtcctttcacttagaatcctaatcatccttatcagtcaggcgtggtggt

SEQ ID NO: 45175 - DNA, 201 bp, Homo sapiens
aattatttattgctacagtgcacaacaatgaaagaggggaagcaacccaaatgcacagcggtagaggagagttgaataagtcagttaatataatgcaatgytataaagccaccaaaaatgtttggtgggttagataaatagaagtgtccataaaatatgtaaattatcaaaacatgcattaaatctatttaagagtatgta

SEQ ID NO: 45176 - DNA, 201 bp, Homo sapiens
actgggattacagttatttgttactctttttattttctagtccgttgtgctgaactgcatttatcttttaaatagactttaaatattctttggcagaaagkgaggaataaatgcatatattctatgtataaaatcagtaaaaccaaatacaaattatcaagcccactgttgtaagggccatagggaaataagcgcatacac

SEQ ID NO: 45177 - DNA, 201 bp, Homo sapiens
ttcagatttgcccaatatcctaagcaaaatgccttcaatatgaagtgaatattgcttgattgtagggaacttgtccataatgtacttgagaatgcagatamaaataaaagaatgtctgtgtcaaattttatttttcacaaattatgttctctttcagcttaagctcttggactcactgaggcagtaaaagaaccatatcct

SEQ ID NO: 45178 - DNA, 201 bp, Homo sapiens
ggtttacaccattctcccacctcagccccctgagtagctgggactacaggtgcccgccaccacacccggatacttttgtttttgtatttttcgtatagacwgagtttcaccatgttagccaggatggtctccatctcctgaccttgtgatctgcccaccttggcctcccaaagtgttgggattacagacgtgagccaccaa

SEQ ID NO: 45179 - DNA, 201 bp, Homo sapiens
gaatcctgtctactgtgtgtctgatgacatgaacttactgagtgctgcttagttgcatcatagacaccacctgtctttgaacagctaccctgactcttgayggaatgcaaaggctgccgagggccactggtgtgtggaatggccttcggtcatttctgcttagaacacagaggtcattttggctactaacataactcttct

SEQ ID NO: 45180 - DNA, 201 bp, Homo sapiens
tttacttgtcttggaagagtagtttttaggactctttaaaaggttacaatatggatgacaatcttggctaatggtaaccagatccagggagctggggtagygttagctggaatcagttcaaattagcaaagcagtggtgttcagtggcaggaatacaagtgtccacatcttgtttaacacaagatatgttaaacacatctt

SEQ ID NO: 45181 - DNA, 201 bp, Homo sapiens
tgaggcaggagaatctcttgaacccgggaggcagaggttgcagagagccgagatcttaccattgcactccagcttgggcaacagagtgagacactgtctcaaaaaaaaaaaaaatgcctaatatgagcgctatggtagttaccagccaggaaccgtggacagaagtcaatatatattataacaccacactggtactatttg

SEQ ID NO: 45182 - DNA, 201 bp, Homo sapiens
aaggatcctatttgtcctttaagactcaccccaaacatcaccgttgtaaagcctcatcagactcctccagcagattgtgttgttctttcctgtgttctcayagcactcaatttttactctctgatgtagcagctgtcccattatatagcagttgtttacttacctttttgtttgttccaagcttgagcttgttagggaaaa

SEQ ID NO: 45183 - DNA, 201 bp, Homo sapiens
ttgggaggacacgatggatggatcacctgagctcgggagtttgagaccagcctgggcaacatggtgaaatcccatgtctacaaaaaatacaaaaattcccygggcacagtggcatgattacatgattaatttgaagttgtttcttggttggctgccagttttagctattttgtctctactaaaaaggggaaaaaaattagc

SEQ ID NO: 45184 - DNA, 201 bp, Homo sapiens
tatataatcaagtttctgttacttaagtacataattgtcatttatattcgctgactctccttggtggttttaaaaacctgtgtcccaaaagcctctgtacrgtgtgcatgatactatggaaagaagatttacaatttagtgcagagtctgtactttaaaaagaaaccattctcgagttgggtgcagtggcttgtacctacc

SEQ ID NO: 45185 - DNA, 201 bp, Homo sapiens
ttccattatgtctttgtttcacagatcacttaatataagttagccaggtaaattttgcatttcacactgattacttgtttggccatcgtgtttggataagrttagcctaagtgcagttttaatgtattgggtctagactagaaacagactttttggattttgtattcttgatcttctttagtccgtgatgcccttgctctt

SEQ ID NO: 45186 - DNA, 201 bp, Homo sapiens
tttgactggtgtacagacctccaaagtcagagggattggtgttattctaaagagtcttcagtcctctctggcttactgaggtgtagttatagcatagtcarcagctcagggtttggatttaagtgcacagacctgggttcaaattccagtctttataagtgactgcaacattattcaagttacttaacatattcaagcctc

SEQ ID NO: 45187 - DNA, 201 bp, Homo sapiens
gtacagacctccaaagtcagagggattggtgttattctaaagagtcttcagtcctctctggcttactgaggtgtagttatagcatagtcaacagctcaggstttggatttaagtgcacagacctgggttcaaattccagtctttataagtgactgcaacattattcaagttacttaacatattcaagcctcagcttcctca

SEQ ID NO: 45188 - DNA, 201 bp, Homo sapiens
cggggtttcaccgtgttagccaggatggtcttgatctcctgacctcgtgatccgcccacctcggcctcccagagtgctggaattacaggcgtgcgccaccrcgtcccgcctattgttcccctactttcccagaacttttgttattagtttcttgtgtatcctctttctgtgcttttattctaatttataaaaacgtatatt

SEQ ID NO: 45189 - DNA, 201 bp, Homo sapiens
tgccactgcactctagcctgggttaatagagcaagaccctgtgccaaaaaaaaaaaggaaagaaaaaataaagaaatgcctttaacacagagaccacctcrtgtattgcaggttgctgttactttagtggagttaagagaaataatttttggtcagtgacttattgaataaattgaccatttgtgctgcttccctgggcga

SEQ ID NO: 45190 - DNA, 201 bp, Homo sapiens
tagatgtttattttcccttgtaaagttgatgagcatgtataattttttttcttttttgagatggggtcttgctttgttgcacaggctggagtgcagtggcrtgacctcgactcaccacagccttcacctaccgggttcaagtgattctcctgcctcagcctccctagtaactgggactacaggcacgcaccaccatgccca

SEQ ID NO: 45191 - DNA, 201 bp, Homo sapiens
gccaggctggtcttgaactcctgccctcatgtgatccacctgcctcggcctcccaaagtgctgggattataggcatgagccaccatgcctggccgaggttkttttttttttttttttttttaatcatagagtaaaattgatttgggaggagtataatgttctgcgaattttttaattttattagatttatgtaaacacctc

SEQ ID NO: 45192 - DNA, 201 bp, Homo sapiens; identical to SEQ ID NO: 3654

SEQ ID NO: 45193 - DNA, 201 bp, Homo sapiens
tgtatgtgctgatctgagacctgcatagtggtctctccgttagttccaatttggaaacctttggtacggaatagcgtcagatccatgcatatgcagcctargggtaagcctagaaattgctttcttgagttctcctcagcaatttttcccacactttttgttctcaaagggctcatattttctttcttttgtccagaaaac

SEQ ID NO: 45194 - DNA, 201 bp, Homo sapiens
tcacctggcttcttaaaatgccatatgaccagcaagaagattgtcacttaagtcacagttgttctataattgagcagacaagccagttgaatggcccaacrtgaagcaagaaagaatctctgtggttaggcctcggtctctgaaaatttatgttggtactcagttatacagttaatgtgaaatgatgagggagactgggaa

SEQ ID NO: 45195 - DNA, 201 bp, Homo sapiens
gttctctgggagccccatcacttgctccccagttcctaccctggggtaattgtaatgaggtctcccctggaggcaggggaatgaataataagacactgttwcccttaagacccttgccagtcttctaggttttgtgacttttgctgtttccttttgttttattataaggaaataaaaggaaatattgcttaccaaaaacac

SEQ ID NO: 45196 - DNA, 201 bp, Homo sapiens
cactgcaacctccacctcttgggttcaagcgattttcctgcatcagcctcccaagtagctgggactacaggtgcgtgccaccatacctggctaagtttttrtatttttagtagagacgggctttcactgtgttagccaggatgatctcgatctcctgacctcatgatccacccgcctcagcctcccaaagtgttgggatta

SEQ ID NO: 45197 - DNA, 201 bp, Homo sapiens
gcctggtaatctcagcactttgggaggacacgatggatggatcacctgagctcgggagtttgagaccagcctgggcaacatggtgaaatcccatgtctacraaaaatacaaaaattccccgggcacagtggcatgattacatgattaatttgaagttgtttcttggttggctgccagttttagctattttgtctctactaa

SEQ ID NO: 45198 - DNA, 201 bp, Homo sapiens
ttgtacttagtttttccccccaggatcctctgtgtgttaaaaaaggttgaatggggaacctgaaactcctccccctgctcttggaagtgtagggcacttcyctttctccacagtgtcagtagaggttgggtggagactgaacttccagccctgccaggtgagcatgaattgtttgttcctgtcctctccaccatctctgtg

SEQ ID NO: 45199 - DNA, 201 bp, Homo sapiens
tggagactgaacttccagccctgccaggtgagcatgaattgtttgttcctgtcctctccaccatctctgtggtattggtgggggctgagaggggagcctgratttctgcctccacccatggtaatgaggtcgcaactcccttttcccaccagtgtgatgttggctaaagaatatttaaatcagattgagagcctcctaata

SEQ ID NO: 45200 - DNA, 201 bp, Homo sapiens
ctttttttttttctttttttgctacggggcctcactctgtcacccaggctggagtgcagtggtacaatcgtagctcaccgcagccttgaccacccaggctsaagcaatcctctcacctcagcctgctgtgtagttggtaccacaggcatgcaccatcacactgggctaatttttttttttttttttttgagatatcgtgtc

SEQ ID NO: 45201 - DNA, 201 bp, Homo sapiens
gtagctcaccgcagccttgaccacccaggctcaagcaatcctctcacctcagcctgctgtgtagttggtaccacaggcatgcaccatcacactgggctaatttttttttttttttttttgagatatcgtgtctcactatgttgcccaggctcgtctcatactcctgggctcaagcagtcctccaacctcgacctctctaag

SEQ ID NO: 45202 - DNA, 201 bp, Homo sapiens
ctacatttgaaagtgctgatgctgagagactgtgtcttggcggaccccaaggagtctgcttttcctctacttattgtccctgcttttcctggcagctggcrttgctgtttaaatgggttgttctttgctgtttaagttgtttggtagtggtgtgtcaggatgcgggttttctgaatacttttccagctggttacttgagtg

SEQ ID NO: 45203 - DNA, 201 bp, Homo sapiens
ccatgtttgtgtcacttcacactagcagcctggggaacagagcaagaccttgtctcaaaacaacaatacgtggtttaccacaaccaacaggaaaaatctgkataaaactgtatgaaatatttactgctgtgctcaacatggtagtgtagaggtcaagggcaaaagtcctggggtcaggccacctggtctactgtctaatta

SEQ ID NO: 45204 - DNA, 201 bp, Homo sapiens
ggaaaaatctgtataaaactgtatgaaatatttactgctgtgctcaacatggtagtgtagaggtcaagggcaaaagtcctggggtcaggccacctggtctrctgtctaattagctgtgtcatctttggaaaggtacttgaactctctgtgccttagaattcgttttctaaaatgtgggcggggcacggtggctcattcttg

SEQ ID NO: 45205 - DNA, 201 bp, Homo sapiens
ccaaaggctgtgcctatccttttaaatagaagagagagggcctggcacggtggctcatgcctgtaatctcagcactttgggaggcggaagaaggcgaatcrtgaggtcaggagttcgagaccagcctggccaacatagtgaaaccccgtctctactaaaaatacaaagaattagccaggcgtaatggcgggcgcctgtatt

SEQ ID NO: 45206 - DNA, 201 bp, Homo sapiens
cttgcctggctaatttttgtatttttagtacatatggggtttcaccatgttggccaggctggtctcaaactgctgacctcaggtgatcaacctgccttggyctcgcaaagtgctggggttacaggcatgagccaccacacctggtcagctcttgactctttatagctgttgtattattttaatcttgagtaaataaatgct

SEQ ID NO: 45207 - DNA, 201 bp, Homo sapiens
aattgattggatgtttcctgtaagtcccagatgagttgtctggagataggaatgacctctgagggcatgacattgaacccaagaataggaagcagggcccrctcaaggatagagggaaactactcacatctgtaaagtgttttggttttgcttttctgagatgaaactggtttgcatccagagtcttaagaaagaacacta

SEQ ID NO: 45208 - DNA, 201 bp, Homo sapiens
gagtaaataaatgctcgctgaaatgttgcagttcatgagaatcttcttctgttatttaaaaaattatttgtaaaagtccaataaggttacactaatgtttmtgttttgaaaatattacctcttccatttagtactatatgtattaaataaaagtagacagtttttttttttttggctttataatgtggttcagattttttt

SEQ ID NO: 45209 - DNA, 201 bp, Homo sapiens
tcttccctgacataagtgggaccaattgaatcgtgcattctttatgcccaggttgctcaatcaagctcctatttattggagtgcagtgctcaaacaggagyggcatgtggccccttggagctccctcctggaagcagtgctggtggtggttacctgtctagggacaggtctgtctgcccaggaaagagttgagtctcatgc

SEQ ID NO: 45210 - DNA, 201 bp, Homo sapiens
tcttcttctgttatttaaaaaattatttgtaaaagtccaataaggttacactaatgtttatgttttgaaaatattacctcttccatttagtactatatgtrttaaataaaagtagacagtttttttttttttggctttataatgtggttcagatttttttagaaagtctggctgtgtctacattgccttaaagcaatagga

SEQ ID NO: 45211 - DNA, 201 bp, Homo sapiens
gacatgaaactcctgggttggaggcaaaagaggaggacacaggtcacaggacatcagcagaaccagcttcatgtccacgtggactacctttgccctgtaarttccctgtgggcaacgacacaagtaggaaatccaagctcagggaactcagatctcataaggggtggcaaacaaatgtctcaaacctttgatatgaaggga

SEQ ID NO: 45212 - DNA, 201 bp, Homo sapiens
aagtccaataaggttacactaatgtttatgttttgaaaatattacctcttccatttagtactatatgtattaaataaaagtagacagtttttttttttttkgctttataatgtggttcagatttttttagaaagtctggctgtgtctacattgccttaaagcaataggatatttctctttatttatttatttgtttgtttt

SEQ ID NO: 45213 - DNA, 201 bp, Homo sapiens
tcaaggcaggtaatgagtcgtaatcaccttaggggaaatggggttcatcctctgaagcatttagcttttatgttacagacaacccagttatattctcttamttactcttaaatgtacaattaaattacttttgactacagttccccttccgtgctagcaatactaggtcttattcattctttctaacttttctggtacccc

SEQ ID NO: 45214 - DNA, 201 bp, Homo sapiens
ttcaaatctggctaacacgtgtggcaaatacttagatttgttgacagaggtttcctggagtgctgtcttgaacgattctgaacaggctcagcaagaaagtrtgtttcagttttaggtgtatctgtcatggagaaggaagtaaggactggggagcactcacagcattcctggggcattcctgtccattatttcaatacctgg

SEQ ID NO: 45215 - DNA, 201 bp, Homo sapiens
gttttgaaaatattacctcttccatttagtactatatgtattaaataaaagtagacagtttttttttttttggctttataatgtggttcagatttttttaraaagtctggctgtgtctacattgccttaaagcaataggatatttctctttatttatttatttgtttgttttttttgagctagagtttcgctcctgttacc

SEQ ID NO: 45216 - DNA, 201 bp, Homo sapiens
gtggtgtgatctcggctcactgcaacatctgcctcccagattcaagcaattctcctagctcagcctcctgagtagctgtgattacaggcacccaccaccayaccctcctaatttttgtatttttagtagagttggggtttcaccatgttggccaggtgggtcttgaactcctgacctcaggtgatcctcccgcttcagcct

SEQ ID NO: 45217 - DNA, 201 bp, Homo sapiens
ttattactttgttttgttactttgtagaaacctcaaatgaagatttagtggtgctcaagcatccagattgtcttttcttttcttaatttttttttttcccygatttggagtcttgctctgtcacccaggatgtagtgcagtggcatggtcttgacacactgcaacctctgtctcctgggttcaggcgattctcctgtctca

SEQ ID NO: 45218 - DNA, 201 bp, Homo sapiens
ccagctactcgggagtctgaggcaggagaattgcttgaacctgggagacagaggttgcagggagtcgagattgtgccattgcactccagcctgggtgacaraatgagactcagtctcaataataataataattattattattagcagtgcacagctgtgtgagaaaggcctatagatttcttctaaatgctttattataat

SEQ ID NO: 45219 - DNA, 201 bp, Homo sapiens
gggtttcaccgtgttagccaggatggtcttgatctcctgacctcgtgatccgcccacctcggcctcccagagtgctggaattacaggcgtgcgccaccgcrtcccgcctattgttcccctactttcccagaacttttgttattagtttcttgtgtatcctctttctgtgcttttattctaatttataaaaacgtatattct

SEQ ID NO: 45220 - DNA, 201 bp, Homo sapiens
gtctcaccacatttattgggttattgcctttgcctttgactcaacaggagctggaagggaaagaatcccaaattctgtttcttaaggcagccagttgtcasaatgaactttcctcattttctattgtgaggcctgaggaaagacattcagttccaaaggctgtgcctatccttttaaatagaagagagagggcctggcacg

SEQ ID NO: 45221 - DNA, 201 bp, Homo sapiens
tgtatcctctttctgtgcttttattctaatttataaaaacgtatattcttaccccactaccccgttttatataaaacatagcacagtgtacataccttacttttttttttttttttttttgagaccaggtctcactctgtcacccaggctggagtgcagtcaaactcctgggctcaagcgatccttctgcctcagcccctc

SEQ ID NO: 45222 - DNA, 201 bp, Homo sapiens
gaattagctgggtgtggtggcactcgcatgtaattgcagctagttggagactgagccaggagaatcgcttgaacctaggaggcagaggttgcagtgagctraagtcttgccactgcactctggcctgggtgacagagcagtactctgtctcaaaaaaaaaaataaaatcaaataaaacatacctttttaaaaaattatttt

SEQ ID NO: 45223 - DNA, 201 bp, Homo sapiens
agactgagccaggagaatcgcttgaacctaggaggcagaggttgcagtgagctaaagtcttgccactgcactctggcctgggtgacagagcagtactctgkctcaaaaaaaaaaataaaatcaaataaaacatacctttttaaaaaattatttttaggaaatcattgggatatggggaacttaaattccttataaacatta

SEQ ID NO: 45224 - DNA, 201 bp, Homo sapiens
atccttatctctcttgtgtaaatgttccattttcctttcagtgtgtttatttgaagaggggaaagaattgtctgcccagccggtgggatagtgtagtgcaygtttcccttgtctcttcattttatgctttgtcgtgttcatcttgctattaatactttggatgcgttctttcactttgatcagtatgactcaccaacgaaa

SEQ ID NO: 45225 - DNA, 201 bp, Homo sapiens
ccatcacctgaagaacctctgtgaaactctcacaatgagtgaaggtcagattcaggaagtgttcagcaagcaccaccaagctgaaccctgtcagagccaasttccaccgttatgtgcatgagggtcttttttttgtctttcttcacatccgacaggcaatgtgccagtgctgtaacaaggtttgagcaaggcatatctcac

SEQ ID NO: 45226 - DNA, 201 bp, Homo sapiens
tctgtgaaactctcacaatgagtgaaggtcagattcaggaagtgttcagcaagcaccaccaagctgaaccctgtcagagccaagttccaccgttatgtgcrtgagggtcttttttttgtctttcttcacatccgacaggcaatgtgccagtgctgtaacaaggtttgagcaaggcatatctcacacatgaaaacccagtgt

SEQ ID NO: 45227 - DNA, 201 bp, Homo sapiens
tgtaacaaggtttgagcaaggcatatctcacacatgaaaacccagtgtgaaaacctagtcatcacactcccagtgctttgggaggctgaggcaggtggatsacttgaggtcaagagttacagaccagcctggcccacatggcgaaactctgtgtctactaaaaatacaaaaattagccaggcgtggtggcgtacgcctgta

SEQ ID NO: 45228 - DNA, 201 bp, Homo sapiens
tgcaataaaaaataaaacatgggaagtcatgaatataaataagagcttcatatagtgaaatatctaaactttactaaaggtagcacctaggcttttatagwtgagggatcaattttaattcaaccaaatggcatgtatatgggtaactagttgacagtgattagggctgcagtcaaggtgatcccatgacttgtgatcacc

SEQ ID NO: 45229 - DNA, 201 bp, Homo sapiens; identical to SEQ ID NO: 3653

SEQ ID NO: 45230 - DNA, 201 bp, Homo sapiens
ccaggctggtctcaaactcctaggctcaatcgatcctctagctgcagcctcccagagcactgggattacagttatttgttactctttttattttctagtcygttgtgctgaactgcatttatcttttaaatagactttaaatattctttggcagaaagtgaggaataaatgcatatattctatgtataaaatcagtaaaac

SEQ ID NO: 45231 - DNA, 201 bp, Homo sapiens
agtggttattgattctaggcaagacagtatttaattatctgtaagttaataaggctgaatacttcccccccccccctttttttttttctttttttgctacrgggcctcactctgtcacccaggctggagtgcagtggtacaatcgtagctcaccgcagccttgaccacccaggctcaagcaatcctctcacctcagcctgc

SEQ ID NO: 45232 - DNA, 201 bp, Homo sapiens
aagggcccctgagccacggggccggcccaattactttactcagtttgagcattagcactggaagaaaagctgtcacttgcatatatatttttttaaagacatgatctcactctgtcctgtcacccaggctggtgtgcagtggcgtaatgtcggcttactgtaaccttaacctcccgggctcaagcaattcttttttttttc

SEQ ID NO: 45233 - DNA, 201 bp, Homo sapiens
agacggagtctcgctttttcgcctaggctggagtgcagtggcgcgatctcggctcattgcaagctccgcctcccgggttcatgccattctcctgcttcagyctccccagtagctcggactacaggagcccgccaccaagcccagataatttttttgtatttttagtagagtcggggtttcaccgtggtagccaggatggtc

SEQ ID NO: 45234 - DNA, 201 bp, Homo sapiens
gcgtcaagcccttgctgcgcccaacgcgcaggtagtagtaatccaggcagtggtaaagctccccttgtagcttattgttgcctgccgccgggtccgagccygcagaagctgacagctgcctgtggccacccgcctgcgcatgcgcgcttctggaagacccaggcccccctcccccgcagccccgcctcgagttccgattgg

SEQ ID NO: 45235 - DNA, 201 bp, Homo sapiens
ctgagcatggtgtcgagaccaccactggctggggccgtggcatgaagggtgccccaggctcggggaaggtggggaccttttccccgctccccaaatgattkttgcatgctctggtgaggggacagttgtactccatttcccgtgtgccagcttcgggactcagctgtgcttttgtgtctctttgattagcaaaagcaaaac

SEQ ID NO: 45236 - DNA, 201 bp, Homo sapiens
ggagtgggccggggatggccgcggcaggcggcaggtcggccgtggagccccggggaggcggccgccacgatcgctgcccgaagtctgcgagatgtccggcrgtccgctcagggccccttttgcagactcggtgcccggtgtgcatcggtgccgcctgtcggtcttggcaccgctggcgcagccgccgcgtaggaggcctgg

SEQ ID NO: 45237 - DNA, 201 bp, Homo sapiens
tgaggcaggagaatcgcttgaacccgggaggtggaggttgcagtgaaccgagatcatgtcactggactccagcctgggcgacagagtgagactccgtctcaaaaaaaaaaaaaaaaatagagaagaggaagcagccgtgccaaggctaggtactgactgaagcaggaggaacaaattggaaatgtgggaatgtgaatgtgg

SEQ ID NO: 45238 - DNA, 201 bp, Homo sapiens
actgttcccatgatagaacaaatttcttaagattcagttgcatttatatattcaaaataattttggagagaggaagggaactggtaaggcaaggtaatccycacgctggagtaacgtagtaaaatgatgcctctgactggttgttagagaagcgctgtgagttatttttctggtttaatcaggaaataaatgaagttcccc

SEQ ID NO: 45239 - DNA, 201 bp, Homo sapiens
ttcctgcgccgtgtctggcttggccagccggagcaccgcgctgggctccatgcagccgggctgcgcggccgctcagagcgggtgcctccggggctccggtygggggcctggcaggagtgggccggggatggccgcggcaggcggcaggtcggccgtggagccccggggaggcggccgccacgatcgctgcccgaagtctgc

SEQ ID NO: 45240 - DNA, 201 bp, Homo sapiens
caacttaaatattgatttcacaaacaataagatggtgtgctgtagcatgtcattgcactagaaagaaaagaaatactccactagtggggaataatttcaayagaggaaagtgatgaatgttggatgtgagttcggaaaccagaggttgataaagtcttacgattgctatatgcactgtgaggctactgtatttggaaaatt

SEQ ID NO: 45241 - DNA, 201 bp, Homo sapiens
ttttgtcgtcaaaaagaagagttgatgtttttgaaagatctaaacagctttgcaaccgatgttctaaagaaataaaatataccgctggaaccccccccccaaaaaaaaaaaaaaactgagctgagtgcattggctcctgcctgtaatcccagtactttgggtggccaaggtgggaggattgcttaaggccaggagctcgag

SEQ ID NO: 45242 - DNA, 201 bp, Homo sapiens
attttagttctttctattttctgtttgtttctacaaacttttaactttttaaagatacctgtaattaatgtagggggtatcagattgctgaccagttattrcaacactattgaaaatttccccttcccctccttcttctaacattaaattaccttatattagattagattagattagattcatttttgagtcagtctgtcc

SEQ ID NO: 45243 - DNA, 201 bp, Homo sapiens
ataagaatatgtaccatatacagtgactctatgactaaaacttttttttctacttgtctatatatatcaggttttgtaaataatgagtattctttgcttctttaactagaaaaaaaaaacaaatttaagggaaaaaaatcacctgtaagttttatttcttaattgaggtcaatggatagcttatcattttgctggaattga

SEQ ID NO: 45244 - DNA, 201 bp, Homo sapiens
taagaatatgtaccatatacagtgactctatgactaaaacttttttttctacttgtctatatatatcaggttttgtaaataatgagtattctttgcttctttaactagaaaaaaaaaacaaatttaagggaaaaaaatcacctgtaagttttatttcttaattgaggtcaatggatagcttatcattttgctggaattgat

SEQ ID NO: 45245 - DNA, 201 bp, Homo sapiens
ggaatgtttgacatggttataagattttattttcgcacattgcgttaagtatatctcagtgtttccatgtggattataattttctcattaaaatattttcyataagtctttacatattcatgctattttgactgatatctctttttatactttctaacttgttattgtttgtctgttacaagagttccacagatttcgtgt

SEQ ID NO: 45246 - DNA, 201 bp, Homo sapiens
ttttaagtttttttttcttttattattatactttaagttttagggtacatgtgcacattgtgcaggttagttacatatgtatacatgtgccatgctggtgygctgcacccactaacttgtcatctagcattaggtatatctcccaatgctatccctcccccctccccccaccccacaacagtccccagagtgtgatgttcc

SEQ ID NO: 45247 - DNA, 201 bp, Homo sapiens
aagaatatgtaccatatacagtgactctatgactaaaacttttttttctacttgtctatatatatcaggttttgtaaataatgagtattctttgcttctttaactagaaaaaaaaaacaaatttaagggaaaaaaatcacctgtaagttttatttcttaattgaggtcaatggatagcttatcattttgctggaattgatt

SEQ ID NO: 45248 - DNA, 201 bp, Homo sapiens
actctccaaggaacagggggactgtgttcttggtccattaccatttcctcaagcaggaagctgtgaatatccgtatcaaggcaggggatgtcggctgggcscggtggctcatacctgtaatcccagcactttgggaggctgaggtgggtggatcacttgaggccaggagttcaagagtagcccgggcaacatggtaaaacc

SEQ ID NO: 45249 - DNA, 201 bp, Homo sapiens
atttaatgttcacctgcagtctacagccctcctcccccaagagagtctctgggccaggtcctcccctgaggacctgtcctgttaactgtcctgaccctccygcctcctaactcagtgctctctccatgcagtccctgtccgagtgctggagctaagtgagagccaccctgacagtggggaacagacagtccgctgtcgtgg

SEQ ID NO: 45250 - DNA, 201 bp, Homo sapiens
agcaatgctctgcccgttgggctccccctgcccaggtaccaggagggaggccagggactgaatctttgggatacctgaggagcaccgctccttcccctccttttgtccaggaggggaagctgaggctgtgacagggcaggggacagaatcactcctggagctagggctgttccacaagatggtccaccccagatgagggaa

SEQ ID NO: 45251 - DNA, 201 bp, Homo sapiens
ggggaggccacaggaaggcgcctctgaacacacccgtcttgtgacctttgccctggggtgctgtaatcgcctctgggtgtgagctctctgggttctaactrtcattttggtagcctcagtgcccagcttggcccagcaggttggttgaaaagtcttgatccacaggctttcctactgggatagactgaaggaagatgagtg

SEQ ID NO: 45252 - DNA, 201 bp, Homo sapiens
  misc_feature (1)...(201): n = A,T,C or G, or insertion/deletion polymorphism (see Tables 1-2)
ctggggtgctgtaatcgcctctgggtgtgagctctctgggttctaactgtcattttggtagcctcagtgcccagcttggcccagcaggttggttgaaaagncttgatccacaggctttcctactgggatagactgaaggaagatgagtgagtgtgtgagtgagagaagaaattcatgagtggcaaggggcaggaggggagg

SEQ ID NO: 45253 - DNA, 201 bp, Homo sapiens
caggactgaagagctgaccctacagagccatttaatctctcatatcgtgtaagcgtttactgagcacctactgtaggcctaattccatattaggaagttgragagagtccagatcgttgttaggtaggtatcctgatttgtgggaagtcatattaaaggactaagacaaaagttcaggaaagaagtaattgacagacagtg

SEQ ID NO: 45254 - DNA, 201 bp, Homo sapiens
cctgagctctgctttgctctgtgtggcctcattttcaggccagcattgcccaaatggctaccagcagtgccagtctcatgtcctactgcttgctccatagwgccagcaaaagtcccagagctgaccttcaagggctcaggtggggtcacatgccatcaagaaccaaccgtggaagctgcagggctgaaaactgttggcgaa

SEQ ID NO: 45255 - DNA, 201 bp, Homo sapiens
acctcccaggttcaagcaattctcctgcctcagcctcccgagtagctggaattacaggcatgcagcaccacgcctggctaattttgtatttttagtagagwtggggtttctccatgttgagactggtctcaacctcctgacctcaggtgatccgcctgcctcggcctcccaaagtgctgggattacagatgtgagccacca

SEQ ID NO: 45256 - DNA, 201 bp, Homo sapiens
agggaacccatcggttttcacactgattcctggtatttaatgttcacctgcagtctacagccctcctcccccaagagagtctctgggccaggtcctcccckgaggacctgtcctgttaactgtcctgaccctcccgcctcctaactcagtgctctctccatgcagtccctgtccgagtgctggagctaagtgagagccacc

SEQ ID NO: 45257 - DNA, 201 bp, Homo sapiens
ttctagtctagtggaggaaacagtcgccggtcagatgatcacccagatgtttagttgtccttgtgatgggtggggccagcagtagcagccaagaagtaaaygggcagatgactggggaagagggtgccaggcaggccactcatggcctgtggtatccctgaggctggagatttgctggctgacagagactgtggtaggtta

SEQ ID NO: 45258 - DNA, 201 bp, Homo sapiens
aggccatcaacatcaccgtggttggtgtgtgccttgggctcagcccaatccccaattccttcaacgctccccaccctcacccactttgctgggtgcagagygatggtgagagttgcatttttgatacagtgatcagggctgagctggacccagtgcctgtcacagccccggggtatagtcagccacactccagtgcagccc

SEQ ID NO: 45259 - DNA, 201 bp, Homo sapiens
gcccctgtttcctgatgtctgatacctcctctcccaaaggcgagctgctgttgctgtctctcctgttacttctggaaccacagatctctcagggcctggtygtcacacccccggggccagagcttgtcctcaatgtctccagcaccttcgttctgacctgctcgggttcagctccggtggtgtgggaacggatgtcccagg

SEQ ID NO: 45260 - DNA, 201 bp, Homo sapiens
  misc_feature (1)...(201): n = A,T,C or G, or insertion/deletion polymorphism (see Tables 1-2)
caggggcaaacaggagcattgtgaaaccctgttgtgtacatgcataggaacacattctggcaaacacaatatgggtacacacgtgtacaaacacaagtctntaagccatggatatgaatatccttcagtgtggtgtacatatactatatgtatgtcgtaagccatgtacatgagcatgcctgttccttgaacataggtgca

SEQ ID NO: 45261 - DNA, 201 bp, Homo sapiens
gctggtggcagggcgtgaagcaccaggcacactgccctgcccttcagctttagttttcaggatttccagtgggctctgtggaggcctccagctgccagccyttcagctcagaaagcgtcagtgggcccctgcttgtccagaaccatcagctcaaatcctttgattggccctccagaccccatcccaccttctggcccacac

SEQ ID NO: 45262 - DNA, 201 bp, Homo sapiens
tgggctgtcctttttgcggggctccttatctttgcctcctgccacagaggggctgtctcatgggcattgggctgtgtgctctggagcctgtctgcccagtrttaaacactggagacaccactggcaagcttttgggcaaacaatgtaaacagtctgtgcctcagtttccacatctgtaaaatgaggaagcagtactgatgt

SEQ ID NO: 45263 - DNA, 201 bp, Homo sapiens
  misc_feature (1)...(201): n = A,T,C or G, or insertion/deletion polymorphism (see Tables 1-2)
cgggaagaagagctgggacttataattgcccacacatgtggggcaggcagtggaaagcaccgtggatccagagtcaggagacccagtgcttgccctggctngatttaaatccaccgtgtggccaacctcagaccccccacatcccatctctgggctccttccgcagctgggaggcagtgagcgctgtgggtaaccagcacc

SEQ ID NO: 45264 - DNA, 201 bp, Homo sapiens
ccaaaaaactcaagaaaccctggaggcctagctcaaggccacctccctcaggaagccatacccgctctccccactggagtaatcatatactgttgttagtyaccatttactgggcacctatgatgtgccaagtgctgtgcgtcatcatctctggccctcccagaaatggaaaaggaggtctcccatgccatttcccaggaa

SEQ ID NO: 45265 - DNA, 201 bp, Homo sapiens
cttaattgtatagatggggaaactgaggcccagagagggaaacaacttgtcaaagcccgcacagcaagtctgtggctgaatagtcatggaaattcctttcrtggaatgagatggctggtggattcttatgtgactctagcctcaggaatgtagccccctcctgcttactagcccccacctcctcaaaacaccccggtaaga

SEQ ID NO: 45266 - DNA, 201 bp, Homo sapiens
gcttgttctgtgccaggtactgggctgtcctttttgcggggctccttatctttgcctcctgccacagaggggctgtctcatgggcattgggctgtgtgctytggagcctgtctgcccagtgttaaacactggagacaccactggcaagcttttgggcaaacaatgtaaacagtctgtgcctcagtttccacatctgtaaaa

SEQ ID NO: 45267 - DNA, 201 bp, Homo sapiens
  misc_feature (1)...(201): n = A,T,C or G, or insertion/deletion polymorphism (see Tables 1-2)
gacctcaagtgatccgcctgcctcagactcccaaagtgctgggattacaggcgtgagccaccgcacccagctaaactctccccattttacaggtgagaaantgcgcagagtcagttgcctaaagtcccacagctcggaagtggcggagctgggatttgcacctgggtgtttctgactccagatccccttgatgagaggctg

SEQ ID NO: 45268 - DNA, 201 bp, Homo sapiens
ctttctgtgtctacttcaattgtgctttacatctgttacctcaaagttgctgctgtattcctcagcacttggaacatgctgggcattcaggacattcttartaaatatttactggattaatttaaccatcgaggctgggcacggtggctcacacatgttatcccagcactttgggaggccgaggcgggtggatcacccgag

SEQ ID NO: 45269 - DNA, 201 bp, Homo sapiens
tctaggctaaaggagggtgctctgggcattggctcagaacaggctgctgctgaatgcagtgggaagggagaaagggatgaaaaggtcttctgaaatgcccrcccatttcttgcatttgattcagaacccagtgggcagtgggttcttggaatgggaatctttttggtgccccctgtcttctgacccagagcgttaggaggg

SEQ ID NO: 45270 - DNA, 201 bp, Homo sapiens
ctgggagatggagtaaggtcatcaccacttcacagcaaaggaaactgaggccctgaagaaggacgctgaggcagcatgagagcctgtgcctgtctgctctyaagtgggggaagagttagagtcctgggtgctggtctgataactgcccctccctgggtggtcctgagctcaccatgccttgtaagattctatgtgaggtag

SEQ ID NO: 45271 - DNA, 201 bp, Homo sapiens
  misc_feature (1)...(201): n = A,T,C or G, or insertion/deletion polymorphism (see Tables 1-2)
agccacacagctagtaagtggcacagcctggagaggttggaatctccccgtgccccattactccaaacttgggccttttgttcccgccagtcagatcccanaattcccagaaggaatgcgcaccatcctgcttgtgggcatttgccctccctcttccccctttctggaatgcccttcctcatcacttttctttcagggata

SEQ ID NO: 45272 - DNA, 201 bp, Homo sapiens
  misc_feature (1)...(201): n = A,T,C or G, or insertion/deletion polymorphism (see Tables 1-2)
gccagtagggccctgaaaccctgccccgtccaacaacacgggtccaagtgaggaggaaatacacatggcctttgacacagaggcagctccttctttgggtncatttctcacccccactgccccccggggatggtcccagggacctgggagatggagtaaggtcatcaccacttcacagcaaaggaaactgaggccctgaag

SEQ ID NO: 45273 - DNA, 201 bp, Homo sapiens
tatgagactgatctcatgtaatgctcaccagcaaccccagaggcagtgactgtttttacctccgttttatacatgaggaaattgaggctcacgcagccacmtaactgtagccacacagctagtaagtggcacagcctggagaggttggaatctccccgtgccccattactccaaacttgggccttttgttcccgccagtca

SEQ ID NO: 45274 - DNA, 201 bp, Homo sapiens
gtcaagatgcttaaatgtgagtagtccttggagccctccacatctgggccttcacctctccctgcccctccccacacacttagcctctcccagggtggccygatgctgatttgcaggcactagaggggccatcacactgcagcaggcgctgctcccgagtctgggtctggtttgggaaagagcgttcctctccctggcctc

SEQ ID NO: 45275 - DNA, 201 bp, Homo sapiens
tagtcccagcatcagccacagtactgacccagaacagagaactgttagtacaactctgttcccaacctgggagctggccccagcatccatattagccccarattcggccccttctccaggccctgtccccagcccaatttcaacctcagctccggaaactccatggctggcacggtccccaggcctgaagccccaccccac

SEQ ID NO: 45276 - DNA, 201 bp, Homo sapiens
cgcaactgtgctgagtgctttatgagactgatctcatgtaatgctcaccagcaaccccagaggcagtgactgtttttacctccgttttatacatgaggaamttgaggctcacgcagccacctaactgtagccacacagctagtaagtggcacagcctggagaggttggaatctccccgtgccccattactccaaacttggg

SEQ ID NO: 45277 - DNA, 201 bp, Homo sapiens
cagggtggcctgatgctgatttgcaggcactagaggggccatcacactgcagcaggcgctgctcccgagtctgggtctggtttgggaaagagcgttcctcwccctggcctcctcggcctgcttccccctaccctggcctcttcccctcctcagagtgtgggtgctcacccccgccaggctgcctgggtcttgcagcacagg

SEQ ID NO: 45278 - DNA, 201 bp, Homo sapiens
acagggatcctggttcaggtcccagctctgctaccttctccctgctgtgtgatgttagcaaattctttgccctctctgggtctctttatctccctgtctgygcattgacaggtttgaacagtgacatcagaaagcctgcttggctctcacattctggctgtctatcctggggagggttgtggtctctgttcagagcccatg

SEQ ID NO: 45279 - DNA, 201 bp, Homo sapiens
  misc_feature (1)...(201): n = A,T,C or G, or insertion/deletion polymorphism (see Tables 1-2)
gccttcacctctccctgcccctccccacacacttagcctctcccagggtggcctgatgctgatttgcaggcactagaggggccatcacactgcagcaggcnctgctcccgagtctgggtctggtttgggaaagagcgttcctctccctggcctcctcggcctgcttccccctaccctggcctcttcccctcctcagagtgt

SEQ ID NO: 45280 - DNA, 201 bp, Homo sapiens
ggttctcatgagccaggccctcagctgccagttgctcctcagtctgccaagtcctgaagcctcctctggggccccttggtccctgttccctccgagcccaygaagaccttggctcagttgagcacttgctgtgtgacttcaaatatgcccctgcccctctctgggcctcagggtctcctgccccatgtgtcctagacggac

SEQ ID NO: 45281 - DNA, 201 bp, Homo sapiens
  misc_feature (1)...(201): n = A,T,C or G, or insertion/deletion polymorphism (see Tables 1-2)
gtcctgtggttccaacaccttaagatgtcaacattctaagcttacatctttctgacttgcccagcactggggagggccatccgcatccagccgagtacccnacctggtgtcactttctggggtcacctgctctactacttccatctgaggagcagcgaaggctgggagagaagctagagaggaggttctcatgagccaggc

SEQ ID NO: 45282 - DNA, 201 bp, Homo sapiens
ctaccagtgtcttgatgcttttgtgtatctagctgcccgtccttatgcatacatgcacctgtatgagtgtgcttcatttattcacctttcttcttcattcrataaatatgaggacccaacttctcattgaagtataaaggtcaaagggctcagccctgcctggacctcctagtacccatagtccagagagagaaggcagac

SEQ ID NO: 45283 - DNA, 201 bp, Homo sapiens
  misc_feature (1)...(201): n = A,T,C or G, or insertion/deletion polymorphism (see Tables 1-2)
tgcgcaacgctgtgggccaggacacgcaggaggtcatcgtggtgccacactgtgagtccccagcctcagtggcccctgacgatcccaatccctaccttaancctgcctaattggtaatgtgcccatgtacccacagcaggccaaaggagttagcatgcccaggggcaaacaggagcattgtgaaaccctgttgtgtacatg

SEQ ID NO: 45284 - DNA, 201 bp, Homo sapiens
  misc_feature (1)...(201): n = A,T,C or G, or insertion/deletion polymorphism (see Tables 1-2)
tgggagagaagctagagaggaggttctcatgagccaggccctcagctgccagttgctcctcagtctgccaagtcctgaagcctcctctggggccccttggnccctgttccctccgagcccacgaagaccttggctcagttgagcacttgctgtgtgacttcaaatatgcccctgcccctctctgggcctcagggtctcctg

SEQ ID NO: 45285 - DNA, 201 bp, Homo sapiens
ctctaccccttctccatgccattctaaagcataaatccaatcacaccacctccctgcccaggatccgcctatggctccccagtgcctggagaaagtcccarctcctaacagaggctgccactgcttgacacttactgcacgccgcaactgtgctgagtgctttatgagactgatctcatgtaatgctcaccagcaacccca

SEQ ID NO: 45286 - DNA, 201 bp, Homo sapiens
caacttggagccagagaggagatcaacaaggaggaggagagagccggcccctcagccctgctgcccagcagcagcctgtgctcgccctgcccaacgcagayagccagacccagggcggcccctctggcggctctgctcctcccgaaggatgcttggggagtgaggcgaagctgggccgctcctctcccctacagcagcccc

SEQ ID NO: 45287 - DNA, 201 bp, Homo sapiens
caaggctaagtccgggatggagaggagacagcctgtggtcatgagtgccctttcaggcttgggacgtggtggcttttgacttcagcccctcggacatgaakgctgggtggcccaagctggggctcattctgcaggagccaggtggtgagatagcccctgtcgctgcctccacctgccctgggccctgactcctgtttaact

SEQ ID NO: 45288 - DNA, 201 bp, Homo sapiens; identical to SEQ ID NO: 36450
  misc_feature (1)...(201): n = A,T,C or G, or insertion/deletion polymorphism (see Tables 1-2)

SEQ ID NO: 45289 - DNA, 201 bp, Homo sapiens; identical to SEQ ID NO: 36451

SEQ ID NO: 45290 - DNA, 201 bp, Homo sapiens
acatctcattgtccccagcccagtgggcattggaggtgccaggggagtcagggttgtagccaagacgcccccgcacggggagggttgggaagggggtgcakgaagctcaacccctctgggcaccaaccctgcattgcaggttggcaccttacttccctgggatccccagagttggtccaaggagggagagtgggttctcaa

SEQ ID NO: 45291 - DNA, 201 bp, Homo sapiens
gccctcaggggctccagggctaatgggaggtccaggcaatggacaggaactcagaacaggatttgcaccccgtccagagctctggcagcaaggccagactsactggcagggctgaagggacgtggaggccagcagtgatctgagtgggggtagttactgaggggatggagtatttacaggacagtctgaacgtgtggccta

SEQ ID NO: 45292 - DNA, 201 bp, Homo sapiens
gacatgaaggctgggtggcccaagctggggctcattctgcaggagccaggtggtgagatagcccctgtcgctgcctccacctgccctgggccctgactccygtttaactctgcaggacaccatgcggcttccgggtgcgatgccagctctggccctcaaaggtgggtagatgggagataaggtaggggacccggggggctg

SEQ ID NO: 45293 - DNA, 201 bp, Homo sapiens
  misc_feature (1)...(201): n = A,T,C or G, or insertion/deletion polymorphism (see Tables 1-2)
ccgtccaacaacacgggtccaagtgaggaggaaatacacatggcctttgacacagaggcagctccttctttgggtccatttctcacccccactgccccccngggatggtcccagggacctgggagatggagtaaggtcatcaccacttcacagcaaaggaaactgaggccctgaagaaggacgctgaggcagcatgagagc

SEQ ID NO: 45294 - DNA, 201 bp, Homo sapiens
  misc_feature (1)...(201): n = A,T,C or G, or insertion/deletion polymorphism (see Tables 1-2)
tgatataacaggaaccaactcgttcttagcactttctgtgtctacttcaattgtgctttacatctgttacctcaaagttgctgctgtattcctcagcactnggaacatgctgggcattcaggacattcttaataaatatttactggattaatttaaccatcgaggctgggcacggtggctcacacatgttatcccagcact

SEQ ID NO: 45295 - DNA, 201 bp, Homo sapiens
tcctgtttaactctgcaggacaccatgcggcttccgggtgcgatgccagctctggccctcaaaggtgggtagatgggagataaggtaggggacccgggggkctgcggagtggaaccctggagctggcaggggtgatgtgtgctggtggcagggcgtgaagcaccaggcacactgccctgcccttcagctttagttttcagg

SEQ ID NO: 45296 - DNA, 201 bp, Homo sapiens
aacagtaaaagtacttctattaggcggtcattgcaaggattaaatgagatagcatacacctttaggagtgcagaggagggagatgctggtgggtgagaaaygagctttggagccagctgaccctgctccgaagttccagctcctgcacttccctgctgtgtgaagtggggcagtgatataacctctctgagccacactttc

SEQ ID NO: 45297 - DNA, 201 bp, Homo sapiens
cctgaagccccaccccacaggctggcctcctttgggattcagttggtgccctgcccccagggccccgcccctgacggtcaccccttgcagagagcggctaygtgcggctcctgggagaggtgggcacactacaatttgctgagctgcatcggagccggacactgcaggtagtgttcgaggcctacccaccgcccactgtcc

SEQ ID NO: 45298 - DNA, 201 bp, Homo sapiens
ggtgactgacttcctcttggatatgccttaccacatccgctccatcctgcacatccccagtgccgagttagaagactcggggacctacacctgcaatgtgmcggagagtgtgaatgaccatcaggatgaaaaggccatcaacatcaccgtggttggtgtgtgccttgggctcagcccaatccccaattccttcaacgctcc

SEQ ID NO: 45299 - DNA, 201 bp, Homo sapiens
  misc_feature (1)...(201): n = A,T,C or G, or insertion/deletion polymorphism (see Tables 1-2)
gggaagtccagagagtgctttagtttattgtgaaatgcagccatcctagaaaagcagacaatcatggaaccagcctggctcagtcggggagtgtgttcgcncccactccttggtctgggtgatctgcctgctccctgccagtcaccctattcctgcctcccaagaactctatattctcagctgcttccaatctgctccctc

SEQ ID NO: 45300 - DNA, 201 bp, Homo sapiens
tgagcggaaacggctctacatctttgtgccaggtaagggctcccagcctgtgtgcccactccttacccctcttgtcaactggaggcatcaggggaagtccrgagagtgctttagtttattgtgaaatgcagccatcctagaaaagcagacaatcatggaaccagcctggctcagtcggggagtgtgttcgcccccactcct

SEQ ID NO: 45301 - DNA, 201 bp, Homo sapiens
  misc_feature (1)...(201): n = A,T,C or G, or insertion/deletion polymorphism (see Tables 1-2)
atgactcccgtggactggagaccgatgagcggaaacggctctacatctttgtgccaggtaagggctcccagcctgtgtgcccactccttacccctcttgtnaactggaggcatcaggggaagtccagagagtgctttagtttattgtgaaatgcagccatcctagaaaagcagacaatcatggaaccagcctggctcagtc

SEQ ID NO: 45302 - DNA, 201 bp, Homo sapiens
  misc_feature (1)...(201): n = A,T,C or G, or insertion/deletion polymorphism (see Tables 1-2)
ggagggggaccaatcacttgacacacacacacccccaaccccagttccctccagcccaaaagggcctcagcatcttttctggcccccctctgagctacctnagcccctccctcccatctctctcccacccagagccacctctgggccttgggcagaacctgggcagtcgggggagggggcagagagctgtagggaagaggc

SEQ ID NO: 45303 - DNA, 201 bp, Homo sapiens
cacccactcctctcccctggacttggggtccttactctgctcctttgacttggggtccccactctgcttccttttgacttggagttcccagtctgctcccytggacttggggtccttactccgctcccctagacttggggccccccactcctctcccctgaacttggggttccactctgtgccccggacttggggtcctca

SEQ ID NO: 45304 - DNA, 201 bp, Homo sapiens
ttgcccctcacccaccagctgccccatccctgaggcagcgctccatgggggtatggttttgtcactgcccagacctagcagtgacatctcattgtccccakcccagtgggcattggaggtgccaggggagtcagggttgtagccaagacgcccccgcacggggagggttgggaagggggtgcaggaagctcaacccctctg

SEQ ID NO: 45305 - DNA, 201 bp, Homo sapiens
tggcatgtagtaggtattcagtaaatatttgttgaatgaatgaatcttctacatcagtcatcctttccctctctagccccctaccctatccccaagctgamgtgctagtggctggtggtgacttccccagacctaagccaatctctctctaccagtgtcatccatcaacgtctctgtgaacgcagtgcagactgtggtccg

SEQ ID NO: 45306 - DNA, 201 bp, Homo sapiens
  misc_feature (1)...(201): n = A,T,C or G, or insertion/deletion polymorphism (see Tables 1-2)
gcctgtgtccctgtccttcaggcccatcagtcctggggctttttctttatcaccctcagtcttaatccatccaccagagtctagaaggccagacgggcccngcatctgtgatgagaatgtaaatgtgccagtgtggagtggccacgtgtgtgtgccagtatatggccctggctctgcattggacctgctatgaggctttgg

SEQ ID NO: 45307 - DNA, 201 bp, Homo sapiens
caagaaaactgcaggggccgtgaccagccctctgcctccagggaggccaactgactctgagccagggttcccccagggaactcagttttcccatatgtaaratgggaaagttaggcttgatgacccagaatctaggattctctccctggctgacaggtggggagaccgaatccctccctgggaagattcttggagttactg

SEQ ID NO: 45308 - DNA, 201 bp, Homo sapiens
ggacttgatgtccacgcaggatctccccttaactggagagaagggctccccatgaggccacgcccacctccaaagcgagatccagcccaaggtgaagtggytggagccccaggctggggtactgtcccaactctgccactagccgctgagacctgggaaggcttctcctctgcgagcctcagtttctccatatgtgccagg

SEQ ID NO: 45309 - DNA, 201 bp, Homo sapiens
atgtgcattgtgatcgggaatgaggtggtcaacttcgagtggacatacccccgcaaagaagtaatgtggggccaggcaggggtcggaggaggggccaggarcgggtggatatctggcttgcaggctgatttctccccggcccctcctgatttggggggcctgcccaacctgttgctgcagagtgggcggctggtggagccg

SEQ ID NO: 45310 - DNA, 201 bp, Homo sapiens
gtcgtgggagcctcaggaccctgagggagggaagctgttgctggcggatgtggccaagatgggctggatttatttagattaaggcggtgggaaaggagtgragaattgtacgtgctgggaggagggaagtctggggctctgagaatgactccccaagcatgcttgctctcctggacttggggcacccactcctctcccctg

SEQ ID NO: 45311 - DNA, 201 bp, Homo sapiens
tcgggggctgcatgccatgaaggcccagcccacatagccagcccagccttccagagccaggccagccccgctgcagtgacctcccttctcctggccagccrgccaaattcctcctttagaataataaacagtgtggccagccagggagactgggagaggaggggcagggaagctgaagtgaccccctcccccagcctctgc

SEQ ID NO: 45312 - DNA, 201 bp, Homo sapiens
gccctcaaaggtgggtagatgggagataaggtaggggacccggggggctgcggagtggaaccctggagctggcaggggtgatgtgtgctggtggcagggcrtgaagcaccaggcacactgccctgcccttcagctttagttttcaggatttccagtgggctctgtggaggcctccagctgccagcccttcagctcagaaag

SEQ ID NO: 45313 - DNA, 201 bp, Homo sapiens
tcctttgggattcagttggtgccctgcccccagggccccgcccctgacggtcaccccttgcagagagcggctacgtgcggctcctgggagaggtgggcacrctacaatttgctgagctgcatcggagccggacactgcaggtagtgttcgaggcctacccaccgcccactgtcctgtggttcaaagacaaccgcaccctgg

SEQ ID NO: 45314 - DNA, 201 bp, Homo sapiens
  misc_feature (1)...(201): n = A,T,C or G, or insertion/deletion polymorphism (see Tables 1-2)
gagactcgctcagtctcacagtgggtcccagggtgcttatgaggggagctgattgctctattcatagtaaagccagtccgagatccctggggtgcctacancctccctacggcatccacactgcctgcctgtcctctccccacagcttgaatctgcctttttgctgtgtgactggggcatgcttctgtccttctctgggcc

SEQ ID NO: 45315 - DNA, 201 bp, Homo sapiens
atgttggctaggttggtctcgatctctcaacctcgtgatccgcctggctcggcctcccaaagtgctgggattacaggcatgagccaccatgcccagccttkgtctaactcttaattgtatagatggggaaactgaggcccagagagggaaacaacttgtcaaagcccgcacagcaagtctgtggctgaatagtcatggaaa

SEQ ID NO: 45316 - DNA, 201 bp, Homo sapiens
gactgttgggcgaaggttacaaaaaggtatgttgaggcagggtaggggtggagcacggagagctctggtgcagaagtcagacaccgagtacaaggctctgygtgatgggctggcatttaggggaccaccctttgtcctctctgggcctcagtttccctgctggttctaggaggggatgggctggcgctgtgagtttatttt

SEQ ID NO: 45317 - DNA, 201 bp, Homo sapiens
caccaggctggagtgtagtggcgtgatctcagctcactgcaacctccgcctcctgggttcaagcgattctcctgcctcggcctcctgagtagctgggactrcaggcacttgccaccatgtccagctaatttttgtatttttagtagagacggggtttcaccatgttggctaggttggtctcgatctctcaacctcgtgatc

SEQ ID NO: 45318 - DNA, 201 bp, Homo sapiens
ccctggcctgcctgtgtcgtgggagcctcaggaccctgagggagggaagctgttgctggcggatgtggccaagatgggctggatttatttagattaaggcrgtgggaaaggagtggagaattgtacgtgctgggaggagggaagtctggggctctgagaatgactccccaagcatgcttgctctcctggacttggggcacc

SEQ ID NO: 45319 - DNA, 201 bp, Homo sapiens
gcatacgtatgtgtttcagaggagtgtgcgaggaagtgcgtaggcaggcatctgtgcatctgtgctgtgtgtatgtgctgaccatgtgcaggctccccccrtcaacccccgcagcaatgcagggccccctccctggcctgcctgtgtcgtgggagcctcaggaccctgagggagggaagctgttgctggcggatgtggcca

SEQ ID NO: 45320 - DNA, 201 bp, Homo sapiens
  misc_feature (1)...(201): n = A,T,C or G, or insertion/deletion polymorphism (see Tables 1-2)
gggcagagaagccagcctttgcctgagggggatggagagcagaggagggccggagaggtcacataggtatttcagaaaggtccctctggctggggtgtganaacaggtggaggggacagattggaggtgaggagattggcggtgggatagccagaggcagccgagcctgtgctggaggagggggtgcagggggcttagcag

SEQ ID NO: 45321 - DNA, 201 bp, Homo sapiens
ttcaatgctccccacccccacccacagttcatctcaaccctccctcttggcctaggggaactgcctgtgggtgaggatttacgagacctggtttgagtccyggctctgctaccaatgccgagatgaccttggcaagcccttcccctccctgggccttgttcctctttataccaggagggtggggagaactgtaagagtcct

SEQ ID NO: 45322 - DNA, 201 bp, Homo sapiens
gccagccgcatcgctgcccccacccccaagcacacgcactctgacgggtgagggggtgtttgctgcaggagagcggggctcgggctggggagatcagcccrttctttatcagcctggccccattccagacagatgtttcatcttattttggacttccagaaaataggtcatttctttccattgtgttccctggggaggcct

SEQ ID NO: 45323 - DNA, 201 bp, Homo sapiens
cctcccttgggcccccagcagccgtgaggcacacactgagcgctttcccacgcactgttccaagtagccagccgcatcgctgcccccacccccaagcacasgcactctgacgggtgagggggtgtttgctgcaggagagcggggctcgggctggggagatcagcccgttctttatcagcctggccccattccagacagatg

SEQ ID NO: 45324 - DNA, 201 bp, Homo sapiens
acttggggttccactctgtgccccggacttggggtcctcactctgctcccctaaggggtccctctgagtcacgtgaggagctgggcatgatctccactttrggcctctgagcctacaacctggccagaataggaggaatcaggaggggttcctggcacatagcactctcttcatgggcaaaagggggacacctaggggtgc

SEQ ID NO: 45325 - DNA, 201 bp, Homo sapiens
acttggggtccccactctgcttccttttgacttggagttcccagtctgctcccctggacttggggtccttactccgctcccctagacttggggccccccamtcctctcccctgaacttggggttccactctgtgccccggacttggggtcctcactctgctcccctaaggggtccctctgagtcacgtgaggagctgggca

SEQ ID NO: 45326 - DNA, 201 bp, Homo sapiens
cctgctgtacaatgtacatctgttagcaggtacacatacacgtgtaatttctgtgcgtatgaacaatgcctaccagtgtcttgatgcttttgtgtatctasctgcccgtccttatgcatacatgcacctgtatgagtgtgcttcatttattcacctttcttcttcattcgataaatatgaggacccaacttctcattgaag

SEQ ID NO: 45327 - DNA, 201 bp, Homo sapiens
gggaacagttccgaagaggagagccagctggagactaacgtgacgtactgggaggaggagcaggagtttgaggtggtgagcacactgcgtctgcagcacgkggatcggccactgtcggtgcgctgcacgctgcgcaacgctgtgggccaggacacgcaggaggtcatcgtggtgccacactgtgagtccccagcctcagtg

SEQ ID NO: 45328 - DNA, 201 bp, Homo sapiens
taaccgcattaaaatcccctcctctcctcaattcagatcagggctatttgatgtctcaggtgcctgaaaccttttatctgccagaggtaccagcttctccrccctgtgatggagagggctgtcccttgggagggtcagggggtctgaaagttcctgaatgtcagagatgaaaaggacttttgggggtcacctgatccaact

SEQ ID NO: 45329 - DNA, 201 bp, Homo sapiens
tgggtttgcagcgaggagacaccccagggcaaacagcctgaccccagccagggatgtccaagaaaggccgcgactcctgataatcccttatgccccggagygcctcgcctgcagaggcagcgtccccgccacccagccccggctctgccgcggtgaggaccggcgggtcggggtggactggacactgtcccacccatcaaa

SEQ ID NO: 45330 - DNA, 201 bp, Homo sapiens
tcacatgacttgcgctttgcaatgtttaacactgcagtcaaatgactcggcatcctaaagagcgtgttagaggcagggaacgcaatggaggtcactccacrgtcactacaaattccgggaaggaaacttccccagattcctccacttggaggtggcgctcggcctcaggctaggagggaacaggtgagaaagcagcccagg

SEQ ID NO: 45331 - DNA, 201 bp, Homo sapiens
ccatctggtcctgggcttcttttggttggtaggctattaattactgcctcaatttcagaggcagttggtctgttcagggactcgacttcttcctggtttastcttgggaggtgtgtgtgtgtgtgtgtgtgtgtgtgtgtgtgtgtgtgtccaggaatttatccatttcttctacattttctagtttatttgtgtagaggt

SEQ ID NO: 45332 - DNA, 201 bp, Homo sapiens
ccaccccacggctctaccaaaactccttttgtcaaagactccagtgatatccacaatgccaaattcagtggttagttctgatttttcttagataaacacayaagccatcagcatcgtgtgtcatagttgactatttcctattccttcaaatgattttatttggattttttttttcctatctgtactgttccttgtcaaact

SEQ ID NO: 45333 - DNA, 201 bp, Homo sapiens
atttagagtcttagttctgcctctttctagctatgagatttttaggtcaatgacttaatctttctatgtctgtatttttatacctttaaaatgaggtactrttaatacctacctcatgggatgttatgaatattaaataagtttatgcaatttgtttatcataacattgtttaataaatgttagttataattgcttttaga

SEQ ID NO: 45334 - DNA, 201 bp, Homo sapiens
tagaccggagctgttcctatttgggcatcttggctcctccattctttcttagactcccccagataaagctttcaactgccccaccccacggctctaccaawactccttttgtcaaagactccagtgatatccacaatgccaaattcagtggttagttctgatttttcttagataaacacacaagccatcagcatcgtgtgt

SEQ ID NO: 45335 - DNA, 201 bp, Homo sapiens
taaaagtccctctggaatacaacactgcattcagttttccctcttaactctctattgttgggcaagttactccaagcctcagtcacctcatcttccttatrgtgagtgaggtataagtgataaaataataattattgaaataaatgctaattattgttaccataacagttgtttctcctgcttttattaatttggagtcag

SEQ ID NO: 45336 - DNA, 201 bp, Homo sapiens
cataatagggtatcaataaatatttgctgaaagagtaaagggatcaatcaagcaacaaacatagcaagtaaaatagaatagatgcccatgatctattgcaytataaatgatgcagttgcaaatattctttaaataaagctgccctgtaatacttgacttttcatgagctacttcagtttcattaaaactaagtaaatatat

SEQ ID NO: 45337 - DNA, 201 bp, Homo sapiens
gatgtattggcaatcttttaatttgtcctaggtttcccaaaatttaacttgaatcggtcttaaccaatttcttatcagatgttaagaaaatttaaaaagawgggaaacatagatgatagaggaaaagcataggggatagccaagtttttttaataaagattaaaaaattgaataatggataacccttttaatcttttagtt

SEQ ID NO: 45338 - DNA, 201 bp, Homo sapiens
tatttcatttttgctctataatgactgatgccttagctgattgggtcaattggctagaattgctgggacagctagctcaaaacagatgttttttaaagttmaaaaataggcaacctaataatattatttgaagatttattcatagattgtttaaaaacaaaaacaaaaaaccaagaacatacaactaaaaagcaagggaat

SEQ ID NO: 45339 - DNA, 201 bp, Homo sapiens
tttttcctttcttctgatattttggtaatatcttctattggctgaccttgataaaaatctttgtgcagcctgcaaggtttaatccccggaaatacaaagcrgagcaggaaaaggatagatctgaagataggcaggtctaggacctgaactgatgttcagctagacaggcaatgtcttaattcttaattgatttgcttctca

SEQ ID NO: 45340 - DNA, 201 bp, Homo sapiens
ctttcactactttggttaaattaattgctaggtatttaattttatttatagctgttataaattggattactttcttgatttctttttcagatagttttctrttgacatatagaaatgctactgatttttgtatgttgattttgtagaatgtgtttatcagtactaatagttttgttgggtggaatctttaggattttctaa

SEQ ID NO: 45341 - DNA, 201 bp, Homo sapiens
ataccaaacagtacttcatgctcacatctcctactaaggtatattagtgatacacatgggtaatgtctgtgagcaagggttaccatatttgagaactgcaytgtccaatatagtagccactagccacatgtggcagctagttaatcacttgacatgtggctcatatgactgaggaactaaattctaaattttaatttaaat

SEQ ID NO: 45342 - DNA, 201 bp, Homo sapiens
atcgaatctgtagatcgctttgggtactgtaggcattttaacaatattcttccattccatgaacatggaatatctttccattttttgtgtgtcctctacartttctttcatcagtgttttataattttctttatagagatctttcactactttggttaaattaattgctaggtatttaattttatttatagctgttataaa

SEQ ID NO: 45343 - DNA, 201 bp, Homo sapiens
agacctcctcatatttccacttaatactgacctcagggagacaaggaagctccatcagaatttcccctacttgcatttctgcctgtatacttcctagcaargaaagttggggtaatttttggctgacctaattggtttcccatctgtctacgatcaccattctgccttgcttgtcatccagtatctgaaatcccttgttca

SEQ ID NO: 45344 - DNA, 201 bp, Homo sapiens
attgctaaattaggttttagtttctgtgatgggaaggtttatgcttcttaaatattgtattttcttgttgccttgtgttttaaaggaagggtcagtaagtrttcatgaatggataagtcgtgtctttacatcactaaagagttaatgcttctcagtatgtatatcgtgttatataatttagttctgtcaccctattacaca

SEQ ID NO: 45345 - DNA, 201 bp, Homo sapiens
gataggtagtttttctatccacaccttcctcctaccctccaccctcaagtaggctgcagtgtctgtttttcccctatgtccatgtgtattcagtgtttagytcccacttgaaagtaagaacatgttgtatttggttttctatccctgagttagtttgcttaggataatgacctccagctccatccatgttgctgcaaaaga

SEQ ID NO: 45346 - DNA, 201 bp, Homo sapiens
ggggcaatagaatttgttgaaaataccaaatgcaatgattaaattagttctagatgaaaaggcagatattgctgaaaagtttaatgtgaaaagtgaaaaaagtgtgatttgtaatacgtagtcaagaagaagcaactcattcttgggtgtgataatgagtggagaaatattcatgtgggtgttttgatgattaatttgttg

SEQ ID NO: 45347 - DNA, 201 bp, Homo sapiens
aatcccacttggtcatgatgaatgatctttttaatgtattgttgaattcagtttgctagtgttttattgagggtttttgcattaatatttattggacataytggcctgtagtcggttttgatgtgtctttctcttgttttggtatcagggtaatactagcctcacacagtgagtttgaaaatattcccttatcctctttct

SEQ ID NO: 45348 - DNA, 201 bp, Homo sapiens
gcttatatgtcagtaggaaagataaatattttttgaagaacatttgtaatacagttgagaagtgttctattgcaggtaagtatgctacaggaaggcatgcmactttatcttcgagtgcaaggattgattatgagtatgtgctgatctcaagaaaaaggcagcactgttaatcatctgtgtgttaccatcttccaactctgg

SEQ ID NO: 45349 - DNA, 201 bp, Homo sapiens
atcagttattatccctctgaataaactttctatccttatctgtctctctagaccttctctttaaggccagtaactcttagatttgccctttggggctattwtctacatcctgtaggcatgcttcatgttttttaattcttttttttgtctcttctgtgtattatcaaatagcctgtcttcaagctcactaattctttcttc

SEQ ID NO: 45350 - DNA, 201 bp, Homo sapiens
tcccacctatgagtgagtcaggaaacaacaggtgctggagaggatgtggagaaataggaacacttttacactgttggtgggactgtaaactagttcaaccrttgtggaagtcagtgtggcgattcctcagggatctagaactagaaataccatttgacccagcaatcccattactggatatatacccaaaggattataaat

SEQ ID NO: 45351 - DNA, 201 bp, Homo sapiens
ggttgcagtgagccaagatcgcatcattgcactccagcctgggcaactagaatgaaactccatctcaaaaaaaaaaaaaaaaaaaaaaagagtgaagaatktacagtggcttctagggccctccagtgtctagtctcttcctacttctttgccccttgttcactttggtcgctctggcttccttgttcatctcctcaaaat

SEQ ID NO: 45352 - DNA, 201 bp, Homo sapiens
ctctgaattaaagtcagtgcattagctgtttttctctacctgggatgttcttctctcactttttctccccttccagtatttgctgagacattacctgctcrataaggcataccttaccaccttattaaaatcataattccagcactactgatctcactcttctctactttatgttactttgtatcttttgatattacttgt

SEQ ID NO: 45353 - DNA, 201 bp, Homo sapiens
cggaggcggtggccaaagtgggcggggctaggccggagctgctggtgggaggcagccacttgagatcaccaggcctcctgtagaccggcgggtgcagggcmcggtcccagagttaagggtgtgagtgagactgctgcgggcaggggttggcctatgccctctgctagggggagaggtggagtttgggtgtggattaatggg

SEQ ID NO: 45354 - DNA, 201 bp, Homo sapiens
tgattttttttaagtcccaggttatagatattatttcagcatagacactttaaaaagagagaaaatacctggaacaaatcggaaatacgtttgctaaaatmactttatttggcagggtgtttttaataacagtatctgaatttcattgttctatatattactgttattgtatccatttagcaattatttagattttagaca

SEQ ID NO: 45355 - DNA, 201 bp, Homo sapiens
agagcagagataaggataaatgaaaagttagatttaaagttgtttcagaccaaaaaataaaaatggaaaaagtaaaagtgaatttaaacatggcaatagtraggtcttatttatttcccccaggaaagtcgtttggaaaccccaggccaacaggaccctttggcagctgaggctggaaacagcggaaccaaaggcagacgg

SEQ ID NO: 45356 - DNA, 201 bp, Homo sapiens
tatttttaagtggaacagagccaagccattggatgtcggttccttaataaaatgaatctatgagatattacagatatatagtcaatttaattgaagtactattaaattacataagtggattaaatagttccagtgggcaatgtttatagcatggagattgagttcaggctctgggggtagactgtgttacaattttagctt

SEQ ID NO: 45357 - DNA, 201 bp, Homo sapiens
cagggtacagggagatgatctcgtcagagaatcggactgatagactgattatcttttttattttttggatgtgcatgcgtagtcttttcccagggatagtstctgaagatgagaatttagcattgtgagaaaaacaaatacaagagcttgaaatagaagaccatctgaatctaaaatgtaatacttttaatccgttcagtc

SEQ ID NO: 45358 - DNA, 201 bp, Homo sapiens
aaacacagtcatactttgacattggtgtttgtactttttcttaaatataaaacttgggaaaaaatcttcaaatcatataaaattactttttttttttttttcttttgagacggagtcttgctctcttgcctaggctggagtgcagtggcacgatcttggctcactgcaacctcctcctcccaggttcaagagattctccct

SEQ ID NO: 45359 - DNA, 201 bp, Homo sapiens
cctacaaaatgcttcggtatccatatttttgtagaatgtataaagaatgcctttcatgttggttggaatctggcatacctaatttaggtgtctggccaaamagaatacatactacagcagaaaaatatagagaatatgaagcccgggagcaaacagatcaaactcaagcccaggagttacacagatctcaagatagagatt

SEQ ID NO: 45360 - DNA, 201 bp, Homo sapiens
atggatatgccacattttgtttatccgttaaccaaatgatgagcatttatattgtttctgctttgtggctattgtgaataatgctactacgaacattcgtrtacaagttttcttttcttttttttgaaacagagtcttgctctgtcacctaagctggagtgcagtggtgtgatctcggctcactgcaacccccgcctcctg

SEQ ID NO: 45361 - DNA, 201 bp, Homo sapiens
cattttcatagaaagctttaagagaaattgagataaaatgagccacactaattgtaagccatctctaaatgagaaattattgaaaatgttattaccagctrgatgctgggaagtgttaaagagctgggggcacaacagtgtgaccagtttgaccttatagagagaaatataaatttgtcttgaattagccagtctgtgtta

SEQ ID NO: 45362 - DNA, 201 bp, Homo sapiens
aaaagctatataataaataatttgggcatatttaagggattttttttggaaggtggatattttctaagctaaagtctcaaagtgagattaatagcacatayatgcctttagcccttgaaacatgcttttcaaaatgtatacatgtccttctagaaaccaaaagcctttactgggcactatttctacagcaatttagtggta

SEQ ID NO: 45363 - DNA, 201 bp, Homo sapiens
ggggaacacattcccaccataggacttgttttttttttttctttccttttaagccctgtcactctcgtattattagtcagagttcatgtctctgttttctrttgtatcactgagtaatagaaaaataagttagttttggagttatacaaaaacctaggttcagattccatctctaccatttactagctttgtgaacttgaa

SEQ ID NO: 45364 - DNA, 201 bp, Homo sapiens
tcccagctactcaggaggctgaggcatgagaatcacttgaacccgggagctggagattacagtgagctgagattgtgccactgcactccagcctgggtgasagagtaaaactctgtctcaaaaataataaaataaaataataaaatttattaagaaatagtcattatcttttagttggaacataaacttattcctgatcaa

SEQ ID NO: 45365 - DNA, 201 bp, Homo sapiens
tcttccaaatcaataaagcagagaccaacatcacatcaggaaaatggataaaggatttgttcaagcaatttctagctggaatcaactggctattagatttraaaagatgtccaaccttactaattgccaaagaaatgaaaattaaaacagcggtaagctaagatttacctactatcagactagtcagggttaaagagtgat

SEQ ID NO: 45366 - DNA, 201 bp, Homo sapiens
gcaacttcctccatgaactggctcctacctgtcttttcatcttcccctttccacataatagtctttgttccagccatattgaagttcttatagtctttccrgcacaccatagtcattcacctgcaggccttggatgtccttctgcctggaatattgaccttcctcttctctcatctccctgccctacccctacccttttct

SEQ ID NO: 45367 - DNA, 201 bp, Homo sapiens
ctccaagtgacatacaagattcacatacagttgcaaatatttttcccagactgtgactgtcattttactttgtagagtttttctgctatgtaggattatamaatgtacagttcacatgtttattgcatcattttattgtgatggaaaaaataaaaaccatcctaaatgttcctgctgcggtgacaatgtgagctccacaag

SEQ ID NO: 45368 - DNA, 201 bp, Homo sapiens
aataaatggtcatctagctttagcctcttcatcttcatctctcctactccccattgtattccggtgaagacgagcacatttcagcctgaagttgccagttscataaatataatacaggcgtagagactttagaaaggatagatttcttagaataaaagcaaaactcctttacatggtttgcaacttcctccatgaactggc

SEQ ID NO: 45369 - DNA, 201 bp, Homo sapiens
actgtatagaaataccagagaatccaaagaatagaatcctaccctcacacaatttgtttaacagagaaaagggttaaatctgtccagtccaataaatcaakaggtactacataaagaaaatatgagacacaattggaagggcacaagttcctgtatgggtttcctcgggctgctgctactaagtactacaaactttgtgcc

SEQ ID NO: 45370 - DNA, 201 bp, Homo sapiens
ttcatttatctattcattatcttttcaacaaacatttattgagtgttttctaaagtagtttttaatcttggctgcatgtcaaaatcctctgtgaagctttkcaaaagtagtgattcctgagtaataaacccctgaaactaattcagtagatctggagtggagccaggcatttttgtcaaaagcaccacaggtgactgtgat

SEQ ID NO: 45371 - DNA, 201 bp, Homo sapiens
ttaatttgtacaaagaagtcagctggaattctgatagggattatattaaatcttagatcagtttgggtagtattcccatcttccagtctttgaacatacaktaattaagtcttccaatctgtgaacattcagtaatttcccatttatataggtctttaatttatttcaaaaatgttttatagctatggccttatcacttca

SEQ ID NO: 45372 - DNA, 201 bp, Homo sapiens
tgaatgacacatataaaaattctcaagctcttcagaagaaagaaaatttatgcacttaattttgaaaaaatggccatggtctggattttgcagaattgatrtatttgatgtattgatgttttgcatagtcttaaaaatgagatagattctagacatccctttgaataaagaaatctgggtattttcctcaagaggctggct

SEQ ID NO: 45373 - DNA, 201 bp, Homo sapiens
gtaatattatactaattgtctaggttgtcgtaaagggtgatataatgaaaattgaatagaaaatatgacttgtattttgaaactttacatcttgaaaaaaaggaacataggatgagtgataattttgggatggtgagttcagcctgggatcttttgaatatgtgctgttggcaaggcactgttgatggaaatactaagcag

SEQ ID NO: 45374 - DNA, 201 bp, Homo sapiens
cctcatactgttatggctaaaaatgttttcatgttcattttcgacagtgttgttacagtgtgaaaatttcaatgattagaatgattggattaaaaaaaaaattatctagtctctgcaagatgatcttgggcaaatgccttgatttctgtcaatctccaactccagagaggagtctgagatgagtcttaaaggatatcaaat

SEQ ID NO: 45375 - DNA, 201 bp, Homo sapiens
gctagacaggcaatgtcttaattcttaattgatttgcttctcatactttgggctgtatccgttgggaatcaaaaatgcaaaatgttaaaaattacagacartggagctgtacaacttgtattcaaaatccagctctacccttactcactgtgtgactctgggataattacttaatctccatgcttgtgtcctcatttgtaa

SEQ ID NO: 45376 - DNA, 201 bp, Homo sapiens
aatgatgaatttacagatgaaacttttttttgtttttttgtttttttttgagacggagtttcgctctgtcgtccaggctggagtacagtggcacaatctcrgcttactgcaagctccacctcgcaggttcactccattctccagatgaaacttttgatgtaacaggaactttaaaaaatatctgaatgtatttgaagtgag

SEQ ID NO: 45377 - DNA, 201 bp, Homo sapiens
tcaaagtaaactagaagacagatgtgaggcaccaataagaggaatgtcccttgggtactgaggtagcttctctggctcaagacttttatataatttcagcrtcagtatggcaggccaggtctgatcaagtaactgatctgaaaaaacagatacaaaggctgagaaaataagctggcacctaaacggaagcaaaatagatta

SEQ ID NO: 45378 - DNA, 201 bp, Homo sapiens
attgttttatgatgatatcttaagcaaaatgaatattgttgctttattttactgttgaaggttctatattgaagattttttctatgaaaacttttaaagcrtatctttgatatgtgtttaaaagtctcattagtattggattttatgataagctttatgtttattatatgcaatattttaagagtggcatgtttatctgtt

SEQ ID NO: 45379 - DNA, 201 bp, Homo sapiens
aaattatggtttcatagttgataaaaatgttacactctcatgtttaaaaatcagacgtatgtactgaatccaaattttaaatttgcttaagagccattctyctggttcaggaaatagacatgacccaggcagaaaacaggttcattgtatatgagaagctcatagaaagaaaagggagaaacgagtgaggtttttctgttc

SEQ ID NO: 45380 - DNA, 201 bp, Homo sapiens
tatcaagagtcttttgaggtacaaaatatgtaggatgagttccaactctaaaagtagtattccagaacattgtaatattatgcggtgatcaagaatagagrcattgaaacagaacaaccagggttagaatctcagcctgccactacccgtaacaatagacagattatttcaacattctgagtcagttatctgatgtataaa

SEQ ID NO: 45381 - DNA, 201 bp, Homo sapiens
cagaggaaaatattttagatttttatttagtaaactagttgttcttcaaaccctgtataaaaacattgctaaacttgtgtttatggaataactaacttcartcagtttaggagatgcctgtgtataaggagagaatgttaattctctcaaattcctgagtgacaccttaaattcaataattattactactgttattgttat

SEQ ID NO: 45382 - DNA, 201 bp, Homo sapiens
gttcaggctgctagaacgactaggttgcttaaaaaaaaatggacatttatttctcacaattctggagaagggaagtctgagatcaaggtgcccacagatccagtatctgttgaggacctaggacttgaagaaaaagattgttttctggcgccatgaagctggagtgaaaggtaaattgtttatgatactttcaatacttgg

SEQ ID NO: 45383 - DNA, 201 bp, Homo sapiens
agacctagcttaaatgctgctgctgctgctgctgctgctgctgctgctgctgctgctggtggtggtggtggtggtggtggtggtggtggtggtggtggtgkgtgtgtgtgtgtgtgtgtgtgtgtgtgtgtgtgtgtgtgagagagagagagagagagaggaagagagattccatccattatttcccaagttgggcatggt

SEQ ID NO: 45384 - DNA, 201 bp, Homo sapiens
gcttttactccattctttctttcctcttttttggaattctggtcatatgtatgttaggttttctcaccatgtctcttatgctttttttttttttttgtatmttccaaattatttccaatctcttcctcaatctgaatagtttctaatgaactgcgtttcatgtccctaattctctctttggctatttgtgagctgctttta

SEQ ID NO: 45385 - DNA, 201 bp, Homo sapiens
ccacggcccaaagaccacatgcagcccaggacagctttgaatgtggcccaacacaaatttataaactttcttaaaacatcatgagatttttttttttttttagctcattagttatccttagtgttagtgtattgtatatgtgacccaagacaatttttcgtcttccagtggcccagggaagccaaaagattggacacccct

SEQ ID NO: 45386 - DNA, 201 bp, Homo sapiens
gcaaggccttatggtgactcatcttataatgttctgtaaactctcttttttcctttgtggtcagttgctagtagttgtcccctttgggtgaaacaaataccaggaggtaatatgcatttaaatgttttatttttcttggtgaatattgctttagaaagtatgtgcattttttatagctacttattttctctctgttggtct

SEQ ID NO: 45387 - DNA, 201 bp, Homo sapiens
ttatgatactttcaatacttgggctattttcttaatatttattcttaactttttccttgctattgttaatcatatttaagttccaaaacacccacatgctsatccactgtatacacattattttatttcatttagaaacttgtatctgtaaagtgactttaatttatttgaaagaagcattttattgctattttatgtaga

SEQ ID NO: 45388 - DNA, 201 bp, Homo sapiens
ctctttccgtctccaccagttgaaatattttcatctttaagacctagcttaaatgctgctgctgctgctgctgctgctgctgctgctgctgctgctggtgstggtggtggtggtggtggtggtggtggtggtggtggtgggtgtgtgtgtgtgtgtgtgtgtgtgtgtgtgtgtgtgtgagagagagagagagagagagga

SEQ ID NO: 45389 - DNA, 201 bp, Homo sapiens
tttggctatttgtgagctgcttttaagcccatctatagaattcttaattttaattattataattttctgttttccatttggtctgatttttattttatttractgttttctatagagccatttctgggataaagttatctagtttgtcctctgttttcttgagtatattaaccagttatcttatagtccattctgataact

SEQ ID NO: 45390 - DNA, 201 bp, Homo sapiens
atattgcttttactccattctttctttcctcttttttggaattctggtcatatgtatgttaggttttctcaccatgtctcttatgctttttttttttttttgtatattccaaattatttccaatctcttcctcaatctgaatagtttctaatgaactgcgtttcatgtccctaattctctctttggctatttgtgagctgc

SEQ ID NO: 45391 - DNA, 201 bp, Homo sapiens
ttataattttctgttttccatttggtctgatttttattttatttaactgttttctatagagccatttctgggataaagttatctagtttgtcctctgtttycttgagtatattaaccagttatcttatagtccattctgataactctattctgtattctgtatgtctgtttctataacatattccttaagcttggtatgtg

SEQ ID NO: 45392 - DNA, 201 bp, Homo sapiens
cactggacagtcttaactcctgagatgaatatgtctgcaactcagtgatcatgggactgcctattacatattagtgagtggtaaaggtttgggacctgctrgattgttattccagagtggggaaagattactccactgaataaattttaaaagggttactgagtgagagaaatataattgtgttttattatttctaaaata

SEQ ID NO: 45393 - DNA, 201 bp, Homo sapiens
aagttctggtgcactgggattgccctacattgttactttgaaacaagaccactcttcctttggaaaaacttgggctaacctgctaaatgctggagacatayggtccattcatcatctttaccccaaccagcttcccaatgtgtaagtgaggccatgtggaaccaactaggcctcagtcaacccactatcaaaagaatcacc

SEQ ID NO: 45394 - DNA, 201 bp, Homo sapiens
aatgtaaaggagagtgattagcaaataaaaacatggtgcaaaagagttaataacagatcattatttgtgttctaggagagatctattcattaatgaatcarttggcaatattaggaatacattgatgttaaatgactctaaaaagttggacatcttgagctgaattataactactttatatggtcctgtggtaatgagtct

SEQ ID NO: 45395 - DNA, 201 bp, Homo sapiens
tgagtgattcagcacacaatggtagaacaatagcttgccttagcaattacaaacatttcaggggcattatgaactctttttagtgatttttttttttttttaatgtccaaataaacttgtcatactagctcatccctctcttaacactgaccttactaattatgtcaaaggagcatccctctgttgtcaaatatttgccag

SEQ ID NO: 45396 - DNA, 201 bp, Homo sapiens
tcttatttactattgtgtttccagttggctggtacttgacactacaaacatttgttaaatggacaaacaaaatgaattataatgcatttatacaactgaarttagtttttaaagataagtaaactaagttgtagattattttacagatgattcgtttcttataagtatatgtatatatatgcacatatacacctatatgta

SEQ ID NO: 45397 - DNA, 201 bp, Homo sapiens
attgttttgatacaatgatttcttttcttttaggtagatacccagtagtaggattgctgaattgaatggtagatctacttttacttctttgagaaatctccatgctgttttccataagggttatactaatttacatttccaccagcaatgtataagttttcccttttccacacattcacactagcatctattgttttttga

SEQ ID NO: 45398 - DNA, 201 bp, Homo sapiens
tcattgagacaactgaggaatttagaaaaataaattgaataatatttgataaatttacactctcagcaaacccagggcccaatgtcgcttctttgaatttyaaatataggaaactataggcctgccatttctcagggtacatctcttgggcaggcagtcctaaactcctgctcagattaggtttgaaaggtttaatcagtt

SEQ ID NO: 45399 - DNA, 201 bp, Homo sapiens
tgatctcaggaatatgatatcaggatctaatctagtttagaacatctaggaagacttccagagtatttgaattcaatttagaacatgaaagatcaatgatwgttagctgggtgaaggagggagggctattctggcaagagagagaattgaagtgttgaaaagagaatattcgaagatctttggcagaaatgagaatggcat

SEQ ID NO: 45400 - DNA, 201 bp, Homo sapiens
ttagaattcacttcccctaacttactagtaataggatcttaatcaagtcacattttctctctgcacctgagttttcctttttttttttttttttttttttktgtaaaaagggatataatgccagttgtctaattccctcacggagcatttgttagaccaagtaggaaaacatcgatgcttggtaaaccataaagcaataag

SEQ ID NO: 45401 - DNA, 201 bp, Homo sapiens
cacagtgaccaatacgatagagatgtgaagcagagaatcacctggcaacagagtttcaagtacgttcctgaaataaaattgccatgaggcaaggtggtaargttttcttaccatctcaacctcctgtccacatttagcttctttcctcgcaccatctctagcccaggtttacctggtagcctggttatgttaacaccggtg

SEQ ID NO: 45402 - DNA, 201 bp, Homo sapiens
tgccttttcttcctctttctctcttcagaaagagcagagaatttagtgttggcgagacctagtttagaattcacttcccctaacttactagtaataggatyttaatcaagtcacattttctctctgcacctgagttttcctttttttttttttttttttttttttgtaaaaagggatataatgccagttgtctaattccct

SEQ ID NO: 45403 - DNA, 201 bp, Homo sapiens
ttatttgttgaaatatgtcataaagaacaatatcctaactgggggtatggcttaagagcaatctgatttaagaaaaagacgaaaagtaagatcttagggtwtcgtaattttgtaaatttttgtttcttggaatatttagaaaaattgattttaaaatgtctcttggaatagctgggctagaaatggtggttcaagggtgca

SEQ ID NO: 45404 - DNA, 201 bp, Homo sapiens
cccagtagctcgatggaaaaaagaagaatcttctttcccctgaccccaggaagtatctcttgtatctcactggccagagttgtgacttgtgccaatttctkaaccaattatagtgggccattgggataatgtacacaaagtagtgtagctaatcaaaaatctacctcttgagcagagatattatatctatcaggctactag

SEQ ID NO: 45405 - DNA, 201 bp, Homo sapiens
tcatatggtaggatttgcaggataattttccaggactagaatattgatccagatttttatcacccatcccttttgtttcttctgagctacagccagttatygctggttggttcacaggaataagcagggttagtttaaaatgtaggcaaaaacttaaaaacaactgatgagattagaatttaataacaggtatatgataag

SEQ ID NO: 45406 - DNA, 201 bp, Homo sapiens
aattaaaattagaagatcgaaatgaagattatttaaaacctgtaattcattatttttatatacatttagggaaagattcctatactgacatcagttttttrctttctttttctttctcttcctctggttttcttccctcccatcctgtattaagccctctttgtctttgcccatatttattgaacacttctatattcaggc

SEQ ID NO: 45407 - DNA, 201 bp, Homo sapiens
aaggtggctcagagaaagaaagatttaagaaagaaagctagaatttgttcacagacgggaagagaatcagcaaattctaaaagtcacacagatactaaccrgaaagtactcattccctatgccaaaattgaacccgggccaccattttaaaatggcagaggccaaaagaaggtactgccacgtggttacaaggtcaagctc

SEQ ID NO: 45408 - DNA, 201 bp, Homo sapiens
cccagttgaggaagaagtaggagttgaggacctgaaatccctattaagtcatatacaatttgagacattttctatttttaaaacaagtaaaatggttagamatttatctttctattcatgtcataaatgcatttcatgtttttgagacttcaacataaatagatttcagtgtgttaagaaagtgtatatttagttcaaaat

SEQ ID NO: 45409 - DNA, 201 bp, Homo sapiens
gccatgtggacatcaaagagtgagtggagtagaatttattaggtgaaaaggaaagctctcagcaaaaagaggggtcctgaaagcaggctgctggttgcccycttcacagttgaatacaagggcattttacatacatgctgatggggctgtgttccctacttgtataaggtgtgaattccttgtcgattcaccccatttccc

SEQ ID NO: 45410 - DNA, 201 bp, Homo sapiens
acatcaggaagcaggctgtctctgtaaggtcacttatatgccacttgagagtaagtatagtaattaatagcgcgatcttcattttgtgtggtaaacgtgasttagcagaaactaatacgactgaagttgaagactgaataaatgtaaatttcttctttaagattaatattttgcttggaaagttttgtatgttcccatgtg

SEQ ID NO: 45411 - DNA, 201 bp, Homo sapiens
atatgctgagaacagcagtagttgcagcagagatagtgtttagtcatagcactttaattgggaggaggatgggagatatttctcaaatctgcctctctaasagtttggaggctagggtttttagcggtaatttggtgggcagagcactagggaataggtattgctgattgactgggcatgaaatcatggtattgtccaaac

SEQ ID NO: 45412 - DNA, 201 bp, Homo sapiens
atgtgcgtgtgtgtaatttttggtggatatagtgaataatgcaaccatttatgtttctctcttgtagtggtttttaggaaactcattggtaaattttgtgktctgcttatattaaaggatgtaaacattttatgtcctttcttttgagtaacagtcataccactgattatactttttattgacacactttattcagatagc

SEQ ID NO: 45413 - DNA, 201 bp, Homo sapiens
ctagactctccaggatgttagaactggctttggcctgtggaacacctcgtcttgtgcattctatttcctgaataaagggtcttctttgttttccctgcaaygagtggtcttttgctcctcatttctgtggtcctttacccattctcccaacccaatggcatttcaaaactatttaaaatttaaaaaaattattaatataat

SEQ ID NO: 45414 - DNA, 201 bp, Homo sapiens
atttcaagtaggagcttggtactttatcatcacatcttctggacttcaattcattttctgattttttttttttttttagccatttctactttgaggaacckatgtaataggatttttctgataattagaggttgttcataaagtgtttaactgacagtacttggcacagacagagatgataatataatgacaaaaatactg

SEQ ID NO: 45415 - DNA, 201 bp, Homo sapiens
ctacacaattcattagatttacagtgaaaaatattaatgttaccggtcttcttttcctatctttacaacatttgttttaggagcatttcctccctctgctwtttatacacggaaagacttactacagcgatctacccatattgccaccaagactttccaggctcttcgcatatttgtgaacaatgagctcaatgaactcta

SEQ ID NO: 45416 - DNA, 201 bp, Homo sapiens
caccatttctctttctgtgctccttgttaaactccaattatccttatgagttatgaaaggtttttttgccacatagttttaaaccttggaagaatgtttgrgaataagagggggaagtatgaatgaagtgccaccacaattttctaagaaaacttagttcactaaatatgcacacaactacacaattcattagatttacag

SEQ ID NO: 45417 - DNA, 201 bp, Homo sapiens
caatggtgggcgcccctcccccagcctggctgccgccttgcagtttgatctcagactgccgtgctagcaatcagcgagactccgtgggcttaggaccctcygagccaggtgtgggttataatctcctggtgcgccgtttcctaagcccgtcggaaaagcgcagtattcgggtgggaatgccccgattttccaggtgccatc

SEQ ID NO: 45418 - DNA, 201 bp, Homo sapiens
taaaccatcaccacttgccataatgatgggtagttgaaatagaaagtctatttcatttgtttaaggtttcagtttctgactttaaaacctcacttctcctrgagtatgtgtgtgtgtctgactttatgtctcagtactctgaagtttcacgtcttgtcaatgagaactgatgtcagtgaactaattggctcttcttgtgcg

SEQ ID NO: 45419 - DNA, 201 bp, Homo sapiens
gctcctttaagcacttctctgtattggttattctagttatacattcgtctaaatttttttcaacgttttcagctcctttgcctttggtttgaatttcctcytgtagctcggaatagtttgatcgtctgaagccttcttctctcaactcgtcaaagtcattctccgtccagctttgttccgttgctggtgaggaactgcgtt

SEQ ID NO: 45420 - DNA, 201 bp, Homo sapiens
tagactttagaaagacttcaatctaacagaagtgttttctctatctcctgggtttactcacagtaaacaaatccgagctatgctgggccagttcagccagrcagaagccttattaatgaaagctggagtgcagccaggaacttttgatggagttcttatggatcttgggtgttcctccatgcaacttgatactcctgaaag

SEQ ID NO: 45421 - DNA, 201 bp, Homo sapiens
ttgatcctgccattatgatgttagctggttattttgctcattagttgatgcagtttcttcctaatctcgatgttctttacattttggcatgattttgtagyggctggtaccagttgtgcctttccatgtttagtgcttccttcaggagctcttttagggcaggcctggtgttgacaaaatctctcagcatttgcttgtctg

SEQ ID NO: 45422 - DNA, 201 bp, Homo sapiens
tatatgctggattacatttattgatttgcgtatattgaaccagccttgcatcccagggatgaagcccacttgatcatggtggataagctttttgatgtgcygctgtattcggtttgccagtattttattgaggatttttgcatcaatgttcatcaaggatattggtctaaaattctcttttttggttgtgtctctgcctgg

SEQ ID NO: 45423 - DNA, 201 bp, Homo sapiens
taactcagggtcattaagaaggactgaaaaggggaaagcgtattggacagtacctggtacataagaacacaataaatgtttgtgcttttttttttttttttaacacggaccgatgtccatcttatattaaaataatagaaacatagtcaccacatacttgcaacactagacatatagtataattttattttgttatcttta

SEQ ID NO: 45424 - DNA, 201 bp, Homo sapiens
aactcatcattttttaaggctgcatagtattccatggtgtatatgtaccacattttctttatccagtctatcattgatggacatttgggtgggttccagcstttgctaatgtgaatagtgctgcaataaacatacgtgtgtgcatgtgtctttatagtagaatgatttataattctttggtatatacccagtaatgggatt

SEQ ID NO: 45425 - DNA, 201 bp, Homo sapiens
tttgtatcctgagactttgctgaagttgcttatcagtttaaggagattttgggctgagatgatgggattttctaaatatacgctcatgtcatctgcaaacrgagacaacatgacttcctctctttctgtttgaataccctttgtttctttctcctgcctgattaccctggccagaacttccaatactgtgttgaataggag

SEQ ID NO: 45426 - DNA, 201 bp, Homo sapiens
aatcataaatctatggctatgtgaataatataaataattcaaagttaatataagcctttctttcacaaaacacttggttttcaaaacctaatgcaaactcctactagataagaataattctattctcttacttttgcagcagagtgttgttattttaaataaagtgattttgaaaatttttcctaaagcctgaacacaagc

SEQ ID NO: 45427 - DNA, 201 bp, Homo sapiens
agttcaagaccagcctggccaacatggtgaaaccccgtctctaccaaagatgcaaaaaattagacgggcatcatggcttgtgcctgtaatcccagctactyggaggctgaggcaggagaatcgcttgaacccgggaggcggaggttgcagtgagctgacatcacgccattgcactccagcctgggtgacagggcaagactc

SEQ ID NO: 45428 - DNA, 201 bp, Homo sapiens
tgcaggttagtgacatatgtatacatgtgccacgttggtgtgctgcacccattaactcatcatttaacattagatatatctcctaatgctatccctccccctccccccatgccacaacaagccctgtgatgctttttgttaaggagaaattttaaaatacagaaaaacacaaactgtagtacaaatattacccatattctc

SEQ ID NO: 45429 - DNA, 201 bp, Homo sapiens
taagtgtatgaaaaatatataaattttgttattagataagtacttgaataaataaagttgtaatgtcagaggtctgtgacttggtactgtgtcactttggrcaagtctgttggcttctttaagctttattagttttacctataaaatagaataataagaactctctcatacaaggattgtgctgattttaagaaatgacac

SEQ ID NO: 45430 - DNA, 201 bp, Homo sapiens
ttcaacctccccttctgccaacatgcgttacttcctacttgataaccatatgaggcacataattttcttttcaggtctctgactttgcacttgcttctgtscattctttcttccatgatgacatttattgcactgttcactaccctgtttgctctttcttccaggatggagttattacactttttgtaattgtctcttaac

SEQ ID NO: 45431 - DNA, 201 bp, Homo sapiens
cttgataaccatatgaggcacataattttcttttcaggtctctgactttgcacttgcttctgtccattctttcttccatgatgacatttattgcactgttsactaccctgtttgctctttcttccaggatggagttattacactttttgtaattgtctcttaacttgcctgtttcctctttaaaactatggagggttcata

SEQ ID NO: 45432 - DNA, 201 bp, Homo sapiens
taacaaaacagtacttaaattttatttaaaatatatttgcatttctcaaattgagagtcaataaagaaaattctgaggcaagaaaacatctctgagatgcyttgcaattggaaacactcattgagacaactgaggaatttagaaaaataaattgaataatatttgataaatttacactctcagcaaacccagggcccaatg

SEQ ID NO: 45433 - DNA, 201 bp, Homo sapiens
aatggcagcagtagcaactgattcttttttaaacccactatcaagaaagcagatgaaaaagagacaaatgtacagtcaataacctgagctaacaataagttattttcaatagaacaaaaaggacaaaagccaaaggtattcattaccattcccaggataagagaccacagcagttgctgccttcaccagatgtgctgtctt

SEQ ID NO: 45434 - DNA, 201 bp, Homo sapiens
aagaaggtcaattcccagcgtgagtgcctggtttatttatactatataacactagttagtggatcttgtatttctacttttatttcccaagacttttagaytttcccttctgtctcctggaccacacctgctactttatatacattttagacaggtgaactgagatttggaggagtgaaatgagttgcccaagatcatgga

SEQ ID NO: 45435 - DNA, 201 bp, Homo sapiens
actgaattatgggggtgggtctttcccgtttgttctcctgatagtgagtggatctcatgagatctgatggttttataaaacaagaattgccctgcacgagytctcattttgcctgctgcaatgcatgtaagacgtgacttactccttcttgccttccaccatgattgtgaagcttcctcagccaagtggaactgtaagtcc

SEQ ID NO: 45436 - DNA, 201 bp, Homo sapiens
aaactgtcacggtgctggtgggagtgtcttttagcatgcaaatgtattataattagcatataatgtgcagtgagggggaccagatgtcactttcatggccrtcttggttttggtgggtttgggccagcttctttacagcaccttgttttatcagcatggtctttgtgactatatcttgtgctgacctcctatttcttcctg

SEQ ID NO: 45437 - DNA, 201 bp, Homo sapiens
gacctcctatttcttcctgtgacttacaatgtctaacctcctgtgtctcagccttattttacccagctcctattcaagatggtttcactctggttcgaatrcctctgacataactacgcacatcctccctttaaatcatctctagattacttataatatctaatataatgcctctccatccctttactccaatgggattca

SEQ ID NO: 45438 - DNA, 201 bp, Homo sapiens
tgtagtggaattatgagtcctgtttagcaatgttaagttttagatgcatagtagaaatccaaatagagaaatgttaaacatggtatctttgggtttggggktctaatgaacaaatgaaaggttaggccatagaaactgtttaaagctatggccaggaaagacagtaattcagggaacaaatcatccactataataaatgcc

SEQ ID NO: 45439 - DNA, 201 bp, Homo sapiens
tggcatgtccatgcatggtttcatttgcatcaccatttgaagtttaatggcctccaagcaaaaaggaacaattcgggttattagaagacatatatcaaaaygaaacaaggggttaaggactgctcaaaaatcccaaggctgccaatgtgctcagatagctggtagctagctatagttactatacctgctaagatttgggtg

SEQ ID NO: 45440 - DNA, 201 bp, Homo sapiens
agttctgttcctttagagaaccctgactaatacaagcctattgttgggaagtgatcaaggaggaaatgatgacacaatccttctcttaagggtattatacyattttcagaattatttatgtaaaacaataggattctacaactaaagacctggcttaagtttcaggattaagattttggtagagcttaatttcttcaagaa

SEQ ID NO: 45441 - DNA, 201 bp, Homo sapiens
taacccctttcattccctccttcagcaactgctgttgcgaaaaagtggacgaagacctctcttaactgcttcctgctgacaggaggcgctgttttggaaamgcggcagttaggactcctcctgaggtcagtttaagggtcctgggaagaatggcatgtccatgcatggtttcatttgcatcaccatttgaagtttaatggc

SEQ ID NO: 45442 - DNA, 201 bp, Homo sapiens
actaagtatacagatctaggtgggacacacatggagcagtgagggaggaaggggacacccaccttgtcagccagatcagctgaatcaactctggtgatcartgggttgacatgttgcagccagatcatcctcatgtttcctattttgtatattgtagttctttaaaataattaaagtagtattttagtagtagtagcaaag

SEQ ID NO: 45443 - DNA, 201 bp, Homo sapiens
tggctgtgggtttgtcatagatagctcttattattttgagatacgtcccatcaatacctaatttattgagagtttttagcatgaagggttgttgaattttktcaaaggccttttctgcatgtattgagataatcatgtggtttttgtctttggttctgtgtatatgctggattacatttattgatttgcgtatattgaacc

SEQ ID NO: 45444 - DNA, 201 bp, Homo sapiens
tcagtatgatattggctgtgggtttgtcatagatagctcttattattttgagatacgtcccatcaatacctaatttattgagagtttttagcatgaagggytgttgaattttgtcaaaggccttttctgcatgtattgagataatcatgtggtttttgtctttggttctgtgtatatgctggattacatttattgatttgc

SEQ ID NO: 45445 - DNA, 201 bp, Homo sapiens
tattagtgtgtaagaatgcttgtgatttttgtacattgattttgtatcctgagactttgctgaagttgcttatcagcttaaggagattttgggctgagacratggggttttctagatatacaatcatgtcatctgcaaacagggacaatttgacttcctgttttcccaattgaataccctttatttccttctcctgcctca

SEQ ID NO: 45446 - DNA, 201 bp, Homo sapiens
cattggtagcttgatggggatggcattgaatctataaattaccttgggcagtgtggccattttcacgatattgattcttcctacccatgagcatggaatgytcttccatttgtttgtatcctcttttatttccttgagcagtggtttgtagttccccttgaagaggtccttcacgtcccttgtaagttggattcctaagta

SEQ ID NO: 45447 - DNA, 201 bp, Homo sapiens
agtttgctggaggtccactccagaccctgtttgcctgggtatcagcagaggtggctgtagaacagcaaatattggtgaacagcaaatgttgctgcctgatygttcctctggaagttttgtctcagaggggtacctggccgtgtgaggtgttagtctgcctctactgggggatgccttccagttaggctactgaggggtcag

SEQ ID NO: 45448 - DNA, 201 bp, Homo sapiens
ggcactgctgttttttgcagaaacatggttaaaattttatgactgattttgaccaattagatttctctccctcttagaactaagcaattatatatatatawaaaacatgaatatatatgcatgtgcatgtatgtaacttgcacatgctttatatccttaaaatgtgtaatatatttaaatataggtttatatattcatatt

SEQ ID NO: 45449 - DNA, 201 bp, Homo sapiens
atagtatcctgcagactgttttccaacttggttccattctccccatcactttcaggtacaccaatcagatgtagatttggtcttttcacatagtcccatakttcttggaggctttgttcatttctttttattcttttttctctaaatttctcttctcgcttcatttcattcatttgatcttccatcactgataccctttga

SEQ ID NO: 45450 - DNA, 201 bp, Homo sapiens
tctgctctgctcttcatgcacaagacaaattcgtgccctcaagaatctcatatattggtgtaagagatagaaaataaatgtgcaaatatatatatatatatgtataggcatataattttttagatgatgagatgatactataatcaaagttgtaaattttgctgtagggaggtcaatttaatattactaaggagtttagaa

SEQ ID NO: 45451 - DNA, 201 bp, Homo sapiens
tctcgtggagtatctttgtggtgttctctgtgtttcctgcatttgaatgttggcctaccttgctagattgaggaagttctcctggatagtatcctgcagastgttttccaacttggttccattctccccatcactttcaggtacaccaatcagatgtagatttggtcttttcacatagtcccatatttcttggaggctttg

SEQ ID NO: 45452 - DNA, 201 bp, Homo sapiens
ttctgctctgctcttcatgcacaagacaaattcgtgccctcaagaatctcatatattggtgtaagagatagaaaataaatgtgcaaatatatatatatatatgtataggcatataattttttagatgatgagatgatactataatcaaagttgtaaattttgctgtagggaggtcaatttaatattactaaggagtttaga

SEQ ID NO: 45453 - DNA, 201 bp, Homo sapiens
catgagacaaagatttaccagatttaattcttattaagtcataacccatgtgatacagtccttgaggagtcttatagtcaaaagaacacagtacattaaarcaacaattatttaaaaacgaagcaagttctttatgcatttctcaaaaccatgaagggactcttaattcccagcagtactctctagtattgctcttgttcc

SEQ ID NO: 45454 - DNA, 201 bp, Homo sapiens
gtatattctgttgatttggggtagagagttctgtagatgtctgttaggtccgctttgtgcagagctgagttcaattcctgtatatcttttttaactttctktcttgttgatctgtctaatgttgacagtggggtgttaaagtctgccattattgttgtgtgggaatcgaagtctctttgtaggtctctgaggacttgcttt

SEQ ID NO: 45455 - DNA, 201 bp, Homo sapiens
gatacagtgttggctggggtgattgacctggactatgaagatgaaatcagtctactacgccgcaacggaggtaaggaagaggaagagttgcatggaatacrggagatccattagggcatctcttagtattaccatgccctgtgattaaggtcaatgggaaattatagcagcccaatccaggcaggactacaagtgatccag

SEQ ID NO: 45456 - DNA, 201 bp, Homo sapiens
attcagaaaatgtctgcagcagaccgattttcttaaagatctcaaaagcatccatttgtatttaggatattatttccgaagttaagcttaaaatacacatratttattcttttgattatgtaatggtattcatatatagtttgaattatgtggaacattcctaagggacttactgcaagaaaatgtgttactagataaaat

SEQ ID NO: 45457 - DNA, 201 bp, Homo sapiens
gaatggccttttgaagtcacaattacaatgccaactaggtgacaatcctttgcagggctggggcaaagttctccagaaggctgtgtgtgctctgaatcagygtccaatatatggtactgtttctcccatagccgggattcacgggtccaggaatcaaggggtggaagtggaagtggcaccacttaccatcaaccctagtga

SEQ ID NO: 45458 - DNA, 201 bp, Homo sapiens
tattgcctaggttttcttctagggtttttatggttttaggtctaccatttaagtctttaatccatttggaattaatttttgtaggaggtgtaaggaagggwtccagtttcagctttctacatatggctagccagttttcccagcaccatttattaaatagggaatcctttctccatttcttgtttttgtcaggtttgtcaa

SEQ ID NO: 45459 - DNA, 201 bp, Homo sapiens
gttttgtatgttcccatgtgtgtctaatgtgttattattctttatactttagagcctaaaatataccccaggatgggaaataagatttggaagtcacctcrtaaaaaaatatcattcatcccttggtctttacagaagacatgatcctgaaaggtacccagttgaggaagaagtaggagttgaggacctgaaatccctatt

SEQ ID NO: 45460 - DNA, 201 bp, Homo sapiens
attctaaaaatatctgtactaactttaaaatgggggtgattttaaaaaatgaaaaatccctctcctttatacacatatcgcctgtgtgatagaaaaaaaaacccctaaaatttatataatttcattctaaaggaaagagctttgttgctctcgccttctagttatcagtttagaaatcctgctcattagggttggaatgtt

SEQ ID NO: 45461 - DNA, 201 bp, Homo sapiens
tggttttggtaaagtgtgtaatttcagcatactttctaactaaattagcatttttcttcctttctactatacttccaagcattttttttttttttttttttgccatttgaaggcagtcacaaaagatgcctgatatttctcaggtaaatgtttatttctcttatttttttcttgctgttaggtaaatgtgttgcataaaat

SEQ ID NO: 45462 - DNA, 201 bp, Homo sapiens
tttttttttttcaaaaaatattggatctaagcacttatttttctttaggccaatcaattagagctattttttataaaaccatcacacacataacacatgtrtgattatacagacacagacagaagaagatccagtaattgtaagattcttcattttctaatctcctagtcagatcattggcctcagggtggtacccttcaa

SEQ ID NO: 45463 - DNA, 201 bp, Homo sapiens
tgtatacatgtgccacgttggtgtgctgcacccattaactcatcatttaacattagatatatctcctaatgctatccctccccctccccccatgccacaasaagccctgtgatgctttttgttaaggagaaattttaaaatacagaaaaacacaaactgtagtacaaatattacccatattctcatgtacctgaattatat

SEQ ID NO: 45464 - DNA, 201 bp, Homo sapiens
tggtagagaaaactgattaaaatgtatgtttaataatgtaggcaaatggtggtgagagtttaaataaagcaatcatcattactattgtgagaggggaataratttgacagagaaatatgaattctgtattcaaaaaactagatagggttattagtggacaaacaaattcaggagccgtggctgttataagtactttgacaa

SEQ ID NO: 45465 - DNA, 201 bp, Homo sapiens
gttttaacacatttttatcattagcaaactagcatcatttgagcaatgctaaatatagtgatgttattgggttcctaacagaaaacctcatattcttgaawgtttacttctttgatactttcataatttgagtatttatatatttttaaaaattttcaaatctttgtttcccctgcccgccgcctctctctctctctctct

SEQ ID NO: 45466 - DNA, 201 bp, Homo sapiens
agtctctagcatattttaacttttttgatatttattttttaaaaaaagagacaaaatttttaatatagattttgtttttttgaacagttcaagaattaaaraaaacttgtaaagatactacagagttccctaagctatagtctgaatatttgtgttccccacaaattcatatgttgcaattcttacctccagtgtgatggt

SEQ ID NO: 45467 - DNA, 201 bp, Homo sapiens
tatatatatatatgtataggcatataattttttagatgatgagatgatactataatcaaagttgtaaattttgctgtagggaggtcaatttaatattactraggagtttagaaagaggaaagaagactgaacgtaagatcagttaatgaataaaaagtaatgaaggctggaataatggcagtggtggaaggaaatcataga

SEQ ID NO: 45468 - DNA, 201 bp, Homo sapiens
tgttaaaccaggaatctatattgtcttgtctgagtactatggtagaccataatgttctgtaagagtacaaattatgttttgttgttgagtgaatgaatgarcaaatgaacccttgactcctatgcatccttttcaaattgatgtgtttttataattttatataacagacattttaaaatgttttctctctgatatcactgc

SEQ ID NO: 45469 - DNA, 201 bp, Homo sapiens
cttgacttaattatagataactataaatgcctagtttttcatcatatacaaaaatatatagtactgtgttataggtgaaaatagtgaaggttaaagtgagraggaagttttaaaaacttgatcatatttagtttgataataatgctgttaatttttattaaaaaacaatatatttgtttctttaataattaccttttaatt

SEQ ID NO: 45470 - DNA, 201 bp, Homo sapiens
acagtcatagcagtaggctaagggcaagcaggcacatcttacattgccagggcaggaggaagagagagaaggtggaggtgccagacagttttaaacaatcrgatcttgtaagaactcttatcatgagaacatcactagggggatggtactaaaccattagaaaccactcccataatccaattgcctccctccaggccccac

SEQ ID NO: 45471 - DNA, 201 bp, Homo sapiens
tatcccaaaaaatcagaggacataattctccctaactaatcctacaagatcagaatcaccctgacgtcaaaaccagacaaagataccaaaaaaaaaaaaaagtctacaggccagtagccctgattagcatagatgcaaaaatccttaacaaaatactagcaaataatgcaaaacacatcaaaaagattcaccatgattaag

SEQ ID NO: 45472 - DNA, 201 bp, Homo sapiens
aaacttaactgtggttttttctctcataccatgccccaccacaaactgctttgttttgtggtaattattcacatatagcctttttccctatgttgtgataygacctgttaacttggcttgtgacctgtagttgttgggactctgttgttcctaagtgttataccttcttttgcacatgttgttggtattcacagaatgaag

SEQ ID NO: 45473 - DNA, 201 bp, Homo sapiens
gaagcattaggaaagatgaccttaaagccgatctgactagtgattttcaaagcattctccatgaaccctggtggaatgtttttctggttgtactaagaggraagggtgtgctaagtggtcagataactaaatctctcagatctagccagccttcttcaagagttggttagtggcagagaccaaattttttacattgtcttc

SEQ ID NO: 45474 - DNA, 201 bp, Homo sapiens
acatgcggtgtttggttttctgtccttgcgatagtttgctgagaatgatggtttccagcctcatccatgtccctacaaaggacatgaactcatctttttttatggctgcatagtattccatggtgtatatgtgccacattttcttaatccagtctatcattgatggacatttgggttggttccaagtctttgctattgtga

SEQ ID NO: 45475 - DNA, 201 bp, Homo sapiens
ggtaactgaccctgaccaaatggatttgcagttatctaattcttaaaaaaaaaaaaaaaaataggaaaaagcaatgcctttttttctttttttttttttttgagacggagtctagctctttcacccaggccggactgcagtggcgctatctcggctcactgcaaggtccgcctcccgggttcacactattctcctgcctca

SEQ ID NO: 45476 - DNA, 201 bp, Homo sapiens
ctgttttggtaccagtaccatgctgttttggttactgtagccttgtagtatagtttgaagtcaggtagcgtgatgcctccagttttgttcttttgccttargattgtcttggcaatgcgggctgttttctggttccatatgaactttaaagtagtcttttccaattctgtgaagaaagtcattggtagcttgatggggatg

SEQ ID NO: 45477 - DNA, 201 bp, Homo sapiens
atttttgtagacaatagaataagaagttaggtgtctgtgaattttgaaacattattatataattaatcattctctattgtaattgcatttctttccattaraaagatgtttttcgtctttccatccataatgtcttgctcagtttctggaacttaatagatgtgcaacatttttcatggacctttttcgaattgagtaatt

SEQ ID NO: 45478 - DNA, 201 bp, Homo sapiens
tggtcaacaaacatgaaaaaaaggttatcatcactggttggtcattagagaaatgcaaatcaaaaccacaatgagataccatttcacgccagttagaatgscgatcattaaaaagtcaggaaataacatatgctggagaggatgtggaaaaataggaacgctcttacactgttggtgggaatgtaaattagttgaaccatt

SEQ ID NO: 45479 - DNA, 201 bp, Homo sapiens
agaaattaaagaaattgtaattatttctccctgcttagtttgcatcatttcatattctaggtgaataactttttgtgaaaatgtattatcctaagaacttytttttttctcctggagatattttagtctgggctaatagattaactttttattcttgatttctgaaaactggagaaaaaaaagtttggttattttctaaat

SEQ ID NO: 45480 - DNA, 201 bp, Homo sapiens
ttggtgttttagacatgaaatccttagccatgcctatgtcctaaatggtaatgcctaggttttcttctagggtttttatggttttaggtctaacgtttaartctttaatccatcttgaattaatttttgtataagatgtaaggaagggatccagtttcagctttctgcatgtggctagccagttttcccagcaccatttat

SEQ ID NO: 45481 - DNA, 201 bp, Homo sapiens
ttgcttttggtgttttagacatgaaatccttagccatgcctatgtcctaaatggtaatgcctaggttttcttctagggtttttatggttttaggtctaacrtttaaatctttaatccatcttgaattaatttttgtataagatgtaaggaagggatccagtttcagctttctgcatgtggctagccagttttcccagcacc

SEQ ID NO: 45482 - DNA, 201 bp, Homo sapiens
tgctccttgttaaactccaattatccttatgagttatgaaaggtttttttgccacatagttttaaaccttggaagaatgtttgggaataagagggggaagkatgaatgaagtgccaccacaattttctaagaaaacttagttcactaaatatgcacacaactacacaattcattagatttacagtgaaaaatattaatgtt

SEQ ID NO: 45483 - DNA, 201 bp, Homo sapiens
gttgccattgcttttggtgttttagacatgaaatccttagccatgcctatgtcctaaatggtaatgcctaggttttcttctagggtttttatggttttagstctaacgtttaaatctttaatccatcttgaattaatttttgtataagatgtaaggaagggatccagtttcagctttctgcatgtggctagccagttttcc

SEQ ID NO: 45484 - DNA, 201 bp, Homo sapiens
ttcttttgctgtgcagaagctctttagtttaattagatcccatttgtcaattttggcttttgttgccattgcttttggtgttttagacatgaaatccttasccatgcctatgtcctaaatggtaatgcctaggttttcttctagggtttttatggttttaggtctaacgtttaaatctttaatccatcttgaattaatttt

SEQ ID NO: 45485 - DNA, 201 bp, Homo sapiens
aatgaccagtgttgatgagcatgttttcgtatgtttgttggctgcataaatgtcttcttttgagaagtgtctgtttatatcctttgcccactttttgatgrggttgtttgtttttttcttgtaaatttgttgaagttctttgtagattctggatattagtcatttgtcagatggatagattgtaaaaattttctcccattc

SEQ ID NO: 45486 - DNA, 201 bp, Homo sapiens
atggttaaaattttatgactgattttgaccaattagatttctctccctcttagaactaagcaattatatatatataaaaaacatgaatatatatgcatgtrcatgtatgtaacttgcacatgctttatatccttaaaatgtgtaatatatttaaatataggtttatatattcatatttattttaacattatacatatcaag

SEQ ID NO: 45487 - DNA, 201 bp, Homo sapiens
ttaatatattcataaagatggagaatttcccacttgaggcgagtatacactgggaagaagattattaataataacaacatagagttgtataagattttacwgtttatgaagcacttttatatattattgactgtgcttttcattaatactaatttcagtagtgttttgtgcaaagtatcatgtcagatatggaaagaagga

SEQ ID NO: 45488 - DNA, 201 bp, Homo sapiens
tctgagtctattgagataatcatgtggtttttgtcactgattctgtttatgtgatggattatgttgaaccagccttacatcccagggatgaagccaacttratcatggtggagaagttttttggtgtgctgctggatttggtttgccagtattttattgaggattttagcatcgatgttcatcagggatattggcctgaag

SEQ ID NO: 45489 - DNA, 201 bp, Homo sapiens
tggttgtttttaactgtattggaggaatccttgtataggaacaatgtttccatatgtatctatcttcatattaagaaagagaaaactttttgaagaaacawttgtttttatttcaatgtgattatgtaatttcagtggggaagtttacaacatgatgtggaaaggacataggatctacattttactattagctttgcccca

SEQ ID NO: 45490 - DNA, 201 bp, Homo sapiens
tagctttttttgttttccttatgtaacatctaaatactcatatatagactgtggctaattttttttttaacttaaaggataaaagtccctctggaatacamcactgcattcagttttccctcttaactctctattgttgggcaagttactccaagcctcagtcacctcatcttccttatggtgagtgaggtataagtgata

SEQ ID NO: 45491 - DNA, 201 bp, Homo sapiens
atatgtaacaaacctgcacgttgtgcacatgtaccctagaacttaaagtataatacaaaatatatatatataattaaagaatgctaaaagactcaaaaaargggaagtttatagtaatatatggcttacatcaattagaaagattacaaactgacaatctagtaatgcacctcaaggaactagaaaaacaagaacatacaa

SEQ ID NO: 45492 - DNA, 201 bp, Homo sapiens
ggacataattctccctaactaatcctacaagatcagaatcaccctgacgtcaaaaccagacaaagataccaaaaaaaaaaaaaagtctacaggccagtagycctgattagcatagatgcaaaaatccttaacaaaatactagcaaataatgcaaaacacatcaaaaagattcaccatgattaagtgagatttatgcttggg

SEQ ID NO: 45493 - DNA, 201 bp, Homo sapiens
atttgtctgccactttttgctttctgtgttacacttgactggtagtaatagattttttttcccctgtggaaactttcttgattgtcagtacatctacaagkgcataatcatgatacattaaaaataatcatgtaaattataatcactcacatttttcagaatattgctaatgatgatgatttttctttaaatattgattgg

SEQ ID NO: 45494 - DNA, 201 bp, Homo sapiens
atctagaatagtatttacagcctctttctggtcccaaactctttgcaaatctaatgaatgtgattaactctccccataaaactataaataaatacacatargcttttgtttacaagatcataggatttatggagtccctgaaacctaccatttgaccgcagattatttcatttcttccgagaataatatgaagacgtgatt

SEQ ID NO: 45495 - DNA, 201 bp, Homo sapiens
gagaaatataaatttgtcttgaattagccagtctgtgttagaggttattttactgatagtctgatcagttcttttagacttatcactcataattgagccaratctcacatgtaacaaattcaactataggcacaacgattgtaattattttcctatttactgtcaagtctgaaaatcattgtgtgcttctagaaattgaga

SEQ ID NO: 45496 - DNA, 201 bp, Homo sapiens
ttcttcttcagggctcattctacaggcctcttttctatttacactcattccctcaataatcttgccttgtttcagagctgtaaaaactatctacacattgwtgactccagatttttatcttcagccttatcccatccaactgcttagctggcatttccacttagctggctaatagaaatctcagatctaacatgtttaaac

SEQ ID NO: 45497 - DNA, 201 bp, Homo sapiens
catatagtaataaatgacattttttggacttgaatgcttctagctaataatcaggttatacagtatgctttttcccctcaaacctaagtgttcttatgttstagaggacaccctagaagatcttcagagcttgttatcaggccccttaatcccttaggacagctatttggcctaacgttactagagaatagatcactagcc

SEQ ID NO: 45498 - DNA, 201 bp, Homo sapiens; identical to SEQ ID NO: 39899
  misc_feature (1)...(201): n = A,T,C or G, or insertion/deletion polymorphism (see Tables 1-2)

SEQ ID NO: 45499 - DNA, 201 bp, Homo sapiens; identical to SEQ ID NO: 39902

SEQ ID NO: 45500 - DNA, 201 bp, Homo sapiens; identical to SEQ ID NO: 39993

SEQ ID NO: 45501 - DNA, 201 bp, Homo sapiens; identical to SEQ ID NO: 39914

SEQ ID NO: 45502 - DNA, 201 bp, Homo sapiens; identical to SEQ ID NO: 39919

SEQ ID NO: 45503 - DNA, 201 bp, Homo sapiens; identical to SEQ ID NO: 39923

SEQ ID NO: 45504 - DNA, 201 bp, Homo sapiens; identical to SEQ ID NO: 39886

SEQ ID NO: 45505 - DNA, 201 bp, Homo sapiens; identical to SEQ ID NO: 39983

SEQ ID NO: 45506 - DNA, 201 bp, Homo sapiens; identical to SEQ ID NO: 21836

SEQ ID NO: 45507 - DNA, 201 bp, Homo sapiens
cttttttgttttttgtttttcctgcagacagaatttctattatcttttgagctcagtgctcaatgtcaagttcagaggtgagacaataaagacaataaatrctggcaggggagggatgatcagacattacagacaattgtcccttcctcttttgtaggaggtgactattagctcacctgatttatctggaataggttcact

SEQ ID NO: 45508 - DNA, 201 bp, Homo sapiens
acagggccatcaccccaggaacctctgaaggtctttgttttttgaactatatggccataaaccttacctctcaaactatattctggaggatgcatagatayctccaccagctttggagagctagtttcgctgaagtttgcttcttttcggctgcacttcatcatgagcatgtctgaaagtcaggagctgagagggcactga

SEQ ID NO: 45509 - DNA, 201 bp, Homo sapiens
gggcttcgggcctaaggtagaggcagaagctaaaaaaaagcagacatgatggaatagatgtaaaataatcccagcacatacacagctcattgcttcaggtktgtgcatttatttcccccataaaacacaaggggttggatgctacctgaaaagcacagggccatcaccccaggaacctctgaaggtctttgttttttgaac

SEQ ID NO: 45510 - DNA, 201 bp, Homo sapiens
aaaacccaaactgtaactggtgaattgctgaaagctcagtgtggatgaatctgagagttagaaactccagtgggggcaggcatacagaggcccctcacttkttatgagttttacttccaggagctctctcaggttctcaaagtgagtatcagagaaaactttcctcatgtatttgaaaatagaagggagaagtaaccatta

SEQ ID NO: 45511 - DNA, 201 bp, Homo sapiens
tcatcaaaagataccacaaagaaagtgaaaaggtaaaccatgctatggaagaaaagagacagctcacaaaagcaatatacaaatcggcatatgtaaaatgygcaatctcattaatcatcagtaaatgcaaattaaaatcacaattaagtgtaccacattcccactagaatggctgaaaattaaaatatatgatagcacagg

SEQ ID NO: 45512 - DNA, 201 bp, Homo sapiens
ctgaggcacagtgggtatgctctctgggagggagagccagctgtactggcaggagtactcactaaggactcagatagacaagaaagtgaatcccagcactrtctctcaccagctttggaaccatgtctttttgagtttcagttttcctatctataaatctatttataatatttttttaccttgcatggctgatctgagaat

SEQ ID NO: 45513 - DNA, 201 bp, Homo sapiens
cgttttggcgaatatttgtatctataaggcatgttcatttcaaaatgtatgaagggcacaaaacaagtaccagggagtctggaagctgaagtagttgagaragaaattcaggtacttttagggtttaataagataaccttctctcttctttgcagctagcaaagcttggagaagcctgaacaagctggtcaccctcactgt

SEQ ID NO: 45514 - DNA, 201 bp, Homo sapiens
acttatctgaggtcagggtgagtgcagagatgagagtggcagcacagtcagctgacaattaaaggggtgttcattcctccaggccatgggagcacttctcyacgcatgatgatgacccagttctctcctaagacacttccaagaacgtaatattttaaagaacactgttaggttaaccaaaaattagacttgctcctcagc

SEQ ID NO: 45515 - DNA, 201 bp, Homo sapiens
gcctacacacataagatcactatattcatgataaatctgatgctgcagtgtaatgagaaagggacttttttctataaatgattctgtaataaacaaatgtscatattaaaaacatgttataacctctttctgatatcatactaaaaaattgattccaggcagcttgcagatgtaaatgtaaaggcaaaacaaacatcaaca

SEQ ID NO: 45516 - DNA, 201 bp, Homo sapiens
tttgtagactttagcactcctttatcagaaatggacaaatccagcaggcagcaaataactaaggacatagtcgaactcaacagctccatcaatcaacttgwtataattcacatctatagactacttcatccaataaaagtatagtacaaattctttttaagctcatgcaaaatatttaccaagatagatcaatattcttgg

SEQ ID NO: 45517 - DNA, 201 bp, Homo sapiens
ctggagaagccaggggggagacatgatccctatgtagcaaagaagatgccatcaacaggccttggctgcatcctgccttgcctctgtactcagtttagagtcactgccatacccagaaccaacccttaggacaagatgctttcaagagcaggcagagacaggagaagaagtcccacaggaataaaggaaatagtccttgag

SEQ ID NO: 45518 - DNA, 201 bp, Homo sapiens
ttagggtttaataagataaccttctctcttctttgcagctagcaaagcttggagaagcctgaacaagctggtcaccctcactgtcaaagactttcatttcyacggaagggaaactgatgacctgggaccattggaagaactagttagtaattaatcagttgcataatcttcccttatcctcttttctaatttcccttcagg

SEQ ID NO: 45519 - DNA, 201 bp, Homo sapiens
taccccactccattctgtcattatttacacatatgtacaagaaaaatgaaagagtctctgtgtatgtgtgtgtgtgcgagtgtgtgtggtttgtgttgttrttttcttgtattaaaaagctctgctggtcgggtgggtgggagggtgggcaggagggcaggcggcgcagtcagatggaggtcccgtgggaggtgtccagag

SEQ ID NO: 45520 - DNA, 201 bp, Homo sapiens
gcttttcctattggtcattgccactttgatgtctatcatggagataagtgcctgccagaaaatggagaagaacccaacaaagaatcagcagctaagcagcrctctccatgtatcacgaaagtggggaaacgaaggctggagtctggaccaatcaaggcaacccaatcttgaggaacccaaatcctggatagtgaaatgggg

SEQ ID NO: 45521 - DNA, 201 bp, Homo sapiens
gtggactcaattaaagtgggaagcaggtgtctaggttccagggctgctcaactctggattctggcagttgatagagggcctggccttttttctcagtcaaytgagcactagcccagggtgttcaggagatgctcccattttgttagagtttggagagagggaaagattaacttcctgtccaagaagaaagccacagggagg

SEQ ID NO: 45522 - DNA, 201 bp, Homo sapiens
atcagatgcctgagtggggagggcccctgctctgggttggattgctgcttgaagaggactccaggtctggtctggagagggtcgtaaaggtggaagggagrgtttgtgctggagccagccctgtttgttggactgcctgcaggatttatgacccagagataggcctttacttttggggctacaagcaacttccctggtgga

SEQ ID NO: 45523 - DNA, 201 bp, Homo sapiens
tctcagaggttatcagatgcctgagtggggagggcccctgctctgggttggattgctgcttgaagaggactccaggtctggtctggagagggtcgtaaagstggaagggagagtttgtgctggagccagccctgtttgttggactgcctgcaggatttatgacccagagataggcctttacttttggggctacaagcaact

SEQ ID NO: 45524 - DNA, 201 bp, Homo sapiens
caagactggctactgcctcccagcttatttgagtttgcttttctgctcactgggaacctgtaggccctgcctcagggtctgtttgcattgtcatatgtagrcttgctatgtgctcagttccaacaccagttcttggactctgccatactatgttttctgccctcagtaactaaaaacctcccaatccatttagtctagggt

SEQ ID NO: 45525 - DNA, 201 bp, Homo sapiens
aactgaagtgacacaactcagattcccccagttccactcctaatggttctttccctgattctgtagtttagttgcctcagaaagggcaactgaaggagggrgcgctgttaggtggtcctaggcttagaaaactgggcttccctgcagctgtacctgcacagggataggcctggaaatctcagaggttatcagatgcctgag

SEQ ID NO: 45526 - DNA, 201 bp, Homo sapiens
aatcacactcagtcctaagacccataacttggggtacctgtatcctgccttggcattgttccaggcctgcttagttctcagtattctgggtgtcccttctytcccagcttttaggtcttggcagggacatctccgtagctaagaacctctacccctctacactgcagaatctttgtataatcctgagttctgttctgctag

SEQ ID NO: 45527 - DNA, 201 bp, Homo sapiens
gaaagagagaggggacggagggttgtgggggagggacagagagagaagagagagagagaaggagagagatgtattcgtttatgtattttagggaattggtrcacatggtatggaccccagcaagtccccctctgcaggtcaggtggggatccagggaagatgctggagaccatgttacagctccaatccaaagggactctg

SEQ ID NO: 45528 - DNA, 201 bp, Homo sapiens
aatgaacaacagattagtggttgccagaggctaaggagaagcagagggaagtgggtgtgactatacaacagcaacatgaagcatcatgtcgtgataaaaayatactttatctcggctgtattcatgtcagtatcctggatttgatattatgctacaacttcacaagatgttatcattggcaaaaaccgagtaaagagtaca

SEQ ID NO: 45529 - DNA, 201 bp, Homo sapiens
aggctaatagacaaatctagttaacagaaggaatctatgtataaggaaaaaataattaatacctgtttcattgctcctgggaaagtaagagtggataggayctggtttccaggatgagatgtggctttaatcccagaagaaagtctactttattattacagcaaaaaaagggggcgatattgaggacagatgcaggtcatt

SEQ ID NO: 45530 - DNA, 201 bp, Homo sapiens
ctagtttgagaatagaggatgctatgggatgtggctcgctgtcataggtgaaaatgacatcagaaaccattggcacagcctcacaggcacagtcacaactycagtgatctgaagcccacccacacaagcagagctcagctcattcgtgctgggagaccatctctgagttagggtcacctctgcatggcaagtgtcgtcggg

SEQ ID NO: 45531 - DNA, 201 bp, Homo sapiens
attactgagcacttgctgtatgtcagccactggcactaggtactttagtccgagttttcttttcttttcttttccttttcttttctttctttctttctttyttttttttttttttttccgagatggtgttttgctgttgttgcccaggctgcaatgtgatggtgcaacctcggctcattgcaacctccacctctggggttc

SEQ ID NO: 45532 - DNA, 201 bp, Homo sapiens
aaattttgatcatgtcagacagcctcctcagatcagctttactgagcttgaggccgacagcggggctgtcccccacaaagtcactgaagccaggggacttyttcagaggtcggctgaaaagcacacacatctgggggtggaagatcaggttgatggcttgaggcctgtaggatgactgagggcataagatgttcattggag

SEQ ID NO: 45533 - DNA, 201 bp, Homo sapiens
taaatgaaaacgcacaggccatagactgcgtccctccatgtcctcgtggcctttaggaccactggtcttttcttctttaatgtgtctgcttctcctttagwacttgaaaagacaaacattaggtatggaattagttttaccttggcactattcgggggatttctgatttaggaactaggcagcttcttcttaagaaaacag

SEQ ID NO: 45534 - DNA, 201 bp, Homo sapiens
gaaaagtggaaaaagaagagtaaattaaatccaacgtaagtagaagaaagaaataataaaaattaaagcagaaataaatgaaatttaaagcaggaaatcaatagagaaaatgaacaaatccaaaagctggttctttgaaagatgaataaaatttataaaactctagtctgcttaccaaaggaaaaaaagaagacaaaaatt

SEQ ID NO: 45535 - DNA, 201 bp, Homo sapiens
gactaaataccaccactgagagacaaaaaaaaaaaaaaaaaagacaatgattaaagttattggcatagaagagggttatttatgtgcagtttcttggtacraagggtgaggataataagaataaacagttttattaaaaacaactaatggcataaaagaatattttagatacaaaaatgttacattaggaacagaaatgct

SEQ ID NO: 45536 - DNA, 201 bp, Homo sapiens
ggagatcgagaccatcctggctaacagggtaaaaccctgtctctactaaaaatacaaaagaaaattagccaggcatggtggcacacgcctgtagtcccagytacacaggaggctgaggcaggagaatcgcttgaacctgggaggtggaggctgcaatgagccgagatcacgccactgcactccagcctgctgacaaagcga

SEQ ID NO: 45537 - DNA, 201 bp, Homo sapiens
gctcagctggcagaagaggggagcttatgaactgggaaaacatcatttcagcaatcatgaatcacacatatagctctgtgaattcattcttatcacttcaratccaaaatcatacaactgtaaagtccagagccaaaatgcaaaagcaggtctcacttattttattgccatagcatttgtctagcatttgtctccatctaa

SEQ ID NO: 45538 - DNA, 201 bp, Homo sapiens
gttgaacccatgaggcagaggttgcagtgaggcgagatcgcaccattgaactccagcctgggtaacaagagcaaaactccatctcaaaaaaaaaaaaaaaagaaaaaaaagaaagaaagaaagaaagaaaagaaaagaaatgaaagcaggctcaagtcagttccattcctgaataattgagattatctttcttgttctagt

SEQ ID NO: 45539 - DNA, 201 bp, Homo sapiens
aggcagtcctgaccgtagttagaacatgtgctccctccttccaccttgttgggccatccgtgggtaagggtgtgctcactttttaacagaagtgagggctrctgttactgccagctcccagtgggagagtgagacccaatacactcaggcttctccactatggaagaaaagagacagctcacaaaagcaatatgcacataa

SEQ ID NO: 45540 - DNA, 201 bp, Homo sapiens
tgtgagaggagcagtgcagctgagcttgtgcaggaaggagccagggcaagtgcttctgggcactgtcaggagcaaaatgctgtgcggggcccatggcagcrtctatgggagagtacccactatccccaaagccccagaaggagtgttacaggcagtgctctttcagctttatcatccacagatggcttaaatgattaacag

SEQ ID NO: 45541 - DNA, 201 bp, Homo sapiens
agctgggctcagctcctgtcaggcagtcctgaccgtagttagaacatgtgctccctccttccaccttgttgggccatccgtgggtaagggtgtgctcactwtttaacagaagtgagggctgctgttactgccagctcccagtgggagagtgagacccaatacactcaggcttctccactatggaagaaaagagacagctca

SEQ ID NO: 45542 - DNA, 201 bp, Homo sapiens
tgctaatttcatctaaaaatgataccttcacagcaacatgtagactagtgtttgaccaaatacctgggcatcacgatcctagctaagtcaacacaaaaaaattaaccatcacatccattataactagagtgatcacaccattcatcattctaatggaagttattaataattgttagaacaataagcacaaactggggctgt

SEQ ID NO: 45543 - DNA, 201 bp, Homo sapiens
ccatggtgtaaatattcccatcatggccaatttcatggtgctaatgtgatgttactgaacacagagttgagaaaagatacacacaagaggttttcatgagytggtaagagcaggacgcagcacaccagtgacattggagctacactggcccagtgcttatgctctgacctggatcttttatgaggaactcatttctggctc

SEQ ID NO: 45544 - DNA, 201 bp, Homo sapiens
ctctgtctgatgtgtcttgtgtcgccatcttcggaacatgtggggcaattcagggcagaaaaagcatgagctttatttaggctgacagacaagatgaatgrccttgagcaaaccactcaactaccctaagtctcattttctgcatttatcaaaaagagatttctttaattttccagggggagaaggaattaattctcctgg

SEQ ID NO: 45545 - DNA, 201 bp, Homo sapiens
agaagtgacaacaactgcaactatgccttcatagcttcttatacattagtatattttatttatcagtgttctctagagaaacagagccaaaagattgtgtrtatagatagatagacagatagacagagaaacagagaaagagagaggggacggagggttgtgggggagggacagagagagaagagagagagagaaggagag

SEQ ID NO: 45546 - DNA, 201 bp, Homo sapiens
tgagcttgtgcaggaaggagccagggcaagtgcttctgggcactgtcaggagcaaaatgctgtgcggggcccatggcagcgtctatgggagagtacccacwatccccaaagccccagaaggagtgttacaggcagtgctctttcagctttatcatccacagatggcttaaatgattaacagcttagtggacgctctgcctt

SEQ ID NO: 45547 - DNA, 201 bp, Homo sapiens
ccgccttggcctcccaaagggctgggattacaggcgtgagccaccatgcccagcctcccggttttcttagttcattattcaaaataaaattgctgctcacrttgtttagatttcatagatatggaagctgatgctcagagaagttaagggacttactcatggtcatgtaactaaaaacctccctccaaaatcacacctttc

SEQ ID NO: 45548 - DNA, 201 bp, Homo sapiens
caggctgcaatgtgatggtgcaacctcggctcattgcaacctccacctctggggttcaagcaattctcctgcctcagcctctcgagtagctgggattacasgtgcccaccaccacacctggctatttttttgtatttttagtagagacatggtttccccatgttggccaggctggtctcgacatcaggtgattcacccgcc

SEQ ID NO: 45549 - DNA, 201 bp, Homo sapiens; identical to SEQ ID NO: 26651
  misc_feature (1)...(201): n = A,T,C or G, or insertion/deletion polymorphism (see Tables 1-2)

SEQ ID NO: 45550 - DNA, 201 bp, Homo sapiens
agactgtgggctcggggcctcagctcttccagaccttcactgtgcaccgcagccctgtcaccaagatcatgctgtcggagaagcacctcatctcaggtgascctctgtggggtgctccagtgctgggagagacagctcagatgggagtgtggagacaggaggatgagaatttccactggggagggacattgtgtaggaaga

SEQ ID NO: 45551 - DNA, 201 bp, Homo sapiens
tcgcctgcagcttcgagaggagttggatcgatcttcttgtggaaacgtcctcttcaatggttacctgccgccaccaggtaggcactcccaatggaatggaggggcgcggaggtgggccaaagactacatttcccataaggctgcagctctcgggtgcctgtgctgtgcgtcctgagatacagtgggaggtgtagttcccta

SEQ ID NO: 45552 - DNA, 201 bp, Homo sapiens
tctcagtgctgttagaattccagaccgttttagaatcccataccccatcagaaatcttctggcccattttatcttctctaattcctgctggaatcttcactttttttttttttgaaatggagtcattctctgttgcccagattggagtacagtggtatgatctcggctcactgcaacctctgcctcctggggtcacgcaat

SEQ ID NO: 45553 - DNA, 201 bp, Homo sapiens; identical to SEQ ID NO: 26654

SEQ ID NO: 45554 - DNA, 201 bp, Homo sapiens
cccagcctgcagctgtcccccaacttgtgtagcatgacccagaggggtttatcgaggggcggcagattcaactctctctcatttttttttctgagacagastctcattctgttgcccaggctggagtgcagtggtgcaatcttggctcactgcaacctccacctcctgagttcaagcgattctcctgcctcagcctcccaa

SEQ ID NO: 45555 - DNA, 201 bp, Homo sapiens; identical to SEQ ID NO: 26655

SEQ ID NO: 45556 - DNA, 201 bp, Homo sapiens
aattttatgtatggtgtgaagcagggattattcttttttaaaaaaaaatagagacagggtcttgctctgttgcccaggctagagtgcagtggcatgatgtsagttctctgccacctccgccactcgggctcaagcgattcttctacctcaacctcctgaacagcggaaccacaggcatgcatcaccacacctgtctaattt

SEQ ID NO: 45557 - DNA, 201 bp, Homo sapiens
taggaagttattgacagtaatgcccatgatagccagcccactggccatggaaggtatgccccagtggttattggaactaggcttttctgattggtagaagkaacagagtagggaaatttcatctacagctttatttccctaactgcagtcagcacctgctaccttcatgaaagttgccagatataaagatctgtagtagta

SEQ ID NO: 45558 - DNA, 201 bp, Homo sapiens
tagagacagggttttgccatgttgcccaggctactcttgaactcctgggctcaagtgatcctcacactttggcctccaaagtgctggaaatacagacttgwgtcactgtgcttggccatagctgctgctgctgcttttcttttttttttaaagcagaaataagttaataatacacctaacttcatgacacattatcacctt

SEQ ID NO: 45559 - DNA, 201 bp, Homo sapiens
tgagcgggacgaccagcaagtgttcatccagaaggtggtgcccagtgccagccagctcttcgtgcgtctctcatctactgggcagcggtgaggacagtcctgtccaacagggagggaggacagtcctgtccaacagggagggaggtcaggggagaaggcaagatgctagccagatcactgaggccagaaaggggtcccagc

SEQ ID NO: 45560 - DNA, 201 bp, Homo sapiens
cctctgcctcctgggttcaagcaattctcatgcctcagccttctgagtagctgggattacaggtgcgtactaccaccaccagctaatttttgtatttttastagagacagggtttcagcacgttggccaggctggtcttgaacgcctgacctcaagcgatccacccgcctcagcttcccaaagtgatgggattacggcgtg

SEQ ID NO: 45561 - DNA, 201 bp, Homo sapiens
caggcatgggctgctgcacccggcctctttcttatttcacttacttactcatttcctcctcatctcccttcccgccacatgccactattatgtcatttttstttgttttttgagacagtctcgcttcgtcacctaggctggagtgcagtggcgcaatcatagctcactgcagcctcaccccctgggctcaagtgatcctcc

SEQ ID NO: 45562 - DNA, 201 bp, Homo sapiens
caacgatttacggggcacccaccatgtgccaggcataggggatacagtgatgaacaagacaggccaagtccctgccctcgtggagctgacattctagcagsgatggcagacaataaatctataaaaatggacatcaatggccagctgcggtggctcacacctataatcccagaactttgggaggccaaggcgggtagatta

SEQ ID NO: 45563 - DNA, 201 bp, Homo sapiens; identical to SEQ ID NO: 26676

SEQ ID NO: 45564 - DNA, 201 bp, Homo sapiens; identical to SEQ ID NO: 26733

SEQ ID NO: 45565 - DNA, 201 bp, Homo sapiens
gtggacggggctggggagcagtgggtgggttctggaggtggaggagagggcccatcctctgtgaggggtcaccacggaaggaaaggaatggaagggctccyggctgcagcctgtcctgccccacccccaggtccaggaggtgcagcccatcaccagttatgacgcggcaggctccttcctcctcctgggctgcaacaacgg

SEQ ID NO: 45566 - DNA, 201 bp, Homo sapiens; identical to SEQ ID NO: 26734

SEQ ID NO: 45567 - DNA, 201 bp, Homo sapiens
atgccccccaaccttggcaatgcagggctgctgggccgaatgctggatgagaaaacccctccctcaccctcaggtacgtttctatctcgtggaaggttggrgcagctgtggggtccctgtgaccctcttctgatccctactcttcccctcaaggacaacctgaggagccggggatggtgcgcctggtgtgtggacaccata

SEQ ID NO: 45568 - DNA, 201 bp, Homo sapiens
  misc_feature (1)...(201): n = A,T,C or G, or insertion/deletion polymorphism (see Tables 1-2)
acagaacaggaggtgaggatggggtgcagatgcgggcgggccttgtcaggctgtggaagggctgaggctttgtcctgtgcggggagccgtggccactgcangggggatgaaaggaggcttgatgggaggccaggagcccagggaggaggccaggaggctgataggaggtgggggagcagctgggacgggcctcaggtcttc

SEQ ID NO: 45569 - DNA, 201 bp, Homo sapiens
ttaggagttaatctttgtgtttctttcccacctttgtgattaaggcatgatgttcacatgttcataaaacaacacagatgcaggttttacagcagatgaasctgagttctcttacttgagacagttttttgttttgttttcttgacatcaaatgcagaatgggttaatttttgagacgtaattctcataccataaaatttc

SEQ ID NO: 45570 - DNA, 201 bp, Homo sapiens; identical to SEQ ID NO: 26680

SEQ ID NO: 45571 - DNA, 201 bp, Homo sapiens
ctctgttgcccaggctagagtgcagtggcatgatgtgagttctctgccacctccgccactcgggctcaagcgattcttctacctcaacctcctgaacagcrgaaccacaggcatgcatcaccacacctgtctaatttttgtatttttttgtagagacagggttttgccatgttgcccaggctactcttgaactcctgggct

SEQ ID NO: 45572 - DNA, 201 bp, Homo sapiens; identical to SEQ ID NO: 26682
  misc_feature (1)...(201): n = A,T,C or G, or insertion/deletion polymorphism (see Tables 1-2)

SEQ ID NO: 45573 - DNA, 201 bp, Homo sapiens; identical to SEQ ID NO: 26686

SEQ ID NO: 45574 - DNA, 201 bp, Homo sapiens; identical to SEQ ID NO: 26742

SEQ ID NO: 45575 - DNA, 201 bp, Homo sapiens; identical to SEQ ID NO: 26743

SEQ ID NO: 45576 - DNA, 201 bp, Homo sapiens; identical to SEQ ID NO: 26691

SEQ ID NO: 45577 - DNA, 201 bp, Homo sapiens; identical to SEQ ID NO: 26744

SEQ ID NO: 45578 - DNA, 201 bp, Homo sapiens; identical to SEQ ID NO: 26745

SEQ ID NO: 45579 - DNA, 201 bp, Homo sapiens; identical to SEQ ID NO: 26746

SEQ ID NO: 45580 - DNA, 201 bp, Homo sapiens; identical to SEQ ID NO: 26747

SEQ ID NO: 45581 - DNA, 201 bp, Homo sapiens
tgccccacccccaggtccaggaggtgcagcccatcaccagttatgacgcggcaggctccttcctcctcctgggctgcaacaacggctccatttactacgtsggtgagcagcagcctgtgtcccgggtgcccgagaccctcccctgggagaggggaagggagggagagaggctggggcacttggaacaaacccgctccaccc

SEQ ID NO: 45582 - DNA, 201 bp, Homo sapiens; identical to SEQ ID NO: 26748

SEQ ID NO: 45583 - DNA, 201 bp, Homo sapiens
ggtcccagccaaggagcattgaaggagcaaaggctgggagggaggacaggcctggtaggtttgtcttctggtatcaaaggtgtgacaggtgttggtgggastgacctggcgcagtgccagcccagtgcaggcagggccaggttgaaggcacagggggtggggtcagggtgggatggggggcccaggcggagggggaggggt

SEQ ID NO: 45584 - DNA, 201 bp, Homo sapiens
gtgcaacgagcgaaactccaactcaaaaaaaaaaaaaaaaaaaaaaacggaaaattaggtaatactgcagattcattaatatcacagcagcactaaactcrgtcttcctctgtgctgggctcaagggaactgaaagggaagtaacttgctatgtggttcagtgtcatttcatgctgtgtcactgcaccacttaaaatcttc

SEQ ID NO: 45585 - DNA, 201 bp, Homo sapiens
cataaggctgcagctctcgggtgcctgtgctgtgcgtcctgagatacagtgggaggtgtagttccctatcagatgcttgggctgatgcttggaaaggaagktggacacagcatttcccatgagacaatgggccagctaactcttgaggctcagaaggatgtcctggagccccatgggagttgtagtccgggtttggtttct

SEQ ID NO: 45586 - DNA, 201 bp, Homo sapiens
agcagtgagtcggacaagaactgaaatgggatgggggggaggggttggtaggaagaggggcaggaccccactcagtcctgccttttaccccatccatcctytgcccccctttcccgcagatcttcatcgacagggaccctacagtcttcgcccccatcctcaacttcctgcgcaccaaagagttggatcccaggttggcat

SEQ ID NO: 45587 - DNA, 201 bp, Homo sapiens; identical to SEQ ID NO: 26706

SEQ ID NO: 45588 - DNA, 201 bp, Homo sapiens
accttcactgtgcaccgcagccctgtcaccaagatcatgctgtcggagaagcacctcatctcaggtgagcctctgtggggtgctccagtgctgggagagasagctcagatgggagtgtggagacaggaggatgagaatttccactggggagggacattgtgtaggaagagagctctggcggagaggattgacctgggatgg

SEQ ID NO: 45589 - DNA, 201 bp, Homo sapiens
gcagtgctggcaatgacattggtgcctactggctcctggccttcccaccccactgacccccttacctgacccctgttgacctccgctgattcccacttgcrgccacctgacccaggagcctgcaacgattggggtgtcctgatccttgaggcacctgagctccactgactgccgcaaccccccagccctctctggccctgc

SEQ ID NO: 45590 - DNA, 201 bp, Homo sapiens; identical to SEQ ID NO: 23318

SEQ ID NO: 45591 - DNA, 201 bp, Homo sapiens; identical to SEQ ID NO: 23379

SEQ ID NO: 45592 - DNA, 201 bp, Homo sapiens; identical to SEQ ID NO: 23335

SEQ ID NO: 45593 - DNA, 201 bp, Homo sapiens; identical to SEQ ID NO: 23319

SEQ ID NO: 45594 - DNA, 201 bp, Homo sapiens; identical to SEQ ID NO: 23336

SEQ ID NO: 45595 - DNA, 201 bp, Homo sapiens; identical to SEQ ID NO: 23230

SEQ ID NO: 45596 - DNA, 201 bp, Homo sapiens; identical to SEQ ID NO: 23375

SEQ ID NO: 45597 - DNA, 201 bp, Homo sapiens; identical to SEQ ID NO: 23223

SEQ ID NO: 45598 - DNA, 201 bp, Homo sapiens; identical to SEQ ID NO: 23432

SEQ ID NO: 45599 - DNA, 201 bp, Homo sapiens; identical to SEQ ID NO: 23377

SEQ ID NO: 45600 - DNA, 201 bp, Homo sapiens; identical to SEQ ID NO: 23225

SEQ ID NO: 45601 - DNA, 201 bp, Homo sapiens
caagtcaggtggacttgaatatgaaccctccaggcctttccaccaactagctatagagccttgggcacatctggcccagagctggccccgacagacacttkcccagtgggtgagtgctcaatgaacccatctgagccaattgtctcatccaaccagtgatataattccttccttgcagaagaataagtgagaaaagacaca

SEQ ID NO: 45602 - DNA, 201 bp, Homo sapiens
acaccccttcagaacagcctgcaggaaggcaccgtctcctcacaggctcacacatgcacggtgtgtgcacagagcttttgctctagttcaggaggtgtgtrgggagcctcactagtccaacagagcttggtaccagtgtcatatgccaggaaccaaggttataagggatacaatgtccccagacctaccagagaaggcaaa

SEQ ID NO: 45603 - DNA, 201 bp, Homo sapiens
gttgggttccgggacgcgggatccggcttctctgggaatcttggattccaggaaggatcctggagatctcccactttatgaagcccaatctccactcactstgatggcgtctttagaccccactggaaaccagatacgacgccctcatcggccctggggaaaaaacaagagcaaagtatgagaggtggccatgaggtcagg

SEQ ID NO: 45604 - DNA, 201 bp, Homo sapiens; identical to SEQ ID NO: 14296

SEQ ID NO: 45605 - DNA, 201 bp, Homo sapiens
tgtcctccaccagcaaaagaggtcttaaaatatacatcacgcgggcctggtgtggtggctcgcgcctgtaatcccagcactttgggaggccgaagcgggcrgatcacctgaggtcgggagttcaagaccagcctgaccaacatggagaaaccccgtctctactaaaaatacaaaaatattagccggacatggtggcacatg

SEQ ID NO: 45606 - DNA, 201 bp, Homo sapiens
catgatcacggctcactgcaacctccacctcccgtgtccaagcaattctcctgtgtcagcctcctgagtagctgggactacaggctcacaccaccacaccyggctaattttttgtattttagtagagacgaagtttcaccatgttgcccaggctggtctcaaactcctgagctcaggtgatccgcgtgcctcagcctccca

SEQ ID NO: 45607 - DNA, 201 bp, Homo sapiens
gaatttactggctttgggagatgcggctgaacaacttatgtttacaacttacttaggcgtggtggctcacgcctataatcccagcactttgggatgccaargcgggcggatcacgaggtcaggagctcgagaccatcctggccaacatggtgtaatcccgtctctactgaaaatacaaaaactagctgggcatggtggtgg

SEQ ID NO: 45608 - DNA, 201 bp, Homo sapiens
cgcctataatcccagcactttgggatgccaaggcgggcggatcacgaggtcaggagctcgagaccatcctggccaacatggtgtaatcccgtctctactgmaaatacaaaaactagctgggcatggtggtgggcgcctgtaatcccagctacttgggaggctgagccaggagaatggcttgaacccgggaggcagaggtca

SEQ ID NO: 45609 - DNA, 201 bp, Homo sapiens; identical to SEQ ID NO: 33099

SEQ ID NO: 45610 - DNA, 201 bp, Homo sapiens; identical to SEQ ID NO: 33102

SEQ ID NO: 45611 - DNA, 201 bp, Homo sapiens
gaggctgtgctctacacgctcctccaagggccacgcttgcctcccaacctgatccctaagtctgcacacagatacattcctgcaccctcacctgcatggtktccagaagcttctgtcgctccagttcccatgtctggctgtggacctcagaagggacttgttccccaacatattttcttagattctcaaccagggtcacct

SEQ ID NO: 45612 - DNA, 201 bp, Homo sapiens
tggtcaggggcagtggctcctgcctgtaatcccagcactttgggaggccgaggcgggcggatcacctgaagtcaggaattggagactagcctggccaacayggtgaaactctctctacttaaaaacacaaaaattagccgggcatggtggctcatgcctgtaatcccagctactccagaggctgaggcacgagaatcactt

SEQ ID NO: 45613 - DNA, 201 bp, Homo sapiens; identical to SEQ ID NO: 14200

SEQ ID NO: 45614 - DNA, 201 bp, Homo sapiens; identical to SEQ ID NO: 14304

SEQ ID NO: 45615 - DNA, 201 bp, Homo sapiens; identical to SEQ ID NO: 14305

SEQ ID NO: 45616 - DNA, 201 bp, Homo sapiens
cctcagcaacaaggtgcccaggaacctgaggtagcagaaacactactccacccacccctccatccctgatacctgctgacagcattgaccacaagcctcarctgctcctcggctgaggctgtctgctgctgccaccaacgcctggcctcctgagcacggctcagctccaactgcaggccctggggaggatgcagcaaagga

SEQ ID NO: 45617 - DNA, 201 bp, Homo sapiens; identical to SEQ ID NO: 14203

SEQ ID NO: 45618 - DNA, 201 bp, Homo sapiens
gatagagctaaatctgcccagccctgtagcctccagtggccactttccagcccctcttgcctgaggatcctcagcaacaaggtgcccaggaacctgaggtrgcagaaacactactccacccacccctccatccctgatacctgctgacagcattgaccacaagcctcagctgctcctcggctgaggctgtctgctgctgcc

SEQ ID NO: 45619 - DNA, 201 bp, Homo sapiens
cgggcgtagtggaggacactggtggaggatgcctgtaatccagctactcgggaggctgaggcaggagaatcacttgaaccagggaggtgaggttgcagtgrgccaagattgcgccattgcactccagcctgggtgacagagcgagactttgtctcaaaataaataaataaatagactaaatttttctccagtgaaacggat

SEQ ID NO: 45620 - DNA, 201 bp, Homo sapiens
ggaagtggtgggcaaggactcatcctgcatcttaatttcgctaaaccaaaaattatctttatctaaattaacccatcaagaagagcctcacgataacaatmaacatttacaagccagagactgtgctaagaactacctgccggccgggcacggtggctcaagcctgtaatcccagcactttgggaggccgaggcgggcgga

SEQ ID NO: 45621 - DNA, 201 bp, Homo sapiens
gctaaattagtccctaaggtacaaacccaagagaaggaagtggtgggcaaggactcatcctgcatcttaatttcgctaaaccaaaaattatctttatctawattaacccatcaagaagagcctcacgataacaatcaacatttacaagccagagactgtgctaagaactacctgccggccgggcacggtggctcaagcctg

SEQ ID NO: 45622 - DNA, 201 bp, Homo sapiens; identical to SEQ ID NO: 14205

SEQ ID NO: 45623 - DNA, 201 bp, Homo sapiens; identical to SEQ ID NO: 14206

SEQ ID NO: 45624 - DNA, 201 bp, Homo sapiens
ctctctgtgtctgagagttgctcccgcagccgagtttccacttcagccaccttttcttgcagggctggggtgaaagtgcagacggggcatatcagcaggasctttgattcgcagttcccaccccaccctccaagggaagcacccatttccctctcgacaccttgcccgtagagttcctgctgctgggtcagctcctgccgc

SEQ ID NO: 45625 - DNA, 201 bp, Homo sapiens; identical to SEQ ID NO: 14207

SEQ ID NO: 45626 - DNA, 201 bp, Homo sapiens
aagccaccgcgaccggccatatgctgtttcttaatctggtgctggctacatgggtgtgttcacgatgtgataattcatctgtgctactcctggataccttyattacttcctgtaatgaagctttgaacacactttgaggggaaaataataaccttatgtcttaacacttccttcttcctggaaggccctatccaccctggc

SEQ ID NO: 45627 - DNA, 201 bp, Homo sapiens
ccaggcggttccgttcttcccgcagctgctgcaactcaaggctcacatctgtgaccggtggtggtaggggacagctgagacggggaagagaaagagtcagragaaatcacccagctgcctgatcccaaagcccccatcccacctcagtcctcatggttttgggggtcccagcagccaatgccctaaagccccatccacctc

SEQ ID NO: 45628 - DNA, 201 bp, Homo sapiens
gcccaggctggagtgtgatgtcagctcactgtaacctctgtctcccaggttcaagcaattctcctgcctcagcctcccaagaagctgggggattacaggckcccacgactatacccggctaatttttgtatttttttgtagagttcttcatgttggccaggttggtctttaactcctggcctcaagtgatccgcccacctc

SEQ ID NO: 45629 - DNA, 201 bp, Homo sapiens
gctgcttgtaacgggagaggagaccttcctgctgcaaggtggcctgggaaggagagggttaaacctagcccggatagagcctccctcaccatcctctttcyacacctctagcccaggaaccagcccaggatgggccctagtgtctgcctgtctgccctcctgtctcctaccagcatgaggttcttatccctctctagctcc

SEQ ID NO: 45630 - DNA, 201 bp, Homo sapiens; identical to SEQ ID NO: 14217

SEQ ID NO: 45631 - DNA, 201 bp, Homo sapiens
gtgaacccgggaggcagaggttgcagtgagctgagatcgtgccattgcactccagcctgggtgacagtgcgagactctgtctcaaaaaaaaaagaactacytgccttgggtacctcagtgtctaaggctgaggggaagtcatcaccagcacaaagaagctttgctgttttcttagaggtttttctgaaggtcatacaacaa

SEQ ID NO: 45632 - DNA, 201 bp, Homo sapiens
tgaggcaggaaaatcgtgtgaacccgggaggcagaggttgcagtgagctgagatcgtgccattgcactccagcctgggtgacagtgcgagactctgtctcaaaaaaaaaagaactacctgccttgggtacctcagtgtctaaggctgaggggaagtcatcaccagcacaaagaagctttgctgttttcttagaggtttttc

SEQ ID NO: 45633 - DNA, 201 bp, Homo sapiens
gaggacactggtggaggatgcctgtaatccagctactcgggaggctgaggcaggagaatcacttgaaccagggaggtgaggttgcagtgagccaagattgygccattgcactccagcctgggtgacagagcgagactttgtctcaaaataaataaataaatagactaaatttttctccagtgaaacggattgcccgtaaaa

SEQ ID NO: 45634 - DNA, 201 bp, Homo sapiens
gcagccaatgccctaaagccccatccacctcaaagtgcccaaacttcacctctcctggcgcagctgagcaagggcaagctttcgagcaatcaggcctgggrgggaaaaagcagggagaaaaagagatgaagtttgcatgggagaaagtggggacagggagtaagggaaaaagagatgcaaggactggtgaaaggaggaagg

SEQ ID NO: 45635 - DNA, 201 bp, Homo sapiens
ggcagggccctctagagctaaaagatgaggggggcactggaagcaaagtggcaggtgcagagatctctgtaagaatgccatgcaggggctggggggagggrgggcgggcgacgggggtgggtcgcagcacggtggctcacacctgtaatcccagcactttgggaggccgaggcagatggatcacttgaggtcaggggttca

SEQ ID NO: 45636 - DNA, 201 bp, Homo sapiens; identical to SEQ ID NO: 14320

SEQ ID NO: 45637 - DNA, 201 bp, Homo sapiens
tccctgcttaaaacctttcaacaggccgggcgcagtggctcattcctgtaattccagcactttgggaggccgaggtgggtggatcacaaggtcaggagatygagatcatcctggctaacacggtgaaaccccgtctctattaaaatacaaaaaattagctgggcgtggtggcgggcgcctgtagtcccagctactcggaag

SEQ ID NO: 45638 - DNA, 201 bp, Homo sapiens
ctttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagt

SEQ ID NO: 45639 - DNA, 201 bp, Homo sapiens; identical to SEQ ID NO: 14324

SEQ ID NO: 45640 - DNA, 201 bp, Homo sapiens
gaaacactactccacccacccctccatccctgatacctgctgacagcattgaccacaagcctcagctgctcctcggctgaggctgtctgctgctgccaccracgcctggcctcctgagcacggctcagctccaactgcaggccctggggaggatgcagcaaaggacagggtccctccctaagtcctggctgcagccccgga

SEQ ID NO: 45641 - DNA, 201 bp, Homo sapiens
tttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtg

SEQ ID NO: 45642 - DNA, 201 bp, Homo sapiens
agaaacactactccacccacccctccatccctgatacctgctgacagcattgaccacaagcctcagctgctcctcggctgaggctgtctgctgctgccacyaacgcctggcctcctgagcacggctcagctccaactgcaggccctggggaggatgcagcaaaggacagggtccctccctaagtcctggctgcagccccgg

SEQ ID NO: 45643 - DNA, 201 bp, Homo sapiens
ccccagagtcagtttctatcatatcatcatactgtactttctcttcaagcacttatttgaaacgatctcgttcatctgtttaggtcccatctgctcgctckctctcccactaggatgtaggctctcagggtccaagtggcccccaggctaatacagtgcctggcattgacattcctgttgaacgagtgaatgtttcatctt

SEQ ID NO: 45644 - DNA, 201 bp, Homo sapiens
tctcctggcgcagctgagcaagggcaagctttcgagcaatcaggcctgggagggaaaaagcagggagaaaaagagatgaagtttgcatgggagaaagtggrgacagggagtaagggaaaaagagatgcaaggactggtgaaaggaggaaggtgaatggatgtgggatcagagagagctgggtcaggaagaagaaagtccga

SEQ ID NO: 45645 - DNA, 201 bp, Homo sapiens
aagggctggtctgtccccacccacttctccaggatcctcccagcccccaggctggctttccctccaactgtcagctgcttagctgctcatctggggattgsagctggagcatctgtcaaggttgtctccttgacaaacagcttcctctttggaaatggcttcactcaggtcctgcaggtcatcgagcaggacagagaggga

SEQ ID NO: 45646 - DNA, 201 bp, Homo sapiens; identical to SEQ ID NO: 14228

SEQ ID NO: 45647 - DNA, 201 bp, Homo sapiens; identical to SEQ ID NO: 2845

SEQ ID NO: 45648 - DNA, 201 bp, Homo sapiens
gagtttcactttgttgcctagactggagtgcaatggcacgatctcagctcactgcaaacgctgcctcccaggttcaagcgattctcctgcctcaccctccygagtagctgagattacaggcatgagccaccacgcccagctaatttttgtatttttagtagagatgaggttttaccatgttggccaggctggtctcgaact

SEQ ID NO: 45649 - DNA, 201 bp, Homo sapiens; identical to SEQ ID NO: 14230
  misc_feature (1)...(201): n = A,T,C or G, or insertion/deletion polymorphism (see Tables 1-2)

SEQ ID NO: 45650 - DNA, 201 bp, Homo sapiens
cagccttgctggtcaaactggaaagagcctcctcgtgagcctgtgtcaaagaggacagctgcggaaagaagagggggctcagcagaggctcgaccccacayggaggccttccttgttcccttcactcccactttctgtgaccttagagaatgacccaaccaatcagccaactgtgcacagcaaatggagagctggcaactc

SEQ ID NO: 45651 - DNA, 201 bp, Homo sapiens; identical to SEQ ID NO: 14231

SEQ ID NO: 45652 - DNA, 201 bp, Homo sapiens; identical to SEQ ID NO: 14232

SEQ ID NO: 45653 - DNA, 201 bp, Homo sapiens
cccatacgctccacctccacctctgcggctttgtcctgcagggatcgctgcaggatggcctgctcctggctctgggatgtcactttttcctggagtgaggycacctgggggaggagagagagctgggcagggccctctagagctaaaagatgaggggggcactggaagcaaagtggcaggtgcagagatctctgtaagaat

SEQ ID NO: 45654 - DNA, 201 bp, Homo sapiens; identical to SEQ ID NO: 14233

SEQ ID NO: 45655 - DNA, 201 bp, Homo sapiens
aggaacattgatagagctaaatctgcccagccctgtagcctccagtggccactttccagcccctcttgcctgaggatcctcagcaacaaggtgcccaggamcctgaggtagcagaaacactactccacccacccctccatccctgatacctgctgacagcattgaccacaagcctcagctgctcctcggctgaggctgtct

SEQ ID NO: 45656 - DNA, 201 bp, Homo sapiens; identical to SEQ ID NO: 14234

SEQ ID NO: 45657 - DNA, 201 bp, Homo sapiens; identical to SEQ ID NO: 14235

SEQ ID NO: 45658 - DNA, 201 bp, Homo sapiens
aaagaaaaagaatgaatgccacgcagggagacagaagcttaggttctgaggatggaatctgagcccagtgttccatgttccacattccatgtgcccactcraagatgggaatagcccttgacacaccccacaagacccaccaactgaccatgccactctcctcagatgctgtcacctcctcagagaggctgtctctgagca

SEQ ID NO: 45659 - DNA, 201 bp, Homo sapiens
agcagccaatgccctaaagccccatccacctcaaagtgcccaaacttcacctctcctggcgcagctgagcaagggcaagctttcgagcaatcaggcctggragggaaaaagcagggagaaaaagagatgaagtttgcatgggagaaagtggggacagggagtaagggaaaaagagatgcaaggactggtgaaaggaggaag

SEQ ID NO: 45660 - DNA, 201 bp, Homo sapiens; identical to SEQ ID NO: 14243

SEQ ID NO: 45661 - DNA, 201 bp, Homo sapiens; identical to SEQ ID NO: 33090

SEQ ID NO: 45662 - DNA, 201 bp, Homo sapiens
acccagctgcctgatcccaaagcccccatcccacctcagtcctcatggttttgggggtcccagcagccaatgccctaaagccccatccacctcaaagtgcmcaaacttcacctctcctggcgcagctgagcaagggcaagctttcgagcaatcaggcctgggagggaaaaagcagggagaaaaagagatgaagtttgcatg

SEQ ID NO: 45663 - DNA, 201 bp, Homo sapiens; identical to SEQ ID NO: 14339

SEQ ID NO: 45664 - DNA, 201 bp, Homo sapiens; identical to SEQ ID NO: 33092

SEQ ID NO: 45665 - DNA, 201 bp, Homo sapiens
gttccgttcttcccgcagctgctgcaactcaaggctcacatctgtgaccggtggtggtaggggacagctgagacggggaagagaaagagtcaggagaaatmacccagctgcctgatcccaaagcccccatcccacctcagtcctcatggttttgggggtcccagcagccaatgccctaaagccccatccacctcaaagtgc

SEQ ID NO: 45666 - DNA, 201 bp, Homo sapiens
ttatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtga

SEQ ID NO: 45667 - DNA, 201 bp, Homo sapiens; identical to SEQ ID NO: 33095

SEQ ID NO: 45668 - DNA, 201 bp, Homo sapiens
aaggtgcccaggaacctgaggtagcagaaacactactccacccacccctccatccctgatacctgctgacagcattgaccacaagcctcagctgctcctcrgctgaggctgtctgctgctgccaccaacgcctggcctcctgagcacggctcagctccaactgcaggccctggggaggatgcagcaaaggacagggtccct

SEQ ID NO: 45669 - DNA, 201 bp, Homo sapiens
tatggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgat

SEQ ID NO: 45670 - DNA, 201 bp, Homo sapiens; identical to SEQ ID NO: 33097

SEQ ID NO: 45671 - DNA, 201 bp, Homo sapiens
cctgccctcaagactgggtgacagagcgagactccatctcaaaaaaacaaaagaaaacaaagttatcctctccaagcccaggagtgtcgatctagcaccartgacgggcaggtccacatgctttaccagctggctgtgccagaagtaggaccaacctggctcatgaaaactgagcagcttaaacaggccccaggaggaggc

SEQ ID NO: 45672 - DNA, 201 bp, Homo sapiens
ggctaatttggtcactgagtcttagagatggcagagtaagtactgagtttgaggactgaataatctctctctcccagtccaccatagcccccttatacccmccttcctcactgccctccacaatacccctgatgaattggtacctggagtaaagtagggaggcaaactatttcctactagaaagggaagcagggcttcaag

SEQ ID NO: 45673 - DNA, 201 bp, Homo sapiens
atggcttctagattttggattttgactcacaggtagaaaggccttgcccactacaaggttataaaggaattctcccttgttttctcccagttccttttttattttattttttgagacagagtcttgctctgtcgcccaggctggagtgcaatggcacagtctcggctcactgcaacctccactgcccaggttcaagtgatt

SEQ ID NO: 45674 - DNA, 201 bp, Homo sapiens; identical to SEQ ID NO: 14248

SEQ ID NO: 45675 - DNA, 201 bp, Homo sapiens
gtgcgcaccaccatgcctggtgaatttttgtatttttagtagagacagggtttcgccatgttggccaggctggtcttgaactcctgaccttgtgatctgcytgcttcggcctcccaaaatgctgggattacaggcgtgagccactgcgcccagggctatggtttctttccttgacatgtcaactggttacagtggccttcc

SEQ ID NO: 45676 - DNA, 201 bp, Homo sapiens
tcactgcaacctccactgcccaggttcaagtgattctcctgcctcggcctcccaagtagctgggattacaggtgcgcaccaccatgcctggtgaatttttktatttttagtagagacagggtttcgccatgttggccaggctggtcttgaactcctgaccttgtgatctgcctgcttcggcctcccaaaatgctgggatta

SEQ ID NO: 45677 - DNA, 201 bp, Homo sapiens; identical to SEQ ID NO: 14250

SEQ ID NO: 45678 - DNA, 201 bp, Homo sapiens
ggcactcagctgcagttctgcatccaggcggttccgttcttcccgcagctgctgcaactcaaggctcacatctgtgaccggtggtggtaggggacagctgrgacggggaagagaaagagtcaggagaaatcacccagctgcctgatcccaaagcccccatcccacctcagtcctcatggttttgggggtcccagcagccaa

SEQ ID NO: 45679 - DNA, 201 bp, Homo sapiens; identical to SEQ ID NO: 14251

SEQ ID NO: 45680 - DNA, 201 bp, Homo sapiens
tcacccaggcttgagtgcagtggcacaatcttggctcactgcagcctcgacctcccgggttcatgtagtcttcccacatcagcctcacaagtaagcttggkgtacaggtgcccaccaccaggcctagctaatttttgtatttttagtcgagacagggtttcgccatgttgtccaggctggcctcaaactcctgacctcagg

SEQ ID NO: 45681 - DNA, 201 bp, Homo sapiens
agattcctgaagtgcgcgcatttgtcccttgtccctttgtgcttggcccaagaccttttatggactccctggtgggcactgctgctgctacaggtgcagawgctgaacactctggaggcctggggctggacaccacagatttcttcttatccagtagggaaggaagaactgtcaacagtcgctgctgcttgtaacgggaga

SEQ ID NO: 45682 - DNA, 201 bp, Homo sapiens; identical to SEQ ID NO: 14344

SEQ ID NO: 45683 - DNA, 201 bp, Homo sapiens
gagacctcctggcctccacaggagcccacttcaggcaggcctctgcacaaggtcccctgctcagaggcctctccccagagtcagtttctatcatatcatcrtactgtactttctcttcaagcacttatttgaaacgatctcgttcatctgtttaggtcccatctgctcgctctctctcccactaggatgtaggctctcagg

SEQ ID NO: 45684 - DNA, 201 bp, Homo sapiens; identical to SEQ ID NO: 14254

SEQ ID NO: 45685 - DNA, 201 bp, Homo sapiens
gatctaagcaggttctggggcacattgacccctcctgcccacagggagggaggcaggggacagtagatgcaggatgcggctgagggtgaggggtctggggsttgggctgtaccttcctggtcagctcctcctcctgcagggcgaggatgtgtgtgaggctctgcacccgcacctgcagcagctccgcggtggcatgcaggc

SEQ ID NO: 45686 - DNA, 201 bp, Homo sapiens
tgctcttctggtttccagactactcagagacttctccaagccctcagccttgctggtcaaactggaaagagcctcctcgtgagcctgtgtcaaagaggacwgctgcggaaagaagagggggctcagcagaggctcgaccccacacggaggccttccttgttcccttcactcccactttctgtgaccttagagaatgaccca

SEQ ID NO: 45687 - DNA, 201 bp, Homo sapiens
atggcacagtctcggctcactgcaacctccactgcccaggttcaagtgattctcctgcctcggcctcccaagtagctgggattacaggtgcgcaccaccaygcctggtgaatttttgtatttttagtagagacagggtttcgccatgttggccaggctggtcttgaactcctgaccttgtgatctgcctgcttcggcctcc

SEQ ID NO: 45688 - DNA, 201 bp, Homo sapiens
gcggctttgtcctgcagggatcgctgcaggatggcctgctcctggctctgggatgtcactttttcctggagtgaggccacctgggggaggagagagagctrggcagggccctctagagctaaaagatgaggggggcactggaagcaaagtggcaggtgcagagatctctgtaagaatgccatgcaggggctggggggaggg

SEQ ID NO: 45689 - DNA, 201 bp, Homo sapiens; identical to SEQ ID NO: 33093

SEQ ID NO: 45690 - DNA, 201 bp, Homo sapiens
cctaagtctgcacacagatacattcctgcaccctcacctgcatggtttccagaagcttctgtcgctccagttcccatgtctggctgtggacctcagaaggsacttgttccccaacatattttcttagattctcaaccagggtcacctgagcctccaagtcttcctgggtcttgctagggttggggtgggaatgggacagcc

SEQ ID NO: 45691 - DNA, 201 bp, Homo sapiens
ttctcccgccagcggttcagcagggactggcacttcctggtaaactcaggctccagggaatctgaaggttgaacctgagggagaaggagtgggagaaaagygtgggctcctgggggaggagaggaaggaggtggcatctttgtttctcctctgtcctgcctgggcaacatgagctacagcaagaggagttcacaggaagga

SEQ ID NO: 45692 - DNA, 201 bp, Homo sapiens
cctgtaatcccatcactttgggaggctgaggcaggtgaatcacctgaggtcaggagttcgagaccaaagtgatcgcattataggtgtgagccactgcaccyggcttcaatctttctatcgcacatataattacccaacattatctgtttacttgcgtgttctgtgtctctgttctagaatgcaagctccacattttagttt

SEQ ID NO: 45693 - DNA, 201 bp, Homo sapiens
acaattctttttttgacacatggtctttctctatcacccaggcttgagtgcagtggcacaatcttggctcactgcagcctcgacctcccgggttcatgtartcttcccacatcagcctcacaagtaagcttggggtacaggtgcccaccaccaggcctagctaatttttgtatttttagtcgagacagggtttcgccatgt

SEQ ID NO: 45694 - DNA, 201 bp, Homo sapiens
ccaaactgttggcattacttgactgggcacggtggctcacacctgtaatcccatcactttgggaggctgaggcaggtgaatcacctgaggtcaggagttcragaccaaagtgatcgcattataggtgtgagccactgcacccggcttcaatctttctatcgcacatataattacccaacattatctgtttacttgcgtgtt

SEQ ID NO: 45695 - DNA, 201 bp, Homo sapiens
cccaccaactgaccatgccactctcctcagatgctgtcacctcctcagagaggctgtctctgagcatcctacctgaggctgactcaccccacagtctctcygtcacattatcttttgaatttttcttactactttctttttttttgagaaaagatctcgctttgtcacccaggctagagtgcagtgatgggatcacagttc

SEQ ID NO: 45696 - DNA, 201 bp, Homo sapiens; identical to SEQ ID NO: 14281

SEQ ID NO: 45697 - DNA, 201 bp, Homo sapiens
atcttgcttatgtgtatgtgttactatctgtcggaccacactggaaggaaagctccaggaaaggaggaattttgtgtcttttgctcatggcacctcaaagkgttgcaggggtgtcagagccaccaagagtcatgggatggactggaaaggagggcaaagtgcccaccctgcttcctggtctgcctcctctagccctgtctc

SEQ ID NO: 45698 - DNA, 201 bp, Homo sapiens; identical to SEQ ID NO: 14282

SEQ ID NO: 45699 - DNA, 201 bp, Homo sapiens
cacggggagtctgctgagaaccagacagcggcccctccttgctccacagaccccaggcaatagcccctcctcagggtggcttcactgggccctctaatacygtccctccccaccctactctgccccatcagctgttcacgtcctcctgagcacttagcactgaccatatcttgcttatgtgtatgtgttactatctgtcgg

SEQ ID NO: 45700 - DNA, 201 bp, Homo sapiens
tgagctcaccctggaggctctcccactgctccccgctccggccacggggagtctgctgagaaccagacagcggcccctccttgctccacagaccccaggcratagcccctcctcagggtggcttcactgggccctctaataccgtccctccccaccctactctgccccatcagctgttcacgtcctcctgagcacttagca

SEQ ID NO: 45701 - DNA, 201 bp, Homo sapiens
cttccttgttcccttcactcccactttctgtgaccttagagaatgacccaaccaatcagccaactgtgcacagcaaatggagagctggcaactcactctcygcagctgccccacaacccatcaggagttcttgtccgatctcccccaaaacatatcttcacctctctgtctccgtctccactgccaccaaccctcatcttt

SEQ ID NO: 45702 - DNA, 201 bp, Homo sapiens
gtgggaccacttctcacaatctccaagagagatggctgcagggagaattcccacagattcccagaaataacatttccaaacaatggctccttctgtagtcrtctttatttagagcagaattcagactcagctggtatcccccagggcaaccccaggatggggaagggctggtctgtccccacccacttctccaggatcctc

SEQ ID NO: 45703 - DNA, 201 bp, Homo sapiens
cccaaactgttggcattacttgactgggcacggtggctcacacctgtaatcccatcactttgggaggctgaggcaggtgaatcacctgaggtcaggagttsgagaccaaagtgatcgcattataggtgtgagccactgcacccggcttcaatctttctatcgcacatataattacccaacattatctgtttacttgcgtgt

SEQ ID NO: 45704 - DNA, 201 bp, Homo sapiens; identical to SEQ ID NO: 14359

SEQ ID NO: 45705 - DNA, 201 bp, Homo sapiens
gcagggagacagaagcttaggttctgaggatggaatctgagcccagtgttccatgttccacattccatgtgcccactcgaagatgggaatagcccttgacmcaccccacaagacccaccaactgaccatgccactctcctcagatgctgtcacctcctcagagaggctgtctctgagcatcctacctgaggctgactcacc

SEQ ID NO: 45706 - DNA, 201 bp, Homo sapiens
cagccttcctgggatacaaggctggcatgacccacatcgtgcgggaagtcgacaggccaggatccaaggtgaacaagaaggaggtggtggaggctgtgacyattgtggagaggccaccagtgggcattgtgggctgcgtggaaacccctcaaggcttccggacttgcaagactgtcttcgctgagcacatcagtgatgaat

SEQ ID NO: 45707 - DNA, 201 bp, Homo sapiens
caggcatcgtgggaaggtgaagagcttccctaaggatgacccgtccaagccggtccacctcacagccttcctgggatacaaggctggcatgacccacatcrtgcgggaagtcgacaggccaggatccaaggtgaacaagaaggaggtggtggaggctgtgaccattgtggagaggccaccagtgggcattgtgggctgcgt

SEQ ID NO: 45708 - DNA, 201 bp, Homo sapiens
tgtggcaaatatgctctaccggcaggatttgatggcgtgatgtctcacagaaagttctccactcccagacatgggtccctcggcttcctgccttggaagcrcagcagcaggcatcgtgggaaggtgaagagcttccctaaggatgacccgtccaagccggtccacctcacagccttcctgggatacaaggctggcatgacc

SEQ ID NO: 45709 - DNA, 201 bp, Homo sapiens
gttcattgcagcactattcacaatagcaaagacatggaatcaacctaaatgtccatcaatggtagactggataaagaaaatgtggcaaatatgctctaccrgcaggatttgatggcgtgatgtctcacagaaagttctccactcccagacatgggtccctcggcttcctgccttggaagcgcagcagcaggcatcgtggga

SEQ ID NO: 45710 - DNA, 201 bp, Homo sapiens
ctcaccctccgcaagtccttgctggtgcagacaaagcagcgggctctggagaagattgaccttaagttcattgacaccccctccaagtttggccatggccrcttccagaccatggaggagaagaaagcattcatgggaccactcaagaaagaccgaattgcaaaggaagaaggagcttaatgctgggaacagatattgcaa

SEQ ID NO: 45711 - DNA, 201 bp, Homo sapiens
cagcaggcatcgtgggaaggtgaagagcttccctaaggatgacccgtccaagccggtccacctcacagccttcctgggatacaaggctggcatgacccacrtcgtgcgggaagtcgacaggccaggatccaaggtgaacaagaaggaggtggtggaggctgtgaccattgtggagaggccaccagtgggcattgtgggctg

SEQ ID NO: 45712 - DNA, 201 bp, Homo sapiens
tctaccggcaggatttgatggcgtgatgtctcacagaaagttctccactcccagacatgggtccctcggcttcctgccttggaagcgcagcagcaggcatygtgggaaggtgaagagcttccctaaggatgacccgtccaagccggtccacctcacagccttcctgggatacaaggctggcatgacccacatcgtgcggga

SEQ ID NO: 45713 - DNA, 201 bp, Homo sapiens
ggtgggaaccaagaagtgggtgctcaccctccgcaagtccttgctggtgcagacaaagcagcgggctctggagaagattgaccttaagttcattgacaccycctccaagtttggccatggccgcttccagaccatggaggagaagaaagcattcatgggaccactcaagaaagaccgaattgcaaaggaagaaggagctta

SEQ ID NO: 45714 - DNA, 201 bp, Homo sapiens
cagcagcaggcatcgtgggaaggtgaagagcttccctaaggatgacccgtccaagccggtccacctcacagccttcctgggatacaaggctggcatgaccyacatcgtgcgggaagtcgacaggccaggatccaaggtgaacaagaaggaggtggtggaggctgtgaccattgtggagaggccaccagtgggcattgtggg

SEQ ID NO: 45715 - DNA, 201 bp, Homo sapiens
ctaccggcaggatttgatggcgtgatgtctcacagaaagttctccactcccagacatgggtccctcggcttcctgccttggaagcgcagcagcaggcatcrtgggaaggtgaagagcttccctaaggatgacccgtccaagccggtccacctcacagccttcctgggatacaaggctggcatgacccacatcgtgcgggaa

SEQ ID NO: 45716 - DNA, 201 bp, Homo sapiens
aagtccttgctggtgcagacaaagcagcgggctctggagaagattgaccttaagttcattgacaccccctccaagtttggccatggccgcttccagaccayggaggagaagaaagcattcatgggaccactcaagaaagaccgaattgcaaaggaagaaggagcttaatgctgggaacagatattgcaactggtgggatct

SEQ ID NO: 45717 - DNA, 201 bp, Homo sapiens
tcaacctaaatgtccatcaatggtagactggataaagaaaatgtggcaaatatgctctaccggcaggatttgatggcgtgatgtctcacagaaagttctcyactcccagacatgggtccctcggcttcctgccttggaagcgcagcagcaggcatcgtgggaaggtgaagagcttccctaaggatgacccgtccaagccgg

SEQ ID NO: 45718 - DNA, 201 bp, Homo sapiens
ttcacaatagcaaagacatggaatcaacctaaatgtccatcaatggtagactggataaagaaaatgtggcaaatatgctctaccggcaggatttgatggcrtgatgtctcacagaaagttctccactcccagacatgggtccctcggcttcctgccttggaagcgcagcagcaggcatcgtgggaaggtgaagagcttccc

SEQ ID NO: 45719 - DNA, 201 bp, Homo sapiens
gtgggaaccaagaagtgggtgctcaccctccgcaagtccttgctggtgcagacaaagcagcgggctctggagaagattgaccttaagttcattgacacccmctccaagtttggccatggccgcttccagaccatggaggagaagaaagcattcatgggaccactcaagaaagaccgaattgcaaaggaagaaggagcttaa

SEQ ID NO: 45720 - DNA, 201 bp, Homo sapiens
tttgggtggcttcgtccactatggtgaagtgaccaatgactttgtcatgctgaaaggctgtgtggtgggaaccaagaagtgggtgctcaccctccgcaagwccttgctggtgcagacaaagcagcgggctctggagaagattgaccttaagttcattgacaccccctccaagtttggccatggccgcttccagaccatgga

SEQ ID NO: 45721 - DNA, 201 bp, Homo sapiens
aaccctttgggtggcttcgtccactatggtgaagtgaccaatgactttgtcatgctgaaaggctgtgtggtgggaaccaagaagtgggtgctcaccctccrcaagtccttgctggtgcagacaaagcagcgggctctggagaagattgaccttaagttcattgacaccccctccaagtttggccatggccgcttccagacc

SEQ ID NO: 45722 - DNA, 201 bp, Homo sapiens
gtccaagccggtccacctcacagccttcctgggatacaaggctggcatgacccacatcgtgcgggaagtcgacaggccaggatccaaggtgaacaagaagsaggtggtggaggctgtgaccattgtggagaggccaccagtgggcattgtgggctgcgtggaaacccctcaaggcttccggacttgcaagactgtcttcgc

SEQ ID NO: 45723 - DNA, 201 bp, Homo sapiens
gactgtcttcgctgagcacatcagtgatgaatgcaagagacgtttctataagaactggcataaatctaagaagaaggcctttaccaagtactgcaagaaayggcaggatgaggatggcaagaagcagctggagaaggacttcagcagcatgaagaagtactgccaagtcatctgcgtcattgcccacacccagatgcaact

SEQ ID NO: 45724 - DNA, 201 bp, Homo sapiens
ccaagtgtttgggcaggatgagatgatcgacgtcatcagggtgaccaagggcaaaggctacaaaagggtcaccagtcgttggcacaccaagaagctgcccygcaagacccaccaaggcctgtgcaaggtggcctgtattggggcatggcatcctgctcgtgtgggcttctctgtggtacgtggtgggcagaaaggctacca

SEQ ID NO: 45725 - DNA, 201 bp, Homo sapiens
gaaagttctccactcccagacatgggtccctcggcttcctgccttggaagcgcagcagcaggcatcgtgggaaggtgaagagcttccctaaggatgacccrtccaagccggtccacctcacagccttcctgggatacaaggctggcatgacccacatcgtgcgggaagtcgacaggccaggatccaaggtgaacaagaagg

SEQ ID NO: 45726 - DNA, 201 bp, Homo sapiens
tcgtgcgggaagtcgacaggccaggatccaaggtgaacaagaaggaggtggtggaggctgtgaccattgtggagaggccaccagtgggcattgtgggctgygtggaaacccctcaaggcttccggacttgcaagactgtcttcgctgagcacatcagtgatgaatgcaagagacgtttctataagaactggcataaatcta

SEQ ID NO: 45727 - DNA, 201 bp, Homo sapiens
ggtccacctcacagccttcctgggatacaaggctggcatgacccacatcgtgcgggaagtcgacaggccaggatccaaggtgaacaagaaggaggtggtgraggctgtgaccattgtggagaggccaccagtgggcattgtgggctgcgtggaaacccctcaaggcttccggacttgcaagactgtcttcgctgagcacat

SEQ ID NO: 45728 - DNA, 201 bp, Homo sapiens
cttcatgccagatgccccagaccacgagagcctcaagcttctccagagaggtggggatggaaccatgaattcctctgctctctgggattgcagatgtgttmcacacacacacacacacacacacacacacacacacacacacatattttttttttctagacagagtcttgctctgttacccaggctcaagtgcagtggcgc

SEQ ID NO: 45729 - DNA, 201 bp, Homo sapiens
tctctggctttagggtatattagggacatctccgcaaatatccatatagtttcatatctcagtaagttgtgtccaggttttttttttttttttttttgagrcagagtctcgctctgtcgcccaggctggagtgcagtggtgcaatatcagctcactgcaagctctgcctcctgggttcacaccattctgctgcctcagcct

SEQ ID NO: 45730 - DNA, 201 bp, Homo sapiens
tttttaactttgtattcaggaaaatgtaaaaaatatttagaataatataattaacccccatgtacccaccatgcagtttcaacactttaacttacgccaattttttttttatttctttttctttttttttttagacagagtcttgctctgtcgcccaggctggattgcagtggtgcgatctcggctcactgcaacctctgc

SEQ ID NO: 45731 - DNA, 201 bp, Homo sapiens
cgcctcagcctcccaaggtgctgggattacaggcatgagcgaccgcgcccggccgtccagttttttacatatgtgtgttgggctcttgagttttttgtttstttgtttgttttttagatggaatcttgctgtgtcacccaggctggagtgcagtggtacaatttaggctcactgcaacctccgcctcttgggttcaagtga

SEQ ID NO: 45732 - DNA, 201 bp, Homo sapiens
cccgcaaggagctggagaatctggactcccgtattccttcatgcagtgtcatctacatccctctggtgagggcaggagagtgggtgtagccttcagatgtmttttgggggagatattaggcttatgaaagacatactggtagataagaaaacttgtggggcagcctgaagaacatgaacacttttttgtggggatacaggg

SEQ ID NO: 45733 - DNA, 201 bp, Homo sapiens
atagagtggcagacgacctcaggttttcaccatgttgtcagcctccaactcctcctctagaattttctaacagatttacactcagagcctggtcgcccccygttagcccagattcaaaaggtgaacatctgtttgcagaatctgattcatgagaaggtgagtttattgttttcagtttagacttttgggaagttggactag

SEQ ID NO: 45734 - DNA, 201 bp, Homo sapiens
ccatcagccaatttaagaataagacatgccgggcgcggtggctcatgcctgtaatcccagcactttgggaggccgaggcgggtggatcacaaggtcaggarttcaagaccagcctggccaagatggtgaaaccccgtctctactaaaaatacaaaaattagctgagcacagtggcgggtgcctgtaattccagaacctggg

SEQ ID NO: 45735 - DNA, 201 bp, Homo sapiens
agtctcaaaacaagagactaggaaagatccaaaacacagagcaggagtccacaggggaacctgccctgcctcagtaaaaatacagtgttgttgctgtaggragactcccggattctaccccaggatacttcatgagaacgaaccccttcagagaggccctacaaaacagattagagggaagacagaggggtccaagggaga

SEQ ID NO: 45736 - DNA, 201 bp, Homo sapiens
gccatctggatgctccgcttcattcaaatctggggtgttctaacccaaagtaactggccacagactgcaatgtaagatacaaatcttcaggacctagtgtrtgcacatgttggctcttatataagatggcatccttagtacttgttctatgtagaaaagaatttgtgggctcacaagtccctacagagtctcacactctca

SEQ ID NO: 45737 - DNA, 201 bp, Homo sapiens
tgatctggctataacctccacctcccgggttcaagagattctcctgcctcagcctcccaagtagctggaattacatgtgcatgccaccaagcccagttaatttttgtattttgagtagagacagggtttcaccatgttggtgaggctgatctcgaactcctgacctcaggtgatctacccacctcagcctcccaaagtgct

SEQ ID NO: 45738 - DNA, 201 bp, Homo sapiens
atgtaaacgcactggtgacatcatctctaaacagagtggaaacctttgctagcctcaggtgcacaatccttcccctacctcacctcccgctgcaatgtgtrtcttgtaggagttaatttaggataatctctgaggtcatctccaggtaatcagcatctccaggaatcggcagggtaatttaattacccacacattcttcag

SEQ ID NO: 45739 - DNA, 201 bp, Homo sapiens
agtctgaaaatttggttcttgctctagctttccattaactgcctgtgtgagcttgggcaagtcaaataatctctcttgcttctattgtctcattcttaaamtggggtgaaaaaattgagctacaagaccgttccctttgcttgcctccctcaaataggtctggagataagcaaacaacgcctcctttctggaaactactcc

SEQ ID NO: 45740 - DNA, 201 bp, Homo sapiens
acagatctcccctctgccttatgtcatcctaaacctttgtgctcctcatgccctatgacctgtccccccaagatctctcctgctccctaccctttaataayctgcagcttattgggaagcctctgcttaagtcatgtctagggatgagggcctcccctgaggagtggtgacactttttggacagggttttattgttggaat

SEQ ID NO: 45741 - DNA, 201 bp, Homo sapiens
tctttcctcccccacagcctcccaggagcacagagagcctaaaagacctgaaatcatatttttgccaagtgtggattttggtatctccttccttttgcttwgcctaactccctgttccggtgtcccattctttcccccaactctaccttcatcatcacagatctcccctctgccttatgtcatcctaaacctttgtgctcc

SEQ ID NO: 45742 - DNA, 201 bp, Homo sapiens
aaactatagcactgactcaatatattttacagttgcttcacagaggctccctcttttgtttttatgaattcatttcattatttaacaaatatttgtgaggytgttttttggtttgtttggttgttcttttttgagacagtgtcttgctccgtcactcaggctggaagtgtagtggtgccatcttggctcactgcaacctcc

SEQ ID NO: 45743 - DNA, 201 bp, Homo sapiens
atttttaagagtgagtctcacccctcagtgtacaaagtggccagtggactgaaggaggggctcagcctctttggtaggtgtgccccatccctcatctcacrttacaaagacctaccagaaaagcaattggctccaaagatgtgtcccagcctcccttcccacttcactcccattgtcagatatctctttcatgccaatcca

SEQ ID NO: 45744 - DNA, 201 bp, Homo sapiens
gtgattcaccccaaccccaaccaaagtaatgtgggattgggaggcctgaaaagtaaagtgggggtggggtgtggatgtggctgtgacccagtgggtcaagkgctctaggacacccgggagaatctaagggctaatgagactttgggaagaagactgggacaatattcagagagggggacaaaggaagtggagttgtggaac

SEQ ID NO: 45745 - DNA, 201 bp, Homo sapiens
cactgcacttgccactacattcccatagcacatcgtggatacatattgccacaatccccagggactgcaagcacactttttggcaaactgagatcaagatratagatgtaacttgtagtacccccacccaaaccctcacttccaggctatggttcacacgtccgactcatgacctgggggagctcagttctcgtctggacg

SEQ ID NO: 45746 - DNA, 201 bp, Homo sapiens
attgaggtcaattggataaagaatgggatggtgggaggaggcagcagaacttcagggaagtatctggagggtgagagttaaaggaggactgcagggagaaytggggcccaaggagagctgaggaacaggacagagggtgccaggtcctaagaaacagtacttatctcctcaggtggactttgagggcagccttgctgaaaa

SEQ ID NO: 45747 - DNA, 201 bp, Homo sapiens
ggcattgctggcagtacaccttctcaagccatgaaccttggattgatgctagaaacaaaaaacctgtcattccaaaacagagatctaagcatgtcactcctttttttttttttttttttttgtgactgagtttcgctcttgttgcccaggctggagtacaatggcacgatctctgctcactgcaacctccacttcccgggt

SEQ ID NO: 45748 - DNA, 201 bp, Homo sapiens
ggatgcttccaacaggcccctcctcttcctgctctctgtctcgctcactctgactctatcttttcctctgaatgtcttgaggtctcagattgtatctgcarcctgtttccagatccccctaggggcctctgcctctccttcactttcccctggaactgacctccagctcccttcctcacccactcccagaccaggagacgc

SEQ ID NO: 45749 - DNA, 201 bp, Homo sapiens
aagtccttggggtacgaatccagaatggcaggtaagaatagaggcgggtggaggaatagacatgaggggcccaaaggctacatcttctgggggttcatctmtcttgatccacaagccatgcgaggtgcctctccgcccactgcagacatcctctgatggaactctgtgcccgaacctttgtgcccaactccacagaatgtg

SEQ ID NO: 45750 - DNA, 201 bp, Homo sapiens
ggctacatcttctgggggttcatctatcttgatccacaagccatgcgaggtgcctctccgcccactgcagacatcctctgatggaactctgtgcccgaacytttgtgcccaactccacagaatgtggtggggacaaagggagggtcaaagtcatcactggacccaactcatcagggaagagcatatacctcaaacaggtga

SEQ ID NO: 45751 - DNA, 201 bp, Homo sapiens
gacccttatttccccttctcttccccactccccttactcctcccaccttcttgcttgttcctaggtctcagacttgatccgcagtggaaaacccatcaagyctgtcaaggatttgctaaagaagaaccaaatggaaaagtgcgtatatggccccagtgtctttaccctctctgcatcttctcctgcaactcttctcccctt

SEQ ID NO: 45752 - DNA, 201 bp, Homo sapiens
ttgtatttttagtagagacgggatttcaccatgttggccaggatggtcttgatctcttgacctcaggtgatccacccgcctcagcctcccaaagtgctggsattacaggcgtgaaccactacacccagccatctattaattctttagcaattacaaagtagtagcatttaaatctctgattctttcttcatttattagcca

SEQ ID NO: 45753 - DNA, 201 bp, Homo sapiens
aacccctgaaaatgctcataacaggaaagcatgccctctgctgcatgccctttatactaaaagtggggagcactaaggtcagagataagaagaatcaatamcataaacatttcttgaacccttgtttcatgtgagtcactgttggcaaagaggatgaacaaagcgtgcacctcaccattcaagaacttgcagtgcagtagg

SEQ ID NO: 45754 - DNA, 201 bp, Homo sapiens
gggagcagaacttgtggcagcaacaggtaaacttcaagaaggagggcaggagccccaccctacagggctgggaggagcccagaggccccatctgtttctcytccaggagttgtcaaggcagcagaaaggagtcacccagccaaaggaggagatggctcagcggggctgcaccaaggggccaagaggccctacccgtgtcta

SEQ ID NO: 45755 - DNA, 201 bp, Homo sapiens
aatctgtactttagttaaatacccgagaattcacctcctgtgtccacagctctccacgcccctcagccctgccccgcagccctgtagcagaagtacttagygctttgcattctgcgcgccaccctaccccggcctcctctgtgaatcgttgcttccgaaccgccctcactttttgcatccgcagagcctccaagctcatgg

SEQ ID NO: 45756 - DNA, 201 bp, Homo sapiens
aagacccaggggcccagagcttcttcctttgggtgagtatcagcccaacaagaggtcccaggggaactctctcaatagatctgccctttatatttccattsaacttgagggcccacagtgttcccgcctgcctccccttgccctccaggtcctcagtggccagtctgggttcacactcagtgaccacacagtgaacccaac

SEQ ID NO: 45757 - DNA, 201 bp, Homo sapiens
tcgcgcttctggccgctgtgctccgacactggctggcacgtggacccacatgcccccacatctttgtggccaccaactttctgagccttgttcagctacarctgctgccacaagggcccctggtgcagtatttggtgaggagaccaatctagctcctcggggacccccaggctgggcatttcccagaggtggggattggct

SEQ ID NO: 45758 - DNA, 201 bp, Homo sapiens
ccacctcagagccatggggagccagggctctggcggggtgcccttggtgcaggctccctacacagtcctgctgctgccgctggggacaagccgccaagacycaggggcccagagcttcttcctttgggtgagtatcagcccaacaagaggtcccaggggaactctctcaatagatctgccctttatatttccattcaactt

SEQ ID NO: 45759 - DNA, 201 bp, Homo sapiens
tggagagccatgctctaatggaactttccgtggcccaaattccttcacctgcctctgagtaggtacacaccactcccaagtatgtctctgcccacgtcccrtgcctcttcactgattctaaattagcccacagggctatggtcaggattcggggaggagagacagagtcagtgtgtctgttacctatttctcctgtttcac

SEQ ID NO: 45760 - DNA, 201 bp, Homo sapiens
tgcctcagcctcccatgtagctgggataacaggcacatgccaccatgcccaagttttttttttgtatttttagtagagacagggtttcaccatgttggccrggatggtcttgatctcctgacctcgtgatccacccgcctcggcctcccagagtgctgggattacaggcgtgagccacctcacccggccaatatttcaggg

SEQ ID NO: 45761 - DNA, 201 bp, Homo sapiens
cagagcctccaagctcatggcctccttaggagcgaacccaaggaggacaccgcagggaccgagacctggggcggcctcctccggcttccccagcccggccycagtgccgggccccagggaggccgaggaggaggaagtcgaggaggaggaggagctggccgaggtctctgaggggagtagaaacttgaatggagagttgat

SEQ ID NO: 45762 - DNA, 201 bp, Homo sapiens
ctgagactccggtgggctgccatgccctctttgtttccttatctccctcagacgcagagtttttagtttctctagaaattttgtttcatattaggaataargtttattttgaagaaagatattgtttctttagtctcaaaacaagagactaggaaagatccaaaacacagagcaggagtccacaggggaacctgccctgcc

SEQ ID NO: 45763 - DNA, 201 bp, Homo sapiens
gcctgaagaacatgaacacttttttgtggggatacagggatcttttaagctccctctagggtggggaggtgtccagtaagtctccaagcaggagagtagaktatctcctctttactctccccagattggcttccttctttctattccccgcctgccttccatggtagaggccagtgactttgagattaatggactggactt

SEQ ID NO: 45764 - DNA, 201 bp, Homo sapiens
ggggagatattaggcttatgaaagacatactggtagataagaaaacttgtggggcagcctgaagaacatgaacacttttttgtggggatacagggatcttytaagctccctctagggtggggaggtgtccagtaagtctccaagcaggagagtagagtatctcctctttactctccccagattggcttccttctttctatt

SEQ ID NO: 45765 - DNA, 201 bp, Homo sapiens
cccaaccaaagtaatgtgggattgggaggcctgaaaagtaaagtgggggtggggtgtggatgtggctgtgacccagtgggtcaagtgctctaggacacccrggagaatctaagggctaatgagactttgggaagaagactgggacaatattcagagagggggacaaaggaagtggagttgtggaacgaactcagactgctt

SEQ ID NO: 45766 - DNA, 201 bp, Homo sapiens
gaccacacagtgaacccaactaggggtggagagaaagggccataacccagagccctactgtggcgtgagagtcagcctctgtgattgcctttcccagctaygcaggatgcaggctctggagagagaacaggatgccctgtggcagggtctggagctgctacagcatggccaggcctggtttgaagaccatctgagggaggc

SEQ ID NO: 45767 - DNA, 201 bp, Homo sapiens
ctgaagttcctgggtcgaagaagaatcggggttgaactggaagactataatgtcagcgtccccatcctgggctttaagaaatttatgttgtaggtgattcmccccaaccccaaccaaagtaatgtgggattgggaggcctgaaaagtaaagtgggggtggggtgtggatgtggctgtgacccagtgggtcaagtgctctag

SEQ ID NO: 45768 - DNA, 201 bp, Homo sapiens
cctttcctactggatctaccttatattctagtcatttagggccacttgccattatggaaacatgtcatgcctgtgtttatgctgctccttctggaaagtcttttttttttttttttgagacggagtctccctctgtcacccaggctggagtgcagtggcgcggtctttgctcactgcaacctccacctcccaggttcaagc

SEQ ID NO: 45769 - DNA, 201 bp, Homo sapiens
gggttcaagcaattctcctgactcaacctcccgagtagctgggactacaggcgtgtgccaccacacccagctagttttttgtgtgtgtttttagcacagayggtgtttcaccatgttggccagggtggtctcaaactcctgaccttgtgatccgcccaccttggcctcctaaagtgctgggactacaggtgtgagtcacca

SEQ ID NO: 45770 - DNA, 201 bp, Homo sapiens
agtcaccacgcccagccatgttttacttacattaactcacctcactgtctagcatattttgtgttgctgtaaggaaatacctgactctgagtaatttgttaaaaaaaaaaaaaagttttatttggcttatggttctggatggttggaaagctcaaaattgggcatcttcactggtgagagcctcagactgcttcaactcat

SEQ ID NO: 45771 - DNA, 201 bp, Homo sapiens
cactgactcaatatattttacagttgcttcacagaggctccctcttttgtttttatgaattcatttcattatttaacaaatatttgtgaggttgttttttkgtttgtttggttgttcttttttgagacagtgtcttgctccgtcactcaggctggaagtgtagtggtgccatcttggctcactgcaacctccgtctcccgg

SEQ ID NO: 45772 - DNA, 201 bp, Homo sapiens
  misc_feature (1)...(201): n = A,T,C or G, or insertion/deletion polymorphism (see Tables 1-2)
agtttggcccaggagcaggtaggaggctcgcctgagaaactgcaggagacatctaactggcttctgtcccagcagcaggctgacggctcgttccaggaccnctctccagtgatacataggagcatgcaggtgcgggcatgctggggctggcccgagaagcgcctgtcggaggactctctttgccccttccccctcctgttt

SEQ ID NO: 45773 - DNA, 201 bp, Homo sapiens
tctcaaaggcaagctcatttttgggggagaaagcaagtgctgggctcctgggtgcccacgcagctgccatcacggcctatgccctgacactgaccaaggcscctgcggacctgcggggtgttgcccacaacaacctcatggcaatggcccaggagactggaggtgaggggtgaggcgctctggcagtgagcctgaggccca

SEQ ID NO: 45774 - DNA, 201 bp, Homo sapiens
tcagaggcctcttgtggctttccacaacttattgtctcatatttttatggacagtttatacaggcaccccacaagtccttttcccaacatgcccccctccstttttttttttttaaccgctattgctattatggcttatttgtggtgtttggtctgttttcagaagtgtcttttgcatctgtagactaaaagtaaacagca

SEQ ID NO: 45775 - DNA, 201 bp, Homo sapiens
  misc_feature (1)...(201): n = A,T,C or G, or insertion/deletion polymorphism (see Tables 1-2)
atgagaagcaagtccttatccccaaccctcctttcctgccctccaggctcacagcctttgtgttgaaggtcctgagtttggcccaggagcaggtaggaggntcgcctgagaaactgcaggagacatctaactggcttctgtcccagcagcaggctgacggctcgttccaggacctctctccagtgatacataggagcatgc

SEQ ID NO: 45776 - DNA, 201 bp, Homo sapiens
  misc_feature (1)...(201): n = A,T,C or G, or insertion/deletion polymorphism (see Tables 1-2)
tggaggaggagctgcaggtgaaccactccctggtgaaccactccctcgcctgggtagccaggacacctgggcctcgtggccaggccagaagccgtccccancctcccacccgtggaatccccgcagcacttcttcctggggtcttcgggggaagactgacttcctggctgcgtgacctggagctctgagcttcagttttct

SEQ ID NO: 45777 - DNA, 201 bp, Homo sapiens
gcaggtaggaggctcgcctgagaaactgcaggagacatctaactggcttctgtcccagcagcaggctgacggctcgttccaggacctctctccagtgatasataggagcatgcaggtgcgggcatgctggggctggcccgagaagcgcctgtcggaggactctctttgccccttccccctcctgtttgacatcttttctcc

SEQ ID NO: 45778 - DNA, 201 bp, Homo sapiens
aggtaggaggctcgcctgagaaactgcaggagacatctaactggcttctgtcccagcagcaggctgacggctcgttccaggacctctctccagtgatacayaggagcatgcaggtgcgggcatgctggggctggcccgagaagcgcctgtcggaggactctctttgccccttccccctcctgtttgacatcttttctcccc

SEQ ID NO: 45779 - DNA, 201 bp, Homo sapiens
gtgttcatgaatcgagagcccaagaggaccctgacctcggtctcggtgtttgtggaccatcacctggcaccctccttctactttgtggccttctactaccmtggagaccacccagtggccaactccctgcgagtggatgtccaggctggggcctgcgagggcaaggtgaccggggtcaggagagatggcacttgtgccgag

SEQ ID NO: 45780 - DNA, 201 bp, Homo sapiens
ttgtggctttccacaacttattgtcccatatttttatggccagtttatacaggcaccccacaagtccttttcccaacacagacaggaatacggcagcctgygccctgggagctcactgtcttgtgggagggaaccactcaagccactccccacttgtcctcctgtccctctcttcttgggctctgtcccccacctctctct

SEQ ID NO: 45781 - DNA, 201 bp, Homo sapiens
  misc_feature (1)...(201): n = A,T,C or G, or insertion/deletion polymorphism (see Tables 1-2)
acactgtggctccccgactctctgaccacgtgggagatccatggcctgagcctgtccaaaaccaaaggtgatgtcaccctgtctgggcctcaggtgacccngcttccatttccctgtaccccagctccctgttccctttgctcttagtgtaggaagagggtccagtgatctggggaggtctgtgccagcgtgcagctggcg

SEQ ID NO: 45782 - DNA, 201 bp, Homo sapiens
actgtggctccccgactctctgaccacgtgggagatccatggcctgagcctgtccaaaaccaaaggtgatgtcaccctgtctgggcctcaggtgaccctgmttccatttccctgtaccccagctccctgttccctttgctcttagtgtaggaagagggtccagtgatctggggaggtctgtgccagcgtgcagctggcgtg

SEQ ID NO: 45783 - DNA, 201 bp, Homo sapiens
tgtcaggctccccagcttctggcattcctgtcaaagtttctgccacggtgtcttctcctgggtctgttcctgaagtccaggacattcagcaaaacacagaygggagcggccaagtcagcattccaataattatccctcagaccatctcagagctgcagctctcagtaggactcctcggacccctgggagatggtgggggaa

SEQ ID NO: 45784 - DNA, 201 bp, Homo sapiens
gtattttgtgtcatctcccttctccttggatcttagcaagaccaagcgacaccttgtgcctggggcccccttcctgctgcaggtttcttccagaggggaasgatgagtagggaggatgtggtagttaggagggctcagggtctgaccactctcttttgcctgccctcctttacctgcctaggccttggtccgtgagatgtc

SEQ ID NO: 45785 - DNA, 201 bp, Homo sapiens
tggcgggggtgggtagtcctcagaccaagggcttgcttgagtcctggctcaacctccctaggacacggtgattgccctggatgccctgtctgcctactggwttgcctcccacaccactgaggagaggggtctcaatgtgactctcagctccacaggccggaatgggttcaagtcccacgcgctgcagctgaacaaccgcca

SEQ ID NO: 45786 - DNA, 201 bp, Homo sapiens
gctggcccccagctctctccctttttcctcaggaacccaggggtccaggcccaagaccctcctcccgttttcttccaggaagcctccatctcaaaggcaarctcatttttgggggagaaagcaagtgctgggctcctgggtgcccacgcagctgccatcacggcctatgccctgacactgaccaaggcccctgcggacctg

SEQ ID NO: 45787 - DNA, 201 bp, Homo sapiens
cctctcatgctcacccccacctggccctgcagtgggtcagtatgcttccccgacagccaagcgctgctgccaggatggggtgacacgtctgcccatgatgmgttcctgcgagcagcgggcagcccgcgtgcagcagccggactgccgggagcccttcctgtcctgctgccaatttgctgagagtctgcgcaagaagagcag

SEQ ID NO: 45788 - DNA, 201 bp, Homo sapiens
tcatttttgggggagaaagcaagtgctgggctcctgggtgcccacgcagctgccatcacggcctatgccctgacactgaccaaggcccctgcggacctgckgggtgttgcccacaacaacctcatggcaatggcccaggagactggaggtgaggggtgaggcgctctggcagtgagcctgaggcccaggggaccttaggat

SEQ ID NO: 45789 - DNA, 201 bp, Homo sapiens
gcggtgtccaaggttctgcagattgaggtgaatggagcacccctgaatataagtccccgggcccccagctttgtcctccaccctcagcactctctctgctrgccaggccaggggcccaacacccgaaccaatgccttggtctgttcccatcttctacaattctgatccaactctgtccctggagttgaaactcaaagttct

SEQ ID NO: 45790 - DNA, 201 bp, Homo sapiens
catttttgggggagaaagcaagtgctgggctcctgggtgcccacgcagctgccatcacggcctatgccctgacactgaccaaggcccctgcggacctgcgsggtgttgcccacaacaacctcatggcaatggcccaggagactggaggtgaggggtgaggcgctctggcagtgagcctgaggcccaggggaccttaggatc

SEQ ID NO: 45791 - DNA, 201 bp, Homo sapiens
aaccccttgggtgagtgaccctctacctccagccattggtttcctaagtgggtacaggtggtgggggatgtggacagcaggacaggctgccaacttccccmatttccccagaccaccgaggccggaccttggaaatacctggcaactctgatcccaatatgatccctgatggggactttaacagctacgtcagggttacag

SEQ ID NO: 45792 - DNA, 201 bp, Homo sapiens
gagtgtgggggttgggaggccttggggccaggcaggggctggcgcagggagccgggtggccatcccagccctcctcacaatgcttccctgtgcagtggaascaaacgaggactatgaggactatgagtacgatgagcttccagccaaggatgacccagatgcccctctgcagcccgtgacacccctgcagctgtttgaggg

SEQ ID NO: 45793 - DNA, 201 bp, Homo sapiens
tggtgtttggtctgttttcagaagtgtcttttgcatctgtagactaaaagtaaacagcataaacagatacacattaaagtaaaatttgtaatagttgatcmtttaatggtcttaatctgtttaagaggatttatgtttgaaagtccgtcagtagctccaatgagaatgtcagtctcaggcaggagggttaaatgagcctga

SEQ ID NO: 45794 - DNA, 201 bp, Homo sapiens
gtgtttgtggaccatcacctggcaccctccttctactttgtggccttctactaccatggagaccacccagtggccaactccctgcgagtggatgtccaggmtggggcctgcgagggcaaggtgaccggggtcaggagagatggcacttgtgccgagggggttgaggacagggtgattgccaacagggcatggatttagctt

SEQ ID NO: 45795 - DNA, 201 bp, Homo sapiens
caggggctggcgcagggagccgggtggccatcccagccctcctcacaatgcttccctgtgcagtggaagcaaacgaggactatgaggactatgagtacgaygagcttccagccaaggatgacccagatgcccctctgcagcccgtgacacccctgcagctgtttgagggtcggaggaaccgccgcaggagggaggcgccca

SEQ ID NO: 45796 - DNA, 201 bp, Homo sapiens
ttctccctgccttcctgtttactcgtggtctcccttcactttcagataacctgtactggggctcagtcactggttctcagagcaatgccgtgtcgcccacsccggctcctcgcaacccatccgaccccatgccccaggccccagccctgtggattgaaaccacagcctacgccctgctgcacctcctgcttcacgagggca

SEQ ID NO: 45797 - DNA, 201 bp, Homo sapiens
gatgctgggtgcttggattggggcagggctggcatcgggacccgattcaggagtgagggagagcaggggtggaggtgtcagagcgaagtctgactgctgawcctgtctgttctccccaggttgctcttgttctctccttctgtggttcatctgggggtccccctatcggtgggggtgcagctccaggatgtgccccgagga

SEQ ID NO: 45798 - DNA, 201 bp, Homo sapiens
acctctctgtctcgcctgacgcctgtggcgaatgtggtgccactcgtgtgtgtggactgtgcagtgacggggaggaaaaggggctgaaggcctcaaatccrgtagcccagggagatgcccttaggtatggcaccagagaggtctgtggcctcacatgtcccacgtcctctccctgccccttgctgagccaggtccttcgta

SEQ ID NO: 45799 - DNA, 201 bp, Homo sapiens
  misc_feature (1)...(201): n = A,T,C or G, or insertion/deletion polymorphism (see Tables 1-2)
tgaagtccaggacattcagcaaaacacagacgggagcggccaagtcagcattccaataattatccctcagaccatctcagagctgcagctctcagtaggantcctcggacccctgggagatggtgggggaaggggaggagggtgagctggggtcccaaggatccatggcctgacttggggggaaggtggggtacttggctc

SEQ ID NO: 45800 - DNA, 201 bp, Homo sapiens
  misc_feature (1)...(201): n = A,T,C or G, or insertion/deletion polymorphism (see Tables 1-2)
cgtgggcacgaggaggggtcaggcctgggacctgagtcggggggtcaggcaggatgacagaacctgcagttaggttgtggcaaataaaggaggacccagtngtatccatgacaaagatgaggccgcgaggagggcgagtgggtttgggggcaggcagagtgccttggagaacttacaggtcctgccacaatcctaatgcaa

SEQ ID NO: 45801 - DNA, 201 bp, Homo sapiens
gccgggagctgccctgggccaggggagggagggcaggacccaggctggggctgggcttctggagcccgcgcaggcagaacctggacgacagctcacacgtytccacaggcggaacggcaaggtggggctgtctggcatggccatcgcggacgtcaccctcctgagtggattccacgccctgcgtgctgacctggagaaggt

SEQ ID NO: 45802 - DNA, 201 bp, Homo sapiens
cgtaatctatagcaatagagttttaaatgaatctcctttgtgctcaaacagcatgtctttaaattatcggagagtagctggtggaagtgggcttagctagragactgcatgtctgtccaatgcttcaaaggagggtctttctccttgaacacagtgtttacagataagacagggggtctcactctgagcatgggaacatga

SEQ ID NO: 45803 - DNA, 201 bp, Homo sapiens; identical to SEQ ID NO: 23576

SEQ ID NO: 45804 - DNA, 201 bp, Homo sapiens
aatatgatccctgatggggactttaacagctacgtcagggttacaggtgggagtgccctttagtcccttcccagtggccaccttcggattcatgtgggacytgtggatccctgcttggtcccactccccgtgagcctctgacacagagtcctcagacctccaccctctccctcccatgtagcctcagatccattggacact

SEQ ID NO: 45805 - DNA, 201 bp, Homo sapiens
cagtgtttacagataagacagggggtctcactctgagcatgggaacatgatggcaattaggaggcttttcttctcagaggcctcttgtggctttccacaayttattgtctcatatttttatggacagtttatacaggcaccccacaagtccttttcccaacatgcccccctccctttttttttttttaaccgctattgcta

SEQ ID NO: 45806 - DNA, 201 bp, Homo sapiens
gtgtagcctgctcctcttacaggtcatgcacgcagcctgtttgctctgacaccaacttcctaccctctcagcctcaaagtaactcacctttcccccttctyctcaccccctcttaggcttccaggttaaggttctccgagaagacagcagagctgctttccgcctctttgagaccaagatcacccaagtcctgcacttcag

SEQ ID NO: 45807 - DNA, 201 bp, Homo sapiens
ggtctcactctgagcatgggaacatgatggcaattaggaggcttttcttctcagaggcctcttgtggctttccacaacttattgtctcatatttttatggmcagtttatacaggcaccccacaagtccttttcccaacatgcccccctccctttttttttttttaaccgctattgctattatggcttatttgtggtgtttg

SEQ ID NO: 45808 - DNA, 201 bp, Homo sapiens
tgggaaagaatatttgatcatgggtctggatggggccacctatgacctcgagggacagtgagtcatctggtcccctcagtctcttgtcctccccatgcctygccacctaggccttgcccctcagaagccagatgcctgtgctctccgtttccacctgccatcctcccgagccctgctgactgcccctttgccccctgcagc

SEQ ID NO: 45809 - DNA, 201 bp, Homo sapiens; identical to SEQ ID NO: 23579

SEQ ID NO: 45810 - DNA, 201 bp, Homo sapiens
gcccccagtacctgctggactcgaatagctggatcgaggagatgccctctgaacgcctgtgccggagcacccgccagcgggcagcctgtgcccagctcaaygacttcctccaggagtatggcactcaggggtgccaggtgtgagggctgccctcccacctccgctgggaggaacctgaacctgggaaccatgaagctggaa

SEQ ID NO: 45811 - DNA, 201 bp, Homo sapiens
tgaatggacagagccacatttccctctcaaaggcagagttccaggacgccctggagaagctgaatatgggcattactgacctccaggggctgcgcctctaygttgctgcagccatcattgagtctccaggtgggtgactttcccttattgtaaccccagacccttgcctctgacctctgagctaaccctctgtcctccggc

SEQ ID NO: 45812 - DNA, 201 bp, Homo sapiens
ggagcaggtaggaggctcgcctgagaaactgcaggagacatctaactggcttctgtcccagcagcaggctgacggctcgttccaggacctctctccagtgwtacataggagcatgcaggtgcgggcatgctggggctggcccgagaagcgcctgtcggaggactctctttgccccttccccctcctgtttgacatcttttc

SEQ ID NO: 45813 - DNA, 201 bp, Homo sapiens
agagacaggttaagagttcataaagagtgggggccagggggccaattgcaaaatggaggctgcaaaaggctcagagctctggtctccacactattttttgkgtacagtcactcagatctaagaagcagatgttcagggagaaacagtgaaagggaggcagtgggtcataggcgtaatctatagcaatagagttttaaatga

SEQ ID NO: 45814 - DNA, 201 bp, Homo sapiens
gtggactgtgcagtgacggggaggaaaaggggctgaaggcctcaaatcccgtagcccagggagatgcccttaggtatggcaccagagaggtctgtggcctyacatgtcccacgtcctctccctgccccttgctgagccaggtccttcgtacctacaatgtcctggacatgaagaacacgacctgccaggacctacagatag

SEQ ID NO: 45815 - DNA, 201 bp, Homo sapiens
ttggcccaggagcaggtaggaggctcgcctgagaaactgcaggagacatctaactggcttctgtcccagcagcaggctgacggctcgttccaggacctctstccagtgatacataggagcatgcaggtgcgggcatgctggggctggcccgagaagcgcctgtcggaggactctctttgccccttccccctcctgtttgac

SEQ ID NO: 45816 - DNA, 201 bp, Homo sapiens
ggagatccatggcctgagcctgtccaaaaccaaaggtgatgtcaccctgtctgggcctcaggtgaccctgcttccatttccctgtaccccagctccctgtyccctttgctcttagtgtaggaagagggtccagtgatctggggaggtctgtgccagcgtgcagctggcgtgggccagagggcagaggcggactgagacaga

SEQ ID NO: 45817 - DNA, 201 bp, Homo sapiens
  misc_feature (1)...(201): n = A,T,C or G, or insertion/deletion polymorphism (see Tables 1-2)
gtgagtgtcacctgagcggccacctctcctctccaaggctacatgcggatccagcagtttcggaaggcggatggttcctatgcggcttggttgtcacgggncagcagcacctggtgagcttgggagagtggttccagggttctgagggggtcagggctggggcaggggtgggacagagctggtatgatgggagggtggata

SEQ ID NO: 45818 - DNA, 201 bp, Homo sapiens
ggtgcttggattggggcagggctggcatcgggacccgattcaggagtgagggagagcaggggtggaggtgtcagagcgaagtctgactgctgatcctgtcygttctccccaggttgctcttgttctctccttctgtggttcatctgggggtccccctatcggtgggggtgcagctccaggatgtgccccgaggacaggtag

SEQ ID NO: 45819 - DNA, 201 bp, Homo sapiens
gtgcttggattggggcagggctggcatcgggacccgattcaggagtgagggagagcaggggtggaggtgtcagagcgaagtctgactgctgatcctgtctkttctccccaggttgctcttgttctctccttctgtggttcatctgggggtccccctatcggtgggggtgcagctccaggatgtgccccgaggacaggtagt

SEQ ID NO: 45820 - DNA, 201 bp, Homo sapiens
  misc_feature (1)...(201): n = A,T,C or G, or insertion/deletion polymorphism (see Tables 1-2)
cctcgtgttggggacactctgaacctgaacttgcgagccgtgggcagtggggccaccttttctcattactactacatggtgtgcatgagctggggagtcanggagggctggggtgcagggaagagccctctgggtggggctgggggggttcaaggctgaggctgtcccatgaagaggcaaccactcttgtccctcccattc

SEQ ID NO: 45821 - DNA, 201 bp, Homo sapiens; identical to SEQ ID NO: 23539

SEQ ID NO: 45822 - DNA, 201 bp, Homo sapiens
  misc_feature (1)...(201): n = A,T,C or G, or insertion/deletion polymorphism (see Tables 1-2)
tttatttattggaactataatttttattgggctcagtgccacaaagtttaataattcatatatgagcctgtccaattagaattgccatctgatttaagtanactgtaagtgcttttatggtattatgtggcaaaaaggaccatttaactaaatcatcattttgaacaataacccccattattgtgtggttagtgtgaagta

SEQ ID NO: 45823 - DNA, 201 bp, Homo sapiens
cctctccaggtatctgcaggctccccacatccagcgatagccaggctcactgtggcagccccaccttcaggaggccccgggtttctgtctattgagcggcyggattctcgacctcctcgtgttggggacactctgaacctgaacttgcgagccgtgggcagtggggccaccttttctcattactactacatggtgtgcatg

SEQ ID NO: 45824 - DNA, 201 bp, Homo sapiens
aggatggctacaggatgaagtttgcctgctactacccccgtgtggagtacggtcagtcttcccaccgaggccctggcctgaccctccctcggggaccggcygttttggtctctctgggtgtagcctgctcctcttacaggtcatgcacgcagcctgtttgctctgacaccaacttcctaccctctcagcctcaaagtaact

SEQ ID NO: 45825 - DNA, 201 bp, Homo sapiens
aaggcaagctcatttttgggggagaaagcaagtgctgggctcctgggtgcccacgcagctgccatcacggcctatgccctgacactgaccaaggcccctgyggacctgcggggtgttgcccacaacaacctcatggcaatggcccaggagactggaggtgaggggtgaggcgctctggcagtgagcctgaggcccagggga

SEQ ID NO: 45826 - DNA, 201 bp, Homo sapiens
actatttattgagtacaataacttagatctaagaagcagatgttcagggcaaaacagtgaaagggtagcagtgcgtcacaggcataatctacagcagaagygctttaaatgaatctcctttgtgctcaaacagcatatctttaacttatcggagagtagctagtgggagtgggcttaactaggagcctgcacgtctgtcca

SEQ ID NO: 45827 - DNA, 201 bp, Homo sapiens
attttttgaaatctgcctctgctaaaggaattgtaaaaaagcagtcttttaaatctataataacaagcggtcagtctttagggagcacagtgggggatggragcccaggttgtaaggctcccatcggttgaattacagcgttgacgccatctaccggactttttcttaattacaaatactggggaattccaaggagagaaa

SEQ ID NO: 45828 - DNA, 201 bp, Homo sapiens
tgcttggattggggcagggctggcatcgggacccgattcaggagtgagggagagcaggggtggaggtgtcagagcgaagtctgactgctgatcctgtctgytctccccaggttgctcttgttctctccttctgtggttcatctgggggtccccctatcggtgggggtgcagctccaggatgtgccccgaggacaggtagtg

SEQ ID NO: 45829 - DNA, 201 bp, Homo sapiens
  misc_feature (1)...(201): n = A,T,C or G, or insertion/deletion polymorphism (see Tables 1-2)
ggcccaacacccgaaccaatgccttggtctgttcccatcttctacaattctgatccaactctgtccctggagttgaaactcaaagttctgggggagtctgngctagcagggcaggctgtagtcctgtgtgacctcacaaccatgttttccctgagacagaaggaaggggccatccatagagaggagctggtctatgaactc

SEQ ID NO: 45830 - DNA, 201 bp, Homo sapiens
aggcaccccacaagtccttttcccaacacagacaggaatacggcagcctgtgccctgggagctcactgtcttgtgggagggaaccactcaagccactcccyacttgtcctcctgtccctctcttcttgggctctgtcccccacctctctctgtcctttgtcttgcaggtggggagatggaggaggcagagctcacatcctg

SEQ ID NO: 45831 - DNA, 201 bp, Homo sapiens
  misc_feature (1)...(201): n = A,T,C or G, or insertion/deletion polymorphism (see Tables 1-2)
tagaaggctgaagtgagataattcatgtgctggtataaactttgtggaaatgtgaggtggggagaggaggtggggctgttttgaggaaggagataagttantggagccgcaaaaacaggtttgcttgtgcccttctaacatcgccttcccttttctgttgctgaagttttccttgggcagcaagatcaatgtgaaggtggg

SEQ ID NO: 45832 - DNA, 201 bp, Homo sapiens
  misc_feature (1)...(201): n = A,T,C or G, or insertion/deletion polymorphism (see Tables 1-2)
gaggtgaatggagcacccctgaatataagtccccgggcccccagctttgtcctccaccctcagcactctctctgctggccaggccaggggcccaacacccnaaccaatgccttggtctgttcccatcttctacaattctgatccaactctgtccctggagttgaaactcaaagttctgggggagtctgtgctagcagggca

SEQ ID NO: 45833 - DNA, 201 bp, Homo sapiens
tacgttgctgcagccatcattgagtctccaggtgggtgactttcccttattgtaaccccagacccttgcctctgacctctgagctaaccctctgtcctccrgcaccaacaccaccccacttctcacatctcatctcagactcaaaaccaggaaacacccaggagacctggtttctctccaactctgtctctgtgactcggc

SEQ ID NO: 45834 - DNA, 201 bp, Homo sapiens
gacaagacagagcagtggagcacactgcctcccgagaccaaggaccacgccgtggatctgatccagaaaggttctgggtgcaagggcaagcaggagggggkccaggaaaggacagttactggaagatggacagcccaggaggctacagagggaaagaaagggggcccctgatgaggatggggagcatggccttgggctcaa

SEQ ID NO: 45835 - DNA, 201 bp, Homo sapiens
tggctcgagggtccttcgaattccctgtgggagatgcggtgtccaaggttctgcagattgaggtgaatggagcacccctgaatataagtccccgggccccragctttgtcctccaccctcagcactctctctgctggccaggccaggggcccaacacccgaaccaatgccttggtctgttcccatcttctacaattctgat

SEQ ID NO: 45836 - DNA, 201 bp, Homo sapiens
ggggctgtgcctggctgggggcggagggctggcccagcaggtgctggtgcctgcgggctctgcccggcctgttgccttctctgtggtgcccacggcagccrccgctgtgtctctgaaggtggtggctcgagggtccttcgaattccctgtgggagatgcggtgtccaaggttctgcagattgaggtgaatggagcacccct

SEQ ID NO: 45837 - DNA, 201 bp, Homo sapiens
  misc_feature (1)...(201): n = A,T,C or G, or insertion/deletion polymorphism (see Tables 1-2)
acccctccctcctgtggccctgaagctttgatggcccctctgatctctgcccctgtgcccacgcttcctttccctcaggcctatgtgtggccaccccagtncagctccgggtgttccgcgagttccacctgcacctccgcctgcccatgtctgtccgccgctttgagcagctggagctgcggcctgtcctctataactacc

SEQ ID NO: 45838 - DNA, 201 bp, Homo sapiens
ccactcccagttcggtaccgggtctttgctctggatcagaagatgcgcccgagcactgacaccatcacagtcatggtggaggtgagtccccgacctctggkcttcctgatcctggccactgatgtgacctcctgcctgtgagcacttctccccttgcagaactctcacggcctccgcgtgcggaagaaggaggtgtacatg

SEQ ID NO: 45839 - DNA, 201 bp, Homo sapiens
tttggggccagagatccgaattccgggattacgagtggaaggtgggcagctctctccagcagcctctcttatgttgctggtctcaaggggtcggggcgggkgctgaggtgtatgtcctttttgtcctctcatgctcacccccacctggccctgcagtgggtcagtatgcttccccgacagccaagcgctgctgccaggatg

SEQ ID NO: 45840 - DNA, 201 bp, Homo sapiens
gcacctccgcctgcccatgtctgtccgccgctttgagcagctggagctgcggcctgtcctctataactacctggataaaaacctgactgtgaggccccatrggagcctgagcatacaggagttgggggagccagggcccagtgaggggtggggaggctaaccgggccaggactctggccatcctcgttttcctgccctcag

SEQ ID NO: 45841 - DNA, 201 bp, Homo sapiens
  misc_feature (1)...(201): n = A,T,C or G, or insertion/deletion polymorphism (see Tables 1-2)
ctctcaaaggcagagttccaggacgccctggagaagctgaatatgggcattactgacctccaggggctgcgcctctacgttgctgcagccatcattgagtntccaggtgggtgactttcccttattgtaaccccagacccttgcctctgacctctgagctaaccctctgtcctccggcaccaacaccaccccacttctcac

SEQ ID NO: 45842 - DNA, 201 bp, Homo sapiens
ccaaaaggcgattaatgagaaatgtgagttgcgggtgcctaggcagtagcttgggctctccacctgggatccgggttgggggtctgcctctctgcccctcrgctccttgctgaacccacgtgtggtatttggggccagagatccgaattccgggattacgagtggaaggtgggcagctctctccagcagcctctcttatgt

SEQ ID NO: 45843 - DNA, 201 bp, Homo sapiens
aggacattcagcaaaacacagacgggagcggccaagtcagcattccaataattatccctcagaccatctcagagctgcagctctcagtaggactcctcggkcccctgggagatggtgggggaaggggaggagggtgagctggggtcccaaggatccatggcctgacttggggggaaggtggggtacttggctctgagctac

SEQ ID NO: 45844 - DNA, 201 bp, Homo sapiens
gagaaacgtgaacttccaaaaggcgattaatgagaaatgtgagttgcgggtgcctaggcagtagcttgggctctccacctgggatccgggttgggggtctkcctctctgcccctcggctccttgctgaacccacgtgtggtatttggggccagagatccgaattccgggattacgagtggaaggtgggcagctctctccag

SEQ ID NO: 45845 - DNA, 201 bp, Homo sapiens
cgtgcagctggcgtgggccagagggcagaggcggactgagacagagctgggtcacccccacccctccctcctgtggccctgaagctttgatggcccctctratctctgcccctgtgcccacgcttcctttccctcaggcctatgtgtggccaccccagtccagctccgggtgttccgcgagttccacctgcacctccgcct

SEQ ID NO: 45846 - DNA, 201 bp, Homo sapiens
tagttctgcctacaaaagtttgacaaactgtgggactatttaacataccctggggcaaaactttccaatgatatttggctgcaggttttttgttattaacrgcaggaatggtaaaggcaaattttttgaaatctgcctctgctaaaggaattgtaaaaaagcagtcttttaaatctataataacaagcggtcagtctttag

SEQ ID NO: 45847 - DNA, 201 bp, Homo sapiens
cagcatttgtaattgtcttttgcaaagattaataatattgaataagttggtctctactttttgctgcacaaatctggaaactgatctctaacaggctggakagttctgcctacaaaagtttgacaaactgtgggactatttaacataccctggggcaaaactttccaatgatatttggctgcaggttttttgttattaacg

SEQ ID NO: 45848 - DNA, 201 bp, Homo sapiens
ttgttaaattaatctgtcatgtaactgagttaataaatgcctgtttaacctgatttttatttattggaactataatttttattgggctcagtgccacaaartttaataattcatatatgagcctgtccaattagaattgccatctgatttaagtatactgtaagtgcttttatggtattatgtggcaaaaaggaccattta

SEQ ID NO: 45849 - DNA, 201 bp, Homo sapiens
gggggagccagggcccagtgaggggtggggaggctaaccgggccaggactctggccatcctcgttttcctgccctcaggtgagcgtccacgtgtccccagyggaggggctgtgcctggctgggggcggagggctggcccagcaggtgctggtgcctgcgggctctgcccggcctgttgccttctctgtggtgcccacggca

SEQ ID NO: 45850 - DNA, 201 bp, Homo sapiens
agcagagatggcagaccaggctgcggcctggctcacccgtcagggcagcttccaagggggattccgcagtacccaagtaggggccgtccccgggctctggsgggggtgggtagtcctcagaccaagggcttgcttgagtcctggctcaacctccctaggacacggtgattgccctggatgccctgtctgcctactggattg

SEQ ID NO: 45851 - DNA, 201 bp, Homo sapiens
tgaggcttcctcgaggctgtggggagcaaaccatgatctacttggctccgacactggctgcttcccgctacctggacaagacagagcagtggagcacactkcctcccgagaccaaggaccacgccgtggatctgatccagaaaggttctgggtgcaagggcaagcaggaggggggccaggaaaggacagttactggaagat

SEQ ID NO: 45852 - DNA, 201 bp, Homo sapiens
tgggcgcctccctcctgcggcggttcctccgaccctcaaacagctgcaggggtgtcacgggctgcagaggggcatctgggtcatccttggctggaagctcrtcgtactcatagtcctcatagtcctcgtttgcttccactgcacagggaagcattgtgaggagggctgggatggccacccggctccctgcgccagcccctg

SEQ ID NO: 45853 - DNA, 201 bp, Homo sapiens
accttctccaggtcagcacgcagggcgtggaatccactcaggagggtgacgtccgcgatggccatgccagacagccccaccttgccgttccgcctgtggaracgtgtgagctgtcgtccaggttctgcctgcgcgggctccagaagcccagccccagcctgggtcctgccctccctcccctggcccagggcagctcccggc

SEQ ID NO: 45854 - DNA, 201 bp, Homo sapiens
ccggggttgtagtagtcgtacagggttgcgctggccggctgcaccagccccaccggcacttcctgcacagcctcaaagcccacgcactcccgggaggtggrgacctggccaagcgtggggaggagagatgagggacccactccctgggccctgcagccccctgtactgggtttccttggcctgtttttgtttgcttcctat

SEQ ID NO: 45855 - DNA, 201 bp, Homo sapiens
ctgaagtgcaggacttgggtgatcttggtctcaaagaggcggaaagcagctctgctgtcttctcggagaaccttaacctggaagcctaagagggggtgagragaagggggaaaggtgagttactttgaggctgagagggtaggaagttggtgtcagagcaaacaggctgcgtgcatgacctgtaagaggagcaggctacac

SEQ ID NO: 45856 - DNA, 201 bp, Homo sapiens
gctgcagggggcaaaggggcagtcagcagggctcgggaggatggcaggtggaaacggagagcacaggcatctggcttctgaggggcaaggcctaggtggcraggcatggggaggacaagagactgaggggaccagatgactcactgtccctcgaggtcataggtggccccatccagacccatgatcaaatattctttccca

SEQ ID NO: 45857 - DNA, 201 bp, Homo sapiens
tattctttcccaggttccaagcgaaggcggcaggaggctcgaaccaggaagttgcgcatctgattagcagcggccttgacatccttggctgcggggatgaygtgcgcaaaagtggtcagaggggaagagaaggtgcagggtgagcccaggctggggactctgtgtagatcctctcattccaccttcgccacccccatggag

SEQ ID NO: 45858 - DNA, 201 bp, Homo sapiens
ttccagcttcatggttcccaggttcaggttcctcccagcggaggtgggagggcagccctcacacctggcacccctgagtgccatactcctggaggaagtcrttgagctgggcacaggctgcccgctggcgggtgctccggcacaggcgttcagagggcatctcctcgatccagctattcgagtccagcaggtactgggggc

SEQ ID NO: 45859 - DNA, 201 bp, Homo sapiens
agttactttgaggctgagagggtaggaagttggtgtcagagcaaacaggctgcgtgcatgacctgtaagaggagcaggctacacccagagagaccaaaacrgccggtccccgagggagggtcaggccagggcctcggtgggaagactgaccgtactccacacgggggtagtagcaggcaaacttcatcctgtagccatcct

SEQ ID NO: 45860 - DNA, 201 bp, Homo sapiens
ccctcaaacagctgcaggggtgtcacgggctgcagaggggcatctgggtcatccttggctggaagctcatcgtactcatagtcctcatagtcctcgtttgsttccactgcacagggaagcattgtgaggagggctgggatggccacccggctccctgcgccagcccctgcctggccccaaggcctcccaacccccacactc

SEQ ID NO: 45861 - DNA, 201 bp, Homo sapiens
  misc_feature (1)...(201): n = A,T,C or G, or insertion/deletion polymorphism (see Tables 1-2)
ttgcattaggattgtggcaggacctgtaagttctccaaggcactctgcctgcccccaaacccactcgccctcctcgcggcctcatctttgtcatggatacnactgggtcctcctttatttgccacaacctaactgcaggttctgtcatcctgcctgaccccccgactcaggtcccaggcctgacccctcctcgtgcccacg

SEQ ID NO: 45862 - DNA, 201 bp, Homo sapiens
gcttctgaggggcaaggcctaggtggcgaggcatggggaggacaagagactgaggggaccagatgactcactgtccctcgaggtcataggtggccccatcyagacccatgatcaaatattctttcccaggttccaagcgaaggcggcaggaggctcgaaccaggaagttgcgcatctgattagcagcggccttgacatcct

SEQ ID NO: 45863 - DNA, 201 bp, Homo sapiens
aaagtgctgggattacaggcttgagccatcgtgcccggccagcttttttcttttttttttaagttacagagtcttgctctgtcacccagactggagtgcartggtgcaatccagtgagttaaagctcactgtaaccttgaactcctgggctcaaacagttctcccacctcagcctcctgagtagctagcagtactagctcc

SEQ ID NO: 45864 - DNA, 201 bp, Homo sapiens
ggtgatccacctgcctcggcctcccaaagtgctgggattacaggtgtgagccactgtgctgggaccttttttgctttcttatcttcttagtctttcttcaktaacctgataccagaccccatcttctttgccattttttaatcttggaaatcacaggagagtctggtaaataaactggtatcatcttgtgtttggaaaggg

SEQ ID NO: 45865 - DNA, 201 bp, Homo sapiens
ggtaaataaactggtatcatcttgtgtttggaaaggggtcactgatgtctctagacacatactcccttggatgccagacagataatataatgtccatgtgktttttttttgtttttcatccgtgttatttttcctggatctataacctgagcttcattaagtttatttatttaattttttgagatggagtccctctctgtc

SEQ ID NO: 45866 - DNA, 201 bp, Homo sapiens
cctcaggtgatgtgccctcctcggcctcccaaagtgctggtattacaggcatgagccaccgcacctggcctcagattttctttttattgatccctttgttygtattccagtagaacgttttctgatgttttgtgagtgaggctgattttgttctgtcctccacatggatagaacttaatgcagagggaaatacagaggaag

SEQ ID NO: 45867 - DNA, 201 bp, Homo sapiens
tccctaagccgtcgatctcctgccctttgtgtttctctccctgtgccccggaatcagaagggggatggggacaggtgtgaatgtgtgtgtgtgcaggagawactttttaggtattggggcagggattaatgctagggagtctttcgggtacactctggtctgggcaacagcgggccttccttccttcgttcttctttagag

SEQ ID NO: 45868 - DNA, 201 bp, Homo sapiens
cttgaacctgggaggcggaggttacagtgagctgagatcatgccactgcactccagcctgggcaacagagcgagactctgtctcaaaaaaaaaaaaaaaaattacagatgcttattatgcatctaatttgtgtcagtcttatgctagttgctagcgagtcggagataaaattgcagagccatgccttcagggagtctagtt

SEQ ID NO: 45869 - DNA, 201 bp, Homo sapiens
tgtgtgtgtgtgtgtgtgtgtgtttggctgtgggttagttgtgccgttctgctggaacaccgtgggaaggcagtagacgcgggcagtcagctagcaggtcygtcgccccgtgagtgccgtttcgggtctatagtgagttaggagggttcgatgggcgtggcgcgcgtgcgcgaaaccactttctccgcagagtgtggggcg

SEQ ID NO: 45870 - DNA, 201 bp, Homo sapiens
ggcaggcctcatccgtggctccgtcttctaccaatgtcgagtcctcagctgagggggctcccccgccaggtccagctcccccgccagccaccagccacccragggtcatccggatttcccaccagagtgtggaacccgtggtcatgatgcacatgaacattcaaggtgagaatagttgctggcgagaagagcaggatcagc

SEQ ID NO: 45871 - DNA, 201 bp, Homo sapiens
atcccccccaggtaagggacctgttgggcgatggggtcagggtacttgagagaactggagagatctgagaggaagtatggtgttctttaatttcacagccrcttcctgaggagccaatggaagttcagggagcagaaagagcttcccctgagcctcaggtactctagagagggggaggttgaggggccagataatgtggag

SEQ ID NO: 45872 - DNA, 201 bp, Homo sapiens
cagatggcaacccacacattgatcacggggctagaagagtatgtgcgggagagttttgtgagtaacccttctctattcctttcctctcctgggtctggtcraggcagctgcctcctccactcccagtcttatgattcttgattttgggatctttgtgttatcttgtctctcagtccttggtgcaggttcagccaggtgtgg

SEQ ID NO: 45873 - DNA, 201 bp, Homo sapiens
gccctgggaattcattgactctgaacctttcattttaaagatgaagaaaatgaggtttagaaaaagaaagtatagtaattagtgtcactgctttctgacarcctgttcagaggaagaggtaggtaagttgtgctgcctgactctgttaaatacctaccatacttctgctttaagcagtgaagatcagaatgtaactcccca

SEQ ID NO: 45874 - DNA, 201 bp, Homo sapiens
gagcctggagctgatggggcccttggtgagcaaaaaggatgctttggcttgctccaggaaggggcagccagaggaatgtagatggccttggtttaggggtrttgccaaggtgggatgaggttgatgatctggttgtgggtgggcaggccaggtggtaaaggccattgctaacatctgcccttgtcccccaggattctttgg

SEQ ID NO: 45875 - DNA, 201 bp, Homo sapiens
ggatcccttcagcgatgaactggtcagcctggtgctaccatttgttttcccctttggcatctgggaaggcttgacagtgccaccccgggctatttgacagygtgcttggggggggaaatgttagcttctgagggatggccttgtgtgcttgctgggatcatagggacttggccagcgtttctccaacctgcttactttttc

SEQ ID NO: 45876 - DNA, 201 bp, Homo sapiens
tgcccagcctccacccacccctcaaccctccatggctgatcttcagttctctcagcttctggggaacctgctagggcctgcagggccaggggctggagggyctggtgtggcttctcccaccatcactgtggcgatgcctggtgtccctgcctttctccaaggcatgactgacttcttgcaggtgagtggctggcttgccat

SEQ ID NO: 45877 - DNA, 201 bp, Homo sapiens
tgggaaggcttgacagtgccaccccgggctatttgacagtgtgcttggggggggaaatgttagcttctgagggatggccttgtgtgcttgctgggatcatrgggacttggccagcgtttctccaacctgcttactttttctctttagctccggtctgatatacaaaaacgactgcaggaagaccccaactacagtccccag

SEQ ID NO: 45878 - DNA, 201 bp, Homo sapiens
gaaggtgaaaccgcagccccctctgagtgatgcctacctcagtggtatgcctgccaagagacgcaaggttggttttcctcttccctaagcctctctctctrtccaggtttccccgtcatgcctggaatcaaactatgtagagatggtgggagctcttgttattcagtctcccctcccctcgtttaatgaggaaactttttc

SEQ ID NO: 45879 - DNA, 201 bp, Homo sapiens
gttctggaagacacctttagcttttcctcgtttaggccccttagcctgagagatgagcttgattttctggtcaccagattttctttttttttcttttttttgagatggagtcacgccctgtcttccaggctggagtgcagtggcgcgatctcgactcactgaaacttccacctcttgggttcaagcgattttcctatctca

SEQ ID NO: 45880 - DNA, 201 bp, Homo sapiens
tcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagtc

SEQ ID NO: 45881 - DNA, 201 bp, Homo sapiens
atcggggaaacggaagtggccgtcggtggcaggtttgggggagaccggaagtgacggtccgtggggaagtcgggggcggagccgcggggtggtgggtgtgtgtgtgtgtgtgtgtgtgtgtgtgtgtgtgtgtgtgtttggctgtgggttagttgtgccgttctgctggaacaccgtgggaaggcagtagacgcgggcagt

SEQ ID NO: 45882 - DNA, 201 bp, Homo sapiens
cttaagtgtccacgcatccgtagtgcgacgcacgcaggcgtagtacggtcccccgggcgacagcggtggcggctcctcggggtgctcggctccctcccacmtaggccggccccggcccgactcgccctcagaaactcactgtttggggctgcggactttctcgtcgtgccccacaaaagtaaagcttggggacctgggggg

SEQ ID NO: 45883 - DNA, 201 bp, Homo sapiens
tagagtcccagctggtgactgtttttcaggcatttacggtagccacctcaatcttctagcgctcaagcgcgcgcacagacgtgaacgccgccagaggggggagggggtggggcgatgcttaagtgtccacgcatccgtagtgcgacgcacgcaggcgtagtacggtcccccgggcgacagcggtggcggctcctcggggtg

SEQ ID NO: 45884 - DNA, 201 bp, Homo sapiens
caaggcatgactgacttcttgcaggtgagtggctggcttgccattcacctcatcttcctgtcccccggcccagccaggcagtggtaccttcttgccattayataaccactgggtaagagcccctagtgacatgttaggggaaggggccctgggaattcattgactctgaacctttcattttaaagatgaagaaaatgaggt

SEQ ID NO: 45885 - DNA, 201 bp, Homo sapiens
ctcgaactcttgaccttgtgatccacccaccttggcctcccaaagtgctgggattacaggcttgagccatcgtgcccggccagcttttttcttttttttttaagttacagagtcttgctctgtcacccagactggagtgcagtggtgcaatccagtgagttaaagctcactgtaaccttgaactcctgggctcaaacagtt

SEQ ID NO: 45886 - DNA, 201 bp, Homo sapiens
tgagcttaaagccttggacatagctatctgtgtctttactcctgtaatacttggagacaaattgcatgtggggtggtccatggttttctaaaatgtgataytacctggatataagaaagccatatatagacttgtgattagatgtatataaatactctggtacttcccaagagtcagtttgtagttaggaaaaatatttct

SEQ ID NO: 45887 - DNA, 201 bp, Homo sapiens
cccagtctctgggacactggtgagcaagggtcggggagttctagtgcgtaacagtctagggagagactcctgtggtggtgcatggaagggcaggtctgaarttctcccttgctctctatccagcagggcgccggtctgggtaccaatgcctcgttggcccagatggtgagcggccttgtggggcagcttcttatgcagcca

SEQ ID NO: 45888 - DNA, 201 bp, Homo sapiens
gtgaatgtgtgtgtgtgcaggagaaactttttaggtattggggcagggattaatgctagggagtctttcgggtacactctggtctgggcaacagcgggccytccttccttcgttcttctttagagacctgtcggccatggagcctaatgatagtaccagtaccgctgtggaggagcctgacagcttggaggtgttggtgaa

SEQ ID NO: 45889 - DNA, 201 bp, Homo sapiens
cctaccttcagtgtcgaggagggccccaaccgcagcacagtcagccgcccccgcagccaccggctgtgaccccggagccagtagccttgagctctcaaacrtcagaaccagttgaaagtgaagcacctccccgggagcccatggaggcagaagaagtggaggagcgtgccccagcccagaacccggagctcactcctggcc

SEQ ID NO: 45890 - DNA, 201 bp, Homo sapiens
gaaggggatctgggagaaggaggctgggaggtggggtggacctggctgagagatggctgggacctgatttagtaggtggtagaactcatggcttcatctgyaacctaccctgataaaccttctctcattgtagagtgagccccgggtacggctggtgatggctcagcacatgatcagggatatacagaccttactatcccg

SEQ ID NO: 45891 - DNA, 201 bp, Homo sapiens
tcttagttgaagggttagcattgaggggcgaggaggggctctctcggtataggtaaatgacgctaggacaggcagctgagaagaactgctgctctccctayggcaaggaaatccaaatggtatctcctgagcctgatcggaattctcctctgagttcacgaaggcctgctctctttcttagaattagtctttcaccattgt

SEQ ID NO: 45892 - DNA, 201 bp, Homo sapiens
atggccttgtgtgcttgctgggatcatagggacttggccagcgtttctccaacctgcttactttttctctttagctccggtctgatatacaaaaacgactrcaggaagaccccaactacagtccccagcgcttccccaatgcccagcgggcctttgctgatgatccttagctctttgctctatggcccttcctcatcaggg

SEQ ID NO: 45893 - DNA, 201 bp, Homo sapiens
gtgctgctgccaccacggactacaataacaatgtgagccctttgatggccctgccctttctcctcagccccagtactcccaaaacagaacaggctgaaatrcagataactctttccctccctggaaaaacattgcaacagggccaggtgcagtggctcacgcctgtaatcccagcactttgggaggccaaggtgggcggat

SEQ ID NO: 45894 - DNA, 201 bp, Homo sapiens
ttgacagtgtgcttggggggggaaatgttagcttctgagggatggccttgtgtgcttgctgggatcatagggacttggccagcgtttctccaacctgcttrctttttctctttagctccggtctgatatacaaaaacgactgcaggaagaccccaactacagtccccagcgcttccccaatgcccagcgggcctttgctga

SEQ ID NO: 45895 - DNA, 201 bp, Homo sapiens
agtgagccgagattgcactactgcactctagcctgggtgacagagcgagactgtctcaaaaaacaaaacaaaacaaaaaaacacacattgcaacaaaacartttctctctaaacctgtaagtgattttgtcctcccttacagagaaggtgataatctttgctgtaagcactgtcctcgtatcgtaccccttgtgcccctga

SEQ ID NO: 45896 - DNA, 201 bp, Homo sapiens
tcccactggccccctgggaccccctggtcatggccaaaccctgggtaagagtgagggcatcagggcaggctgagctctgggtagagaaagggaagggctgwgtgggtgggttgaaggggtccaggttcaaggttacatcagacccgccccccaggctccaccctcatccagctgccctccctgccccctgagttcatgcac

SEQ ID NO: 45897 - DNA, 201 bp, Homo sapiens
gtgccaccccgggctatttgacagtgtgcttggggggggaaatgttagcttctgagggatggccttgtgtgcttgctgggatcatagggacttggccagcstttctccaacctgcttactttttctctttagctccggtctgatatacaaaaacgactgcaggaagaccccaactacagtccccagcgcttccccaatgcc

SEQ ID NO: 45898 - DNA, 201 bp, Homo sapiens
aacccgggtggtgattgcccggcccactcctccacaggctcggccttcccatcctggagggcccccagtctctgggacactggtgagcaagggtcggggakttctagtgcgtaacagtctagggagagactcctgtggtggtgcatggaagggcaggtctgaagttctcccttgctctctatccagcagggcgccggtctg

SEQ ID NO: 45899 - DNA, 201 bp, Homo sapiens
cggggagttctagtgcgtaacagtctagggagagactcctgtggtggtgcatggaagggcaggtctgaagttctcccttgctctctatccagcagggcgcyggtctgggtaccaatgcctcgttggcccagatggtgagcggccttgtggggcagcttcttatgcagccagtccttgtgggtgagttttcattcttcccca

SEQ ID NO: 45900 - DNA, 201 bp, Homo sapiens
gctaattttttatgtttttagtagagaagggggtttcaccatgttggccaggatggtctcgaactcttgaccttgtgatccacccaccttggcctcccaargtgctgggattacaggcttgagccatcgtgcccggccagcttttttcttttttttttaagttacagagtcttgctctgtcacccagactggagtgcagtg

SEQ ID NO: 45901 - DNA, 201 bp, Homo sapiens
gactgtaagtgtagaacaggacgctgttcctgaatcaggaaacaagggactggtgacctgaactgccaccaccctccctggtgctcagatgcaatgaaatygtgaggcaacaaatctatggctaggtaaagggtcaactccatttcagcaaatgtttcagatgttccttcctgcctagtaatgttccagctttaccccagc

SEQ ID NO: 45902 - DNA, 201 bp, Homo sapiens
ctgggacagttatattcatcagaacagcacggtgtcaaggccctcacccccagaaagcttaggagacactgttttatggaggagagtgagattggaggaasccctgactccaggtctcctgatccttcctacacaaagcgaagctgaaaaaaagtgcaggacactccatttcctcctgggaccagacagggaagccagagc

SEQ ID NO: 45903 - DNA, 201 bp, Homo sapiens
atttgctttgactgtaagtgtagaacaggacgctgttcctgaatcaggaaacaagggactggtgacctgaactgccaccaccctccctggtgctcagatgyaatgaaatcgtgaggcaacaaatctatggctaggtaaagggtcaactccatttcagcaaatgtttcagatgttccttcctgcctagtaatgttccagctt

SEQ ID NO: 45904 - DNA, 201 bp, Homo sapiens
cagtcggtattttgtgcacctgtgcttttatttcaggagctgggacagttatattcatcagaacagcacggtgtcaaggccctcacccccagaaagcttargagacactgttttatggaggagagtgagattggaggaagccctgactccaggtctcctgatccttcctacacaaagcgaagctgaaaaaaagtgcaggac

SEQ ID NO: 45905 - DNA, 201 bp, Homo sapiens
ataaaccacaatgcctggcccctgtgtgtgtacatacaaagtcaaagtgctaaacctggcgcctaggaaacatccccacctaggcattgcttgcaacagtmggtattttgtgcacctgtgcttttatttcaggagctgggacagttatattcatcagaacagcacggtgtcaaggccctcacccccagaaagcttaggaga

SEQ ID NO: 45906 - DNA, 201 bp, Homo sapiens
tcttgaacttctggcttcaaacaattctcatgcctcagcctcccaaagtgctgagattacaggcataaaccacaatgcctggcccctgtgtgtgtacatasaaagtcaaagtgctaaacctggcgcctaggaaacatccccacctaggcattgcttgcaacagtcggtattttgtgcacctgtgcttttatttcaggagct

SEQ ID NO: 45907 - DNA, 201 bp, Homo sapiens
ttcaacagtacatagggaggccatttctggggagaaatgtagactgtccttagactcctgaggtttttacacttgcttgctgactctgtggactttgactwcatcattaaacatcttataatgatgtaatttgctttgactgtaagtgtagaacaggacgctgttcctgaatcaggaaacaagggactggtgacctgaact

SEQ ID NO: 45908 - DNA, 201 bp, Homo sapiens
tttttttttttttttgtagagactgggtcttgctttgttacccatgctggtcttgaacttctggcttcaaacaattctcatgcctcagcctcccaaagtgmtgagattacaggcataaaccacaatgcctggcccctgtgtgtgtacatacaaagtcaaagtgctaaacctggcgcctaggaaacatccccacctaggcat

SEQ ID NO: 45909 - DNA, 201 bp, Homo sapiens
gaattcctagctcaggtgagatcaccaaagttgcctgtgaggcttcgtggaacctgcaggtagaaaggacatctttatttcgagctgcagcccagttgctyctgcgtcttggagccccttgaaaggaccctctcccttcaacagtacatagggaggccatttctggggagaaatgtagactgtccttagactcctgaggtt

SEQ ID NO: 45910 - DNA, 201 bp, Homo sapiens
agaacccacatcaaaaaaccgaattcctagctcaggtgagatcaccaaagttgcctgtgaggcttcgtggaacctgcaggtagaaaggacatctttatttygagctgcagcccagttgcttctgcgtcttggagccccttgaaaggaccctctcccttcaacagtacatagggaggccatttctggggagaaatgtagact

SEQ ID NO: 45911 - DNA, 201 bp, Homo sapiens
atccttcctacacaaagcgaagctgaaaaaaagtgcaggacactccatttcctcctgggaccagacagggaagccagagccaccatggatgtcaaattccrgcaaggaaacaccagtatagcaaaatctccacatcacattttaaagctcacacaatggctcaaagagaacccacatcaaaaaaccgaattcctagctcag

SEQ ID NO: 45912 - DNA, 201 bp, Homo sapiens
cgcctgcgtacacctttccccctcctcccaacagagtgaaataggactttagggcgcccgccttgcgcaggcgcggtcaggggcagaggcggggccgggascgaggcgtagggggtgtggccaaagcgcagtagggggctctcgcggttggtaagggacgttcgggaagagtcggttgggggcgggaaggggctgagcggg

SEQ ID NO: 45913 - DNA, 201 bp, Homo sapiens
ccaccaccatgcccagctagtttttgtattttcagtagagacgggattacaccatgttggccaggatggtctcgagctcctgacctcgtgatccgcccgcyttggcatcccaaagtgctgggattataggcgtgagccaccacgcctaagtaagttgtaaacataagttgttcagccgcatctcccaaagccagtaaattc

SEQ ID NO: 45914 - DNA, 201 bp, Homo sapiens
gagcgggggtcctgggagggttcaaggggtccaaaggggaagggggtacaggggccaggtgaagggacagatgaagagatcagaacagccttagagctcaygggctaactgggtgaagcctcgggtatctaggggagcagtggtgggagagtagagccggctagcgtacagggggcgagggcaggctattgagagatgggg

SEQ ID NO: 45915 - DNA, 201 bp, Homo sapiens
tgacctctgcctcccgggttcaagccattctcctggctcagcctcccaagtagctgggattacaggcgcccaccaccatgcccagctagtttttgtatttkcagtagagacgggattacaccatgttggccaggatggtctcgagctcctgacctcgtgatccgcccgccttggcatcccaaagtgctgggattataggcg

SEQ ID NO: 45916 - DNA, 201 bp, Homo sapiens
agaactctggagatggcgctcaagacccctgcactgtgtacctcctttctcacctctggccaggagcagcagggaccatagaaacttaaggaggagggtaraggcactgcccagaatcctgaaagtatgagtaaagcctcagagcccctctcagtctgtctctttcagtaaattctctccacttgatagttagttgcttgg

SEQ ID NO: 45917 - DNA, 201 bp, Homo sapiens
tcacctgcactaacctgtctttgaaggtcctgggggctggaggggtcacaggccctgagccagcaggctgaggtgatcgttcggcagctgcaagagctgcrgcggctggaggaggaggtccggctcctgcgggagacctcgctgcagcagaagatgaggctagaggcccaggccatggagctagaggctctggcacgggcg

SEQ ID NO: 45918 - DNA, 201 bp, Homo sapiens
ccatggagctagaggctctggcacgggcggagaaggccggccgagctgaggctgagggcctgcgtgctgctttggctggggctgaggttgtccggaagaayttggaagaggggaggcagcgggagctggaagaggttcagaggctgcaccaagagcaggtgaatgcaggggtagaaaggattcaaattcataacggagagc

SEQ ID NO: 45919 - DNA, 201 bp, Homo sapiens
aggtgaccctggttgagaatctaagaaaatatgttggggaacaagtcccttctgaggtccacagccagacatgggaactggagcgacagaagcttctggamaccatgcaggtgagggtgcaggaatgtatctgtgtgcagacttagggatcaggttgggaggcaagcgtggcccttggaggagcgtgtagagcacagcctc

SEQ ID NO: 45920 - DNA, 201 bp, Homo sapiens
aagtgattctcgtgcctcagcctctggagtagctgggattacaggcatgagccaccatgcccggctaatttttgtgtttttaagtagagagagtttcaccrtgttggccaggctagtctccaattcctgacttcaggtgatccgcccgcctcggcctcccaaagtgctgggattacaggcaggagccactgcccctgacca

SEQ ID NO: 45921 - DNA, 201 bp, Homo sapiens
tcctttgctgcatcctccccagggcctgcagttggagctgagccgtgctcaggaggccaggcgttggtggcagcagcagacagcctcagccgaggagcagytgaggcttgtggtcaatgctgtcagcaggtatcagggatggaggggtgggtggagtagtgtttctgctacctcaggttcctgggcaccttgttgctgagg

SEQ ID NO: 45922 - DNA, 201 bp, Homo sapiens
ggcagcagcagacagcctcagccgaggagcagctgaggcttgtggtcaatgctgtcagcaggtatcagggatggaggggtgggtggagtagtgtttctgcyacctcaggttcctgggcaccttgttgctgaggatcctcaggcaagaggggctggaaagtggccactggaggctacagggctgggcagatttagctctatc

SEQ ID NO: 45923 - DNA, 201 bp, Homo sapiens
atccgtttcactggagaaaaatttagtctatttatttatttattttgagacaaagtctcgctctgtcacccaggctggagtgcaatggcgcaatcttggcycactgcaacctcacctccctggttcaagtgattctcctgcctcagcctcccgagtagctggattacaggcatcctccaccagtgtcctccactacgcccg

SEQ ID NO: 45924 - DNA, 201 bp, Homo sapiens
tccgcccgcctcggcctcccaaagtgctgggattacaggcttgagccaccgtgcccggccggcaggtagttcttagcacagtctctggcttgtaaatgttkattgttatcgtgaggctcttcttgatgggttaatttagataaagataatttttggtttagcgaaattaagatgcaggatgagtccttgcccaccacttcc

SEQ ID NO: 45925 - DNA, 201 bp, Homo sapiens
caggcttgagccaccgtgcccggccggcaggtagttcttagcacagtctctggcttgtaaatgttgattgttatcgtgaggctcttcttgatgggttaatwtagataaagataatttttggtttagcgaaattaagatgcaggatgagtccttgcccaccacttccttctcttgggtttgtaccttagggactaatttagc

SEQ ID NO: 45926 - DNA, 201 bp, Homo sapiens
gcagcagctgagcaaggtggcccagcagctggagcaggagctgcagcagacccaggagtccctggctagcttggggctgcagctggaggtagcacgccagkgccagcaggagagcacagaggaggctgccagtctgcggcaggagctgacccagcagcaggaactctacgggcaaggtgtcgagagggaaatgggtgcttc

SEQ ID NO: 45927 - DNA, 201 bp, Homo sapiens
gcggcaggagctgacccagcagcaggaactctacgggcaaggtgtcgagagggaaatgggtgcttcccttggagggtggggtgggaactgcgaatcaaagstcctgctgatatgccccgtctgcactttcaccccagccctgcaagaaaaggtggctgaagtggaaactcggctgcgggagcaactctcagacacagagag

SEQ ID NO: 45928 - DNA, 201 bp, Homo sapiens
acacctgcctcctctgtgccttggcctctctgtagtggtctccttgcgccagattcagcgcagagccgcccaggaaaaggagcggagccaggaactcaggygtctgcaggaggaggcccggaaggaggaggggcagcgactggcccggcgcttgcaggagctagagagggataagaacctcatgctggtaggagacaggag

SEQ ID NO: 45929 - DNA, 201 bp, Homo sapiens
gccagggtggatagggccttccaggaagaaggaagtgttaagacataaggttattattttcccctcaaagtgtgttcaaagcttcattacaggaagtaatraaggtatccaggagtagcacagatgaattatcacatcgtgaacacacccatgtagccagcaccagattaagaaacagcatatggccggtcgcggtggctt

SEQ ID NO: 45930 - DNA, 201 bp, Homo sapiens
ggatcaggcagctgggtgatttctcctgactctttctcttccccgtctcagctgtcccctaccaccaccggtcacagatgtgagccttgagttgcagcagytgcgggaagaacggaaccgcctggatgcagaactgcagctgagtgcccgcctcatccagcaggaggtgggccgggctcgggagcaaggtacacctggttg

SEQ ID NO: 45931 - DNA, 201 bp, Homo sapiens
gaggtggatggggctttagggcattggctgctgggacccccaaaaccatgaggactgaggtgggatgggggctttgggatcaggcagctgggtgatttctyctgactctttctcttccccgtctcagctgtcccctaccaccaccggtcacagatgtgagccttgagttgcagcagctgcgggaagaacggaaccgcctgg

SEQ ID NO: 45932 - DNA, 201 bp, Homo sapiens
gaggtgggcggatcacttgaggccaggagttaaagaccaacctggccaacatgaagaactctacaaaaaaatacaaaaattagccgggtatagtcgtgggmgcctgtaatcccccagcttcttgggaggctgaggcaggagaattgcttgaacctgggagacagaggttacagtgagctgacatcacactccagcctgggc

SEQ ID NO: 45933 - DNA, 201 bp, Homo sapiens
ggagctagagagggataagaacctcatgctggtaggagacaggagggcagacaggcagacactagggcccatcctgggctggttcctgggctagaggtgtrgaaagaggatggtgagggaggctctatccgggctaggtttaaccctctccttcccaggccaccttgcagcaggaaggtctcctctcccgttacaagcagc

SEQ ID NO: 45934 - DNA, 201 bp, Homo sapiens
ggtggagaggatgaggaaaaacccagtgtctagggtgctgggagaggcctgacccagcaccccctccttttaggggaggcagagcggcagcagctgagcarggtggcccagcagctggagcaggagctgcagcagacccaggagtccctggctagcttggggctgcagctggaggtagcacgccagtgccagcaggagagc

SEQ ID NO: 45935 - DNA, 201 bp, Homo sapiens
caaggggtccaaaggggaagggggtacaggggccaggtgaagggacagatgaagagatcagaacagccttagagctcacgggctaactgggtgaagcctckggtatctaggggagcagtggtgggagagtagagccggctagcgtacagggggcgagggcaggctattgagagatgggggtgagggtcaggaccagaataa

SEQ ID NO: 45936 - DNA, 201 bp, Homo sapiens
agctcacgggctaactgggtgaagcctcgggtatctaggggagcagtggtgggagagtagagccggctagcgtacagggggcgagggcaggctattgagasatgggggtgagggtcaggaccagaataattccttcagaaaaaggtagattaggttgtaaaaagggacgggagtagggatcccagattcgggtaaaaaata

SEQ ID NO: 45937 - DNA, 201 bp, Homo sapiens
ttgttgtatgaccttcagaaaaacctctaagaaaacagcaaagcttctttgtgctggtgatgacttcccctcagccttagacactgaggtacccaaggcargtagttcttttttttttgagacagagtctcgcactgtcacccaggctggagtgcaatggcacgatctcagctcactgcaacctctgcctcccgggttcac

SEQ ID NO: 45938 - DNA, 201 bp, Homo sapiens
gaaaaacctctaagaaaacagcaaagcttctttgtgctggtgatgacttcccctcagccttagacactgaggtacccaaggcaggtagttcttttttttttgagacagagtctcgcactgtcacccaggctggagtgcaatggcacgatctcagctcactgcaacctctgcctcccgggttcacacgattttcctgcctca

SEQ ID NO: 45939 - DNA, 201 bp, Homo sapiens
ggggatagtagagagaagctgagagaacagccgcaggaaagatttgaataagatgtcaggacgctggcttttctgcctggggatctaggcggcctggattyccaaggtcttggggagggtctagccctgcatgtggccacattcagctggggccaggccttgggccagcactttaacagggaaggacccaagagtcatggc

SEQ ID NO: 45940 - DNA, 201 bp, Homo sapiens
ttttacgggcaatccgtttcactggagaaaaatttagtctatttatttatttattttgagacaaagtctcgctctgtcacccaggctggagtgcaatggcrcaatcttggctcactgcaacctcacctccctggttcaagtgattctcctgcctcagcctcccgagtagctggattacaggcatcctccaccagtgtcctc

SEQ ID NO: 45941 - DNA, 201 bp, Homo sapiens
ccttcctcctttcaccagtccttgcatctctttttcccttactccctgtccccactttctcccatgcaaacttcatctctttttctccctgctttttcccycccaggcctgattgctcgaaagcttgcccttgctcagctgcgccaggagaggtgaagtttgggcactttgaggtggatggggctttagggcattggctgc

SEQ ID NO: 45942 - DNA, 201 bp, Homo sapiens
tgaacccctgacctcaagtgatccatctgcctcggcctcccaaagtgctgggattacaggtgtgagccaccgtgctgcgacccacccccgtcgcccgcccyccctccccccagcccctgcatggcattcttacagagatctctgcacctgccactttgcttccagtgcccccctcatcttttagctctagagggccctgcc

SEQ ID NO: 45943 - DNA, 201 bp, Homo sapiens
cttccgagtagctgggactacaggcgcccgccaccacgcccagctaattttttgtattttaatagagacggggtttcaccgtgttagccaggatgatctcratctcctgaccttgtgatccacccacctcggcctcccaaagtgctggaattacaggaatgagccactgcgcccggcctgttgaaaggttttaagcaggga

SEQ ID NO: 45944 - DNA, 201 bp, Homo sapiens
tccggggctgcagccaggacttagggagggaccctgtcctttgctgcatcctccccagggcctgcagttggagctgagccgtgctcaggaggccaggcgtyggtggcagcagcagacagcctcagccgaggagcagctgaggcttgtggtcaatgctgtcagcaggtatcagggatggaggggtgggtggagtagtgtttc

SEQ ID NO: 45945 - DNA, 201 bp, Homo sapiens
acttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaag

SEQ ID NO: 45946 - DNA, 201 bp, Homo sapiens
ccggggctgcagccaggacttagggagggaccctgtcctttgctgcatcctccccagggcctgcagttggagctgagccgtgctcaggaggccaggcgttrgtggcagcagcagacagcctcagccgaggagcagctgaggcttgtggtcaatgctgtcagcaggtatcagggatggaggggtgggtggagtagtgtttct

SEQ ID NO: 45947 - DNA, 201 bp, Homo sapiens
cacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataaa

SEQ ID NO: 45948 - DNA, 201 bp, Homo sapiens
tcggactttcttcttcctgacccagctctctctgatcccacatccattcaccttcctcctttcaccagtccttgcatctctttttcccttactccctgtcyccactttctcccatgcaaacttcatctctttttctccctgctttttccctcccaggcctgattgctcgaaagcttgcccttgctcagctgcgccaggaga

SEQ ID NO: 45949 - DNA, 201 bp, Homo sapiens
tccctctctgtcctgctcgatgacctgcaggacctgagtgaagccatttccaaagaggaagctgtttgtcaaggagacaaccttgacagatgctccagctscaatccccagatgagcagctaagcagctgacagttggagggaaagccagcctgggggctgggaggatcctggagaagtgggtggggacagaccagccctt

SEQ ID NO: 45950 - DNA, 201 bp, Homo sapiens
agttcgagaccagcctggccaacatggtaaaacctcatctctactaaaaatacaaaaattagctgggcgtggtggctcatgcctgtaatctcagctactcrggagggtgaggcaggagaatcgcttgaacctgggaggcagcgtttgcagtgagctgagatcgtgccattgcactccagtctaggcaacaaagtgaaactc

SEQ ID NO: 45951 - DNA, 201 bp, Homo sapiens
gagttgccagctctccatttgctgtgcacagttggctgattggttgggtcattctctaaggtcacagaaagtgggagtgaagggaacaaggaaggcctccrtgtggggtcgagcctctgctgagccccctcttctttccgcagctgtcctctttgacacaggctcacgaggaggctctttccagtttgaccagcaaggctg

SEQ ID NO: 45952 - DNA, 201 bp, Homo sapiens
attcttacagagatctctgcacctgccactttgcttccagtgcccccctcatcttttagctctagagggccctgcccagctctctctcctcccccaggtgrcctcactccaggaaaaagtgacatcccagagccaggagcaggccatcctgcagcgatccctgcaggacaaagccgcagaggtggaggtggagcgtatggg

SEQ ID NO: 45953 - DNA, 201 bp, Homo sapiens
agacagcctcagccgaggagcagctgaggcttgtggtcaatgctgtcagcaggtatcagggatggaggggtgggtggagtagtgtttctgctacctcaggktcctgggcaccttgttgctgaggatcctcaggcaagaggggctggaaagtggccactggaggctacagggctgggcagatttagctctatcaatgttcct

SEQ ID NO: 45954 - DNA, 201 bp, Homo sapiens
tgctcagagacagcctctctgaggaggtgacagcatctgaggagagtggcatggtcagttggtgggtcttgtggggtgtgtcaagggctattcccatcttygagtgggcacatggaatgtggaacatggaacactgggctcagattccatcctcagaacctaagcttctgtctccctgcgtggcattcattctttttcttt

SEQ ID NO: 45955 - DNA, 201 bp, Homo sapiens
tgactttgttattgtaggggctttctctttggaaggtggcctgaaaattgaattggagtgtctttgtttctcctcttgtccaggggaacatagatggctgragacagaatctagagccttcaaataatgtggagatgtttccaccttcaggtcagtgggaccagacaaggggagtggtggttgtctctgcctgggaaactg

SEQ ID NO: 45956 - DNA, 201 bp, Homo sapiens
taaatgccttttaactagcacctggcctcaccatattgatactggaagcttacgacctctctatgcccattcctccctcaaacttcttgcccttaaattasaattgagaagtccctgtgtgttcttccaacctttccacttaaaatgtgtggcctaaaaataaaaaaataaataagacaaaaaaaccaccaaaaaacaaaa

SEQ ID NO: 45957 - DNA, 201 bp, Homo sapiens
cttcctcctttcaccagtccttgcatctctttttcccttactccctgtccccactttctcccatgcaaacttcatctctttttctccctgctttttccctyccaggcctgattgctcgaaagcttgcccttgctcagctgcgccaggagaggtgaagtttgggcactttgaggtggatggggctttagggcattggctgct

SEQ ID NO: 45958 - DNA, 201 bp, Homo sapiens
acctgcactaacctgtctttgaaggtcctgggggctggaggggtcacaggccctgagccagcaggctgaggtgatcgttcggcagctgcaagagctgcggyggctggaggaggaggtccggctcctgcgggagacctcgctgcagcagaagatgaggctagaggcccaggccatggagctagaggctctggcacgggcgga

SEQ ID NO: 45959 - DNA, 201 bp, Homo sapiens
catgcaaacttcatctctttttctccctgctttttccctcccaggcctgattgctcgaaagcttgcccttgctcagctgcgccaggagaggtgaagtttgkgcactttgaggtggatggggctttagggcattggctgctgggacccccaaaaccatgaggactgaggtgggatgggggctttgggatcaggcagctgggt

SEQ ID NO: 45960 - DNA, 201 bp, Homo sapiens
ctgaggtgggatgggggctttgggatcaggcagctgggtgatttctcctgactctttctcttccccgtctcagctgtcccctaccaccaccggtcacagaygtgagccttgagttgcagcagctgcgggaagaacggaaccgcctggatgcagaactgcagctgagtgcccgcctcatccagcaggaggtgggccgggctc

SEQ ID NO: 45961 - DNA, 201 bp, Homo sapiens
ttgaaggtcctgggggctggaggggtcacaggccctgagccagcaggctgaggtgatcgttcggcagctgcaagagctgcggcggctggaggaggaggtcyggctcctgcgggagacctcgctgcagcagaagatgaggctagaggcccaggccatggagctagaggctctggcacgggcggagaaggccggccgagctga

SEQ ID NO: 45962 - DNA, 201 bp, Homo sapiens
gcactttgaggtggatggggctttagggcattggctgctgggacccccaaaaccatgaggactgaggtgggatgggggctttgggatcaggcagctgggtkatttctcctgactctttctcttccccgtctcagctgtcccctaccaccaccggtcacagatgtgagccttgagttgcagcagctgcgggaagaacggaac

SEQ ID NO: 45963 - DNA, 201 bp, Homo sapiens
tcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccataa

SEQ ID NO: 45964 - DNA, 201 bp, Homo sapiens
agggaccctgtcctttgctgcatcctccccagggcctgcagttggagctgagccgtgctcaggaggccaggcgttggtggcagcagcagacagcctcagcygaggagcagctgaggcttgtggtcaatgctgtcagcaggtatcagggatggaggggtgggtggagtagtgtttctgctacctcaggttcctgggcacctt

SEQ ID NO: 45965 - DNA, 201 bp, Homo sapiens
gctgcggcggctggaggaggaggtccggctcctgcgggagacctcgctgcagcagaagatgaggctagaggcccaggccatggagctagaggctctggcaygggcggagaaggccggccgagctgaggctgagggcctgcgtgctgctttggctggggctgaggttgtccggaagaacttggaagaggggaggcagcggga

SEQ ID NO: 45966 - DNA, 201 bp, Homo sapiens
atcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccata

SEQ ID NO: 45967 - DNA, 201 bp, Homo sapiens
ctctggcacgggcggagaaggccggccgagctgaggctgagggcctgcgtgctgctttggctggggctgaggttgtccggaagaacttggaagaggggagscagcgggagctggaagaggttcagaggctgcaccaagagcaggtgaatgcaggggtagaaaggattcaaattcataacggagagctgggcagtagcttcc

SEQ ID NO: 45968 - DNA, 201 bp, Homo sapiens
gcctcctcctggggcctgtttaagctgctcagttttcatgagccaggttggtcctacttctggcacagccagctggtaaagcatgtggacctgcccgtcaytggtgctagatcgacactcctgggcttggagaggataactttgttttcttttgtttttttgagatggagtctcgctctgtcacccagtcttgagggcagg

SEQ ID NO: 45969 - DNA, 201 bp, Homo sapiens
cttgaagccctgcttccctttctagtaggaaatagtttgcctccctactttactccaggtaccaattcatcaggggtattgtggagggcagtgaggaaggkgggtataagggggctatggtggactgggagagagagattattcagtcctcaaactcagtacttactctgccatctctaagactcagtgaccaaattagcc

SEQ ID NO: 45970 - DNA, 201 bp, Homo sapiens
aatcacttgaacctgggcagtggaggttgcagtgagccgagactgtgccattgcactccagcctgggcgacagagcaagactctgtctcaaaaaataaaataaaaaaggaactgggagaaaacaagggagaattcctttataaccttgtagtgggcaaggcctttctacctgtgagtcaaaatccaaaatctagaagccat

SEQ ID NO: 45971 - DNA, 201 bp, Homo sapiens
gtctgcactttcaccccagccctgcaagaaaaggtggctgaagtggaaactcggctgcgggagcaactctcagacacagagaggaggctgaacgaggctcrgagggagcatgccaaggccggtgagccttgccagggtggatagggccttccaggaagaaggaagtgttaagacataaggttattattttcccctcaaagt

SEQ ID NO: 45972 - DNA, 201 bp, Homo sapiens
ggaaggccactgtaaccagttgacatgtcaaggaaagaaaccatagccctgggcgcagtggctcacgcctgtaatcccagcattttgggaggccgaagcargcagatcacaaggtcaggagttcaagaccagcctggccaacatggcgaaaccctgtctctactaaaaatacaaaaattcaccaggcatggtggtgcgcac

SEQ ID NO: 45973 - DNA, 201 bp, Homo sapiens
taatcccagcattttgggaggccgaagcaggcagatcacaaggtcaggagttcaagaccagcctggccaacatggcgaaaccctgtctctactaaaaatamaaaaattcaccaggcatggtggtgcgcacctgtaatcccagctacttgggaggccgaggcaggagaatcacttgaacctgggcagtggaggttgcagtga

SEQ ID NO: 45974 - DNA, 201 bp, Homo sapiens
gtgacccagcgtttgttcctgtcttcatggtgcctggctgcctctggcctgactcacacctgcctcctctgtgccttggcctctctgtagtggtctccttrcgccagattcagcgcagagccgcccaggaaaaggagcggagccaggaactcaggcgtctgcaggaggaggcccggaaggaggaggggcagcgactggccc

SEQ ID NO: 45975 - DNA, 201 bp, Homo sapiens
ctctaaaggctggcactgtgttatttatgtactgttctctcagactcctcataaagtatacctaacactcaataaatgcctttttttttttttttttttttgagatggagtctcactctgtcgcccaggctggagtgcactggggagatcttggctcactgcaagctccgcctcccaggttgacgccattctcctgcctca

SEQ ID NO: 45976 - DNA, 201 bp, Homo sapiens
cagcgtttgttcctgtcttcatggtgcctggctgcctctggcctgactcacacctgcctcctctgtgccttggcctctctgtagtggtctccttgcgccakattcagcgcagagccgcccaggaaaaggagcggagccaggaactcaggcgtctgcaggaggaggcccggaaggaggaggggcagcgactggcccggcgct

SEQ ID NO: 45977 - DNA, 201 bp, Homo sapiens
ttggctgctgggacccccaaaaccatgaggactgaggtgggatgggggctttgggatcaggcagctgggtgatttctcctgactctttctcttccccgtcycagctgtcccctaccaccaccggtcacagatgtgagccttgagttgcagcagctgcgggaagaacggaaccgcctggatgcagaactgcagctgagtgcc

SEQ ID NO: 45978 - DNA, 201 bp, Homo sapiens
cctgaggtcaggagtttgaggccagcctggacaacatggcgaaaccctgtctcgactaaaaatacaaaaattagctaggcctggtggtgggcacctgtacmccaagcttacttgtgaggctgatgtgggaagactacatgaacccgggaggtcgaggctgcagtgagccaagattgtgccactgcactcaagcctgggtga

SEQ ID NO: 45979 - DNA, 201 bp, Homo sapiens
tctcccgttacaagcagcagcgactgttgacagttcttccttccctactggataagaagaaatctgtggtgtccagccccaggcctccagagtgttcagcwtctgcacctgtagcagcagcagtgcccaccagggagtccataaaaggtcttgggccaagcacaaagggacaagggacaaatgcgcgcacttcaggaatct

SEQ ID NO: 45980 - DNA, 201 bp, Homo sapiens
agggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacctg

SEQ ID NO: 45981 - DNA, 201 bp, Homo sapiens
gagggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacct

SEQ ID NO: 45982 - DNA, 201 bp, Homo sapiens
ggagggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggacc

SEQ ID NO: 45983 - DNA, 201 bp, Homo sapiens
aggagggtaaaggcactgcccagaatcctgaaagtatgagtaaagcctcagagcccctctcagtctgtctctttcagtaaattctctccacttgatagttagttgcttgggttccatgaggaaccaggttgagacaagcaagtgaatttggggtatctcctactttggggaagtaggaaaagagctaagcatcgggtggac

SEQ ID NO: 45984 - DNA, 201 bp, Homo sapiens
gcgggaaggggctgagcgggggtcctgggagggttcaaggggtccaaaggggaagggggtacaggggccaggtgaagggacagatgaagagatcagaacagccttagagctcacgggctaactgggtgaagcctcgggtatctaggggagcagtggtgggagagtagagccggctagcgtacagggggcgagggcaggcta

SEQ ID NO: 45985 - DNA, 201 bp, Homo sapiens
gcctgcatgccaccgcggagctgctgcaggtgcgggtgcagagcctcacacacatcctcgccctgcaggaggaggagctgaccaggaaggtacagcccaasccccagacccctcaccctcagccgcatcctgcatctactgtcccctgcctccctccctgtgggcaggaggggtcaatgtgccccagaacctgcttagatc

SEQ ID NO: 45986 - DNA, 201 bp, Homo sapiens
tgggtcattctctaaggtcacagaaagtgggagtgaagggaacaaggaaggcctccgtgtggggtcgagcctctgctgagccccctcttctttccgcagcwgtcctctttgacacaggctcacgaggaggctctttccagtttgaccagcaaggctgagggcttggagaagtctctgagtagtctggaaaccagaagagca

SEQ ID NO: 45987 - DNA, 201 bp, Homo sapiens
ggaggccgaagcaggcagatcacaaggtcaggagttcaagaccagcctggccaacatggcgaaaccctgtctctactaaaaatacaaaaattcaccaggcrtggtggtgcgcacctgtaatcccagctacttgggaggccgaggcaggagaatcacttgaacctgggcagtggaggttgcagtgagccgagactgtgccat

SEQ ID NO: 45988 - DNA, 201 bp, Homo sapiens
ccctccccccagcccctgcatggcattcttacagagatctctgcacctgccactttgcttccagtgcccccctcatcttttagctctagagggccctgccyagctctctctcctcccccaggtggcctcactccaggaaaaagtgacatcccagagccaggagcaggccatcctgcagcgatccctgcaggacaaagccgc

SEQ ID NO: 45989 - DNA, 201 bp, Homo sapiens
ctggaagacacttggtgggacaacaggtgaaggcggggacaggaggccagaaggctggggcacagagatgaggggcactgagtgtgctgcagagcccaggrcccagggcacaaggctttggccacttcagaacttgctactttcccataagagcaatgagcaggctgggcacagtggctcatacctgtaatcctagcactt

SEQ ID NO: 45990 - DNA, 201 bp, Homo sapiens
ggctgtcccattcccaccccaaccctagcaagacccaggaagacttggaggctcaggtgaccctggttgagaatctaagaaaatatgttggggaacaagtsccttctgaggtccacagccagacatgggaactggagcgacagaagcttctggaaaccatgcaggtgagggtgcaggaatgtatctgtgtgcagacttagg

SEQ ID NO: 45991 - DNA, 201 bp, Homo sapiens
tccttcctgtgaactcctcttgctgtagctcatgttgcccaggcaggacagaggagaaacaaagatgccacctccttcctctcctcccccaggagcccacrcttttctcccactccttctccctcaggttcaaccttcagattccctggagcctgagtttaccaggaagtgccagtccctgctgaaccgctggcgggagaa

SEQ ID NO: 45992 - DNA, 201 bp, Homo sapiens
acatggcgaaaccctgtctcgactaaaaatacaaaaattagctaggcctggtggtgggcacctgtaccccaagcttacttgtgaggctgatgtgggaagaytacatgaacccgggaggtcgaggctgcagtgagccaagattgtgccactgcactcaagcctgggtgatagagaaagaccatgtgtcaaaaaaagaattgt

SEQ ID NO: 45993 - DNA, 201 bp, Homo sapiens
aaactaaaatgtggagcttgcattctagaacagagacacagaacacgcaagtaaacagataatgttgggtaattatatgtgcgatagaaagattgaagccrggtgcagtggctcacacctataatgcgatcactttggtctcgaactcctgacctcaggtgattcacctgcctcagcctcccaaagtgatgggattacagg

SEQ ID NO: 45994 - DNA, 201 bp, Homo sapiens
aacacgcaagtaaacagataatgttgggtaattatatgtgcgatagaaagattgaagccgggtgcagtggctcacacctataatgcgatcactttggtctygaactcctgacctcaggtgattcacctgcctcagcctcccaaagtgatgggattacaggtgtgagccaccgtgcccagtcaagtaatgccaacagtttgg

SEQ ID NO: 45995 - DNA, 201 bp, Homo sapiens
gaactgtgatcccatcactgcactctagcctgggtgacaaagcgagatcttttctcaaaaaaaaagaaagtagtaagaaaaattcaaaagataatgtgacrgagagactgtggggtgagtcagcctcaggtaggatgctcagagacagcctctctgaggaggtgacagcatctgaggagagtggcatggtcagttggtggg

SEQ ID NO: 45996 - DNA, 201 bp, Homo sapiens
gagacagggctagaggaggcagaccaggaagcagggtgggcactttgccctcctttccagtccatcccatgactcttggtggctctgacacccctgcaacmctttgaggtgccatgagcaaaagacacaaaattcctcctttcctggagctttccttccagtgtggtccgacagatagtaacacatacacataagcaagat

SEQ ID NO: 45997 - DNA, 201 bp, Homo sapiens
ccgacagatagtaacacatacacataagcaagatatggtcagtgctaagtgctcaggaggacgtgaacagctgatggggcagagtagggtggggagggacrgtattagagggcccagtgaagccaccctgaggaggggctattgcctggggtctgtggagcaaggaggggccgctgtctggttctcagcagactccccgtg

SEQ ID NO: 45998 - DNA, 201 bp, Homo sapiens
tgctaagtgctcaggaggacgtgaacagctgatggggcagagtagggtggggagggacggtattagagggcccagtgaagccaccctgaggaggggctatygcctggggtctgtggagcaaggaggggccgctgtctggttctcagcagactccccgtggccggagcggggagcagtgggagagcctccagggtgagctca

SEQ ID NO: 45999 - DNA, 201 bp, Homo sapiens
aaagatgagggttggtggcagtggagacggagacagagaggtgaagatatgttttgggggagatcggacaagaactcctgatgggttgtggggcagctgcrgagagtgagttgccagctctccatttgctgtgcacagttggctgattggttgggtcattctctaaggtcacagaaagtgggagtgaagggaacaaggaag

SEQ ID NO: 46000 - DNA, 201 bp, Homo sapiens
gatagttagttgcttgggttccatgaggaaccaggttgagacaagcaagtgaatttggggtatctcctactttggggaagtaggaaaagagctaagcatcrggtggacctggctataattcaaggattatgactttgttattgtaggggctttctctttggaaggtggcctgaaaattgaattggagtgtctttgtttctc

SEQ ID NO: 46001 - DNA, 201 bp, Homo sapiens
gaggatcctggagaagtgggtggggacagaccagcccttccccatcctggggttgccctgggggataccagctgagtctgaattctgctctaaataaagaygactacagaaggagccattgtttggaaatgttatttctgggaatctgtgggaattctccctgcagccatctctcttggagattgtgagaagtggtcccac

SEQ ID NO: 46002 - DNA, 201 bp, Homo sapiens
acacgcaagtaaacagataatgttgggtaattatatgtgcgatagaaagattgaagccgggtgcagtggctcacacctataatgcgatcactttggtctcsaactcctgacctcaggtgattcacctgcctcagcctcccaaagtgatgggattacaggtgtgagccaccgtgcccagtcaagtaatgccaacagtttggg

SEQ ID NO: 46003 - DNA, 201 bp, Homo sapiens
ggtgagtcagcctcaggtaggatgctcagagacagcctctctgaggaggtgacagcatctgaggagagtggcatggtcagttggtgggtcttgtggggtgkgtcaagggctattcccatcttcgagtgggcacatggaatgtggaacatggaacactgggctcagattccatcctcagaacctaagcttctgtctccctgc

SEQ ID NO: 46004 - DNA, 201 bp, Homo sapiens
gtggtctccttgcgccagattcagcgcagagccgcccaggaaaaggagcggagccaggaactcaggcgtctgcaggaggaggcccggaaggaggaggggcwgcgactggcccggcgcttgcaggagctagagagggataagaacctcatgctggtaggagacaggagggcagacaggcagacactagggcccatcctgggc

SEQ ID NO: 46005 - DNA, 201 bp, Homo sapiens; identical to SEQ ID NO: 37814

SEQ ID NO: 46006 - DNA, 201 bp, Homo sapiens; identical to SEQ ID NO: 37815

SEQ ID NO: 46007 - DNA, 201 bp, Homo sapiens
ataagaagcaccatctgctttttaaatcaactttaaacaatttaatttggggcttaatttaattctttccaaatccttatgcacctaatctcattcttgtyacttttgattttagtgtagatgttgatacaatttgaacaacacacacacacacgaagatatttaggataagggatttaaggaattttgaatatgaaggtt

SEQ ID NO: 46008 - DNA, 201 bp, Homo sapiens; identical to SEQ ID NO: 37605

SEQ ID NO: 46009 - DNA, 201 bp, Homo sapiens
cattttttattacaaagtgttccatgttcagacttgatgaactctcattctgctttccttgaattttatttttccccataatccttgacacttgagctttygcgtttatgcaaatccatatcatatggacatcttaggaacttcttaggcctaagcctaaaacaaatggctgtttcttttattatttatataaagaataat

SEQ ID NO: 46010 - DNA, 201 bp, Homo sapiens
cagaacagcccccagcaaagggtcacccaggccacagtgtcaggagggccctaagtgaaaagggagtaatacaaaataggcttagtcggcagaacatttaycaaaataatgcaagttcagcatgtattcatcatgaatcccacattacattggagatttaccctgctaatttcttctttaatatacccaacagtgaaagtt

SEQ ID NO: 46011 - DNA, 201 bp, Homo sapiens
atgctctccagacaggttttttttttttttttttttttttttgagatggagtttcgctcttgttgcccaggctggagtgcaatggcgtgatctcggctcamcgcaaactccacctcccgggttcaagcgattctcctgtctcagcctcccgagtagctgggattacaggcatgtgccaccacgcccagctaattttgtatt

SEQ ID NO: 46012 - DNA, 201 bp, Homo sapiens
ggaatgtttagctgatacaacgaagtctcttcagactctcttagaacccagttttcatttacgtataattcatgccctaaccacagattttacttttagtrttcatcaaaacagcacattcccctcaaacccatacattgtttatataattcccagcaaactttctgtgggtctttttggaggagatgggaaggtggttgc

SEQ ID NO: 46013 - DNA, 201 bp, Homo sapiens
ctcattattaatgtctgatcaatccctctagataattagcaattcagcaacatttcctgaccctggtactggttttgatccttttgacttatttgtttagrtgaggtcattctcactgtaagaagttttgagttttaaggaggagtgtggaatcacgcttttgtttgttttttggtctctgaagttgttgaggtgtcccct

SEQ ID NO: 46014 - DNA, 201 bp, Homo sapiens
atttgcttatgtaatgagaacatgatgtctgcagattgtttacacttactgaggaacagaatcataacaaaagcccagttaccaactctgccaggcaggtscaatctttctatggctttgaggcaaggatgcctttctgtgcaagtgtagactcaagtatctgacatctgcacctcagttggggcagagcacgtgagtctt

SEQ ID NO: 46015 - DNA, 201 bp, Homo sapiens
  misc_feature (1)...(201): n = A,T,C or G, or insertion/deletion polymorphism (see Tables 1-2)
cagcttagagtatctagcatttttcacaaattggttaaccttgcttacagggtaaaggattatcacaatgaattgcaagctctgtgttggagggagggaangaggcttccgccctggacatgtgctggggtgtggccttggtccagtgcctcatctagcccaggcgttgttacctacctcaactttaaggtgggaaaggtg

SEQ ID NO: 46016 - DNA, 201 bp, Homo sapiens
tacccactttttgaaattgtgccatgcagcttttcgtgctgccttccctgtcctcagctgctgctcaggtgccaaccttccatcctcaggctggtgctcgygccctggggacatgcactgtcctttgtacagctcttcgttcatctcacaaagtgcccaggacattgtaggtgctgagtaaataatgggatgattgaggaa

SEQ ID NO: 46017 - DNA, 201 bp, Homo sapiens
agctacttgagaggctgaggcaggaggattgcttgagtccagaaagtggcagttgcagtgagtggagatcgcgccactgctctccagcctgggtggcagarcgagaccctgtctcaaaaaataaacaaaaacaaaatgcttctgtcagttaacaatctttattagagggtttttagtctttctttctcagctgtatgttaa

SEQ ID NO: 46018 - DNA, 201 bp, Homo sapiens
cgggtgcagtgctgtgtgtatctagttccagctacttgagaggctgaggcaggaggattgcttgagtccagaaagtggcagttgcagtgagtggagatcgygccactgctctccagcctgggtggcagagcgagaccctgtctcaaaaaataaacaaaaacaaaatgcttctgtcagttaacaatctttattagagggttt

SEQ ID NO: 46019 - DNA, 201 bp, Homo sapiens
gtaaaggattatcacaatgaattgcaagctctgtgttggagggagggaacgaggcttccgccctggacatgtgctggggtgtggccttggtccagtgcctyatctagcccaggcgttgttacctacctcaactttaaggtgggaaaggtgggacaattgagtatagtgccgggggtttagcatagtgggatgactcaaggg

SEQ ID NO: 46020 - DNA, 201 bp, Homo sapiens
atgttttagccacaaagctggctgttttggacaggtgtgcaggcataagagaattactgatgttacatggatagtcttgtcttagcatttactttgagtaygtattttgcttattttatgtcgggtaccaaaagaaaaaactgttgaagtgcatatgagataaaatttaacattcaatttttgactgatgaatgcttaata

SEQ ID NO: 46021 - DNA, 201 bp, Homo sapiens
caaccaaccagccagccaaccaaccaaccaaccaatcggttagccaactaaccaaccagccaaccagccaaccaaccaaccaaccagttaaccaacaaatmaaccaaccaaccaaccaaccaaccaactgggagttactcctgagaagaaatatagttggaaaaaacctcagttgacaagttcaagaatgatcagaaagta

SEQ ID NO: 46022 - DNA, 201 bp, Homo sapiens
tgtctgtgttttaaacctgggagatttttcactgtgctggaacgaaataccatgttccccttgtcttaaccaggcatgggcaaggcacctatttatacgcrgagacgggcagtaagtatgttggcacctgggtgaacggacagcaggagggcacggccgagctcattcacctgaaccacaggtaccagggcaagttcttga

SEQ ID NO: 46023 - DNA, 201 bp, Homo sapiens
cttgtgacagcatcacttcttagtgaggaggacatattcttacaaagtgcgagctatagttgcttgctttgctcctagataaaataagaaccagtaggtgrttcttattttaatagatgtcagtgatgattctgtccaattctgagaccaagatggagggttttaataccatccctgttagatagaaattgttttgttttg

SEQ ID NO: 46024 - DNA, 201 bp, Homo sapiens
tctagtctgggtggaaggcagcttcctgtaagtcacctgcatctaacaaaacgtagaggaatttgacatactgtcctcccccgaggttccacttcatttakgtgtgtgtgtgtgtgtgtgtgtgtgtgtgtgtgtaacctcctacacacatagtcagaagcctaagaaagacagtcggctttaggatttgattgtgacagg

SEQ ID NO: 46025 - DNA, 201 bp, Homo sapiens
ctgctggcatcttcctgggtggaggccggggacggtgctgaataccctgcagggcacagaacagcccccagcaaagggtcacccaggccacagtgtcaggrgggccctaagtgaaaagggagtaatacaaaataggcttagtcggcagaacatttatcaaaataatgcaagttcagcatgtattcatcatgaatcccacat

SEQ ID NO: 46026 - DNA, 201 bp, Homo sapiens
gaacagcccccagcaaagggtcacccaggccacagtgtcaggagggccctaagtgaaaagggagtaatacaaaataggcttagtcggcagaacatttatcaaaataatgcaagttcagcatgtattcatcatgaatcccacattacattggagatttaccctgctaatttcttctttaatatacccaacagtgaaagttat

SEQ ID NO: 46027 - DNA, 201 bp, Homo sapiens
aaagtgcgagctatagttgcttgctttgctcctagataaaataagaaccagtaggtggttcttattttaatagatgtcagtgatgattctgtccaattctragaccaagatggagggttttaataccatccctgttagatagaaattgttttgttttgtttcataaatcccagaaggcttgctctataagaagcaccatct

SEQ ID NO: 46028 - DNA, 201 bp, Homo sapiens
aacagtgaaagttatagagtttaattaataataaaaaatagctctacctttcacaaaacatttaaatatagcgtcttataagaatgtggcaaatttctgctttttttttttttttttttaagatggaatcttgctctgttgctcaggctgaagtgcaatggcgtgacctcggctcactgaaacctctgccacggggttcaa

SEQ ID NO: 46029 - DNA, 201 bp, Homo sapiens
tgtaattccagcactttgggaggccaaggatcgcttgagtccaggactttgagaccagccagggcaatatagtgagaccttgtctctacaaaaaaattttraaattagctgggaatggtggcgcatgcctatagtctcagctactcaggagtctgaggtggaaggatcactggagcctgggaggcggaggttgcagtgagc

SEQ ID NO: 46030 - DNA, 201 bp, Homo sapiens
ctcccaagtaactgggttgacaggcatgtaccaccatgcccagctaatttttgtatttttagttgagacggggtttcaccatgttggccgggctggtctcraactcctgacctcaagtgatccgcctgccttggcctcccaaagtgctgggattacaggcatgagccactgcgcccggcctgcttttcttttaaattaata

SEQ ID NO: 46031 - DNA, 201 bp, Homo sapiens
ccaaccaaccaaccaaccaaccaaccagccaaccagccaaccaaacagctaaccaatcaacaaaccagtcaactgactagccaaccaaccaaacaaccaaygaaccagccaaccaaacagccaaccaatcaaccaaccagccaactgactagccaaccacccagccaaccagttaaccaaccaaccagccagccaaccaac

SEQ ID NO: 46032 - DNA, 201 bp, Homo sapiens
gatggaaggaaacatcttccggaacctgacttacgcagtgcggtgtatacataatagcaaggtgctgtcatgactttagattggtcagggggctcctgtgrctatatgtaggaagggtttgatggggctattttgcattttaaaaataattttctttaaacttattcacacacgcttgacgtcatgcccatcatctgattt

SEQ ID NO: 46033 - DNA, 201 bp, Homo sapiens
gccacattaagggtggttctggccagggcctggggaaagaagggatataggagaagccttgttcttcttacagattgcttgagtagttgcaacagtgaagrctagtctgatgaggtctcagacagaaatgaggaacaaggtattggaaattggaagaaaggttatctttcttataaagtggcaaagaacttggctgaatca

SEQ ID NO: 46034 - DNA, 201 bp, Homo sapiens
aaagtgctgggattacaagcgtgagccacctcgcccagccataagtgtctgttctttacagattagtcagattcaagaattccgacatggttgcactaaamagactaagacataaattggtactggaggagtggggtgttgctataacaaatacctaaaaatgtagaagcaacttggaaacggataatgcatagaggctgg

SEQ ID NO: 46035 - DNA, 201 bp, Homo sapiens
caccgtgtcagccaggatggtctcgatctcctgacctcgtgatcctcctgcctcggcctcccaaagtgctgggattacaagcgtgagccacctcgcccagycataagtgtctgttctttacagattagtcagattcaagaattccgacatggttgcactaaacagactaagacataaattggtactggaggagtggggtgt

SEQ ID NO: 46036 - DNA, 201 bp, Homo sapiens
gacaactgcaactttgagaacgggcacatccaggtccatggcccgggtacttgccaagtgaagttctgtaccttcaaaaacacccatatcttcctgcacarcgtgcccctgtgtgtcctggaaaactgtgaatttgtgggcagtgaaaacaactctgtgactgttgagggtcacccatctgcagataagaactgggcctac

SEQ ID NO: 46037 - DNA, 201 bp, Homo sapiens
ctctctgggaaaagaacctaggaattccactcctaagtattgactcaagaaaaattaaaacgtgtccacaaaaacacttatataagaatattcacagcagyattatccataatagccccaaactgaaagtaattcaggtttccatcgaggagaattaattttttttaaactgtgatatattaacacttaatacaatgaaat

SEQ ID NO: 46038 - DNA, 201 bp, Homo sapiens
ttaagacaatgaaaaggcaaaccacagattgggagaaaatattcaaagaacatgtatctggcaaaggacatataaagaagtcctataattaaatatatatwaaaaaaaacaattaaaaacagacaaaaggaccaggcgcagtggctcacgcctgtaatcccagtgctttgggaggccaaggtgggtggatcacctgtggtc

SEQ ID NO: 46039 - DNA, 201 bp, Homo sapiens
atgcaaaaggcttagaaacaatgaccaagccagtagaaaaagcatgtctaatatccagattgtggttttgacatattccattaaagaatacagaacaggcyggatgcggtggctcacgcctgtaatcccagcactttgggaggacaagacggacagatcacctgatgtcaggagttcaaaaccagcctggccaacatggtg

SEQ ID NO: 46040 - DNA, 201 bp, Homo sapiens
aaaagggttcatttgagctgccagaggtactactgtcttgtgatgatggtcgggtcaattgtaagtaatcataaatcatcacttattggcatcattgcctraaagaacccatagcctgggaaaaatcagaatcctactctcatagtgcatggacacgtagacccagtattggaataatgtaggcaccctgtagctaagaat

SEQ ID NO: 46041 - DNA, 201 bp, Homo sapiens
ctcccaaagtgctgggattccaggcatgagccaccgtgcctggccaggatctctattatttcttataactgcatgtgaatctacaattttctcaatgaacrttttttaaagacaacttcttaaagaaagaagctgttatgctatctagccataccacatagcaaggaagctatcagagggtacaggggttgtgccaggagg

SEQ ID NO: 46042 - DNA, 201 bp, Homo sapiens
ctgaactgcatctaccccactcaggtcctggcagagctccttcctcatgagaatgactttgtgaggagaaaagcaacattcaaattaagaaaagaataatyagaggcagagccatccaaggcctccgaaggggtaaagaggtctggggtaaggctcagaagggatgtagagtgcaaggatatgaagttgtgagggaaagag

SEQ ID NO: 46043 - DNA, 201 bp, Homo sapiens
gggcaagaagagtgaaactccatctcaaaaaaataaaaaagggggactggtaagtaggatagacagaaatctcttttgttttgtgtctgtctcctaggtgmccatggaggctggtggcctccccttggagctgtggcgcatgatcttagcctacttgcaccttcccgacctgggccgctgcagcctggtatgcagggcctg

SEQ ID NO: 46044 - DNA, 201 bp, Homo sapiens
tcaagaaaaagtgagtgcttggggttgcctgaacgagtcctctagagccacagtaagctccctgaagaagccaggcccacacccagggattgtggctgccygggctccctgcaaccctgccagctgtcgactccagtcagaaaaaggcctgtgcctggctctatgtcaggcccgggctgaggactccccaggagggaacaa

SEQ ID NO: 46045 - DNA, 201 bp, Homo sapiens
gagcctgaagaggcagaggatcctgcccaaagtcctacacctagtgacagagctgggatttgaatccaggcagtctgactcacgggtaatgctgaacccaycatatcttaactgcccataaagatacagagagaaggctgggcacagtggcttatgcctgtaatctcagcactttgggaggccaaggcaggaagatcactt

SEQ ID NO: 46046 - DNA, 201 bp, Homo sapiens
gatcagtagagttcagaattctgctttattcttggtaaagcagtatttaaaaatggcttgggcttggaaccaaaattcttttgcacctcttccctttccarctggaccaactggagccaccagtctagcagcggcgggaaagccaggttctggaagcatgccacttggtgacaggaagcagagagcccattagctgctcat

SEQ ID NO: 46047 - DNA, 201 bp, Homo sapiens
agggctcttacagtgacgtcattttctccactgtgttcatcctgccgcggaggtgtgggcggcacctgggcactctgcttcgctgacgtgtctgatctggyttctgtggtgtctcattttcacttgcagtgtaaccagatccaccatggccttcgctctggcattgtcgtccttggcaatgggaaaggcatcatccggaac

SEQ ID NO: 46048 - DNA, 201 bp, Homo sapiens
cctgtgaggcttgtgtgcctcataatgttggaagagaaattttttcttttcctgtcaatactaaatagggttctgagcagcccttgatttttttttccacttttttttttttttttccgagacagagtctcactttgttgtccaagctgcagtgcagtggtgtgatctcagctcactgcaacctccacctcccaggttcaa

SEQ ID NO: 46049 - DNA, 201 bp, Homo sapiens
tggcattgtcgtccttggcaatgggaaaggcatcatccggaacaatcaaatcttttccaataaggaggctggcatttacatcctgtaccacggaaaccccrttgtgaggtgtgtgctgctgtttccctccttcatctttgttaacctcctccctgtctctcctccatttgaaaacactctttacggaaacaactgtacaga

SEQ ID NO: 46050 - DNA, 201 bp, Homo sapiens
gcctcataatgttggaagagaaattttttcttttcctgtcaatactaaatagggttctgagcagcccttgatttttttttccacttttttttttttttttycgagacagagtctcactttgttgtccaagctgcagtgcagtggtgtgatctcagctcactgcaacctccacctcccaggttcaagcgattctctgcctca

SEQ ID NO: 46051 - DNA, 201 bp, Homo sapiens
catgctgtggtcagggactgatataagtgataggtgggaggcagcagtggcagtcctgggaccctgtctgccatcccagctctagtatggggcagactgtrataaatgctgtcagagtggtaccagaaggagagactcattctgactaggaggatgtgggaaggcctcatttaggaggtagcatcagagtcagactttgga

SEQ ID NO: 46052 - DNA, 201 bp, Homo sapiens
caaaatgatctcctttgactgcatgtctcatatccaggttatgctgatgcaaaaggtgggctcccagccttgggcagctccacccctgtggctttgcaggrtacaacccacctcctggctgctttcacaggctggtgttgagtgtctgcagcttttccaggcacatgatgcaagctctcagtggatctgccattgtggggt

SEQ ID NO: 46053 - DNA, 201 bp, Homo sapiens
tggcagtcctgggaccctgtctgccatcccagctctagtatggggcagactgtgataaatgctgtcagagtggtaccagaaggagagactcattctgactrggaggatgtgggaaggcctcatttaggaggtagcatcagagtcagactttggaatatgggtaagacttggactcatggagataggggtagggaggggtcg

SEQ ID NO: 46054 - DNA, 201 bp, Homo sapiens
gaggaattttgttacatgtatactgagagacagatttcctaggagttgggaaatataacagactttttatgggcttgaaaaaataatagccaccattaatrcataatgcttattatacgccagatgcttttttaagcacttcatagatatttacttgtcatttaatgcttacagaaccctgtgaagaattattatcatccc

SEQ ID NO: 46055 - DNA, 201 bp, Homo sapiens
agttcgaggctgcagtgagctatgatcctgccactgtactccagcctgggcaacacagagagacctcacttctttaaaaaaaaaaaaaaaaaaaaagttgrttttgttttgttttgttttgtttttttgagacggagtcttgctctttcgcccaggctagagtgcagtggcacgatctcggctcactgcaagccccgcctc

SEQ ID NO: 46056 - DNA, 201 bp, Homo sapiens
catttaggaggtagcatcagagtcagactttggaatatgggtaagacttggactcatggagataggggtagggaggggtcggtggatgttcctagtaatgraacagcatgagcaaaggcagcagggcacagcagattcaggggttagcaaaccgttgacggtggcttgagaaaaaatctgacatggtgtgacagtgctata

SEQ ID NO: 46057 - DNA, 201 bp, Homo sapiens
ctgaggctgaactgcatctaccccactcaggtcctggcagagctccttcctcatgagaatgactttgtgaggagaaaagcaacattcaaattaagaaaagwataatcagaggcagagccatccaaggcctccgaaggggtaaagaggtctggggtaaggctcagaagggatgtagagtgcaaggatatgaagttgtgaggg

SEQ ID NO: 46058 - DNA, 201 bp, Homo sapiens
tttttgtactccaaaattacagaacttacattaagaagaaaatttccggccaggcatggtggctcacgcccgtaatcccagcactttgggaggccgaggcrggtggatcacgaggtcaggagatcgagaccatcctggctaacacggtgaaaccatgtctctactaaaaatacaaaaaattagccgggcgtggtggcgggt

SEQ ID NO: 46059 - DNA, 201 bp, Homo sapiens
aatcacttgaacctgggaggtggaggttgcagtgagccaagatcatgccactacactccagcctgagcaacagagcaagactctatctcaaaaaaaaaaaaaaaaaaaaaaaaaaaaaaacctgagacaacaaaaaaagaaaactgagaaataaaatgaaagcattaagctggctcttcctatatgtactgtgccactgga

SEQ ID NO: 46060 - DNA, 201 bp, Homo sapiens
ctcaggagtaacctcatctgctttggctattcagatggtgtggttgtgggagacgaaggcaaaggcctcatagaaggaaataccatctacggtgaggagcytgttcccaacccagccggggaggcaggaagcccaggttccatctccagcttgtgggtcctgagaaggtcactgcctttccctgtgcctcaaagacctcat

SEQ ID NO: 46061 - DNA, 201 bp, Homo sapiens
ctcatggagataggggtagggaggggtcggtggatgttcctagtaatggaacagcatgagcaaaggcagcagggcacagcagattcaggggttagcaaacygttgacggtggcttgagaaaaaatctgacatggtgtgacagtgctatagaatattttaaattgggatggtcccagaatatcttgggccctgtggtcactg

SEQ ID NO: 46062 - DNA, 201 bp, Homo sapiens
atcacttgaacctgggaggtggaggttgcagtgagccaagatcatgccactacactccagcctgagcaacagagcaagactctatctcaaaaaaaaaaaaaaaaaaaaaaaaaaaaaaacctgagacaacaaaaaaagaaaactgagaaataaaatgaaagcattaagctggctcttcctatatgtactgtgccactggat

SEQ ID NO: 46063 - DNA, 201 bp, Homo sapiens
tagtaacaataggaaactaatacaccaagctgaaaagtctgggctttaccttggggatgctggggaaccatgaaagagttttgggtgaggaatatcataaktagatcagtgttgggtttttaaaacatagtcatcttgagagaataggttgtgcttttttcctttgtttctttgcaatgagagataagagtctggagcagg

SEQ ID NO: 46064 - DNA, 201 bp, Homo sapiens
gcagtgagccaagatcatgccactacactccagcctgagcaacagagcaagactctatctcaaaaaaaaaaaaaaaaaaaaaaaaaaaaaaacctgagacracaaaaaaagaaaactgagaaataaaatgaaagcattaagctggctcttcctatatgtactgtgccactggataaccaaatagtggatgaatagaattat

SEQ ID NO: 46065 - DNA, 201 bp, Homo sapiens
ggttagtgtaggaaggagagcaaagcaaaaccctctaatgagtagatctgcctgtccagagggggagtgagcagccttgaggcggcagtgagcaccccgtyagggaggtgtaagtggcagtaggatggcggtggtgcaggaggcattcaagcacacggtgggagctcaggccagaggagccttctcacatggtgtttccct

SEQ ID NO: 46066 - DNA, 201 bp, Homo sapiens
gaactagtgagccccatgctgcagacaaggaaactgaggcttaaagaggtgaagtcatttgtccaagataacacttgcagtcaacccccggagcccatgctttttttttttttttttggacaccgagtcttgctctttcgcccaggctggagtgtactggcgcaatctcggctcactgcaacctctgcctcccaggctcaa

SEQ ID NO: 46067 - DNA, 201 bp, Homo sapiens
cctggcagagctccttcctcatgagaatgactttgtgaggagaaaagcaacattcaaattaagaaaagaataatcagaggcagagccatccaaggcctccraaggggtaaagaggtctggggtaaggctcagaagggatgtagagtgcaaggatatgaagttgtgagggaaagagtgagttacgtgagagttcaatataaa

SEQ ID NO: 46068 - DNA, 201 bp, Homo sapiens
tttttagtggagatgaggtttcaccatgttgacaaggctggtctcgaactcctgacctcaagtgatctgcccatcttggccttccaacgtgctggaactaygggcgtgagccaccacacctggcagagcccatgcttttaaccactgttcaatgcttcctggtaatggcagtataccttgtcccctctctttagagacata

SEQ ID NO: 46069 - DNA, 201 bp, Homo sapiens
ataaggaaaaaaatgaaaccaggacagctagaaaagtattatagatgagcccctctttatagggaaatagataagaaatgtagaaagataaatgtaaaccrtgtggggacatagtatgtaagctgttatgtgggagggagattatctgagctagctagaaatggactttgtgaacggtcaaggccagctagatgaaatgta

SEQ ID NO: 46070 - DNA, 201 bp, Homo sapiens
taaagtaaactaggctcgagttgagaagcagagatgcatttatgagggttggtggttgcaatttgggtctctcttattccaagtccctcctgagacttggwataccaaccattagcaatagatcccaggagaaccctaatggaaagtcctgcaaaagaccatatggaagcctctcacctggaaggtggtatagattaggtt

SEQ ID NO: 46071 - DNA, 201 bp, Homo sapiens
agctgaggtcacaccattgcactccagcctgggcaacaagagcgaaactccatctcaaaaaaaaaaaaaagattttctttcttcttgatctctataagctkcagtagtgcttaattccttctatctcacattgttattagctatgacagcaaatggttgctatcacctaatgggtgatacattaattattcacctaaaatt

SEQ ID NO: 46072 - DNA, 201 bp, Homo sapiens
gtggatgatcctgcataggcaatgaagtgctctagtcgagaagtaacgcacatctcttctactcaaaacccattggttagtactagtcttgtggccccatytgacctcaggagggatcagatgtacaatcttgtcatgtgcccagaaggaaagaaaactggaagcagttgatgaagagcattgattcccaatgtaatgtgc

SEQ ID NO: 46073 - DNA, 201 bp, Homo sapiens
tcttcatagcatttatgttaatatctttttcgtttattgtctgtctctgaaggtagggactttgcctcatttactgcttttcagttcttggaacaatgctyggcacataggcaatcaacgaatgtttgttgaataaatgatttttttctctggaaattgtcaaaatctgcatgaggtgtatcaggccagccattgtcagcc

SEQ ID NO: 46074 - DNA, 201 bp, Homo sapiens
ggtaagcggccggtgcgcagaggctgcgggcgaacttgggcggccgggggaggggacccggggcgcttccccaggcgaccgacccaggaggcgccgctcaktcctggccgaggctgagcgtctggtcgggcttcgggcatcaggggtctggcaggaccatgaggcgtaccctcaggccgcccgcggctccgcggtcccccg

SEQ ID NO: 46075 - DNA, 201 bp, Homo sapiens
gcgccaggcatagttctgggcatagtgcaaagcagtgatgcaaagtttctgcccttcaggagcttacattttactcaggggagacagacaataaatgaagraaaacatttaattccacagggaatttcctcctagaggtgcccaggctctgtcacctggcgctctgggtccacaggtgtgtttcccttttcccgtggttca

SEQ ID NO: 46076 - DNA, 201 bp, Homo sapiens
tccaaacttttatgctctgcttcctcttgaatgctttgtcatttagaagtttcttctgccagataccctgaatcatttctctcaagttcaaagttccacaratctctaggggagggacaaaatgctgtgagtctctttgcatagcaagagttacctttactccggttcctaagaagtggcttatctccatctgagaccacc

SEQ ID NO: 46077 - DNA, 201 bp, Homo sapiens
cgtgcaggcagatgctaggctgggtgggcagggatgcacaaggctctactccatccccagagagctcccaaatgcagaaggattcaaaccccatgtgagcrtgcccacaccagccgcccctcctgagcatcagcctgttcagatgagggtacctgggcctctcgttcgcatctgtgttctcatggatgagcgctggtcttt

SEQ ID NO: 46078 - DNA, 201 bp, Homo sapiens
acacacaccaaacccagactcttctcaggaaagagcagatttacttctgatggcgggaagtgattctagtgaggtggagagagacaactgctccagaattktcccctttgctagagctgtctccctctcaatccctccagggaccccaccacaccctcccagctgtctctggaggctggaggagttgagtttggttgactt

SEQ ID NO: 46079 - DNA, 201 bp, Homo sapiens
atttttgacacatattactcgcttagtaagtttttgtactccaaaattacagaacttacattaagaagaaaatttccggccaggcatggtggctcacgccygtaatcccagcactttgggaggccgaggcgggtggatcacgaggtcaggagatcgagaccatcctggctaacacggtgaaaccatgtctctactaaaaat

SEQ ID NO: 46080 - DNA, 201 bp, Homo sapiens
ggagagcaaagcaaaaccctctaatgagtagatctgcctgtccagagggggagtgagcagccttgaggcggcagtgagcaccccgttagggaggtgtaagyggcagtaggatggcggtggtgcaggaggcattcaagcacacggtgggagctcaggccagaggagccttctcacatggtgtttccctggctacactgaata

SEQ ID NO: 46081 - DNA, 201 bp, Homo sapiens
ttataaagggactttaggaaatgcttttatgcccctgtggacttgagccatagggaggctcaagtgatcctccaccccagcctcccaagaagctgggactrcaggtgcacaccaccacacccggctaatttttttgtattttttgtagagacagggtttccatgaaagaaggcagtctcctggaagcatgacattgatgcc

SEQ ID NO: 46082 - DNA, 201 bp, Homo sapiens
ggccctcacaaggtggctcacagaacagtttcagaagcactgatgcccaaccacctgtccaaatccctcctcttggtctttgtgcggacctctgcctgctytggaaacctccgcccggctaacccctgcttatcctttgggtcttagcttaactgtcacttcctcagggaagccttccctgacttccccattgtacacaga

SEQ ID NO: 46083 - DNA, 201 bp, Homo sapiens
gtatacaggccgtgttccaggagctacaagtgcagcagtgaacgaggctgtcagccactgacattttaggagaggaagcgaataaataaataaaagcctaygtatatgagcaaaaaacatcccatctgagggtgacaagtgctctatggataattaaggcaaaagagggactgggtaggcatttgggattgtgtggtcagg

SEQ ID NO: 46084 - DNA, 201 bp, Homo sapiens
cctgcgtcaggagggtgctgtctccagtctctcatctgcccccagttttctccatgaacacctagtgaaggccacagagaagtgaacaggtgcagctactcccagagtttctgcactcacactaattcacagctggtctttaacagtgcattgaaaatgttagctgagttcttactggcttgtatgacacatgcagccctg

SEQ ID NO: 46085 - DNA, 201 bp, Homo sapiens
tcagtcatctctagattacttataatacccaatacgatgcaaatgctatgtaaatagctcttctactgggtttttttgtttgttggttgtgttttttttgtttttttttttttgagacggagtctccactgtttagcccaggctggagtgcaaagatgtgatctcagctcactgcaacctctgcctcctgggttcaagcga

SEQ ID NO: 46086 - DNA, 201 bp, Homo sapiens
tcacactgtgtggaacgagccgagcttgtgaggttcacctgatcctgatgacctctcttgtgtgaaggtgaagtctgcagctagagccatcaggtggcttktccgaggtcattagcaaggcagggactctctcccaggccagtggcttttgtttcccctctcagggagactcaggtgccgcttcacctgagttcagtgtcg

SEQ ID NO: 46087 - DNA, 201 bp, Homo sapiens
ttgacgcacctggatttcctcctgctgtttcatcagcttggaagacgcaaactcaagggttgtttctgagtgttggtacctcttcttctccactccgttcycccggagtgcacaattcagggaaggcttttcctgactggtggtgtcagggctgaccctgggaccccctgtgctttccaacccttccacccatagcctcag

SEQ ID NO: 46088 - DNA, 201 bp, Homo sapiens
ctgggaggcggagcttgcagtaagccgagatcatgccactgcactccagcctgggcaacagagcaagaccctgtctcaaaaaaaaaaaaaaaaaaaaaaargaaccaatgtgagaccgctaaggagcctgcagggcaaagccaggtagggcctggagatggctgtgtcctgggagcacacagtgggagcgtggctgtgcca

SEQ ID NO: 46089 - DNA, 201 bp, Homo sapiens
cctgagttcagtgtcggtgaccagctcctctcactgtcccagctaacaagggctgtggtgtgtggatgatgtcgtccagcctcccccatgtcaccagcaaycacgtcagctacaatggcctgtatggagtggcagtatttagccagaaggatggctccagcgagttacctcgaggccacagggctcaagagaacttcagcg

SEQ ID NO: 46090 - DNA, 201 bp, Homo sapiens
catggctttggcttaggaaattattgcccctctggctagagagatgaggggtttgcccttctgaggacagagggatagcaggtggagggggaagggagtgrtatattttagtcctggcgttgtgaaagggtgtagggatggaaatgctgctgcatactccttttggagctcttcagccctgtgcgggacttctcttaggca

SEQ ID NO: 46091 - DNA, 201 bp, Homo sapiens
gcaggagaatcgcttgaacccgggaggcgaaggttgcagtgagccgagatcgtgccactgcactccagcctgggtgacaagagcgagactccatttcaatwaataaataaataaataaataaataaataaataaataaaatattttaaaaaataaataaataagagagcaggagatgtgaggacagaagcagaagtcagag

SEQ ID NO: 46092 - DNA, 201 bp, Homo sapiens
cctcctttgaactgggccctccccatccccactggcacttgttatgaggcctcgcgactgtatttatttctgtggctgtttcatcaacactgataggccaygaacttgagacaaagaactgaagcccacccagctcagtgcccctgtccctgcagtaccaaatcccacctctggcacacatgcttttaatcaactctagga

SEQ ID NO: 46093 - DNA, 201 bp, Homo sapiens
aaaaaaaaaaaaaaaaaaaaagaagaagaaggagtagagaaagaaaaattagttggatctggtggcatgtgcctgtggtcccagctactcaggaggcgggrggatcgcttgagcccaggagttcaaggctgcagtgaggtgtgattgcaccacggtattctaggtgctcagagctcaggagtgacaggagcaagaccctgt

SEQ ID NO: 46094 - DNA, 201 bp, Homo sapiens
tatagcccactgcagccctgacctccagggttcaagtgatcctcccacccagcctcccaagaagctgggactacaggcacgcaccaccacacctggctaatttttttttgtatttttttgtagagacaggatttccccattttgcccaggatggtctggaactcctgggctcaagtgatctacccgccttggcctcctaaa

SEQ ID NO: 46095 - DNA, 201 bp, Homo sapiens
taatgggaaaacaagataatcacaggaagaaaactcttctcactcacgcagtgactttgggcagagccttcatctgtctggactctatctctaataatacrgtgataataataaagatgactcaggcccacctctctactcagccctttctatgcatgatcacatttaatcctcatgactgccttctgaaggaggcacggt

SEQ ID NO: 46096 - DNA, 201 bp, Homo sapiens
gctttctcttttctgcttagatcatcatgctcaggaacgacatttaccgctgccgagcgtcaggcatctttcttcgcttggagggcggtggcttgattgcyggcaacaacatttaccacaatgcagaggctggtgtagacatccggaaaaagtccaacccactcatactggtactttgtgttcgttccctattcagggtga

SEQ ID NO: 46097 - DNA, 201 bp, Homo sapiens
atggcctccaagtccatccaaattgctgcaaaggctgttatttcattctgttttatggctgagtagtattctgtggtatatatataccaccttttttttgttttttttttttttgagatggagtttcactcttttgcccaggctggagtgcaatgacatgatctcagctcactgcaacctccgcctcccagattcaagcca

SEQ ID NO: 46098 - DNA, 201 bp, Homo sapiens
aggccgaggtgggtggatcacctgaggtcgggatttcgagaccagcctggccaacatggtgaaaccccatctctactaaaaatacaaaaattagctgggcrtcatggcacgcaactgtagtcccagctactcgggaggctgagccaggaggatcactcgaacctgggaggaagaggttgcagtgaacccagatcacactac

SEQ ID NO: 46099 - DNA, 201 bp, Homo sapiens
ggtgaaaccccatctctactaaaaatacaaaaattagctgggcatcatggcacgcaactgtagtcccagctactcgggaggctgagccaggaggatcactygaacctgggaggaagaggttgcagtgaacccagatcacactactgcactccagcctgggtaacagagcaagactccgtctcggaaaaaatatatatatat

SEQ ID NO: 46100 - DNA, 201 bp, Homo sapiens
tcaggtgttcctccagtggtttctaaaaaaatatttgtaacaggaaaataaatggctttctcttttctgcttagatcatcatgctcaggaacgacatttaycgctgccgagcgtcaggcatctttcttcgcttggagggcggtggcttgattgccggcaacaacatttaccacaatgcagaggctggtgtagacatccgga

SEQ ID NO: 46101 - DNA, 201 bp, Homo sapiens
gttgtggtagtgcatgcctgtaaccccagctacttgggaggctgaggcaggagaattgcttgaatctgggaggtggaggttatggtgaggccaagatcgcrccactgcactccagcctgggcaagaagagtgaaactccatctcaaaaaaataaaaaagggggactggtaagtaggatagacagaaatctcttttgttttg

SEQ ID NO: 46102 - DNA, 201 bp, Homo sapiens
atcacatccaataggccagtcattaaaccttaaaattccaaaatgatctcctgcaaattttccaaacttttatgctctgcttcctcttgaatgctttgtcrtttagaagtttcttctgccagataccctgaatcatttctctcaagttcaaagttccacaaatctctaggggagggacaaaatgctgtgagtctctttgca

SEQ ID NO: 46103 - DNA, 201 bp, Homo sapiens
acttgtgcaaatttctgcattgggcttgaatttctccccagaaaatggggttttcttttctatcacatccaataggccagtcattaaaccttaaaattccraaatgatctcctgcaaattttccaaacttttatgctctgcttcctcttgaatgctttgtcatttagaagtttcttctgccagataccctgaatcatttct

SEQ ID NO: 46104 - DNA, 201 bp, Homo sapiens
ctggcccaggcccatggaaccatttttccctcctaggccttgggcctgtgatgggaggggctgccttgaagttctctgacatgccctgcagacattttctrcattatcttggtgattaacattcctcattacttgtgcaaatttctgcattgggcttgaatttctccccagaaaatggggttttcttttctatcacatcca

SEQ ID NO: 46105 - DNA, 201 bp, Homo sapiens
cctggcccaggcccatggaaccatttttccctcctaggccttgggcctgtgatgggaggggctgccttgaagttctctgacatgccctgcagacattttcygcattatcttggtgattaacattcctcattacttgtgcaaatttctgcattgggcttgaatttctccccagaaaatggggttttcttttctatcacatcc

SEQ ID NO: 46106 - DNA, 201 bp, Homo sapiens
agagccctaccagcccagcttctagctccccaaagccaggctccaaggctggctcacaggaggcagaggtgggtagtgatggtgaaagggtggcccagacyccggacagcagcgatggaggcctgagtcccagcggtgaggatgaagatgaggaccagctgatgtacagactatcctaccaagtgcagggcccacgccctg

SEQ ID NO: 46107 - DNA, 201 bp, Homo sapiens
tagggtgcacatcagttccctggtgatgttgttaaaatgccaaatctgatccaggaggtacacggtggtgcccaatgtctgccacttctaacaagctcctrggtcctgggagcacattttgagttgtaaggcttgaagagatcttcagggaataggatgaaataatgcatgaaaagcacttaatattgtgcccctcaaata

SEQ ID NO: 46108 - DNA, 201 bp, Homo sapiens
catgattgtttttcaactaaaggagacatgggggcctgggatggctttgcctgaaaaatgcaaaggccaaggcgatttcacagcagttttcagtgacttcyaaggagaaccttagcagtggctctgcatctccagagagctggcttttttatctttagagagaaaatggatttaaatagcaaggaaaaattaggttagcca

SEQ ID NO: 46109 - DNA, 201 bp, Homo sapiens
tctgaatgtcccagtcctatgcaaatttcagagtccagttcagataccagctcctccatgaagcttggcttagtggttaaaaacaagagtctctggggacrggctgggcttcagtggttctgcacctctctaacgagtgattggggcaagccatttgtcacataagtttagtttcttgaactgaaaaatgaagacagtatt

SEQ ID NO: 46110 - DNA, 201 bp, Homo sapiens
acacaaccgcaagcgtcagttttcctttcccaaatttcaaacacatttttgacacatattactcgcttagtaagtttttgtactccaaaattacagaactwacattaagaagaaaatttccggccaggcatggtggctcacgcccgtaatcccagcactttgggaggccgaggcgggtggatcacgaggtcaggagatcga

SEQ ID NO: 46111 - DNA, 201 bp, Homo sapiens
agactcctggagctgcagccagactgaacctcccaacatgtcctaagcccagctgaaggttttctacctcaggagcttttgctgatgctgtttcctctgcyatagccccctttcttcctcctctgaatgtcccagtcctatgcaaatttcagagtccagttcagataccagctcctccatgaagcttggcttagtggttaa

SEQ ID NO: 46112 - DNA, 201 bp, Homo sapiens
cctgccccttcaaggacatgcaataaatttatgtgagaatcagtactaaaacctggatctggggacccccctgcaactccccttctgtctcctaagtaaamcaaaatgaacaggcagtgcattgaaaggagagagggtccttatggctccaagcccactcagaaagcaccatcagaacacagctttctggtttatgtcatc

SEQ ID NO: 46113 - DNA, 201 bp, Homo sapiens
tgagccaagatcacatcactgcactccaatctgggtgacaaagcaagaccttgtctcaaaaaaaaaaaagaaaaaaagaaaaaaaaaagacatgtaaaaarcacctggcatttagtaagccctcaaaacacccttgcctgccccttcaaggacatgcaataaatttatgtgagaatcagtactaaaacctggatctgggga

SEQ ID NO: 46114 - DNA, 201 bp, Homo sapiens
cctcccaaagtgctgggattataggcgtgagccaccatgtccggccatagtcctactttctagttgtctagagacttgggtttcagacttggaagttgctmtaggtcatctacttggccctttgttttttaagtgggaaaattgacactcataaatgagagaccttgaactaggtataaaaacaagtaaatgaagccagct

SEQ ID NO: 46115 - DNA, 201 bp, Homo sapiens
gtgtactggtgcaggaagggcagggcggcagtgtgacccattccctttgtcacgggctagggctcttacagtgacgtcattttctccactgtgttcatccygccgcggaggtgtgggcggcacctgggcactctgcttcgctgacgtgtctgatctggcttctgtggtgtctcattttcacttgcagtgtaaccagatcca

SEQ ID NO: 46116 - DNA, 201 bp, Homo sapiens
agctcacacctgtcgtcccagatacttgggaggcggaggtgggaggtgggaggatcacttgagtctgggaggtcatggctgccataactatggcatggtcrtgagccatgattgtgccactgcactccagcctgggcaacagagcgagaccctgtctcaaaaaaagaaaaagaaaatacacacagctagccagtgtctcct

SEQ ID NO: 46117 - DNA, 201 bp, Homo sapiens
agaccccatggaaaggctgccccagggatgacaagagggacatgctgaaacaggtggggctgcagcgtgcaggcagatgctaggctgggtgggcagggatrcacaaggctctactccatccccagagagctcccaaatgcagaaggattcaaaccccatgtgagcgtgcccacaccagccgcccctcctgagcatcagcct

SEQ ID NO: 46118 - DNA, 201 bp, Homo sapiens
ttcagggagaagggatagaagctggtgggtttccagtcactcgaagtctataaagattgtgaagagcgggggaagctcaaatgctgaagcttttggtcagsattttctctgagttctaaggaactgtgttttacacacaccaaacccagactcttctcaggaaagagcagatttacttctgatggcgggaagtgattctag

SEQ ID NO: 46119 - DNA, 201 bp, Homo sapiens
cccagatttaaacacctggatccaccgatctggaacccaagttaagactgtgcagggcattcagccagcactgcacacccctcagaagttcactgactttygttttgcacctccaggtctgatacgtggcgcctggtgaacccaccagcacggccccaccttgaaaattctctcagacgtccctcggcagcccacaatggg

SEQ ID NO: 46120 - DNA, 201 bp, Homo sapiens
ctcttctatccctggcactgtcctttgcacttgtttggtggccccaatgtgagtcgctgtaaaaaatgctgccgttactattttctaagaaatgacttttctgtgaaccaacagtaacaaaaacctcagtaaccaaaataaagttctatattttaaaaaaggcacttttggaagcctttccttagtctgggcatatactgg

SEQ ID NO: 46121 - DNA, 201 bp, Homo sapiens
agtagtgagcaagtaaggacataggatatttggttttccgtttctgagttacttctcttagaataatggcctccaagtccatccaaattgctgcaaaggcygttatttcattctgttttatggctgagtagtattctgtggtatatatataccaccttttttttgttttttttttttttgagatggagtttcactcttttg

SEQ ID NO: 46122 - DNA, 201 bp, Homo sapiens
gagtttcactcttttgcccaggctggagtgcaatgacatgatctcagctcactgcaacctccgcctcccagattcaagccattctcctgcctcagcctccyaagtagctgggattacaggcatgtgccgccatgcccagctaattttgtatttttagtagagataccatgttggtcaggctggtctcaaactcctgacctc

SEQ ID NO: 46123 - DNA, 201 bp, Homo sapiens
tttcgtctcagttgggttgccagtggccctgacttctgacactgcctcccctctctgccaggcctttgcatattgtttctccttcctgcaacagctctccstgttgtgcatctgataaatgcctacaactcacctatcacctcttccaggaagccttccctggctcccccaggctgttcttggtgcccttctttgagctca

SEQ ID NO: 46124 - DNA, 201 bp, Homo sapiens
gccggtgcgcagaggctgcgggcgaacttgggcggccgggggaggggacccggggcgcttccccaggcgaccgacccaggaggcgccgctcagtcctggcygaggctgagcgtctggtcgggcttcgggcatcaggggtctggcaggaccatgaggcgtaccctcaggccgcccgcggctccgcggtcccccggcatccgg

SEQ ID NO: 46125 - DNA, 201 bp, Homo sapiens
tgaagaaaccccccgatgtaggtatacctaattatttatttatttatttagagaccaagtctcactctgttgcccaggctgcagtgcagtggtgcgatctyggctcactgcaacctcttcctcccagattcaagcgatcctcctgcctcagcctcctgagcagctgggattacaggcgcccaccaccactcccggctgatt

SEQ ID NO: 46126 - DNA, 201 bp, Homo sapiens
cccgagtggccaacaacagcatctcctgcaaccggcaaagtggggtcaaggttgaggcccagtgcaaagtggagctccggggcaatggtatctatgacaasagaggccacggcattatcaccaagggcgacagcaccatcgtcattgaaaacgatatcattggcaaccggggcagcgggctgcagctgctgcccaggtccg

SEQ ID NO: 46127 - DNA, 201 bp, Homo sapiens
aggctgaggtgggaggatcacttgagcccaggaggttgaggctgcagtgagccatgatcgtgccactgcaccccagcctgggcaacagagtgtctcaaagygggaaaattgaggcctacagagggaccttgtccaaggctacatgcagagttgaaggcagagctggacgtggaatgcagggcttttgctccttagtttctc
